(12) United States Patent
Breton et al.

(10) Patent No.: US 6,610,836 B1
(45) Date of Patent: Aug. 26, 2003

(54) **NUCLEIC ACID AMINO ACID SEQUENCES RELATING TO *KLEBSIELLA* PNEUMONIAE FOR DIAGNOSTICS AND THERAPEUTICS**

(75) Inventors: Gary L. Breton, Marlborough, MA (US); Mark Osborne, Needham, MA (US)

(73) Assignee: Genome Therapeutics Corporation, Waltham, MA (US)

( * ) Notice: Subject to any disclaimer, the term of this patent is extended or adjusted under 35 U.S.C. 154(b) by 0 days.

(21) Appl. No.: 09/489,039

(22) Filed: Jan. 27, 2000

Related U.S. Application Data

(60) Provisional application No. 60/117,747, filed on Jan. 29, 1999.

(51) Int. Cl.⁷ .......................... C07H 21/04; C12Q 1/68; C12N 15/63; C12N 15/85
(52) U.S. Cl. ..................... 536/23.1; 536/24.1; 435/6; 435/320.1; 435/325
(58) Field of Search ................ 435/6, 320.1, 325, 435/252.3; 536/23.1, 24.1

(56) References Cited

U.S. PATENT DOCUMENTS

| | | | |
|---|---|---|---|
| 5,714,321 A | 2/1998 | Hogan | 435/6 |
| 5,763,188 A | 6/1998 | Ohno et al. | 435/6 |
| 5,827,651 A | 10/1998 | Hogan et al. | 435/6 |

FOREIGN PATENT DOCUMENTS

| | | |
|---|---|---|
| WO | WO98/42843 | 10/1998 |

OTHER PUBLICATIONS

Blattner et al., PIR ID No: pir2:C65176, Sep. 17, 1997.*

Burland et al., GenBank Acc. No L10328, Feb. 7, 1995.*

\* cited by examiner

*Primary Examiner*—Michael P. Woodward
*Assistant Examiner*—Shubo Zhou
(74) *Attorney, Agent, or Firm*—Genome Therapeutics Corporation

(57) ABSTRACT

The invention provides isolated polypeptide and nucleic acid sequences derived from *Klebsiella pneumoniae* that are useful in diagnosis and therapy of pathological conditions; antibodies against the polypeptides; and methods for the production of the polypeptides. The invention also provides methods for the detection, prevention and treatment of pathological conditions resulting from bacterial infection.

14 Claims, No Drawings

NUCLEIC ACID AMINO ACID SEQUENCES RELATING TO *KLEBSIELLA* PNEUMONIAE FOR DIAGNOSTICS AND THERAPEUTICS

RELATED APPLICATIONS

This application claims the benefit of U.S. Provisional Application Ser. No. 60/117,747, filed Jan. 29, 1999, the entire teachings of which are incorporated herein by reference.

BACKGROUND OF THE INVENTION

The genus Klebsiella belongs to the family Enterobacteriaceae and is divided into at least 4 species. They are gram-negative, capsulated, oxidase-negative, non-motile, straight rods. They are facultative anaerobes, having both a respiratory and fermnentative metabolism. Most strains can use citrate and glucose as their sole carbon source. Some strains can fix nitrogen. They are commonly found in the intestines, clinical samples, soil, water and grains. The species *Klebsiella pneumoniae* can be divided into 3 subspecies; *pneumoniae, ozaenae* and *rhinoscleromatis* (Orskov, I. 1984. Genus V. Klebsiella Trevisan 1885, 105. Krieg and Holt (editors) In Bergey's Manual of Systematic Bacteriology, 1:461–465). *Klebsiella pneumoniae* is the most common gram-negative pathogen causing community acquired pneumonia (Carpenter, J., et al, 1990. Rev Infect. Dis. 12:672–682). Klebsiella is also responsible for an estimated 8% of all nosocomial infections (Sahly, H. and Podschun, R., 1997. Clin. Diagn. Lab. Immunol. 4:393–399).

*K. pneumoniae* is an opportunistic pathogen that is associated with pneumonia, septicemia, meningitis, endocarditis, ventriculitis, and infections of urinary tract and wounds. These diseases are both nosocomial and community acquired. *K. pneumoniae* also plays a large role in two major nonrheumatoid arthritic diseases, Ankylosing Spondylitis and Reiter's Syndrome (Schwimmbeck, P. and Oldstone, M., 1989. Current Topics in Microbiology and Immunology. 145:45–56.). Despite available antibiotics, observed mortality rates for pneumonia are approximately 50%, but when bacteremic *K. pneumoniae* occurs in alcoholics, the mortality rises to almost 100% (Sahly, H. and Podschun, R., 1997. Clin. Diagn. Lab. Immunol. 4:393–399). The overall mortality rate for Klebsiella bacteremia in one study was 37% and has ranged in others from 25% to 55% (Watanakunakron, C. and Jura, J., 1991. Scand. J. Infect. Dis. 23:399–405).

Incidence of *K. pneumoniae* meningitis is on the rise. A study of 3377 cases of Bacterial meningitis in 1948, found only 7 were *K. pneumoniae*. In 1957, *K. pneumoniae* accounted for 1.5% of all cases of meningitis. In an eleven-year study, from 1981 to 1991, 13% of culture proven bacterial meningitis cases were *K. pneumoniae*. There was an increase occurrence of *K. pneumoniae* meningitis within this study with 7% occurrence in the first 6 years, and 16% occurrence in the last 5 years (Tang, L-M and Chen, S-T., 1994. Scand. J. Infect. Dis. 26:95–102).

In recent years, Klebsiella strains have become multi-resistant to many antibiotics. In the 1970's, the resistance was mainly to aminoglycoside antibiotics. Since 1982, some Klebsiella strains have become resistant to the extended-spectrum cephalosporins (Sahly, H. and Podschun, R., 1997. Clin. Diagn. Lab. Immunol. 4:393–399). Resistance to the extended-spectrum cephalosporins among clinical isolates of Klebsiella in France and England has been reported at 14 to 16% (Sirot, D. 1995 J. Antimicrob. Chemother. 36:19–34). Since Klebsiella is a good recipient for R factors, resistance has been gained to β-lactams, tetracycline, chloramphenicols, ceftazidime, sulfonamides and trimethoprim. Today, almost all strains of Klebsiella are resistant to ampicillin. (Orskov, I. 1984. Genus V. Klebsiella Trevisan 1885, 105. Krieg and Holt (editors) In Bergey's Manual of Systematic Bacteriology, 1:461–465).

Microbial fermentation is an important way to convert renewable resources to products of biological and industrial importance. *K. pneumoniae* has been used to convert simple sugars to the commodity chemicals 1,3-propanediol and 1,2-propanediol. These products have been made by fed-batch fermentation of glycerol by *K. pneumoniae*. (Cameron, D. et al, 1998. Biotechnol. Prog. 14:116–125). Genes from the 1,3-propanediol pathway of *K. pneumoniae* have recently been cloned and expressed into both *E. coli* and *S. cerevisiae*. Metabolic engineering of these genes can significantly improve the product yield and productivity (Cameron, D. et al, 1998. Biotechnol. Prog. 14:116–125).

With *K. pneumoniae* playing the lead role, the Klebsiella genus is becoming an increasingly important pathogen. Over the past 10 years, discovery of multi-drug resistant strains has emphasized the importance of this genus. Furthermore, Klebsiella is considered to be a model for systemic infections caused by capsulated bacteria.

SUMMARY OF THE INVENTION

The present invention fulfills the need for diagnostic tools and therapeutics by providing bacterial-specific compositions and methods for detecting Klebsiella species including *K. pneumoniae*, as well as compositions and methods useful for treating and preventing Klebsiella infection, in particular, *K. pneumoniae* infection, in vertebrates including mammals.

The present invention encompasses isolated nucleic acids and polypeptides derived from *K. pneumoniae* that are useful as reagents for diagnosis of bacterial disease, components of effective antibacterial vaccines, and/or as targets for antibacterial drugs including anti-*K. pneumoniae* drugs. They can also be used to detect the presence of *K. pneumoniae* and other Klebsiella species in a sample; and in screening compounds for the ability to interfere with the *K. pneumoniae* life cycle or to inhibit *K. pneumoniae* infection. They also have use as biocontrol agents for plants.

In one aspect, the invention features compositions of nucleic acids corresponding to entire coding sequences of *K. pneumoniae* proteins (SEQ ID NO: 1–SEQ ID NO: 7171), including surface or secreted proteins or parts thereof, nucleic acids capable of binding mRNA from *K. pneumoniae* proteins to block protein translation, and methods for producing *K. pneumoniae* proteins or parts thereof using peptide synthesis and recombinant DNA techniques. This invention also features antibodies and nucleic acids useful as probes to detect *K. pneumoniae* infection. In addition, vaccine compositions and methods for the protection or treatment of infection by *K. pneumoniae* are within the scope of this invention.

In another aspect, the invention relates to the nucliec acids corresponding to 2 naturally occurring plasmids of *K. pneumoniae*; one megaplasmid (SEQ ID NO: 3961–SEQ ID NO: 4368 and SEQ ID NO: 5441–SEQ ID NO: 5445) and the corresponding amino acid sequences (SEQ ID NO: 11132–SEQ ID NO: 11539 and SEQ ID NO: 12612–SEQ ID NO: 12616) and another plasmid (SEQ ID NO: 4637–SEQ ID NO: 4661) and the corresponding amino acid sequences (SEQ ID NO: 11808–SEQ ID NO: 11832).

The nucleotide sequences provided in SEQ ID NO: 1–SEQ ID NO: 7171, a fragment thereof, or a nucleotide sequence at least about 99.5% identical to a sequence contained within SEQ ID NO: 1–SEQ ID NO: 7171 may be "provided" in a variety of medias to facilitate use thereof. As used herein, "provided" refers to a manufacture, other than an isolated nucleic acid molecule, which contains a nucleotide sequence of the present invention, i.e., the nucleotide sequence provided in SEQ ID NO: 1–SEQ ID NO: 7171, a fragment thereof, or a nucleotide sequence at least about 99.5% identical to a sequence contained within SEQ ID NO: 1–SEQ ID NO: 7171. Uses for and methods for providing nucleotide sequences in a variety of media is well known in the art (see e.g., EPO Publication No. EP 0 756 006).

In one application of this embodiment, a nucleotide sequence of the present invention can be recorded on computer readable media. As used herein, "computer readable media" refers to any media which can be read and accessed directly by a computer. Such media include, but are not limited to: magnetic storage media, such as floppy discs, hard disc storage media, and magnetic tape; optical storage media such as CD-ROM; electrical storage media such as RAM and ROM; and hybrids of these categories such as magnetic/optical storage media. A person skilled in the art can readily appreciate how any of the presently known computer readable media can be used to create a manufacture comprising computer readable media having recorded thereon a nucleotide sequence of the present invention.

As used herein, "recorded" refers to a process for storing information on computer readable media. A person skilled in the art can readily adopt any of the presently known methods for recording information on computer readable media to generate manufactures comprising the nucleotide sequence information of the present invention.

A variety of data storage structures are available to a person skilled in the art for creating a computer readable media having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2, Sybase, Oracle, or the like. A person skilled in the art can readily adapt any number of data processor structuring formats (e.g. text file or database) in order to obtain computer readable media having recorded thereon the nucleotide sequence information of the present invention.

By providing the nucleotide sequence of SEQ ID NO: 1–SEQ ID NO: 7171, a fragment thereof, or a nucleotide sequence at least about 99.5% identical to SEQ ID NO: 1–SEQ ID NO: 7171 in computer readable form, a person skilled in the art can routinely access the coding sequence information for a variety of purposes. Computer software is publicly available which allows a person skilled in the art to access sequence information provided in a computer readable media. Examples of such computer software include programs of the (Genetics Computer Group, Madison, Wis.) and "NCBI Toolbox" (National Center For Biotechnology Information). Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

Computer algorithms enable the identification of *K. pneumoniae* open reading frames (ORFs) within SEQ ID NO: 1–SEQ ID NO: 7171 which contain homology to ORFs or proteins from other organisms. Examples of such similarity-search algorithms include the BLAST [Altschul et al., J. Mol. Biol. 215:403–410 (1990)] and Smith-Waterman [Smith and Waterman (1981) Advances in Applied Mathematics, 2:482–489] search algorithms. Suitable search algorithms are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997). Such algorithms are utilized on computer systems as exemplified below. The ORFs so identified represent protein encoding fragments within the *K. pneumoniae* genome and *K. pneumoniae* plasmids and are useful in producing commercially important proteins such as enzymes used in fermentation reactions and in the production of commercially useful metabolites.

The present invention further provides systems, particularly computer-based systems, which contain the sequence information described herein. Such systems are designed to identify commercially important fragments of the *K. pneumoniae* genome and plasmids. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A person skilled in the art can readily appreciate that any one of the currently available computer-based systems is suitable for use in the present invention. The computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the *K. pneumoniae* genome and plasmids which are similar to, or "match", a particular target sequence or target motif. A variety of known algorithms are known in the art and have been disclosed publicly, and a variety of commercially available software for conducting homology-based similarity searches are available and can be used in the computer-based systems of the present invention. Examples of such software includes, but is not limited to, FASTA (GCG Wisconsin Package), Bic_SW (Compugen Bioccelerator), BLASTN2, BLASTP2, BLASTX2 (NCBI) and Motifs (GCG). Suitable software programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology:*

*Tools for Genomic and Molecular Research*, American Society for Microbiology, Washington, D.C. (1997). A person skilled in the art can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A person skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that many genes are longer than 500 amino acids, or 1.5 kb in length, and that commercially important fragments of the *K. pneumoniae* genome and plasmids from *K. pneumoniae*, such as sequence fragments involved in gene expression and protein processing, will often be shorter than 30 nucleotides.

As used herein, "a target structural motif," or "target motif," refers to any rationally selected sequence or combination of sequences in which the sequence(s) are chosen based on a specific functional domain or three-dimensional configuration which is formed upon the folding of the target polypeptide. There are a variety of target motifs known in the art. Protein target motifs include, but are not limited to, enzymatic active sites, membrane-spanning regions, and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the *K. pneumoniae* genome and plasmids possessing varying degrees of homology to the target sequence or target motif. Such presentation provides a person skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the *K. pneumoniae* genome and plasmids. In the present examples, implementing software which implement the BLASTP2 and bic_SW algorithms (Altschul et al., J Mol. Biol. 215:403–410 (1990); Compugen Biocellerator) was used to identify open reading frames within the *K. pneumoniae* genome and plasmids. A person skilled in the art can readily recognize that any one of the publicly available homology search programs can be used as the search means for the computer-based systems of the present invention. Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology. Tools for Genomic and Molecular Research*, American Society for Microbiology, Washington, D.C. (1997).

The invention features *K. pneumoniae* polypeptides, preferably a substantially pure preparation of an *K. pneumoniae* polypeptide, or a recombinant *K. pneumoniae* polypeptide. In preferred embodiments: the polypeptide has biological activity; the polypeptide has an amino acid sequence at least about 60%, 70%, 80%, 90%, 95%, 98%, or 99% identical to an amino acid sequence of the invention contained in the Sequence Listing, preferably it has about 65% sequence identity with an amino acid sequence of the invention contained in the Sequence Listing, and most preferably it has about 92% to about 99% sequence identity with an amino acid sequence of the invention contained in the Sequence Listing; the polypeptide has an amino acid sequence essentially the same as an amino acid sequence of the invention contained in the Sequence Listing; the polypeptide is at least about 5, 10, 20, 50, 100, or 150 amino acid residues in length; the polypeptide includes at least about 5, preferably at least about 10, more preferably at least about 20, still more preferably at least about 50, 100, or 150 contiguous amino acid residues of the invention contained in the Sequence Listing. In yet another preferred embodiment, the amino acid sequence which differs in sequence identity by about 7% to about 8% from the *K. pneumoniae* amino acid sequences of the invention contained in the Sequence Listing is also encompassed by the invention.

In preferred embodiments: the *K. pneumoniae* polypeptide is encoded by a nucleic acid of the invention contained in the Sequence Listing, or by a nucleic acid having at least about 60%, 70%, 80%, 90%, 95%, 98%, or 99% homology with a nucleic acid of the invention contained in the Sequence Listing.

In a preferred embodiment, the subject *K. pneumoniae* polypeptide differs in amino acid sequence at about 1, 2, 3, 5, 10 or more residues from a sequence of the invention contained in the Sequence Listing. The differences, however, are such that the *K. pneumoniae* polypeptide exhibits an *K. pneumoniae* biological activity, e.g., the *K. pneumoniae* polypeptide retains a biological activity of a naturally occurring *K. pneumoniae* enzyme.

In preferred embodiments, the polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

In yet other preferred embodiments, the *K. pneumoniae* polypeptide is a recombinant fusion protein having a first *K. pneumoniae* polypeptide portion and a second polypeptide portion, e.g., a second polypeptide portion having an amino acid sequence unrelated to *K. pneumoniae*. The second polypeptide portion can be, e.g., any of glutathione-S-transferase, a DNA binding domain, or a polymerase activating domain. In preferred embodiment the fusion protein can be used in a two-hybrid assay.

Polypeptides of the invention include those which arise as a result of alternative transcription events, alternative RNA splicing events, and alternative translational and postranslational events.

In a preferred embodiment, the encoded *K. pneumoniae* polypeptide differs (e.g., by amino acid substitution, addition or deletion of at least one amino acid residue) in amino acid sequence at about 1, 2, 3, 5, 10 or more residues, from a sequence of the invention contained in the Sequence Listing. The differences, however, are such that: the *K. pneumoniae* encoded polypeptide exhibits an *K. pneumoniae* biological activity, e.g., the encoded *K. pneumoniae* enzyme retains a biological activity of a naturally occurring *K. pneumoniae.*

In preferred embodiments, the encoded polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

The *K. pneumoniae* strain, 93,19097, from which genomic sequences have been sequenced, has been deposited on Jan. 9, 1998, in the American Type Culture Collection and assigned the ATCC designation #202080.

Included in the invention are: allelic variations; natural mutants; induced mutants; proteins encoded by DNA that hybridize under high or low stringency conditions to a nucleic acid which encodes a polypeptide of the invention contained in the Sequence Listing (for definitions of high and low stringency see Current Protocols in Molecular Biology, John Wiley & Sons, New York, 1989, 6.3.1–6.3.6, hereby incorporated by reference); and, polypeptides specifically bound by antisera to *K. pneumoniae* polypeptides, especially by antisera to an active site or binding domain of *K. pneumoniae* polypeptide. The invention also includes fragments, preferably biologically active fragments. These and other polypeptides are also referred to herein as *K. pneumoniae* polypeptide analogs or variants.

The invention further provides nucleic acids, e.g., RNA or DNA, encoding a polypeptide of the invention. This includes double stranded nucleic acids as well as coding and antisense single strands.

In preferred embodiments, the subject *K. pneumoniae* nucleic acid will include a transcriptional regulatory sequence, e.g., at least one of a transcriptional promoter or transcriptional enhancer sequence, operably linked to the *K. pneumoniae* gene sequence, e.g., to render the *K. pneumoniae* gene sequence suitable for expression in a recombinant host cell.

In yet a further preferred embodiment, the nucleic acid which encodes an *K. pneumoniae* polypeptide of the invention, hybridizes under stringent conditions to a nucleic acid probe corresponding to at least about 8 consecutive nucleotides of the invention contained in the Sequence Listing; more preferably to at least about 12 consecutive nucleotides of the invention contained in the Sequence Listing; still more preferably to at least about 20 consecutive nucleotides of the invention contained in the Sequence Listing; most preferably to at least about 40 consecutive nucleotides of the invention contained in the Sequence Listing.

In another aspect, the invention provides a substantially pure nucleic acid having a nucleotide sequence which encodes an *K. pneumoniae* polypeptide. In preferred embodiments: the encoded polypeptide has biological activity; the encoded polypeptide has an amino acid sequence at least about 60%, 70%, 80%, 90%, 95%, 98% or 99% homologous to an amino acid sequence of the invention contained in the Sequence Listing; the encoded polypeptide has an amino acid sequence essentially the same as an amino acid sequence of the invention contained in the Sequence Listing; the encoded polypeptide is at least about 5, 10, 20, 50, 100, or 150 amino acids in length; the encoded polypeptide comprises at least about 5, preferably at least about 10, more preferably at least about 20, still more preferably at least about 50, 100, or 150 contiguous amino acids of the invention contained in the Sequence Listing.

In another aspect, the invention encompasses: a vector including a nucleic acid which encodes an *K. pneumoniae* polypeptide or an *K. pneumoniae* polypeptide variant as described herein; a host cell transfected with the vector; and a method of producing a recombinant *K. pneumoniae* polypeptide or *K. pneumoniae* polypeptide variant; including culturing the cell, e.g., in a cell culture medium, and isolating an *K. pneumoniae* or *K. pneumoniae* polypeptide variant, e.g., from the cell or from the cell culture medium.

One embodiment of the invention is directed to substantially isolated nucleic acids. Nucleic acids of the invention include sequences comprising at least about 8 nucleotides in length, more preferably at least about 12 nucleotides in length, even more preferably at least about 15–20 nucleotides in length, that correspond to a subsequence of any one of SEQ ID NO: 1–SEQ ID NO: 7171 or complements thereof. Alternatively, the nucleic acids comprise sequences contained within any ORF (open reading frame), including a complete protein-coding sequence, of which any of SEQ ID NO: 1–SEQ ID NO: 7171 forms apart. The invention encompasses sequence-conservative variants and function-conservative variants of these sequences. The nucleic acids may be DNA, RNA, DNA/RNA duplexes, protein-nucleic acid (PNA), or derivatives thereof.

In another aspect, the invention features a purified recombinant nucleic acid having at least about 50%, 60%, 70%, 80%, 90%, 95%, 98%, or 99% homology with a sequence of the invention contained in the Sequence Listing The invention also encompasses recombinant DNA (including DNA cloning and expression vectors) comprising these *K. pneumoniae*-derived sequences; host cells comprising such DNA, including flngal, bacterial, yeast, plant, insect, and mammalian host cells; and methods for producing expression products comprising RNA and polypeptides encoded by the *K. pneumoniae* sequences. These methods are carried out by incubating a host cell comprising an *K. pneumoniae*-derived nucleic acid sequence under conditions in which the sequence is expressed. The host cell may be native or recombinant. The polypeptides can be obtained by (a) harvesting the incubated cells to produce a cell fraction and a medium fraction; and (b) recovering the *K. pneumoniae* polypeptide from the cell fraction, the medium fraction, or both. The polypeptides can also be made by in vitro translation.

In another aspect, the invention features nucleic acids capable of binding mRNA of *K. pneumoniae*. Such nucleic acid is capable of acting as antisense nucleic acid to control the translation of mRNA of *K. pneumoniae*. A further aspect features a nucleic acid which is capable of binding specifically to an *K. pneumoniae* nucleic acid. These nucleic acids are also referred to herein as complements and have utility as probes and as capture reagents.

In another aspect, the invention features an expression system comprising an open reading frame corresponding to *K. pneumoniae* nucleic acid. The nucleic acid further comprises a control sequence compatible with an intended host. The expression system is useful for making polypeptides corresponding to *K. pneumoniae* nucleic acid.

In another aspect, the invention encompasses: a vector including a nucleic acid which encodes an *K. pneumoniae* polypeptide or an *K. pneumoniae* polypeptide variant as described herein; a host cell transfected with the vector; and a method of producing a recombinant *K. pneumoniae* polypeptide or *K. pneumoniae* polypeptide variant; including culturing the cell, e.g., in a cell culture medium, and isolating the *K. pneumoniae* or *K. pneumoniae* polypeptide variant, e.g., from the cell or from the cell culture medium.

In yet another embodiment of the invention encompasses reagents for detecting bacterial infection, including *K. pneumoniae* infection, which comprise at least one *K. pneumoniae*-derived nucleic acid defined by any one of SEQ ID NO: 1–SEQ ID NO: 7171, or sequence-conservative or function-conservative variants thereof. Alternatively, the diagnostic reagents comprise nucleotide sequences that are contained within any open reading frames (ORFs), including preferably complete protein-coding sequences, contained within any of SEQ ID NO: 1–SEQ ID NO: 7171, or polypeptide sequences contained within any of SEQ ID NO: 7172–SEQ ID NO: 14342, or polypeptides of which any of the above sequences forms a part, or antibodies directed against any of the above peptide sequences or function-conservative variants and/or fragments thereof.

The invention further provides antibodies, preferably monoclonal antibodies, which specifically bind to the polypeptides of the invention. Methods are also provided for producing antibodies in a host animal. The methods of the invention comprise immunizing an animal with at least one *K. pneumoniae*-derived immunogenic component, wherein the immunogenic component comprises one or more of the polypeptides encoded by any one of SEQ ID NO: 1–SEQ ID NO: 7171 or sequence-conservative or function-conservative variants thereof; or polypeptides that are contained within any ORFs, including complete protein-coding sequences, of which any of SEQ ID NO: 1–SEQ ID NO: 7171 forms a part; or polypeptide sequences contained within any of SEQ ID NO: 7172–SEQ ID NO: 14342; or polypeptides of which any of SEQ ID NO: 7172–SEQ ID NO: 14342 forms a part. Host animals include any warm blooded animal, including without limitation mammals and birds. Such antibodies have utility as reagents for immunoassays to evaluate the abundance and distribution of *K. pneumoniae*-specific antigens.

In yet another aspect, the invention provides diagnostic methods for detecting *K. pneumoniae* antigenic components or anti-*K. pneumoniae* antibodies in a sample. *K. pneumoniae* antigenic components may be detected by known processes, including but not limited to detection by a process comprising: (i) contacting a sample suspected to contain a bacterial antigenic component with a bacterial-specific antibody, under conditions in which a stable antigen-antibody complex can form between the antibody and bacterial antigenic components in the sample; and (ii) detecting any antigen-antibody complex formed in step (i), wherein detection of an antigen-antibody complex indicates the presence of at least one bacterial antigenic component in the sample. In different embodiments of this method, the antibodies used are directed against a sequence encoded by any of SEQ ID NO: 1–SEQ ID NO: 7171 or sequence-conservative or function-conservative variants thereof, or against a polypeptide sequence contained in any of SEQ ID NO: 7172–SEQ ID NO: 14342 or function-conservative variants thereof.

In yet another aspect, the invention provides a method for detecting antibacterial-specific antibodies in a sample, which comprises: (i) contacting a sample suspected to contain antibacterial-specific antibodies with an *K. pneumoniae* antigenic component, under conditions in which a stable antigen-antibody complex can form between the *K. pneumoniae* antigenic component and antibacterial antibodies in the sample; and (ii) detecting any antigen-antibody complex formed in step (i), wherein detection of an antigen-antibody complex indicates the presence of antibacterial antibodies in the sample. In different embodiments of this method, the antigenic component is encoded by a sequence contained in any of SEQ ID NO: 1–SEQ ID NO: 7171 or sequence-conservative and function-conservative variants thereof, or is a polypeptide sequence contained in any of SEQ ID NO: 7172–SEQ ID NO: 14342 or function-conservative variants thereof.

In another aspect, the invention features a method of generating vaccines for immunizing an individual against *K. pneumoniae*. The method includes: immunizing a subject with an *K. pneumoniae* polypeptide, e.g., a surface or secreted polypeptide, or a combination of such peptides or active portion(s) thereof, and a pharmaceutically acceptable carrier. Such vaccines have therapeutic and prophylactic utilities.

In another aspect, the invention features a method of evaluating a compound, e.g., a polypeptide, e.g., a fragment of a host cell polypeptide, for the ability to bind an *K. pneumoniae* polypeptide. The method includes contacting the compound to be evaluated with an *K. pneumoniae* polypeptide and determining if the compound binds or otherwise interacts with the *K. pneumoniae* polypeptide. Compounds which bind or otherwise interact with *K. pneumoniae* polypeptides are candidates as modulators, including activators and inhibitors, of the bacterial life cycle. These assays can be performed in vitro or in vivo.

In another aspect, the invention features a method of evaluating a compound, e.g., a polypeptide, e.g., a fragment of a host cell polypeptide, for the ability to bind an *K. pneumoniae* nucleic acid, e.g., DNA or RNA. The method includes contacting the compound to be evaluated with an *K. pneumoniae* nucleic acid and determining if the compound binds or otherwise interacts with the *K. pneumoniae* nucleic acid. Compounds which bind *K. pneumoniae* are candidates as modulators, including activators and inhibitors, of the bacterial life cycle. These assays can be performed in vitro or in vivo.

A particularly preferred embodiment of the invention is directed to a method of screening test compounds for anti-bacterial activity, which method comprises: selecting as a target a bacterial specific sequence, which sequence is essential to the viability of a bacterial species; contacting a test compound with said target sequence; and selecting those test compounds which bind to said target sequence as potential anti-bacterial candidates. In one embodiment, the target sequence selected is specific to a single species, or even a single strain, such as, for example, the strain *K. pneumoniae* 93,19097. In a second embodiment, the target sequence is common to at least two species of bacteria. In a third embodiment, the target sequence is common to a family of bacteria. The target sequence may be a nucleic acid sequence or a polypeptide sequence. Methods employing sequences common to more than one species of microorganism may be used to screen candidates for broad spectrum anti-bacterial activity.

The invention also provides methods for preventing or treating disease caused by certain bacteria, including *K. pneumoniae*, which are carried out by administering to an animal in need of such treatment, in particular a warm-blooded vertebrate, including but not limited to birds and mammals, a compound that specifically inhibits or interferes with the function of a bacterial polypeptide or nucleic acid. In a particularly preferred embodiment, the mammal to be treated is human.

DETAILED DESCRIPTION OF THE INVENTION

The sequences of the present invention include the specific nucleic acid and amino acid sequences set forth in the Sequence Listing that forms a part of the present specification, and which are designated SEQ ID NO: 1–SEQ ID NO: 14342. Use of the terms "SEQ ID NO: 1–SEQ ID NO: 7171", "SEQ ID NO: 7172–SEQ ID NO: 14342, "the sequences depicted in Table 2", etc., is intended, for convenience, to refer to each individual SEQ ID NO individually, and is not intended to refer to the genus of these sequences unless such reference would be indicated. In other words, it is a shorthand for listing all of these sequences individually. The invention encompasses each sequence individually, as well as any combination thereof.

Definitions

"Nucleic acid" or "polynucleotide" as used herein refers to purine- and pyrimidine-containing polymers of any length, either polyribonucleotides or polydeoxyribonucleotides or mixed polyribo-polydeoxyribo nucleotides. This includes single- and double-stranded molecules, i.e., DNA-DNA, DNA-RNA and RNA-RNA hybrids, as well as "protein nucleic acids" (PNA) formed by conjugating bases to an amino acid backbone. This also includes nucleic acids containing modified bases.

A nucleic acid or polypeptide sequence that is "derived from" a designated sequence refers to a sequence that corresponds to a region of the designated sequence. For nucleic acid sequences, this encompasses sequences that are homologous or complementary to the sequence, as well as "sequence-conservative variants", and "function-conservative variants." For polypeptide sequences, this encompasses "function-conservative variants." Sequence-conservative variants are those in which a change of one or more nucleotides in a given codon position results in no alteration in the amino acid encoded at that position. Function-conservative variants are those in which a given amino acid residue in a polypeptide has been changed without altering the overall conformation and function of the native polypeptide, including, but not limited to, replacement of an amino acid with one having similar physico-chemical properties (such as, for example, acidic, basic, hydrophobic, and the like). "Function-conservative" variants also include any polypeptides that have the ability to elicit antibodies specific to a designated polypeptide.

An "K. pneumoniae-derived" nucleic acid or polypeptide sequence may or may not be present in other bacterial species, and may or may not be present in all K. pneumoniae strains. This term is intended to refer to the source from which the sequence was originally isolated. Thus, an K. pneumoniae-derived polypeptide, as used herein, may be used, e.g., as a target to screen for a broad spectrum antibacterial agent, to search for homologous proteins in other species of bacteria or in eukaryotic organisms such as bacteria humans, etc.

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylarnide, which are used to purify it. Preferably, the polypeptide constitutes at least about 10, 20, 50 70, 80 or 95% dry weight of the purified preparation. Preferably, the preparation contains sufficient polypeptide to allow protein sequencing; at least about 1, 10, or preferably 100 mg of polypeptide.

A purified preparation of cells refers to, in the case of plant or animal cells, an in vitro preparation of cells and not an entire intact plant or animal. In the case of cultured cells or microbial cells, it consists of a preparation of at least about 10%, more preferably at least about 50%, of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally-occurring genome and plasmids of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes a recombinant DNA which is part of a hybrid gene encoding additional K. pneumoniae DNA sequence.

A "contig" as used herein is a nucleic acid representing a continuous stretch of genomic sequence of an organism.

An "open reading frame", also referred to herein as ORF, is a region of nucleic acid which encodes a polypeptide. This region may represent a portion of a coding sequence or a total sequence and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop code at the three prime terminus. A coding sequence can include but is not limited to messenger RNA, synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by a gene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitro-cellulose, glass, nylon membranes, beads, particles and the like. The specificity of hybridization is dependent on conditions such as the base pair composition of the nucleotides, and the temperature and salt concentration of the reaction. These conditions are readily discernable to one of ordinary skill in the art using routine experimentation.

"Homologous" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared ×100. For example, if 6 of 10 of the positions in two sequences are matched or homologous then the two sequences are 60% homologous. By way of example, the DNA sequences ATTGCC and TATGGC share 50% homology. Generally, a comparison is made when two sequences are aligned to give maximum homology.

Nucleic acids are hybridizable to each other when at least one strand of a nucleic acid can anneal to the other nucleic acid under defined stringency conditions. Stringency of hybridization is determined by: (a) the temperature at which hybridization and/or washing is performed; and (b) the ionic strength and polarity of the hybridization and washing solutions. Hybridization requires that the two nucleic acids contain complementary sequences; depending on the stringency of hybridization, however, mismatches may be tolerated. Typically, hybridization of two sequences at high stringency (such as, for example, in a solution of 0.5×SSC, at 65° C.) requires that the sequences be essentially completely homologous. Conditions of intermediate stringency (such as, for example, 2×SSC at 65 ° C.) and low stringency (such as, for example 2×SSC at 55° C.) require correspondingly less overall complementarity between the hybridizing sequences. (1×SSC is 0.15 M NaCl, 0.015 M Na citrate).

The terms peptides, proteins, and polypeptides are used interchangeably herein.

As used herein, the term "surface protein" refers to all surface accessible proteins, e.g. inner and outer membrane proteins, proteins adhering to the cell wall, and secreted proteins.

A polypeptide has K. pneumoniae biological activity if it has one, two or preferably more of the following properties: (1) if when expressed in the course of an K. pneumoniae infection, it can promote, or mediate the attachment of K. pneumoniae to a cell; (2) it has an enzymatic activity, structural or regulatory function characteristic of an K. pneumoniae protein; (3) the gene which encodes it can rescue a lethal mutation in an K. pneumoniae gene. A polypeptide has biological activity if it is an antagonist, agonist, or super-agonist of a polypeptide having one of the above-listed properties.

A biologically active fragment or analog is one having an in vivo or in vitro activity which is characteristic of the K. pneumoniae polypeptides of the invention contained in the Sequence Listing, or of other naturally occurring K. pneumoniae polypeptides, e.g., one or more of the biological activities described herein. Especially preferred are fragments which exist in vivo, e.g., fragments which arise from post transcriptional processing or which arise from translation of alternatively spliced RNA's. Fragments include those expressed in native or endogenous cells as well as those made in expression systems, e.g., in CHO (Chinese Hamster Ovary) cells. Because peptides such as K. pneumoniae polypeptides often exhibit a range of physiological properties and because such properties may be attributable to different portions of the molecule, a useful K. pneumoniae fragment or K. pneumoniae analog is one which exhibits a biological activity in any biological assay for K. pneumoniae activity. The fragment or analog possesses about 10%, preferably about 40%, more preferably about 60%, 70%, 80% or 90% or greater of the activity of K. pneumoniae, in any in vivo or in vitro assay.

Analogs can differ from naturally occurring K. pneumoniae polypeptides in amino acid sequence or in ways that do not involve sequence, or both. Non-sequence modifications include changes in acetylation, methylation, phosphorylation, carboxylation, or glycosylation. Preferred analogs include *K. pneumoniae* polypeptides (or biologically active fragments thereof) whose sequences differ from the wild-type sequence by one or more conservative amino acid substitutions or by one or more non-conservative amino acid substitutions, deletions, or insertions which do not substantially diminish the biological activity of the *K. pneumoniae* polypeptide. Conservative substitutions typically include the substitution of one amino acid for another with similar characteristics, e.g., substitutions within the following groups: valine, glycine; glycine, alanine; valine, isoleucine, leucine; aspartic acid, glutamic acid; asparagine, glutarnine; serine, threonine; lysine, arginine; and phenylalanine, tyrosine. Other conservative substitutions can be made in view of the table below.

TABLE 1

CONSERVATIVE AMINO ACID REPLACEMENTS

| For Amino Acid | Code | Replace with any of |
|---|---|---|
| Alanine | A | D-Ala, Gly, beta-Ala, L-Cys, D-Cys |
| Arginine | R | D-Arg, Lys, D-Lys, homo-Arg, D-homo-Arg, Met, Ile, D-Met, D-Ile, Orn, D-Orn |
| Asparagine | N | D-Asn, Asp, D-Asp, Glu, D-Glu, Gln, D-Gln |
| Aspartic Acid | D | D-Asp, D-Asn, Asn, Glu, D-Glu, Gln, D-Gln |
| Cysteine | C | D-Cys, S-Me—Cys, Met, D-Met, Thr, D-Thr |
| Glutamine | Q | D-Gln, Asn, D-Asn, Glu, D-Glu, Asp, D-Asp |
| Glutamic Acid | E | D-Glu, D-Asp, Asp, Asn, D-Asn, Gln, D-Gln |
| Glycine | G | Ala, D-Ala, Pro, D-Pro, β-Ala, Acp |
| Isoleucine | I | D-Ile, Val, D-Val, Leu, D-Leu, Met, D-Met |
| Leucine | L | D-Leu, Val, D-Val, Leu, D-Leu, Met, D-Met |
| Lysine | K | D-Lys, Arg, D-Arg, homo-Arg, D-homo-Arg, Met, D-Met, Ile, D-Ile, Orn, D-Orn |
| Methionine | M | D-Met, S-Me—Cys, Ile, D-Ile, Leu, D-Leu, Val, D-Val |
| Phenylalanine | F | D-Phe, Tyr, D-Thr, L-Dopa, His, D-His, Trp, D-Trp, Trans-3,4, or 5-phenylproline, cis-3,4, or 5- |
| Proline | P | D-Pro, L-I-thioazolidine-4-carboxylic acid, D- or L-1- |
| Serine | S | D-Ser, Thr, D-Thr, allo-Thr, Met, D-Met, Met(O), |
| Threonine | T | D-Thr, Ser, D-Ser, allo-Thr, Met, D-Met, Met(O), |
| Tyrosine | Y | D-Tyr, Phe, D-Phe, L-Dopa, His, D-His |
| Valine | V | D-Val, Leu, D-Leu, Ile, D-Ile, Met, D-Met |

Other analogs within the invention are those with modifications which increase peptide stability; such analogs may contain, for example, one or more non-peptide bonds (which replace the peptide bonds) in the peptide sequence. Also included are: analogs that include residues other than naturally occurring L-amino acids, e.g., D-amino acids or non-naturally occurring or synthetic amino acids, e.g., β or γ amino acids; and cyclic analogs.

As used herein, the term "fragment", as applied to an *K. pneumoniae* analog, will ordinarily be at least about 20 residues, more typically at least about 40 residues, preferably at least about 60 residues in length. Fragments of *K. pneumoniae* polypeptides can be generated by methods known to those skilled in the art. The ability of an Klebsiella fragment to exhibit a biological activity of *K. pneumoniae* polypeptide can be assessed by methods known to those skilled in the art as described herein. Also included are *K. pneumoniae* polypeptides containing residues that are not required for biological activity of the peptide or that result from alternative mRNA splicing or alternative protein processing events.

An "immunogenic component" as used herein is a moiety, such as an *K. pneumoniae* polypeptide, analog or fragment thereof, that is capable of eliciting a humoral and/or cellular immune response in a host animal.

An "antigenic component" as used herein is a moiety, such as an K. pneumoniae polypeptide, analog or fragment thereof, that is capable of binding to a specific antibody with sufficiently high affinity to form a detectable antigen-antibody complex.

The term "antibody" as used herein is intended to include fragments thereof which are specifically reactive with K. pneumoniae polypeptides.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

Misexpression, as used herein, refers to a non-wild type pattern of gene expression. It includes: expression at non-wild type levels, i.e., over or under expression; a pattern of expression that differs from wild type in terms of the time or stage at which the gene is expressed, e.g., increased or decreased expression (as compared with wild type) at a predetermnined developmental period or stage; a pattern of expression that differs from wild type in terms of increased expression (as compared with wild type) in a predetermined cell type or tissue type; a pattern of expression that differs from wild type in terms of the splicing size, amino acid sequence, post-translational modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

As used herein, "host cells" and other such terms denoting microorganisms or higher eukaryotic cell lines cultured as unicellular entities refers to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

As used herein, the term "operably linked" refers to sequences joined or ligated to function in their intended manner. For example, a control sequence is operably linked to coding sequence by ligation in such a way that expression of the coding sequence is achieved under conditions compatible with the control sequence and host cell.

The "metabolism" of a substance, as used herein, means any aspect of the expression, function, action, or regulation of the substance. The metabolism of a substance includes modifications, e.g., covalent or non-covalent modifications of the substance. The metabolism of a substance includes modifications, e.g., covalent or non-covalent modification, the substance induces in other substances. The metabolism of a substance also includes changes in the distribution of the substance. The metabolism of a substance includes changes the substance induces in the distribution of other substances.

A "sample" as used herein refers to a biological sample, such as, for example, tissue or fluid isloated from an individual (including without limitation plasma, serum, cerebrospinal fluid, lymph, tears, saliva and tissue sections) or from in vitro cell culture constituents, as well as samples from the environment.

Technical and scientific terms used herein have the meanings commonly understood by one of ordinary skill in the art to which the present invention pertains, unless otherwise defined. Reference is made herein to various methodologies known to those of skill in the art. Publications and other materials setting forth such known methodologies to which reference is made are incorporated herein by reference in their entireties as though set forth in full. The practice of the invention will employ, unless otherwise indicated, conventional techniques of chemistry, molecular biology, microbiology, recombinant DNA, and immunology, which are within the skill of the art. Such techniques are explained fully in the literature. See e.g., Sambrook, Fritsch, and Maniatis, *Molecular Cloning; Laboratory Manual* 2nd ed. (1989); *DNA Cloning*, Volumes I and II (D. N. Glover ed. 1985); *Oligonucleotide Synthesis* (M. J. Gait ed, 1984); *Nucleic Acid Hybridization* (B. D. Hames & S. J. Higgins eds. 1984); the series, Methods in Enzymoloqy (Academic Press, Inc.), particularly Vol. 154 and Vol. 155 (Wu and Grossman, eds.); *PCR-A Practical Approach* (McPherson, Quirke, and Taylor, eds., 1991); *Immunology*, 2d Edition, 1989, Roitt et al., C. V. Mosby Company, and New York; *Advanced Immunology*, 2d Edition, 1991, Male et al., Grower Medical Publishing, New York.; *DNA Cloning: A Practical Approach*, Volumes I and II, 1985 (D. N. Glover ed.); *Oligonucleotide Synthesis*, 1984, (M. L. Gait ed); *Transcription and Translation*, 1984 (Hames and Higgins eds.); *Animal Cell Culture*, 1986 (R. I. Freshney ed.); *Immobilized Cells and Enzymes*, 1986 (IRL Press); Perbal, 1984, *A Practical Guide to Molecular Cloning; Gene Transfer Vectors for Mammalian Cells*, 1987 (J. H. Miller and M. P. Calos eds., Cold Spring Harbor Laboratory); Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

Any suitable materials and/or methods known to those of skill can be utilized in carrying out the present invention; however, preferred materials and/or methods are described. Materials, reagents and the like to which reference is made in the following description and examples are obtainable from commercial sources, unless otherwise noted.

K. pneumoniae Genomic Sequence

This invention provides nucleotide sequences of the genome of K. pneumoniae which thus comprises a DNA sequence library of K. pneumoniae genomic DNA. The detailed description that follows provides nucleotide sequences of K. pneumoniae, and also describes how the sequences were obtained and how ORFs and protein-coding sequences were identified. Also described are compositions and methods of using the disclosed *K. pneumoniae* sequences in methods including diagnostic and therapeutic applications. Furthermore, the library can be used as a database for identification and comparison of medically important sequences in this and other strains of *K. pneumoniae*.

To determine the genomic sequence of *K. pneumoniae*, DNA from strain 93,19097 of *K. pneumoniae* was isolated and a library of DNA fragments were transformed into DH5 cells. DNA sequencing was achieved using established ABI sequencing methods on ABI377 automated DNA sequencers. The cloning and sequencing procedures are described in more detail in the Exemplification.

Individual sequence reads were assembled using PHRAP (P. Green, Abstracts of DOE Human Genome Program Contractor-Grantee Workshop V, January 1996, p.157). The average contig length was about 3–4 kb.

All subsequent steps were based on sequencing by ABI377 automated DNA sequencing methods. The cloning and sequencing procedures are described in more detail in the Exemplification.

A variety of approaches may be used to order the contigs so as to obtain a continuous sequence representing the entire *K. pneumoniae* genome. Synthetic oligonucleotides are designed that are complementary to sequences at the end of each contig. These oligonucleotides may be hybridized to libaries of *K. pneumoniae* genomic DNA in, for example, lambda phage vectors or plasmid vectors to identify clones that contain sequences corresponding to the junctional regions between individual contigs. Such clones are then used to isolate template DNA and the same oligonucleotides are used as primers in polymerase chain reaction (PCR) to amplify junctional fragments, the nucleotide sequence of which is then determined.

The *K. pneumoniae* sequences were analyzed for the presence of open reading frames (ORFs) comprising at least 180 nucleotides. As a result of the analysis of ORFs based on stop-to-stop codon reads, it should be understood that these ORFs may not correspond to the ORF of a naturally-occurring *K. pneumoniae* polypeptide. These ORFs may contain start codons which indicate the initiation of protein synthesis of a naturally-occurring *K. pneumoniae* polypeptide. Such start codons within the ORFs provided herein were identified by those of ordinary skill in the relevant art, and the resulting ORF and the encoded *K. pneumoniae* polypeptide is within the scope of this invention. For example, within the ORFs a codon such as AUG or GUG (encoding methionine or valine) which is part of the initiation signal for protein synthesis were identified and the portion of an ORF to corresponding to a naturally-occurring *K. pneumoniae* polypeptide was recognized. The predicted coding regions were defined by evaluating the coding potential of such sequences with the program GENEMARK™ (Borodovsky and McIninch, 1993, *Comp.*, 17:123).

Each predicted ORF amino acid sequence was compared with all sequences found in current GENBANK, SWISS-PROT, and PIR databases using the BLAST algorithm. BLAST identifies local alignments occurring by chance between the ORF sequence and the sequence in the databank (Altschal et al., 1990, L Mol. Biol. 215:403–410). Homologous ORFs (probabilities less than $10^{-5}$ by chance) and ORF's that are probably non-homologous (probabilities greater than $10^{-5}$ by chance) but have good codon usage were identified. Both homologous, sequences and non-homologous sequences with good codon usage, are likely to encode proteins and are encompassed by the invention.

*K. pneumoniae* Plasmid Sequences

This invention also provides nucleotide sequences of two naturally occurs plasmids which thus comprises a DNA sequence library of *K. pneumoniae* plasmid DNA. One megaplasmid disclosed is contained within SEQ ID NO: 3961–SEQ ID NO: 4368 and SEQ ID NO: 5441–SEQ ID NO: 5445. The other plasmid is contained within SEQ ID NO: 4637–SEQ ID NO: 4661. The detailed description that follows provides nucleotide sequences of *K. pneumoniae*, and also describes how the sequences were obtained and how ORFs and protein-coding sequences were identified. Also described are compositions and methods of using the disclosed *K. pneumoniae* sequences in methods including diagnostic and therapeutic applications. The plasmid sequences can also be used as vectors and gene expression. Furthermore, the plasmid library can be used as a database for identification and comparison of medically important sequences in this and other strains of *K. pneumoniae*.

Similar methods were used to determine to plasmid sequences of *K. pneumoniaeas* described above in deterinirng the genomic sequence. A more detailed description of the methods are in the Exemplification.

*K. pneumoniae* Nucleic Acids

The present invention provides a library of *K. pneumoniae*-derived nucleic acid sequences. The libraries provide probes, primers, and markers which are used as markers in epidemiological studies. The present invention also provides a library of *K. pneumoniae*-derived nucleic acid sequences which comprise or encode targets for therapeutic drugs.

The nucleic acids of this invention may be obtained directly from the DNA of the above referenced *K. pneumoniae* strain by using the polymerase chain reaction (PCR). See "*PCR, A Practical Approach*" (McPherson, Quirke, and Taylor, eds., IRL Press, Oxford, UK, 1991) for details about the PCR. High fidelity PCR is used to ensure a faithful DNA copy prior to expression. In addition, the authenticity of amplified products is verified by conventional sequencing methods. Clones carrying the desired sequences described in this invention may also be obtained by screening the libraries by means of the PCR or by hybridization of synthetic oligonucleotide probes to filter lifts of the library colonies or plaques as known in the art (see, e.g., Sambrook et al., *Molecular Cloning, A Laboratory Manual* 2nd edition, 1989, Cold Spring Harbor Press, New York).

It is also possible to obtain nucleic acids encoding *K. pneumoniae* polypeptides from a cDNA library in accordance with protocols herein described. A cDNA encoding an *K. pneumoniae* polypeptide can be obtained by isolating total mRNA from an appropriate strain. Double stranded cDNAs can then be prepared from the total mRNA. Subsequently, the cDNAs can be inserted into a suitable plasmid or viral (e.g., bacteriophage) vector using any one of a number of known techniques. Genes encoding *K. pneumoniae* polypeptides can also be cloned using established polymerase chain reaction techniques in accordance with the nucleotide sequence information provided by the invention. The nucleic acids of the invention can be DNA or RNA. Preferred nucleic acids of the invention are contained in the Sequence Listing.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

In another example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Nucleic acids isolated or synthesized in accordance with features of the present invention are useful, by way of example, without limitation, as probes, primers, capture ligands, antisense genes and for developing expression systems for the synthesis of proteins and peptides corresponding to such sequences. As probes, primers, capture ligands and antisense agents, the nucleic acid normally consists of all or part (approximately twenty or more nucleotides for specificity as well as the ability to form stable hybridization products) of the nucleic acids of the invention contained in the Sequence Listing. These uses are described in further detail below.

Probes

A nucleic acid isolated or synthesized in accordance with the sequence of the invention contained in the Sequence Listing can be used as a probe to specifically detect *K. pneumoniae*. With the sequence informnation set forth in the present application, sequences of twenty or more nucleotides are identified which provide the desired inclusivity and exclusivity with respect to *K. pneumoniae*, and extraneous nucleic acids likely to be encountered during hybridization conditions. More preferably, the sequence will comprise at least about twenty to thirty nucleotides to convey stability to the hybridization product formed between the probe and the intended target molecules.

Sequences larger than 1000 nucleotides in length are difficult to synthesize but can be generated by recombinant DNA techniques. Individuals skilled in the art will readily recognize that the nucleic acids, for use as probes, can be provided with a label to facilitate detection of a hybridization product.

Nucleic acid isolated and synthesized in accordance with the sequence of the invention contained in the Sequence Listing can also be useful as probes to detect homologous regions (especially homologous genes) of other Klebsiella species using appropriate stringency hybridization conditions as described herein.

Capture Ligand

For use as a capture ligand, the nucleic acid selected in the manner described above with respect to probes, can be readily associated with a support. The manner in which nucleic acid is associated with supports is well known. Nucleic acid having twenty or more nucleotides in a sequence of the invention contained in the Sequence Listing have utility to separate *K. pneumoniae* nucleic acid from one strain from the nucleic acid of other another strain as well as from other organisms. Nucleic acid having twenty or more nucleotides in a sequence of the invention contained in the Sequence Listing can also have utility to separate other Klebsiella species from each other and from other organisms. Preferably, the sequence will comprise at least about twenty nucleotides to convey stability to the hybridization product formed between the probe and the intended target molecules. Sequences larger than 1000 nucleotides in length are difficult to synthesize but can be generated by recombinant DNA techniques.

Primers

Nucleic acid isolated or synthesized in accordance with the sequences described herein have utility as primers for the amplification of *K. pneumoniae* nucleic acid. These nucleic acids may also have utility as primers for the amplification of nucleic acids in other Klebsiella species. With respect to polymerase chain reaction (PCR) techniques, nucleic acid sequences of $\geq$10–15 nucleotides of the invention contained in the Sequence Listing have utility in conjunction with suitable enzymes and reagents to create copies of *K. pneumoniae* nucleic acid. More preferably, the sequence will comprise twenty or more nucleotides to convey stability to the hybridization product formed between the primer and the intended target molecules. Binding conditions of primers greater than 100 nucleotides are more difficult to control to obtain specificity. High fidelity PCR can be used to ensure a faithful DNA copy prior to expression. In addition, amplified products can be checked by conventional sequencing methods.

The copies can be used in diagnostic assays to detect specific sequences, including genes from *K. pneumoniae* and/or other Klebsiella species. The copies can also be incorporated into cloning and expression vectors to generate polypeptides corresponding to the nucleic acid synthesized by PCR, as is described in greater detail herein.

The nucleic acids of the present invention find use as templates for the recombinant production of *K. pneumoniae*-derived peptides or polypeptides.

Antisense

Nucleic acid or nucleic acid-hybridizing derivatives isolated or synthesized in accordance with the sequences described herein have utility as antisense agents to prevent the expression of *K. pneumoniae* genes. These sequences also have utility as antisense agents to prevent expression of genes of other Klebsiella species.

In one embodiment, nucleic acid or derivatives corresponding to *K. pneumoniae* nucleic acids is loaded into a suitable carrier such as a liposome or bacteriophage for introduction into bacterial cells. For example, a nucleic acid having twenty or more nucleotides is capable of binding to bacteria nucleic acid or bacteria messenger RNA. Preferably, the antisense nucleic acid is comprised of 20 or more nucleotides to provide necessary stability of a hybridization product of non-naturally occurring nucleic acid and bacterial nucleic acid and/or bacterial messenger RNA. Nucleic acid having a sequence greater than 1000 nucleotides in length is difficult to synthesize but can be generated by recombinant DNA techniques. Methods for loading antisense nucleic acid in liposomes is known in the art as exemplified by U.S. Pat. No. 4,241,046 issued Dec. 23, 1980 to Papahadjopoulos et al.

The present invention encompasses isolated polypeptides and nucleic acids derived from *K. pneumoniae* that are useful as reagents for diagnosis of bacterial infection, components of effective anti-bacterial vaccines, and/or as targets for anti-bacterial drugs, including anti-*K. pneumoniae* drugs.

Expression of *K. pneumoniae* Nucleic Acids

Table 2, which is appended herewith and which forms part of the present specification, provides a list of open reading frames (ORFs) in both strands and a putative identification of the particular function of a polypeptide which is encoded by each ORF, based on the homology match (determined by the BLASTP2 algorithm) of the predicted polypeptide with known proteins encoded by ORFs in other organisms. An ORF is a region of nucleic acid which encodes a polypeptide. This region may represent a portion of a coding sequence or a total sequence and was determined from stop to stop codons. The first column contains a designation for the ORF ("ORF Name"). The second and third columns list the SEQ ID numbers for the nucleic acid ("NT ID") and amino acid ("AA ID") sequences corresponding to each ORF, respectively. The fourth and fifth columns list the length of the nucleic acid ORF ("NT LN") and the length of the amino acid ORF ("AA LN"), respectively. The nucleotide sequence corresponding to each ORF begins at the first nucleotide immediately following a stop codon and ends at the nucleotide immediately preceding the next downstream stop codon in the same reading frame. It will be recognized by one skilled in the art that the natural translation initiation sites will correspond to ATG, GTG, or TTG codons located within the ORFs. The natural initiation sites depend not only on the sequence of a start codon but also on the context of the DNA sequence adjacent to the start codon. Usually, a recognizable ribosome binding site is found within 20 nucleotides upstream from the initiation codon. In some cases where genes are translationally coupled and coordinately expressed together in "operons", ribosome binding sites are not present, but the initiation codon of a downstream gene may occur very close to, or overlap, the stop codon of the an upstream gene in the same operon. The correct start codons can be generally identified without undue experimentation because only a few codons need be tested. It is recognized that the translational machinery in bacteria initiates all polypeptide chains with the amino acid methionine, regardless of the sequence of the start codon. In some cases, polypeptides are post-translationally modified, resulting in an N-terminal amino acid other than methionine in vivo. The sixth and seventh columns provide metrics for assessing the likelihood of the homology match (determined by the BLASTP2 algorithm), as is known in the art, to the genes indicated in the description frame ("Desciption") below the ORF Name. These genes in the Description were identified when the designated ORF was compared against a comprehensive non-redundant protein database. Specifically, the sixth column represents the Blast Score ("Score") for the match (a higher score is a better match), and the seventh column represents the probability ("P-value") for the match (the probability that such a match can have occurred by chance; the lower the value, the more likely the match is valid). If a BLASTP2 score of less than 100 was obtained, no value is reported in the table. The Description provides, where available, the Swissprot accession number (SP), the locus name (LN), the Organism (OR), Source of variant (SR), E.C. number (EC), the gene name (GN), the product name (PN), the Function Description (FN), Left End (LE), Right End (RE), Coding Direction (DI), and the description (DE) or notes (NT) for each ORF. This information allows one of ordinary skill in the art to determine a potential use for each identified coding sequence and, as a result, allows to use the polypeptides of the present invention for commercial and industrial purposes.

Using the information provided in SEQ ID NO: 1–SEQ ID NO: 7171, SEQ ID NO: 7172–SEQ ID NO: 14342 and in Table 2 together with routine cloning and sequencing methods, one of ordinary skill in the art will be able to clone and sequence all the nucleic acid fragments of interest including open reading frames (ORFs) encoding a large variety of proteins of K. pneumoniae.

Nucleic acid isolated or synthesized in accordance with the sequences described herein have utility to generate polypeptides. The nucleic acid of the invention exemplified in SEQ ID NO: 1–SEQ ID NO: 7171 and in Table 2 or fragments of said nucleic acid encoding active portions of K. pneumoniae polypeptides can be cloned into suitable vectors or used to isolate nucleic acid. The isolated nucleic acid is combined with suitable DNA linkers and cloned into a suitable vector.

The function of a specific gene or operon can be ascertained by expression in a bacterial strain under conditions where the activity of the gene product(s) specified by the gene or operon in question can be specifically measured. Alternatively, a gene product may be produced in large quantities in an expressing strain for use as an antigen, an industrial reagent, for structural studies, etc. This expression can be accomplished in a mutant strain which lacks the activity of the gene to be tested, or in a strain that does not produce the same gene product(s). This includes, but is not limited to, Eucaryotic species such as the yeast *Saccharomyces cerevisiae*, Methanobacterium strains or other Archaea, and Eubacteria such as *E. coli*, *B. Subtilis*, *S. Aureus*, *S. Pneumonia* or *Pseudomonas putida*. In some cases the expression host will utilize the natural *K. pneumoniae* promoter whereas in others, it will be necessary to drive the gene with a promoter sequence derived from the expressing organism (e.g., an *E. coli* beta-galactosidase promoter for expression in *E. coli*).

To express a gene product using the natural *K. pneumoniae* promoter, a procedure such as the following can be used. A restriction fragment containing the gene of interest, together with its associated natural promoter element and regulatory sequences (identified using the DNA sequence data) is cloned into an appropriate recombinant plasmid containing an origin of replication that functions in the host organism and an appropriate selectable marker. This can be accomplished by a number of procedures known to those skilled in the art. It is most preferably done by cutting the plasmid and the fragment to be cloned with the same restriction enzyme to produce compatible ends that can be ligated to join the two pieces together. The recombinant plasmid is introduced into the host organism by, for example, electroporation and cells containing the recombinant plasmid are identified by selection for the marker on the plasmid. Expression of the desired gene product is detected using an assay specific for that gene product.

In the case of a gene that requires a different promoter, the body of the gene (coding sequence) is specifically excised and cloned into an appropriate expression plasmid. This subcloning can be done by several methods, but is most easily accomplished by PCR amplification of a specific fragment and ligation into an expression plasmid after treating the PCR product with a restriction enzyme or exonuclease to create suitable ends for cloning.

A suitable host cell for expression of a gene can be any procaryotic or eucaryotic cell. Suitable methods for transforming host cells can be found in Sambrook et al. (*Molecular Cloning: A Laboratory Manual*, 2nd Edition, Cold Spring Harbor Laboratory Press (1989)), and other laboratory textbooks.

For example, a host cell transfected with a nucleic acid vector directing expression of a nucleotide sequence encoding an *K. pneumoniae* polypeptide can be cultured under appropriate conditions to allow expression of the polypeptide to occur. Suitable media for cell culture are well known in the art. Polypeptides of the invention can be isolated from cell culture medium, host cells, or both using techniques known in the art for purifying proteins including ion-exchange chromatography, gel filtration chromatography, ultrafiltration, electrophoresis, and immunoaffinity purification with antibodies specific for such polypeptides. Additionally, in many situations, polypeptides can be produced by chemical cleavage of a native protein (e.g., tryptic digestion) and the cleavage products can then be purified by standard techniques.

In the case of membrane bound proteins, these can be isolated from a host cell by contacting a membrane-associated protein fraction with a detergent forming a solubilized complex, where the membrane-associated protein is no longer entirely embedded in the membrane fraction and is solubilized at least to an extent which allows it to be chromatographically isolated from the membrane fraction. Chromatographic techniques which can be used in the final purification step are known in the art and include hydrophobic interaction, lectin affinity, ion exchange, dye affinity and immunoaffinity.

One strategy to maximize recombinant *K. pneumoniae* peptide expression in *E. coli* is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119–128). Another strategy would be to alter the nucleic acid encoding an *K. pneumoniae* peptide to be inserted into an expression vector so that the individual codons for each amino acid would be those preferentially utilized in highly expressed *E. coli* proteins (Wada et al., (1992) *Nuc. Acids Res.* 20:2111–2118). Such alteration of nucleic acids of the invention can be carried out by standard DNA synthesis techniques.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See, e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

The present invention provides a library of *K. pneumoniae*-derived nucleic acid sequences. The libraries provide probes, primers, and markers which can be used as markers in epidemiological studies. The present invention also provides a library of *K. pneumoniae*-derived nucleic acid sequences which comprise or encode targets for therapeutic drugs.

Nucleic acids comprising any of the sequences disclosed herein or sub-sequences thereof can be prepared by standard methods using the nucleic acid sequence information provided in SEQ ID NO: 1–SEQ ID NO: 7171. For example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Of course, due to the degeneracy of the genetic code, many different nucleotide sequences can encode polypeptides having the amino acid sequences defined by SEQ ID NO: 7172–SEQ ID NO: 14342 or sub-sequences thereof The codons can be selected for optimal expression in prokaryotic or eukaryotic systems. Such degenerate variants are also encompassed by this invention.

Insertion of nucleic acids (typically DNAs) encoding the polypeptides of the invention into a vector is easily accomplished when the termini of both the DNAs and the vector comprise compatible restriction sites. If this cannot be done, it may be necessary to modify the termini of the DNAs and/or vector by digesting back single-stranded DNA overhangs generated by restriction endonuclease cleavage to produce blunt ends, or to achieve the same result by filling in the single-stranded termini with an appropriate DNA polymerase.

Alternatively, any site desired may be produced, e.g., by ligating nucleotide sequences (linkers) onto the termini. Such linkers may comprise specific oligonucleotide sequences that define desired restriction sites. Restriction sites can also be generated by the use of the polymerase chain reaction (PCR). See, e.g., Saiki et al., 1988, *Science* 239:48. The cleaved vector and the DNA fragments may also be modified if required by homopolymeric tailing.

The nucleic acids of the invention may be isolated directly from cells. Alternatively, the polymerase chain reaction (PCR) method can be used to produce the nucleic acids of the invention, using either chemically synthesized strands or genomic material as templates. Primers used for PCR can be synthesized using the sequence information provided herein and can further be designed to introduce appropriate new restriction sites, if desirable, to facilitate incorporation into a given vector for recombinant expression.

The nucleic acids of the present invention may be flanked by natural *K. pneumoniae* regulatory sequences, or may be associated with heterologous sequences, including promoters, enhancers, response elements, signal sequences, polyadenylation sequences, introns, 5'- and 3'-noncoding regions, and the like. The nucleic acids may also be modified by many means known in the art. Non-limiting examples of such modifications include methylation, "caps", substitution of one or more of the naturally occurring nucleotides with an analog, internucleotide modifications such as, for example, those with uncharged linkages (e.g., methyl phosphonates, phosphotriesters, phosphoroamidates, carbamates, etc.) and with charged linkages (e.g., phosphorothioates, phosphorodithioates, etc.). Nucleic acids may contain one or more additional covalently linked moieties, such as, for example, proteins (e.g., nucleases, toxins, antibodies, signal peptides, poly-L-lysine, etc.), intercalators (e.g., acridine, psoralen, etc.), chelators (e.g., metals, radioactive metals, iron, oxidative metals, etc.), and alkylators. PNAs are also included. The nucleic acid may be derivatized by formation of a methyl or ethyl phosphotriester or an alkyl phosphoramidate linkage. Furthermore, the nucleic acid sequences of the present invention may also be modified with a label capable of providing a detectable signal, either directly or indirectly. Exemplary labels include radioisotopes, fluorescent molecules, biotin, and the like.

The invention also provides nucleic acid vectors comprising the disclosed *K. pneumoniae*-derived sequences or derivatives or fragments thereof. A large number of vectors, including plasmid and bacterial vectors, have been described for replication and/or expression in a variety of eukaryotic and prokaryotic hosts, and may be used for cloning or protein expression.

The encoded *K. pneumoniae* polypeptides may be expressed by using many known vectors, such as pUC plasmids, pET plasmids (Novagen, Inc., Madison, Wis.), or pRSET or pREP (Invitrogen, San Diego, Calif.), and many appropriate host cells, using methods disclosed or cited herein or otherwise known to those skilled in the relevant art. The particular choice of vector/host is not critical to the practice of the invention.

Recombinant cloning vectors will often include one or more replication systems for cloning or expression, one or more markers for selection in the host, e.g. antibiotic resistance, and one or more expression cassettes. The inserted *K. pneumoniae* coding sequences may be synthesized by standard methods, isolated from natural sources, or prepared as hybrids, etc. Ligation of the *K. pneumoniae* coding sequences to transcriptional regulatory elements and/or to other amino acid coding sequences may be achieved by known methods. Suitable host cells may be transformed/transfected/infected as appropriate by any suitable method including electroporation, $CaCl_2$ mediated DNA uptake, bacterial infection, microinjection, microprojectile, or other established methods.

Appropriate host cells include bacteria, archebacteria, fungi, especially yeast, and plant and animal cells, especially mammalian cells. Of particular interest are *K. pneumoniae, E. coli, B. Subtilis, Saccharomyces cerevisiae, Saccharomyces carlsbergensis, Schizosaccharomyces pombi*, SF9 cells, C129 cells, 293 cells, Neurospora, and CHO cells, COS cells, HeLa cells, and immortalized mammalian myeloid and lymphoid cell lines. Preferred replication systems include M13, ColE1, SV40, baculovirus, lambda, adenovirus, and the like. A large number of transcription initiation and termination regulatory regions have been isolated and shown to be effective in the transcription and translation of heterologous proteins in the various hosts. Examples of these regions, methods of isolation, manner of manipulation, etc. are known in the art. Under appropriate expression conditions, host cells can be used as a source of recombinantly produced *K. pneumoniae*-derived peptides and polypeptides.

Advantageously, vectors may also include a transcription regulatory element (i.e., a promoter) operably linked to the *K. pneumoniae* portion. The promoter may optionally contain operator portions and/or ribosome binding sites. Non-limiting examples of bacterial promoters compatible with *E. coli* include: b-lactamase (penicillinase) promoter; lactose promoter; tryptophan (trp) promoter; araBAD (arabinose) operon promoter; lambda-derived $P_1$ promoter and N gene ribosome binding site; and the hybrid tac promoter derived from sequences of the trp and lac UV5 promoters. Non-limiting examples of yeast promoters include 3-phosphoglycerate kinase promoter, glyceraldehyde-3-phosphate dehydrogenase (GAPDH) promoter, galactokinase (GAL 1) promoter, galactoepimerase promoter, and alcohol dehydrogenase (ADH) promoter. Suitable promoters for mammalian cells include without limitation viral promoters such as that from Simian Virus 40 (SV40), Rous sarcoma virus (RSV), adenovirus (ADV), and bovine papilloma virus (BPV). Mammalian cells may also require terminator sequences, polyA addition sequences and enhancer sequences to increase expression. Sequences which cause amplification of the gene may also be desirable. Furthermore, sequences that facilitate secretion of the recombinant product from cells, including, but not limited to, bacteria, yeast, and animal cells, such as secretory signal sequences and/or prohormone pro region sequences, may also be included. These sequences are well described in the art.

Nucleic acids encoding wild-type or variant *K. pneumoniae*-derived polypeptides may also be introduced into cells by recombination events. For example, such a sequence can be introduced into a cell, and thereby effect homologous recombination at the site of an endogenous gene or a sequence with substantial identity to the gene. Other recombination-based methods such as nonhomologous recombinations or deletion of endogenous genes by homologous recombination may also be used.

The nucleic acids of the present invention find use as templates for the recombinant production of *K. pneumoniae*-derived peptides or polypeptides.

Identification and Use of *K. pneumoniae* Nucleic Acid Sequences

The disclosed *K. pneumoniae* polypeptide and nucleic acid sequences, or other sequences that are contained within ORFs, including complete protein-coding sequences, of which any of the disclosed *K. pneumoniae*-specific sequences forms a part, are useful as target components for diagnosis and/or treatment of *K. pneumoniae*-caused infection.

It will be understood that the sequence of an entire protein-coding sequence of which each disclosed nucleic acid sequence forms a part can be isolated and identified based on each disclosed sequence. This can be achieved, for example, by using an isolated nucleic acid encoding the disclosed sequence, or fragments thereof, to prime a sequencing reaction with genomic *K. pneumoniae* DNA as template; this is followed by sequencing the amplified product. The isolated nucleic acid encoding the disclosed sequence, or fragments thereof, can also be hybridized to *K. pneumoniae* genomic libraries to identify clones containing additional complete segments of the protein-coding sequence of which the shorter sequence forms a part. Then, the entire protein-coding sequence, or fragments thereof, or nucleic acids encoding all or part of the sequence, or sequence-conservative or function-conservative variants thereof, may be employed in practicing the present invention.

Preferred sequences are those that are useful in diagnostic and/or therapeutic applications. Diagnostic applications include without limitation nucleic-acid-based and antibody-based methods for detecting bacterial infection. Therapeutic applications include without limitation vaccines, passive immunotherapy, and drug treatments directed against gene products that are both unique to bacteria and essential for growth and/or replication of bacteria.

Identification of Nucleic Acids Encoding Vaccine Components and Targets for Agents Effective Against *K. pneumoniae*

The disclosed *K. pneumoniae* genome sequence includes segments that direct the synthesis of ribonucleic acids and polypeptides, as well as origins of replication, promoters, other types of regulatory sequences, and intergenic nucleic acids. The invention encompasses nucleic acids encoding immunogenic components of vaccines and targets for agents effective against *K. pneumoniae*. Identification of said immunogemc components involved in the determination of the function of the disclosed sequences, which can be achieved using a variety of approaches. Non-limiting examples of these approaches are described briefly below.

Homology to Known Sequences

Computer-assisted comparison of the disclosed *K. pneumoniae* sequences with previously reported sequences present in publicly available databases is useful for identifying functional *K. pneumoniae* nucleic acid and polypeptide sequences. It will be understood that protein-coding sequences, for example, may be compared as a whole, and that a high degree of sequence homology between two proteins (such as, for example, >80–90%) at the amino acid level indicates that the two proteins also possess some degree of functional homology, such as, for example, among enzymes involved in metabolism, DNA synthesis, or cell wall synthesis, and proteins involved in transport, cell division, etc. In addition, many structural features of particular protein classes have been identified and correlate with specific iconsensus sequences, such as, for example, binding domains for nucleotides, DNA, metal ions, and other small molecules; sites for covalent modifications such as phosphorylation, acylation, and the like; sites of protein-:protein interactions, etc. These consensus sequences may be quite short and thus may represent only a fraction of the entire protein-coding sequence. Identification of such a feature in an K. pneumoniae sequence is therefore useful in determining the function of the encoded protein and identifying useful targets of antibacterial drugs.

Of particular relevance to the present invention are structural features that are common to secretory, transmembrane, and surface proteins, including secretion signal peptides and hydrophobic transmembrane domains. K. pneumoniae proteins identified as containing putative signal sequences and/ or transmembrane domains are useful as immunogenic components of vaccines.

Targets for therapeutic drugs according to the invention include, but are not limited to, polypeptides of the invention, whether unique to K. pneumoniae or not, that are essential for growth and/or viability of K. pneumoniae under at least one growth condition. Polypeptides essential for growth and/or viability can be determined by examining the effect of deleting and/or disrupting the genes, i.e., by so-called gene "knockout". Alternatively, genetic footprinting can be used (Smith et al., 1995, Proc. Natl. Acad. Sci. USA 92:5479–6433; Published International Application WO 94/26933; U.S. Pat. No. 5,612,180). Still other methods for assessing essentiality includes the ability to isolate conditional lethal mutations in the specific gene (e.g., temperature sensitive mutations). Other useful targets for therapeutic drugs, which include polypeptides that are not essential for growth or viability per se but lead to loss of viability of the cell, can be used to target therapeutic agents to cells.

Strain-specific Sequences

Because of the evolutionary relationship between different K. pneumoniae strains, it is believed that the presently disclosed K. pneumoniae sequences are useful for identifying, and/or discriminating between, previously known and new K. pneumoniae strains. It is believed that other K. pneumoniae strains will exhibit at least about 70% sequence homology with the presently disclosed sequence. Systematic and routine analyses of DNA sequences derived from samples containing K. pneumoniae strains, and comparison with the present sequence allows for the identification of sequences that can be used to discriminate between strains, as well as those that are common to all K. pneumoniae strains. In one embodiment, the invention provides nucleic acids, including probes, and peptide and polypeptide sequences that discriminate between different strains of K. pneumoniae. Strain-specific components can also be identified functionally by their ability to elicit or react with antibodies that selectively recognize one or more K. pneumoniae strains.

In another embodiment, the invention provides nucleic acids, including probes, and peptide and polypeptide sequences that are common to all K. pneumoniae strains but are not found in other bacterial species.

K. pneumoniae Polypeptides

This invention encompasses isolated K. pneumoniae polypeptides encoded by the disclosed K. pneumoniae genomic sequences, including the polypeptides of the invention contained in the Sequence Listing. Polypeptides of the invention are preferably at least about 5 amino acid residues in length. Using the DNA, sequence information provided herein, the amino acid sequences of the polypeptides encompassed by the invention can be deduced using methods well-known in the art. It will be understood that the sequence of an entire nucleic acid encoding an K. pneumoniae polypeptide can be isolated and identified based on an ORF that encodes only a fragment of the cognate protein-coding region. This can be achieved, for example, by using the isolated nucleic acid encoding the ORF, or fragmnents thereof, to prime a polymerase chain reaction with genomic K. pneumoniae DNA as template; this is followed by sequencing the amplified product.

The polypeptides of the present invention, including function-conservative variants of the disclosed ORFs, may be isolated from wild-type or mutant K. pneumoniae cells, or from heterologous organisms or cells (including, but not limited to, bacteria, fungi, insect, plant, and mammalian cells) including K. pneumoniae into which an K. pneumoniae-derived protein-coding sequence has been introduced and expressed. Furthermore, the polypeptides may be part of recombinant fusion proteins.

K. pneumoniae polypeptides of the invention can be chemically synthesized using commercially automated procedures such as those referenced herein, including, without limitation, exclusive solid phase synthesis, partial solid phase methods, fragment condensation or classical solution synthesis. The polypeptides are preferably prepared by solid phase peptide synthesis as described by Merrifield, 1963, J. Am. Chem. Soc. 85:2149. The synthesis is carried out with amino acids that are protected at the alpha-amino terminus. Trifunctional amino acids with labile side-chains are also protected with suitable groups to prevent undesired chemical reactions from occurring during the assembly of the polypeptides. The alpha-amino protecting group is selectively removed to allow subsequent reaction to take place at the amino-terminus. The conditions for the removal of the alpha-amino protecting group do not remove the side-chain protecting groups.

Methods for polypeptide purification are well-known in the art, including, without limitation, preparative disc-gel electrophoresis, isoelectric focusing, HPLC, reversed-phase HPLC, gel filtration, ion exchange and partition chromatography, and countercurrent distribution. For some purposes, it is preferable to produce the polypeptide in a recombinant system in which the K. pneumoniae protein contains an additional sequence tag that facilitates purification, such as, but not limited to, a polyhistidine sequence. The polypeptide can then be purified from a crude lysate of the host cell by chromatography on an appropriate solid-phase matrix. Alternatively, antibodies produced against an K. pneumoniae protein or against peptides derived therefrom can be used as purification reagents. Other purification methods are possible.

The present invention also encompasses derivatives and homologues of K. pneumoniae-encoded polypeptides. For some purposes, nucleic acid sequences encoding the peptides may be altered by substitutions, additions, or deletions that provide for functionally equivalent molecules, i.e., function-conservative variants. For example, one or more amino acid residues within the sequence can be substituted by another amino acid of similar properties, such as, for example, positively charged amino acids (arginine, lysine, and histidine); negatively charged amino acids (aspartate and glutamate); polar neutral amino acids; and non-polar amino acids.

The isolated polypeptides may be modified by, for example, phosphorylation, sulfation, acylation, or other protein modifications. They may also be modified with a label capable of providing a detectable signal, either directly or indirectly, including, but not limited to, radioisotopes and fluorescent compounds.

To identify K. pneumoniae-derived polypeptides for use in the present invention, essentially the complete genomic sequence of a virulent, methicillin-resistant isolate of Klebsiella pneumoniae isolate was analyzed. While, in very rare instances, a nucleic acid sequencing error may be revealed, resolving a rare sequencing error is well within the art, and such an occurrence will not prevent one skilled in the art from practicing the invention.

Also encompassed are any K. pneumoniae polypeptide sequences that are contained within the open reading frames (ORFs), including complete protein-coding sequences, of which any of SEQ ID NO: 1–SEQ ID NO: 7171 forms a part. Table 2, which is appended herewith and which forms part of the present specification, provides a putative identification of the particular function of a polypeptide which is encoded by each ORF, based on the homology match (determined by the BLAST algorithm) of the predicted polypeptide with known proteins encoded by ORFs in other organisms. As a result, one skilled in the art can use the polypeptides of the present invention for commercial and industrial purposes consistent with the type of putative identification of the polypeptide.

The present invention provides a library of K. pneumoniae-derived polypeptide sequences, and a corresponding library of nucleic acid sequences encoding the polypeptides, wherein the polypeptides themselves, or polypeptides contained within ORFs of which they form a part, comprise sequences that are contemplated for use as components of vaccines. Non-limiting examples of such sequences are listed by SEQ ID NO in Table 2, which is appended herewith and which forms part of the present specification.

The present invention also provides a library of K. pneumoniae-derived polypeptide sequences, and a corresponding library of nucleic acid sequences encoding the polypeptides, wherein the polypeptides themselves, or polypeptides contained within ORFs of which they form a part, comprise sequences lacking homology to any known prokaryotic or eukaryotic sequences. Such libraries provide probes, primers, and markers which can be used to diagnose K. pneumoniae infection, including use as markers in epidemiological studies. Non-limiting examples of such sequences are listed by SEQ ID NO in Table 2, which is appended hereto and part hereof.

The present invention also provides a library of K. pneumoniae-derived polypeptide sequences, and a corresponding library of nucleic acid sequences encoding the polypeptides, wherein the polypeptides themselves, or polypeptides contained within ORFs of which they form a part, comprise targets for therapeutic drugs.

Specific Example

Determination of Klebsiella Protein Antigens for Antibody and Vaccine Development The selection of Klebsiella protein antigens for vaccine development can be derived from the nucleic acids encoding K. pneumoniae polypeptides. First, the ORF's can be analyzed for homology to other known exported or membrane proteins and analyzed using the discriminant analysis described by Klein, et al. (Klein, P., Kanehsia, M., and DeLisi, C. (1985) Biochimica et Biophysica Acta 815, 468–476) for predicting exported and membrane proteins.

Homology searches can be performed using the BLAST algorithm contained in the Wisconsin Sequence Analysis Package (Genetics Computer Group, University Research Park, 575 Science Drive, Madison, Wis. 53711) to compare each predicted ORF amino acid sequence with all sequences found in the current GenBank, SWISS-PROT and PIR databases. BLAST searches for local alignments between the ORF and the databank sequences and reports a probability score which indicates the probability of finding this sequence by chance in the database. ORF's with significant homology (e.g. probabilities lower than $1 \times 10^{-6}$ that the homology is only due to random chance) to membrane or exported proteins represent protein antigens for vaccine development. Possible functions can be provided to K. pneumoniae genes based on sequence homology to genes cloned in other organisms.

Discriminant analysis (Klein, et al. supra) can be used to examine the ORF amino acid sequences. This algorithm uses the intrinsic information contained in the ORF amino acid sequence and compares it to information derived from the properties of known membrane and exported proteins. This comparison predicts which proteins will be exported, membrane associated or cytoplasmic. ORF amino acid sequences identified as exported or membrane associated by this algorithm are likely protein antigens for vaccine development.

Production of Fragments and Analogs of K. pneumoniae Nucleic Acids and Polypeptides Based on the discovery of the K. pneumoniae gene products of the invention provided in the Sequence Listing, one skilled in the art can alter the disclosed structure of K. pneumoniae genes, e.g., by producing fragments or analogs, and test the newly produced structures for activity. Examples of techniques known to those skilled in the relevant art which allow the production and testing of fragments and analogs are discussed below. These, or analogous methods can be used to make and screen libraries of polypeptides, e.g., libraries of random peptides or libraries of fragments or analogs of cellular proteins for the ability to bind K. pneumoniae polypeptides. Such screens are useful for the identification of inhibitors of K pneumoniae.

Generation of Fragments

Fragments of a protein can be produced in several ways, e.g., recombinantly, by proteolytic digestion, or by chemical synthesis. Internal or terminal fragments of a polypeptide can be generated by removing one or more nucleotides from one end (for a terminal fragment) or both ends (for an internal fragment) of a nucleic acid which encodes the polypeptide. Expression of the mutagenized DNA produces polypeptide fragments. Digestion with "end-nibbling" endonucleases can thus generate DNAs which encode an array of fragments. DNAs which encode fragments of a protein can also be generated by random shearing, restriction digestion or a combination of the above-discussed methods.

Fragments can also be chemically synthesized using techniques known in the art such as conventional Merrifield solid phase f-Moc or t-Boc chemistry. For example, peptides of the present invention may be arbitrarily divided into fragments of desired length with no overlap of the fragments, or divided into overlapping fragments of a desired length.

Alteration of Nucleic Acids and Polypeptides

Random Methods

Amino acid sequence variants of a protein can be prepared by random mutagenesis of DNA which encodes a protein or a particular domain or region of a protein. Useful methods include PCR mutagenesis and saturation mutagenesis. A library of random amino acid sequence variants can also be generated by the synthesis of a set of degenerate oligonucleotide sequences. (Methods for screening proteins in a library of variants are elsewhere herein).

PCR Mutagenesis

In PCR mutagenesis, reduced Taq polymerase fidelity is used to introduce random mutations into a cloned fragment of DNA (Leung et al., 1989, *Technique* 1:11–15). The DNA region to be mutagenized is amplified using the polymerase chain reaction (PCR) under conditions that reduce the fidelity of DNA synthesis by Taq DNA polymerase, e.g., by using a dGTP/dATP ratio of five and adding $Mn^{2+}$ to the PCR reaction. The pool of amplified DNA fragments are inserted into appropriate cloning vectors to provide random mutant libraries.

Saturation Mutagenesis

Saturation mutagenesis allows for the rapid introduction of a large number of single base substitutions into cloned DNA fragments (Mayers et al., 1985, *Science* 229:242). This technique includes generation of mutations, e.g., by chemical treatment or irradiation of single-stranded DNA in vitro, and synthesis of a complimentary DNA strand. The mutation frequency can be modulated by modulating the severity of the treatment, and essentially all possible base substitutions can be obtained. Because this procedure does not involve a genetic selection for mutant fragments both neutral substitutions, as well as those that alter function, are obtained. The distribution of point mutations is not biased toward conserved sequence elements.

Degenerate Oligonucleotides

A library of homologs can also be generated from a set of degenerate oligonucleotide sequences. Chemical synthesis of a degenerate sequences can be carried out in an automatic DNA synthesizer, and the synthetic genes then ligated into an appropriate expression vector. The synthesis of degenerate oligonucleotides is known in the art (see for example, Narang, S A (1983) *Tetrahedron* 39:3; Itakura et al. (1981) *Recombinant DNA, Proc 3rd Cleveland Sympos. Macromolecules*, ed. A G Walton, Amsterdam: Elsevier pp273–289; Itakura et al. (1984) *Annu. Rev. Biochem.* 53:323; Itakura et al. (1984) *Science* 198:1056; Ike et al. (1983) *Nucleic Acid Res.* 11:477. Such techniques have been employed in the directed evolution of other proteins (see, for example, Scott et al. (1990) *Science* 249:386–390; Roberts et al. (1992) *PNAS* 89:2429–2433; Devlin et al. (1990) *Science* 249: 404–406; Cwirla et al. (1990) *PNAS* 87: 6378–6382; as well as U.S. Pat. Nos. 5,223,409, 5,198,346, and 5,096,815).

Alteration of Nucleic Acids and Polypeptides

Methods for Directed Mutagenesis

Non-random or directed, mutagenesis techniques can be used to provide specific sequences or mutations in specific regions. These techniques can be used to create variants which include, e.g., deletions, insertions, or substitutions, of residues of the known amino acid sequence of a protein. The sites for mutation can be modified individually or in series, e.g., by (1) substituting first with conserved amino acids and then with more radical choices depending upon results achieved, (2) deleting the target residue, or (3) inserting residues of the same or a different class adjacent to the located site, or combinations of options 1–3.

Alanine Scanning Mutagenesis

Alanine scanning mutagenesis is a useful method for identification of certain residues or regions of the desired protein that are preferred locations or domains for mutagenesis, Cunningham and Wells (*Science* 244:1081–1085, 1989). In alanine scanning, a residue or group of target residues are identified (e.g., charged residues such as Arg, Asp, His, Lys, and Glu) and replaced by a neutral or negatively charged amino acid (most preferably alanine or polyalanine). Replacement of an amino acid can affect the interaction of the amino acids with the surrounding aqueous environment in or outside the cell. Those domains demonstrating functional sensitivity to the substitutions are then refined by introducing further or other variants at or for the sites of substitution. Thus, while the site for introducing an amino acid sequence variation is predetermined, the nature of the mutation per se need not be predetermined. For example, to optimize the performance of a mutation at a given site, alanine scanning or random mutagenesis may be conducted at the target codon or region and the expressed desired protein subunit variants are screened for the optimal combination of desired activity.

Oligonucleotide-Mediated Mutagenesis

Oligonucleotide-mediated mutagenesis is a useful method for preparing substitution, deletion, and insertion variants of DNA, see, e.g., Adelman et al., (*DNA* 2:183, 1983). Briefly, the desired DNA is altered by hybridizing an oligonucleotide encoding a mutation to a DNA template, where the template is the single-stranded form of a plasmid or bacteriophage containing the unaltered or native DNA sequence of the desired protein. After hybridization, a DNA polymerase is used to synthesize an entire second complementary strand of the template that will thus incorporate the oligonucleotide primer, and will code for the selected alteration in the desired protein DNA. Generally, oligonucleotides of at least about 25 nucleotides in length are used. An optimal oligonucleotide will have 12 to 15 nucleotides that are completely complementary to the template on either side of the nucleotide(s) coding for the mutation. This ensures that the oligonucleotide will hybridize properly to the single-stranded DNA template molecule. The oligonucleotides are readily synthesized using techniques known in the art such as that described by Crea et al. (*Proc. Natl. Acad. Sci. USA*, 75: 5765[1978]).

Cassette Mutagenesis

Another method for preparing variants, cassette mutagenesis, is based on the technique described by Wells et al. (*Gene*, 34:315[1985]). The starting material is a plasmid (or other vector) which includes the protein subunit DNA to be mutated. The codon(s) in the protein subunit DNA to be mutated are identified. There must be a unique restriction endonuclease site on each side of the identified mutation site(s). If no such restriction sites exist, they may be generated using the above-described oligonucleotide-mediated mutagenesis method to introduce them at appropriate locations in the desired protein subunit DNA. After the restriction sites have been introduced into the plasmid, the plasmid is cut at these sites to linearize it. A double-stranded oligonucleotide encoding the sequence of the DNA between the restriction sites but containing the desired mutation(s) is synthesized using standard procedures. The two strands are synthesized separately and then hybridized together using standard techniques. This double-stranded oligonucleotide is referred to as the cassette. This cassette is designed to have 3' and 5' ends that are comparable with the ends of the linearized plasmid, such that it can be directly ligated to the plasmid. This plasmid now contains the mutated desired protein subunit DNA sequence.

Combinatorial Mutagenesis

Combinatorial mutagenesis can also be used to generate mutants (Ladner et al., WO 88/06630). In this method, the amino acid sequences for a group of homologs or other related proteins are aligned, preferably to promote the highest homology possible. All of the amino acids which appear at a given position of the aligned sequences can be selected to create a degenerate set of combinatorial sequences. The variegated library of variants is generated by combinatorial mutagenesis at the nucleic acid level, and is encoded by a variegated gene library. For example, a mixture of synthetic oligonucleotides can be enzymatically ligated into gene sequences such that the degenerate set of potential sequences are expressible as individual peptides, or alternatively, as a set of larger fusion proteins containing the set of degenerate sequences.

Other Modifications of *K. pneumoniae* Nucleic Acids and Polypeptides

It is possible to modify the structure of an *K. pneumoniae* polypeptide for such purposes as increasing solubility, enhancing stability (e.g., shelf life ex vivo and resistance to proteolytic degradation in vivo). A modified *K. pneumoniae* protein or peptide can be produced in which the amino acid sequence has been altered, such as by amino acid substitution, deletion, or addition as described herein.

An *K. pneumoniae* peptide can also be modified by substitution of cysteine residues preferably with alanine, serine, threonine, leucine or glutamic acid residues to minimize dimerization via disulfide linkages. In addition, amino acid side chains of fragments of the protein of the invention can be chemically modified. Another modification is cyclization of the peptide.

In order to enhance stability and/or reactivity, an *K. pneumoniae* polypeptide can be modified to incorporate one or more polymorphisms in the amino acid sequence of the protein resulting from any natural allelic variation. Additionally, D-amino acids, non-natural amino acids, or non-amino acid analogs can be substituted or added to produce a modified protein within the scope of this invention. Furthermore, an *K. pneumoniae* polypeptide can be modified using polyethylene glycol (PEG) according to the method of A. Sehon and coworkers (Wie et al., supra) to produce a protein conjugated with PEG. In addition, PEG can be added during chemical synthesis of the protein. Other modifications of *K. pneumoniae* proteins include reduction/alkylation (Tarr, *Methods of Protein Microcharacterization*, J. E. Silver ed., Humana Press, Clifton N.J. 155–194 (1986)); acylation (Tarr, supra); chemical coupling to an appropriate carrier (Mishell and Shiigi, eds, *Selected Methods in Cellular Immunology*, W H Freeman, San Francisco, Calif. (1980), U.S. Pat. No. 4,939,239; or mild formalin treatment (Marsh, (1971) *Int. Arch. of Allergy and Appl. Immunol.*, 41: 199–215).

To facilitate purification and potentially increase solubility of an *K. pneumoniae* protein or peptide, it is possible to add an amino acid fusion moiety to the peptide backbone. For example, hexa-histidine can be added to the protein for purification by immobilized metal ion affinity chromatography (Hochuli, E. et al., (1988) *Bio/Technology*, 6: 1321–1325). In addition, to facilitate isolation of peptides free of irrelevant sequences, specific endoprotease cleavage sites can be introduced between the sequences of the fusion moiety and the peptide.

To potentially aid proper antigen processing of epitopes within an *K. pneumoniae* polypeptide, canonical protease sensitive sites can be engineered between regions, each comprising at least one epitope via recombinant or synthetic methods. For example, charged amino acid pairs, such as KK or RR, can be introduced between regions within a protein or fragment during recombinant construction thereof. The resulting peptide can be rendered sensitive to cleavage by cathepsin and/or other trypsin-like enzymes which would generate portions of the protein containing one or more epitopes. In addition, such charged amino acid residues can result in an increase in the solubility of the peptide.

Primary Methods for Screening Polypeptides and Analogs

Various techniques are known in the art for screening generated mutant gene products. Techniques for screening large gene libraries often include cloning the gene library into replicable expression vectors, transforming appropriate cells with the resulting library of vectors, and expressing the genes under conditions in which detection of a desired activity, e.g., in this case, binding to *K. pneumoniae* polypeptide or an interacting protein, facilitates relatively easy isolation of the vector encoding the gene whose product was detected. Each of the techniques described below is amenable to high through-put analysis for screening large numbers of sequences created, e.g., by random mutagenesis techniques.

Two Hybrid Systems

Two hybrid assays such as the system described below (as with the other screening methods described herein), can be used to identify polypeptides, e.g., fragments or analogs of a naturally-occurring *K. pneumoniae* polypeptide, e.g., of cellular proteins, or of randomly generated polypeptides which bind to an *K. pneumoniae* protein. (The *K. pneumoniae* domain is used as the bait protein and the library of variants are expressed as prey fusion proteins.) In an analogous fashion, a two hybrid assay (as with the other screening methods described herein), can be used to find polypeptides which bind an *K. pneumoniae* polypeptide.

Display Libraries

In one approach to screening assays, the Klebsiella peptides are displayed on the surface of a cell or viral particle, and the ability of particular cells or viral particles to bind an appropriate receptor protein via the displayed product is detected in a "panning assay". For example, the gene library can be cloned into the gene for a surface membrane protein of a bacterial cell, and the resulting fusion protein detected by panning (Ladner et al., WO 88/06630; Fuchs et al. (1991) *Bio/Technology* 9:1370–1371; and Goward et al. (1992) *TIBS* 18:136–140). In a similar fashion, a detectably labeled ligand can be used to score for potentially functional peptide homologs. Fluorescently labeled ligands, e.g., receptors, can be used to detect homologs which retain ligand-binding activity. The use of fluorescently labeled ligands, allows cells to be visually inspected and separated under a fluorescence microscope, or, where the morphology of the cell permits, to be separated by a fluorescence-activated cell sorter.

A gene library can be expressed as a fusion protein on the surface of a viral particle. or instance, in the filamentous phage system, foreign peptide sequences can be expressed on the surface of infectious phage, thereby conferring two significant benefits. First, since these phage can be applied to affinity matrices at concentrations well over $10^{13}$ phage per milliliter, a large number of phage can be screened at one tine. Second, since each infectious phage displays a gene product on its surface, if a particular phage is recovered from an affinity matrix in low yield, the phage can be amplified by another round of infection. The group of almost identical *E. coli* filamentous phages, M13, fd., and fl, are most often used in phage display libraries. Either of the phage gIII or gVIII coat proteins can be used to generate fusion proteins without disrupting the ultimate packaging of the viral particle. Foreign epitopes can be expressed at the $NH_2$-terminal end of pIII and phage bearing such epitopes recovered from a large excess of phage lacking this epitope (Ladner et al. PCT publication WO 90/02909; Garrard et al., PCT publication WO 92/09690; Marks et al. (1992) *J. Biol. Chem.* 267:16007–16010; Griffiths et al. (1993) *EMBO J* 12:725–734; Clackson et al. (1991) *Nature* 352:624–628; and Barbas et al. (1992) *PNAS* 89:4457–4461).

A common approach uses the maltose receptor of *E. coli* (the outer membrane protein, LamB) as a peptide fusion partner (Charbit et al. (1986) *EMBO* 5, 3029–3037). Oligonucleotides have been inserted into plasmids encoding the LamB gene to produce peptides fused into one of the extracellular loops of the protein. These peptides are available for binding to ligands, e.g., to antibodies, and can elicit an immune response when the cells are administered to animals. Other cell surface proteins, e.g., OmpA (Schorr et al. (1991) *Vaccines* 91, pp. 387–392), PhoE (Agterberg, et al. (1990) *Gene* 88, 37–45), and PAL (Fuchs et al. (1991) *Bio/Tech* 9, 1369–1372), as well as large bacterial surface structures have served as vehicles for peptide display. Peptides can be fused to pilin, a protein which polymerizes to form the pilus-a conduit for interbacterial exchange of genetic information (Thiry et al. (1989) *Appl. Environ. Microbiol.* 55, 984–993). Because of its role in interacting with other cells, the pilus provides a useful support for the presentation of peptides to the extracellular enviromnent. Another large surface structure used for peptde display is the bacterial motive organ, the flagellum. Fusion of peptides to the subunit protein flagellin offers a dense array of many peptide copies on the host cells (Kuwajima et al. (1988) *Bio/Tech.* 6, 1080–1083). Surface proteins of other bacterial species have also served as peptide fusion partners. Examples include the Klebsiella protein A and the outer membrane IgA protease of Neisseria (Hansson et al. (1992) *J. Bacteriol.* 174, 4239–4245 and Klauser et al. (1990) *EMBO J.* 9, 1991–1999).

In the filamentous phage systems and the LamB system described above, the physical link between the peptide and its encoding DNA occurs by the containment of the DNA within a particle (cell or phage) that carries the peptide on its surface. Capturing the peptide captures the particle and the DNA within. An alternative scheme uses the DNA-binding protein LacI to form a link between peptide and DNA (Cull et al. (1992) *PNAS USA* 89:1865–1869). This system uses a plasrnid containing the LacI gene with an oligonucleotide cloning site at its 3'-end. Under the controlled induction by arabinose, a LacI-peptide fusion protein is produced. This fusion retains the natural ability of LacI to bind to a short DNA sequence known as LacO operator (LacO). By installing two copies of LacO on the expression plasmid, the LacI-peptide fusion binds tightly to the plasmid that encoded it. Because the plasmids in each cell contain only a single oligonucleotide sequence and each cell expresses only a single peptide sequence, the peptides become specifically and stably associated with the DNA sequence that directed its synthesis. The cells of the library are gently lysed and the peptide-DNA complexes are exposed to a matrix of immobilized receptor to recover the complexes containing active peptides. The associated plasniid DNA is then reintroduced into cells for amplification and DNA sequencing to determine the identity of the peptide ligands. As a demonstration of the practical utility of the method, a large random library of dodecapeptides was made and selected on a monoclonal antibody raised against the opioid peptide dynorphin B. A cohort of peptides was recovered, all related by a consensus sequence corresponding to a six-residue portion of dynorphin B. (Cull et al. (1992) *Proc. Natl. Acad. Sci. U.S.A.* 89–1869)

This scheme, sometimes referred to as peptides-on-plasmids, differs in two important ways from the phage display methods. First, the peptides are attached to the C-terminus of the fusion protein, resulting in the display of the library members as peptides having free carboxy termini. Both of the filamentous phage coat proteins, pIII and pVIII, are anchored to the phage through their C-termini, and the guest peptides are placed into the outward-extending N-terminal domains. In some designs, the phage-displayed peptides are presented right at the amino terminus of the fusion protein. (Cwirla, et al. (1990) *Proc. Natl. Acad. Sci. U.S.A.* 87, 6378–6382) A second difference is the set of biological biases affecting the population of peptides actually present in the libraries. The LacI fusion molecules are confined to the cytoplasm of the host cells. The phage coat fusions are exposed briefly to the cytoplasm during translation but are rapidly secreted through the inner membrane into the periplasmic compartment, remaining anchored in the membrane by their C-terminal hydrophobic domains, with the N-termini, containing the peptides, protruding into the periplasm while awaiting assembly into phage particles. The peptides in the LacI and phage libraries may differ significantly as a result of their exposure to different proteolytic activities. The phage coat proteins require transport across the inner membrane and signal peptidase processing as a prelude to incorporation into phage. Certain peptides exert a deleterious effect on these processes and are under-represented in the libraries (Gallop et al. (1994) *J. Med. Chem.* 37(9):1233–1251). These particular biases are not a factor in the LacI display system.

The number of small peptides available in recombinant random libraries is enormous. Libraries of $10^7$–$10^9$ independent clones are routinely prepared. Libraries as large as $10^{11}$ recombinants have been created, but this size approaches the practical limit for clone libraries. This limitation in library size occurs at the step of transforming the DNA containing randomized segments intothe host bacterial cells. To circumvent this limitation, an in vitro system based on the display of nascent peptides in polysome complexes has recently been developed. This display library method has the potential of producing libraries 3–6 orders of magnitude larger than the currently available phage/phagemid or plasmid libraries. Furthermore, the construction of the libraries, expression of the peptides, and screening, is done in an entirely cell-free format.

In one application of this method (Gallop et al. (1994) *J. Med. Chem.* 37(9):1233–1251), a molecular DNA library encoding $10^{12}$ decapeptides was constructed and the library expressed in an *E. coli* S30 in vitro coupled transcription/translation system. Conditions were chosen to stall the ribosomes on the mRNA, causing the accumulation of a substantial proportion of the RNA in polysomes and yielding complexes containing nascent peptides still linked to their encoding RNA. The polysomes are sufficiently robust to be affinity purified on immobilized receptors in much the same way as the more conventional recombinant peptide display libraries are screened. RNA from the bound complexes is recovered, converted to cDNA, and amplified by PCR to produce a template for the next round of synthesis and screening. The polysome display method can be coupled to the phage display system. Following several rounds of screening, cDNA from the enriched pool of polysomes was cloned into a phagemid vector. This vector serves as both a peptide expression vector, displaying peptides fused to the coat proteins, and as a DNA sequencing vector for peptide identification. By expressing the polysome-derived peptides on phage, one can either continue the affinity selection procedure in this format or assay the peptides on individual clones for binding activity in a phage ELISA, or for binding specificity in a completion phage ELISA (Barret, et al. (1992) *Anal. Biochem* 204,357–364). To identify the sequences of the active peptides one sequences the DNA produced by the phagemid host.

Secondary Screening of Polypeptides and Analogs

The high through-put assays described above can be followed by secondary screens in order to identify further biological activities which will, e.g., allow one skilled in the art to differentiate agonists from antagonists. The type of a secondary screen used will depend on the desired activity that needs to be tested. For example, an assay can be developed in which the ability to inhibit an interaction between a protein of interest and its respective ligand can be used to identify antagonists from a group of peptide fragments isolated though one of the primary screens described above.

Therefore, methods for generating fragments and analogs and testing them for activity are known in the art. Once the core sequence of interest is identified, it is routine for one skilled in the art to obtain analogs and fragments.

Peptide Mimetics of *K. pneumoniae* Polypeptides

The invention also provides for reduction of the protein binding domains of the subject *K. pneumoniae* polypeptides to generate mimetics, e.g. peptide or non-peptide agents. The peptide mimetics are able to disrupt binding of a polypeptide to its counter ligand, e.g., in the case of an *K. pneumoniae* polypeptide binding to a naturally occurring ligand. The critical residues of a subject *K. pneumoniae* polypeptide which are involved in molecular recognition of a polypeptide can be determined and used to generate *K. pneumoniae*-derived peptidomimetics which competitively or noncompetitively inhibit binding of the *K. pneumoniae* polypeptide with an interacting polypeptide (see, for example, European patent applications EP-412,762A and EP-B31,080A).

For example, scanning mutagenesis can be used to map the amino acid residues of a particular *K. pneumoniae* polypeptide involved in binding an interacting polypeptide, peptidomimetic compounds (e.g. diazepine or isoquinoline derivatives) can be generated which mimic those residues in binding to an interacting polypeptide, and which therefore can inhibit binding of an *K. pneumoniae* polypeptide to an interacting polypeptide and thereby interfere with the function of *K. pneumoniae* polypeptide. For instance, non-hydrolyzable peptide analogs of such residues can be generated using benzodiazepine (e.g., see Freidinger et al. in *Peptides: Chemistry and Biology*, G. R. Marshall ed., ESCOM Publisher: Leiden, Netherlands, 1988), azepine (e.g., see Huffman et al. in *Peptides: Chemistry and Biology*, G. R. Marshall ed., ESCOM Publisher: Leiden, Netherlands, 1988), substituted gama lactam rings (Garvey et al. in *Peptides: Chemistry and Biology*, G. R. Marshall ed., ESCOM Publisher: Leiden, Netherlands, 1988), keto-methylene pseudopeptides (Ewenson et al. (1986) *J. Med Chem* 29:295; and Ewenson et al. in *Peptides: Structure and Function* (Proceedings of the 9th American Peptide Symposium) Pierce Chemical Co. Rockland, Ill., 1985), b-turn dipeptide cores (Nagai et al. (1985) *Tetrahedron Lett* 26:647; and Sato et al. (1986) *J Chem Soc Perkin Trans* 1:1231), and b-aminoalcohols (Gordon et al. (1985) *Biochem Biophys Res Commun* 126:419; and et al. (1986) *Biochem Biophys Res Commun* 134:71).

Vaccine Formulations for *K. pneumoniae* Nucleic Acids and Polypeptides

This invention also features vaccine compositions for protection against infection by *K. pneumoniae* or for treatment of *K. pneumoniae* infection. In one embodiment, the vaccine compositions contain one or more immunogenic components such as a surface protein from *K. pneumoniae*, or portion thereof, and a pharmaceutically acceptable carrier. Nucleic acids within the scope of the invention are exemplified by the nucleic acids of the invention contained in the Sequence Listing which encode *K. pneumoniae* surface proteins. Any nucleic acid encoding an immunogenic *K. pneumoniae* protein, or portion thereof, which is capable of expression in a cell, can be used in the present invention. These vaccines have therapeutic and prophylactic utilities.

One aspect of the invention provides a vaccine composition for protection against infection by *K. pneumoniae* which contains at least one immunogenic fragment of an *K. pneumoniae* protein and a pharmaceutically acceptable carrier. Preferred fragments include peptides of at least about 10 amino acid residues in length, preferably about 10–20 amino acid residues in length, and more preferably about 12–16 amino acid residues in length.

Immunogenic components of the invention can be obtained, for example, by screening polypeptides recombinantly produced from the corresponding fragment of the nucleic acid encoding the full-length *K. pneumoniae* protein. In addition, fragments can be chemically synthesized using techniques known in the art such as conventional Merrifield solid phase f-Moc or t-Boc chemistry.

In one embodiment, immunogenic components are identified by the ability of the peptide to stimulate T cells. Peptides which stimulate T cells, as determined by, for example, T cell proliferation or cytokine secretion are defined herein as comprising at least one T cell epitope. T cell epitopes are believed to be involved in initiation and perpetuation of the immune response to the protein allergen which is responsible for the clinical symptoms of allergy. These T cell epitopes are thought to trigger early events at the level of the T helper cell by binding to an appropriate HLA molecule on the surface of an antigen presenting cell, thereby stimulating the T cell subpopulation with the relevant T cell receptor for the epitope. These events lead to T cell proliferation, lymphokine secretion, local inflammatory reactions, recruitment of additional immune cells to the site of antigen/T cell interaction, and activation of the B cell cascade, leading to the production of antibodies. A T cell epitope is the basic element, or smallest unit of recognition by a T cell receptor, where the epitope comprises amino acids essential to receptor recognition (e.g., approximately 6 or 7 amino acid residues). Amino acid sequences which mimic those of the T cell epitopes are within the scope of this invention.

Screening immunogenic components can be accomplished using one or more of several different assays. For example, in vitro, peptide T cell stimulatory activity is assayed by contacting a peptide known or suspected of being immunogenic with an antigen presenting cell which presents appropriate MHC molecules in a T cell culture. Presentation of an immunogenic K. pneumoniae peptide in association with appropriate MHC molecules to T cells in conjunction with the necessary co-stimulation has the effect of transmitting a signal to the T cell that induces the production of increased levels of cytokines, particularly of interleukin-2 and interleukin-4. The culture supernatant can be obtained and assayed for interleukin-2 or other known cytokines. For example, any one of several conventional assays for interleukin-2 can be employed, such as the assay described in *Proc. Natl. Acad. Sci USA*, 86: 1333 (1989) the pertinent portions of which are incorporated herein by reference. A kit for an assay for the production of interferon is also available from Genzyme Corporation (Cambridge, Mass.).

Alternatively, a common assay for T cell proliferation entails measuring tritiated thymidine incorporation. The proliferation of T cells can be measured in vitro by determining the amount of $^3$H-labeled thymidine incorporated into the replicating DNA of cultured cells. Therefore, the rate of DNA synthesis and, in turn, the rate of cell division can be quantified.

Vaccine compositions of the invention containing immunogenic components (e.g., K. pneumoniae polypeptide or fragment thereof or nucleic acid encoding an K. pneumoniae polypeptide or fragment thereof) preferably include a pharmaceutically acceptable carrier. The term "pharmaceutically acceptable carrier" refers to a carrier that does not cause an allergic reaction or other untoward effect in patients to whom it is administered. Suitable pharmaceutically acceptable carriers include, for example, one or more of water, saline, phosphate buffered saline, dextrose, glycerol, ethanol and the like, as well as combinations thereof. Pharmaceutically acceptable carriers may further comprise minor amounts of auxiliary substances such as wetting or emulsifying agents, preservatives or buffers, which enhance the shelf life or effectiveness of the antibody. For vaccines of the invention containing K. pneumoniae polypeptides, the polypeptide is co-administered with a suitable adjuvant.

It will be apparent to those of skill in the art that the therapeutically effective amount of DNA or protein of this invention will depend, inter alia, upon the administration schedule, the unit dose of antibody administered, whether the protein or DNA is administered in combination with other therapeutic agents, the immune status and health of the patient, and the therapeutic activity of the particular protein or DNA.

Vaccine compositions are conventionally administered parenterally, e.g., by injection, either subcutaneously or intramuscularly. Methods for intramuscular immunization are described by Wolff et al. (1990) *Science* 247: 1465–1468 and by Sedegah et al. (1994) *Immunology* 91: 9866–9870. Other modes of administration include oral and pulmonary formulations, suppositories, and transdermal applications. Oral immunization is preferred over parenteral methods for inducing protection against infection by K. pneumoniae. Cain et. al. (1993) *Vaccine* 11: 637–642. Oral formulations include such normally employed excipients as, for example, pharmaceutical grades of mannitol, lactose, starch, magnesium stearate, sodium saccharine, cellulose, magnesium carbonate, and the like.

The vaccine compositions of the invention can include an adjuvant, including, but not limited to aluminum hydroxide; N-acetyl-muramyl-L-threonyl-D-isoglutamine (thr-MDP); N-acetyl-nor-muramyl-L-alanyl-D-isoglutamine (CGP 11637, referred to as nor-MDP); N-acetylmuramyl-L-alanyl-D-isoglutaminyl-L-alanine-2-(1'-2'-dipalmitoyl-sn-glycero-3-hydroxyphos-phoryloxy)-ethylamine (CGP 19835A, referred to a MTP-PE); RIBI, which contains three components from bacteria; monophosphoryl lipid A; trehalose dimycoloate; cell wall skeleton (MPL+TDM+CWS) in a 2% squalene/Tween 80 emulsion; and cholera toxin. Others which may be used are non-toxic derivatives of cholera toxin, including its B subunit, and/or conjugates or genetically engineered fusions of the K. pneumoniae polypeptide with cholera toxin or its B subunit, procholeragenoid, fungal polysaccharides, including schizophyllan, muramyl dipeptide, muramyl dipeptide derivatives, phorbol esters, labile toxin of E. coli, non-K. pneumoniae bacterial lysates, block polymers or saponins.

Other suitable delivery methods include biodegradable microcapsules or immuno-stimulating complexes (ISCOMs), cochleates, or liposomes, genetically engineered attenuated live vectors such as viruses or bacteria, and recombinant (chimeric) virus-like particles, e.g., bluetongue. The amount of adjuvant employed will depend on the type of adjuvant used. For example, when the mucosal adjuvant is cholera toxin, it is suitably used in an amount of 5 mg to 50 mg, for example 10 mg to 35 mg. When used in the form of microcapsules, the amount used will depend on the amount employed in the matrix of the microcapsule to achieve the desired dosage. The determination of this amount is within the skill of a person of ordinary skill in the art.

Carrier systems in humans may include enteric release capsules protecting the antigen from the acidic environment of the stomach, and including K. pneumoniae polypeptide in an insoluble form as fusion proteins. Suitable carriers for the vaccines of the invention are enteric coated capsules and polylactide-glycolide microspheres. Suitable diluents are 0.2 N NaHCO$_3$ and/or saline.

Vaccines of the invention can be administered as a primary prophylactic agent in adults or in children, as a secondary prevention, after successful eradication of K. pneumoniae in an infected host, or as a therapeutic agent in the aim to induce an immune response in a susceptible host to prevent infection by K. pneumoniae. The vaccines of the invention are administered in amounts readily determined by persons of ordinary skill in the art. Thus, for adults a suitable dosage will be in the range of 10 mg to 10 g, preferably 10 mg to 100 mg. A suitable dosage for adults will also be in the range of 5 mg to 500 mg. Similar dosage ranges will be applicable for children. Those skilled in the art will recognize that the optimal dose may be more or less depending upon the patient's body weight, disease, the route of administration, and other factors. Those skilled in the art will also recognize that appropriate dosage levels can be obtained based on results with known oral vaccines such as, for example, a vaccine based on an E. coli lysate (6 mg dose daily up to total of 540 mg) and with an enterotoxigenic E. coli purified antigen (4 doses of 1 mg) (Schulman et al., *J. Urol.* 150:917–921 (1993); Boedecker et al., *American Gastroenterological Assoc.* 999:A-222 (1993)). The number of doses will depend upon the disease, the formulation, and efficacy data from clinical trials. Without intending any limitation as to the course of treatment, the treatment can be administered over 3 to 8 doses for a primary immunization schedule over 1 month (Boedeker, *American Gastroenterological Assoc.* 888:A-222 (1993)).

In a preferred embodiment, a vaccine composition of the invention can be based on a killed whole *E. coli* preparation with an immunogenic fragment of an *K. pneumoniae* protein of the invention expressed on its surface or it can be based on an *E. coli* lysate, wherein the killed *E. coli* acts as a carrier or an adjuvant.

It will be apparent to those skilled in the art that some of the vaccine compositions of the invention are useful only for preventing *K. pneumoniae* infection, some are useful only for treating *K. pneumoniae* infection, and some are useful for both preventing and treating *K. pneumoniae* infection. In a preferred embodiment, the vaccine composition of the invention provides protection against *K. pneumoniae* infection by stimulating humoral and/or cell-mediated immunity against *K. pneumoniae*. It should be understood that amelioration of any of the symptoms of *K. pneumoniae* infection is a desirable clinical goal, including a lessening of the dosage of medication used to treat *K. pneumoniae*-caused disease, or an increase in the production of antibodies in the serum or mucous of patients.

Antibodies Reactive with *K. pneumoniae* Polypeptides

The invention also includes antibodies specifically reactive with the subject *K. pneumoniae* polypeptide. Anti-protein/anti-peptide antisera or monoclonal antibodies can be made by standard protocols (See, for example, *Antibodies: A Laboratory Manual* ed. by Harlow and Lane (Cold Spring Harbor Press: 1988)). A mammal such as a mouse, a hamster or rabbit can be immunized with an immunogenic form of the peptide. Techniques for conferring immunogenicity on a protein or peptide include conjugation to carriers or other techniques well known in the art. An immunogenic portion of the subject *K. pneumoniae* polypeptide can be administered in the presence of adjuvant. The progress of immunization can be monitored by detection of antibody titers in plasma or serum. Standard ELISA or other immunoassays can be used with the immunogen as antigen to assess the levels of antibodies.

In a preferred embodiment, the subject antibodies are immunospecific for antigenic determinants of the *K. pneumoniae* polypeptides of the invention, e.g. antigenic determinants of a polypeptide of the invention contained in the Sequence Listing, or a closely related human or non-human mammalian homolog (e.g., 90% homologous, more preferably at least about 95% homologous). In yet a further preferred embodiment of the invention, the anti-*K. pneumoniae* antibodies do not substantially cross react (i.e., react specifically) with a protein which is for example, less than 80% percent homologous to a sequence of the invention contained in the Sequence Listing. By "not substantially cross react", it is meant that the antibody has a binding affinity for a non-homologous protein which is less than 10 percent, more preferably less than 5 percent, and even more preferably less than 1 percent, of the binding affinity for a protein of the invention contained in the Sequence Listing. In a most preferred embodiment, there is no cross-reactivity between bacterial and mammalian antigens.

The term antibody as used herein is intended to include fragments thereof which are also specifically reactive with *K. pneumoniae* polypeptides. Antibodies can be fragmented using conventional techniques and the fragments screened for utility in the same manner as described above for whole antibodies. For example, F(ab')$_2$ fragments can be generated by treating antibody with pepsin. The resulting F(ab')$_2$ fragment can be treated to reduce disulfide bridges to produce Fab' fragments. The antibody of the invention is further intended to include bispecific and chimeric molecules having an anti-*K. pneumoniae* portion.

Both monoclonal and polyclonal antibodies (Ab) directed against *K. pneumoniae* polypeptides or *K. pneumoniae* polypeptide variants, and antibody fragments such as Fab' and F(ab')$_2$, can be used to block the action of *K. pneumoniae* polypeptide and allow the study of the role of a particular *K. pneumoniae* polypeptide of the invention in aberrant or unwanted intracellular signaling, as well as the normal cellular function of the *K. pneumoniae* and by microinjection of anti-*K. pneumoniae* polypeptide antibodies of the present invention.

Antibodies which specifically bind *K. pneumoniae* epitopes can also be used in immunohistochemical staining of tissue samples in order to evaluate the abundance and pattern of expression of *K. pneumoniae* antigens. Anti-*K. pneumoniae* polypeptide antibodies can be used diagnostically in immuno-precipitation and immuno-blotting to detect and evaluate *K. pneumoniae* levels in tissue or bodily fluid as part of a clinical testing procedure. Likewise, the ability to monitor *K. pneumoniae* polypeptide levels in an individual can allow determination of the efficacy of a given treatment regimen for an individual afflicted with such a disorder. The level of an *K. pneumoniae* polypeptide can be measured in cells found in bodily fluid, such as in urine samples or can be measured in tissue, such as produced by gastric biopsy. Diagnostic assays using anti-*K. pneumoniae* antibodies can include, for example, immnunoassays designed to aid in early diagnosis of *K. pneumoniae* infections. The present invention can also be used as a method of detecting antibodies contained in samples from individuals infected by this bacterium using specific *K. pneumoniae* antigens.

Another application of anti-*K. pneumoniae* polypeptide antibodies of the invention is in the immunological screening of cDNA libraries constructed in expression vectors such as λgt11, λgt18–23, λZAP, and λORF8. Messenger libraries of this type, having coding sequences inserted in the correct reading frame and orientation, can produce fusion proteins. For instance, λgt11 will produce fusion proteins whose amino termini consist of β-galactosidase amino acid sequences and whose carboxy termini consist of a foreign polypeptide. Antigenic epitopes of a subject *K. pneumoniae* polypeptide can then be detected with antibodies, as, for example, reacting nitrocellulose filters lifted from infected plates with anti-*K. pneumoniae* polypeptide antibodies. Phage, scored by this assay, can then be isolated from the infected plate. Thus, the presence of *K. pneumoniae* gene homologs can be detected and cloned from other species, and alternate isoforms (including splicing variants) can be detected and cloned.

Kits Containing Nucleic Acids, Polypeptides or Antibodies of the Invention

The nucleic acid, polypeptides and antibodies of the invention can be combined with other reagents and articles to form kits. Kits for diagnostic purposes typically comprise the nucleic acid, polypeptides or antibodies in vials or other suitable vessels. Kits typically comprise other reagents for performing hybridization reactions, polymerase chain reactions (PCR), or for reconstitution of lyophilized components, such as aqueous media, salts, buffers, and the like. Kits may also comprise reagents for sample processing such as detergents, chaotropic salts and the like. Kits may also comprise immobilization means such as particles, supports, wells, dipsticks and the like. Kits may also comprise labeling means such as dyes, developing reagents, radioisotopes, fluorescent agents, luminescent or chemiluminescent agents, enzymes, intercalating agents and the like. With the nucleic acid and amino acid sequence information provided herein, individuals skilled in art can readily assemble kits to serve their particular purpose. Kits further can include instructions for use.

Bio Chip Technology

The nucleic acid sequence of the present invention may be used to detect K. pneumoniae or other species of Klebsiella acid sequence using bio chip technology. Bio chips containing arrays of nucleic acid sequence can also be used to measure expression of genes of K. pneumoniae or other species of Klebsiella. For example, to diagnose a patient with a K. pneumoniae or other Klebsiella infection, a sample from a human or animal can be used as a probe on a bio chip containing an array of nucleic acid sequence from the present invention. In addition, a sample from a disease state can be compared to a sample from a non-disease state which would help identify a gene that is up-regulated or expressed in the disease state. This would provide valuable insight as to the mechanism by which the disease manifests. Changes in gene expression can also be used to identify critical pathways involved in drug transport or metabolism, and may enable the identification of novel targets involved in virulence or host cell interactions involved in maintenance of an infection. Procedures using such techniques have been described by Brown et al., 1995, *Science* 270: 467–470.

Bio chips can also be used to monitor the genetic changes of potential therapeutic compounds including, deletions, insertions or mismatches. Once the therapeutic is added to the patient, changes to the genetic sequence can be evaluated for its efficacy. In addition, the nucleic acid sequence of the present invention can be used to determine essential genes in cell cycling. As described in Iyer et al., 1999 (*Science*, 283:83–87) genes essential in the cell cycle can be identified using bio chips. Furthermore, the present invention provides nucleic acid sequence which can be used with bio chip technology to understand regulatory networks in bacteria, measure the response to environmental signals or drugs as in drug screening, and study virulence induction. (Mons et al., 1998, *Nature Biotechnology*, 16: 45–48. Patents teaching this technology include U.S. Pat. Nos. 5,445,934, 5,744,305, and 5,800,992.

Drug Screening Assays Using K. pneumoniae Polypeptides

By making available purified and recombinant K. pneumoniae polypeptides, the present invention provides assays which can be used to screen for drugs which are either agonists or antagonists of the normal cellular function, in this case, of the subject K. pneumoniae polypeptides, or of their role in intracellular signaling. Such inhibitors or potentiators may be useful as new therapeutic agents to combat K. pneumoniae infections in humans. A variety of assay formats will suffice and, in light of the present inventions, will be comprehended by the person skilled in the art.

In many drug screening programs which test libraries of compounds and natural extracts, high throughput assays are desirable in order to maximize the number of compounds surveyed in a given period of time. Assays which are performed in cell-free systems, such as may be derived with purified or semi-purified proteins, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or change in enzymatic properties of the molecular target. Accordingly, in an exemplary screening assay of the present invention, the compound of interest is contacted with an isolated and purified K. pneumoniae polypeptide.

Screening assays can be constructed in vitro with a purified K. pneumoniae polypeptide or fragment thereof, such as an K. pneumoniae polypeptide having enzymatic activity, such that the activity of the polypeptide produces a detectable reaction product. The efficacy of the compound can be assessed by generating dose response curves from data obtained using various concentrations of the test compound. Moreover, a control assay can also be performed to provide a baseline for comparison. Suitable products include those with distinctive absorption, fluorescence, or chemiluminescence properties, for example, because detection may be easily automated. A variety of synthetic or naturally occurring compounds can be tested in the assay to identify those which inhibit or potentiate the activity of the K pneumoniae polypeptide. Some of these active compounds may directly, or with chemical alterations to promote membrane permeability or solubility, also inhibit or potentiate the same activity (e.g., enzymatic activity) in whole, live *K. pneumoniae* cells.

Overexpression Assays

Overexpression assays are based on the premise that overproduction of a protein would lead to a higher level of resistance to compounds that selectively interfere with the function of that protein. Overexpression assays may be used to identify compounds that interfere with the function of virtually any type of protein, including without limitation enzymes, receptors, DNA- or RNA-binding proteins, or any proteins that are directly or indirectly involved in regulating cell growth.

Typically, two bacterial strains are constructed. One contains a single copy of the gene of interest, and a second contains several copies of the same gene. Identification of useful inhibitory compounds of this type of assay is based on a comparison of the activity of a test compound in inhibiting growth and/or viability of the two strains. The method involves constructing a nucleic acid vector that directs high level expression of a particular target nucleic acid. The vectors are then transformed into host cells in single or multiple copies to produce strains that express low to moderate and high levels of protein encoding by the target sequence (strain A and B, respectively). Nucleic acid comprising sequences encoding the target gene can, of course, be directly integrated into the host cell.

Large numbers of compounds (or crude substances which may contain active compounds) are screened for their effect on the growth of the two strains. Agents which interfere with an unrelated target equally inhibit the growth of both strains. Agents which interfere with the function of the target at high concentration should inhibit the growth of both strains. It should be possible, however, to titrate out the inhibitory effect of the compound in the overexpressing strain. That is, if the compound is affecting the particular target that is being tested, it should be possible to inhibit the growth of strain A at a concentration of the compound that allows strain B to grow.

Alternatively, a bacterial strain is constructed that contains the gene of interest under the control of an inducible promoter. Identification of useful inhibitory agents using this type of assay is based on a comparison of the activity of a test compound in inhibiting growth and/or viability of this strain under both inducing and non-inducing conditions. The method involves constructing a nucleic acid vector that directs high-level expression of a particular target nucleic acid. The vector is then transformed into host cells that are grown under both non-inducing and inducing conditions (conditions A and B, respectively).

Large numbers of compounds (or crude substances which may contain active compounds) are screened for their effect on growth under these two conditions. Agents that interfere with the function of the target should inhibit growth under both conditions. It should be possible, however, to titrate out the inhibitory effect of the compound in the overexpressing strain. That is, if the compound is affecting the particular target that is being tested, it should be possible to inhibit growth under condition A at a concentration that allows the strain to grow under condition B.

Ligand-binding Assays

Many of the targets according to the invention have functions that have not yet been dentified. Ligand-binding assays are useful to identify inhibitor compounds that interfere with the function of a particular target, even when that function is unknown. These assays are designed to detect binding of test compounds to particular targets. The detection may involve direct measurement of binding. Alternatively, indirect indications of binding may involve stabilization of protein structure or disruption of a biological function. Non-limiting examples of useful ligand-binding assays are detailed below.

A useful method for the detection and isolation of binding proteins is the Biomolecular Interaction Assay (BIAcore) system developed by Pharmacia Biosensor and described in the manufacturer's protocol (LKB Pharmacia, Sweden). The BIAcore system uses an affinity purified anti-GST antibody to immobilize GST-fusion proteins onto a sensor chip. The sensor utilizes surface plasmon resonance which is an optical phenomenon that detects changes in refractive indices. In accordance with the practice of the invention, a protein of interest is coated onto a chip and test compounds are passed over the chip. Binding is detected by a change in the refractive index (surface plasmon resonance).

A different type of ligand-binding assay involves scintillation proximity assays (SPA, described in U.S. Pat. No. 4,568,649).

Another type of ligand binding assay, also undergoing development, is based on the fact that proteins containing mitochondrial targeting signals are imported into isolated mitochondria in vitro (Hurt et al., 1985, Embo J. 4:2061–2068; Eilers and Schatz, Nature, 1986, 322:228–231). In a mitochondrial import assay, expression vectors are constructed in which nucleic acids encoding particular target proteins are inserted downstream of sequences encoding mitochondrial import signals. The chimeric proteins are synthesized and tested for their ability to be imported into isolated mitochondria in the absence and presence of test compounds. A test compound that binds to the target protein should inhibit its uptake into isolated mitochondria in vitro.

Another ligand-binding assay is the yeast two-hybrid system (Fields and Song, 1989, Nature 340:245–246). The yeast two-hybrid system takes advantage of the properties of the GAL4 protein of the yeast Saccharomyces cerevisiae. The GAL4 protein is a transcriptional activator required for the expression of genes encoding enzymes of galactose utilization. This protein consists of two separable and functionally essential domains: an N-terminal domain which binds to specific DNA sequences ($UAS_G$); and a C-terminal domain containing acidic regions, which is necessary to activate transcription. The native GAL4 protein, containing both domains, is a potent activator of transcription when yeast are grown on galactose media. The N-terminal domain binds to DNA in a sequence-specific manner but is unable to activate transcription. The C-terminal domain contains the activating regions but cannot activate transcription because it fails to be localized to $UAS_G$. In the two-hybrid system, a system of two hybrid proteins containing parts of GAL4: (1) a GAL4 DNA-binding domain fused to a protein 'X' and (2) a GAL4 activation region fused to a protein 'Y'. If X and Y can form a protein-protein complex and reconstitute proximity of the GAL4 domains, transcription of a gene regulated by $UAS_G$ occurs. Creation of two hybrid proteins, each containing one of the interacting proteins X and Y, allows the activation region of $UAS_G$ to be brought to its normal site of action.

The binding assay described in Fodor et al., 1991, Science 251:767–773, which involves testing the binding affinity of test compounds for a plurality of defined polymers synthesized on a solid substrate, may also be useful.

Compounds which bind to the polypeptides of the invention are potentially useful as antibacterial agents for use in therapeutic compositions.

Pharmaceutical formulations suitable for antibacterial therapy comprise the antibacterial agent in conjunction with one or more biologically acceptable carriers. Suitable biologically acceptable carriers include, but are not limited to, phosphate-buffered saline, saline, deionized water, or the like. Preferred biologically acceptable carriers are physiologically or pharmaceutically acceptable carriers.

The antibacterial compositions include an antibacterial effective amount of active agent. Antibacterial effective amounts are those quantities of the antibacterial agents of the present invention that afford prophylactic protection against bacterial infections or which result in amelioration or cure of an existing bacterial infection. This antibacterial effective amount will depend upon the agent, the location and nature of the infection, and the particular host. The amount can be determined by experimentation known in the art, such as by establishing a matrix of dosages and frequencies and comparing a group of experimental units or subjects to each point in the matrix.

The antibacterial active agents or compositions can be formed into dosage unit forms, such as for example, creams, ointments, lotions, powders, liquids, tablets, capsules, suppositories, sprays, aerosols or the like. If the antibacterial composition is formulated into a dosage unit form, the dosage unit form may contain an antibacterial effective amount of active agent. Alternatively, the dosage unit form may include less than such an amount if multiple dosage unit forms or multiple dosages are to be used to administer a total dosage of the active agent. Dosage unit forms can include, in addition, one or more excipient(s), diluent(s), disintegrant(s), lubricant(s), plasticizer(s), colorant(s), dosage vehicle(s), absorption enhancer(s), stabilizer(s), bactericide(s), or the like.

For general information concerning formulations, see, e.g., Gilman et al. (eds.), 1990, *Goodman and Gilman's: The Pharmacological Basis of Therapeutics*, 8th ed., Pergamon Press; and *Remington's Pharmaceutical Sciences*, 17th ed., 1990, Mack Publishing Co., Easton, Pa.; Avis et al. (eds.), 1993, *Pharmaceutical Dosage Forms: Parenteral Medications*, Dekker, New York; Lieberman et al (eds.), 1990, *Pharmaceutical Dosage Forms: Disperse Systems*, Dekker, New York.

The antibacterial agents and compositions of the present invention are useful for preventing or treating *K. pneumoniae* infections. Infection prevention methods incorporate a prophylactically effective amount of an antibacterial agent or composition. A prophylactically effective amount is an amount effective to prevent *K. pneumoniae* infection and will depend upon the specific bacterial strain, the agent, and the host. These amounts can be determined experimentally by methods known in the art and as described above.

*K. pneumoniae* infection treatment methods incorporate a therapeutically effective amount of an antibacterial agent or composition. A therapeutically effective amount is an amount sufficient to ameliorate or eliminate the infection. The prophylactically and/or therapeutically effective amounts can be administered in one administration or over repeated admninistrations. Therapeutic administration can be followed by prophylactic administration, once the initial bacterial infection has been resolved.

The antibacterial agents and compositions can be administered topically or systemically. Topical application is typically achieved by administration of creams, ointments, lotions, or sprays as described above. Systemic administration includes both oral and parental routes. Parental routes include, without limitation, subcutaneous, intramuscular, intraperitoneal, intravenous, transdermal, inhalation and intranasal administration.

EXEMPLIFICATION

Cloning and Sequencing *K. pneumoniae* Genornic Sequence

This invention provides nucleotide sequences of the genome of *K. pneumoniae* which thus comprises a DNA sequence library of *K. pneumoniae* genomic DNA. The invention also provides nucleotide sequences of two naturally occurring plasmids in *K. pneumoniae*. The detailed description that follows provides nucleotide sequences of *K. pneumoniae*, and also describes how the sequences were obtained and how ORFs (Open Reading Frames) and protein-coding sequences can be identified. Also described are methods of using the disclosed *K. pneumoniae* sequences in methods including diagnostic and therapeutic applications. Furthermore, the library can be used as a database for identification and comparison of medically important sequences in this and other strains of *K. pneumoniae* as well as other species of Klebsiella.

Chromosomal DNA from strain 93,19097 of *K. pneumoniae*, was isolated using a protocol described by Storrs, et al.(*J. Bacteriol.* 173: 4347–4352 (1991). The only exception to this protocol was that lysostaphin (120 U/ml) was used instead of lysozyme. Two endogenous plasmids of approximately 39 Kb and 2.9 Kb in size were identified upon visualization of the *K. pneumoniae* genomic DNA on a 0.5% agarose gel. The first library constructed contained fragments from the *K. pneumoniae* genome as well as from the endogenous plasmid. A second library was later constructed with genomic DNA, from which the plasmid DNA was removed by CsCl centrifugation. The genomic DNA prep involved a lysozyme:lysostaphin digestion, sodium dodecyl sulfate lysis, Proteinase K and RNase treatment, phenol:chloroform extraction, and sodium acetate precipitation, followed by the CsCl gradient to remove the plasmid.

In the construction of both libraries, genomic *K. pneumoniae* DNA was hydrodynamically sheared in an HPLC and then separated on a standard 1% agarose gel. A fraction corresponding to 2000–3000 bp in length was excised from the gel and purifed by the GeneClean procedure (Bio101, Inc.).

The purified DNA fragments were then blunt-ended using T4 DNA polymerase. The healed DNA was then ligated to unique BstXI-linker adapters (5'-GTCTTCACCACGGGG-3' and 5'-GTGGTGAAGAC-3' in 100–1000 fold molar excess). These linkers are complimentary to the BstXI-cut pGTC vector, while the overhang is not self-complimentary. Therefore, the linkers will not concatermerize nor will the cut-vector religate itself easily. The linker-adapted inserts were separated from the unincorporated linkers on a 1% agarose gel and purified using GeneClean. The linker-adapted inserts were then ligated to BstXI-cut vector to construct a "shotgun" sublclone libraries.

Only major modifications to the protocols are highlighted. Briefly, the library was then transformed into DH5á competent cells (Gibco/BRL, DH5 transformation protocol). It was assessed by plating onto antibiotic plates containing ampicillin and IPTG/Xgal. The plates were incubated overnight at 37° C. Transformants were then used for plating of clones and picking for sequencing. The cultures were grown overnight at 37° C. DNA was purified using a silica bead DNA preparation (Engelstein, 1996) method. In this manner, 25 μg of DNA was obtained per clone.

These purified DNA samples were then sequenced using primarily ABI dye-terminator chemistry. All subsequent steps were based on sequencing by ABI377 automated DNA sequencing methods. The ABI dye terminator sequence reads were run on ABI377 machines and the data was transferred to UNIX machines following lane tracking of the gels. Base calls and quality scores were determined using the program PHRED (Ewing et al., 1998, Genome Res. 8: 175–185; Ewing and Green, 1998, Genome Res. 8: 685–734). Reads were assembled using PHRAP (P. Green, Abstracts of DOE Human Genome Program Contractor-Grantee Workshop V, January 1996, p.157) with default program parameters and quality scores.

Finishing followed the initial assembly. Missing mates (sequences from clones that only gave reads from one end of the Klebsiella DNA inserted in the plasmid) were identified and sequenced with ABI technology to allow the identification of additional overlapping contigs.

End-sequencing of randomly picked genomic lambda was also performed. Sequencing of both sides was done for all lambda sequences. The lambda library backbone helped to verify the integrity of the assembly and allowed closure of some of the physical gaps. Primers for walking off the ends of contigs would be selected using pick_primer (a GTC program) near the ends of the clones to facilitate gap closure. These walks can be sequenced using the selected clones and primers. These data are then reassembled with PHRAP. Additional sequencing using PCR-generated templates and screened and/or unscreened lambda templates can be done in addition.

Additional templates for the physical gaps were obtained through PCR using primers designed from the ends of the contigs. These templates were then used in sequencing reactions to close the gaps.

Contigs were ordered by aligning identified *K. pneumoniae* genes to the published physical maps. Order was confirmed by PCR. The final chromosomal assembly included 36 ordered contigs and the two plasmids. The megaplasmid contained 7 contigs and the other plasmid contained 1 contig.

To identify *K. pneumoniae* polypeptides the complete genormic sequence of *K. pneumoniae* were analyzed essentially as follows: First, all possible stop-to-stop open reading frames (ORFs) greater than 180 nucleotides in all six reading frames were translated into amino acid sequences. Second, the identified ORFs were analyzed for homology to known (archeabacter, prokaryotic and eukaryotic) protein sequences. Third, the coding potential of non-homologous sequences were evaluated with the program GEN-EMARK™ (Borodovsky and McIninch, 1993, Comp. Chem. 17:123)

Identification, Cloning and Expression of *K. pneumoniae* Nucleic Acids

Expression and purification of the *K. pneumoniae* polypeptides of the invention can be performed essentially as outlined below.

To facilitate the cloning, expression and purification of membrane and secreted proteins from *K. pneumoniae*, a gene expression system, such as the pET System (Novagen), for cloning and expression of recombinant proteins in *E. coli*, is selected. Also, a DNA sequence encoding a peptide tag, the His-Tag, is fused to the 3' end of DNA sequences of interest in order to facilitate purification of the recombinant protein products. The 3' end is selected for fusion in order to avoid alteration of any 5' terminal signal sequence.

PCR Amplification and Cloning of Nucleic Acids Containing ORF's Encodin Enzymes

Nucleic acids chosen (for example, from the nucleic acids set forth in SEQ ID NO: 1–SEQ ID NO: 7171 for cloning from the 93,19097 strain of *K. pneumoniae* and plasmids are prepared for amplification cloning by polymerase chain reaction (PCR). Synthetic oligonucleotide primers specific for the 5' and 3' ends of open reading frames (ORFs) are designed and purchased from GibcoBRL Life Technologies (Gaithersburg, Md., USA). All forward primers (specific for the 5' end of the sequence) are designed to include an NcoI cloning site at the extreme 5' terminus. These primers are designed to permit initiation of protein translation at a methionine residue followed by a valine residue and the coding sequence for the remainder of the native *K. pneumoniae* DNA sequence. All reverse primers (specific for the 3' end of any *K. pneumoniae* ORF) include a EcoRI site at the extreme 5' terminus to permit cloning of each *K. pneumoniae* sequence into the reading frame of the pET-28b. The pET-28b vector provides sequence encoding an additional 20 carboxy-terminal amino acids including six histidine residues (at the extreme C-terminus), which comprise the His-Tag.

Genomic DNA or plasmid DNA prepared from the 93,19097 strain of *K. pneumoniae* is used as the source of template DNA for PCR amplification reactions (Current Protocols in Molecular Biology, John Wiley and Sons, Inc., F. Ausubel et al., eds., 1994). To amplify a DNA sequence containing an *K. pneumoniae* ORF, genomic DNA (50 nanograms) is introduced into a reaction vial containing 2 mM $MgCl_2$, 1 micromolar synthetic oligonucleotide primers (forward and reverse primers) complementary to and flanking a defined *K. pneumoniae* ORF, 0.2 mM of each deoxynucleotide triphosphate; dATP, dGTP, dCTP, dTTP and 2.5 units of heat stable DNA polymerase (Amplitaq, Roche Molecular Systems, Inc., Branchburg, N.J., USA) in a final volume of 100 microliters.

Upon completion of thermal cycling reactions, each sample of amplified DNA is washed and purified using the Qiaquick Spin PCR purification kit (Qiagen, Gaithersburg, Md., USA). All amplified DNA samples are subjected to digestion with the restriction endonucleases, e.g., NcoI and EcoRI (New England BioLabs, Beverly, Mass., USA) (Current Protocols in Molecular Biology, John Wiley and Sons, Inc., F. Ausubel et al., eds., 1994). DNA samples are then subjected to electrophoresis on 1.0% NuSeive (FMC BioProducts, Rockland, Me. USA) agarose gels. DNA is visualized by exposure to ethidiun bromide and long wave uv irradiation., DNA contained in slices isolated from the agarose gel is purified using the Bio 101 GeneClean Kit protocol (Bio 101 Vista, Calif., USA).

Cloning of *K. pneumoniae* Nucleic Acids Into an Expression Vector

The pET-28b vector is prepared for cloning by digestion with restriction endonucleases, e.g., NcoI and EcoRI (Current Protocols in Molecular Biology, John Wiley and Sons, Inc., F. Ausubel et al., eds., 1994). The pET-28a vector, which encodes a His-Tag that can be fused to the 5 end of an inserted gene, is prepared by digestion with appropriate restriction endonucleases.

Following digestion, DNA inserts are cloned (Current Protocols in Molecular Biology, John Wiley and Sons, Inc., F. Ausubel et al., eds., 1994) into the previously digested pET-28b expression vector. Products of the ligation reaction are then used to transform the BL21 strain of *E. coli* (Current Protocols in Molecular Biology, John Wiley and Sons, Inc., F. Ausubel et al., eds., 1994) as described below.

Transformation of Competent Bacteria with Recombinant Plasmids

Competent bacteria, *E coli* strain BL21 or *E. coli* strain BL21(DE3), are transformed with recombinant pET expression plasmids carrying the cloned *K. pneumoniae* sequences according to standard methods (Current Protocols in Molecular, John Wiley and Sons, Inc., F. Ausubel et al., eds., I1994). Briefly, 1 microliters of ligation reaction is mixed with 50 microliters of electrocompetent cells and subjected to a high voltage pulse, after which, samples are incubated in 0.45 milliliters SOC medium (0.5% yeast extract, 2.0% tryptone, 10 mM NaCl, 2.5 mM KCl, 10 mM MgC12, 10 mM MgSO4 and 20, mM glucose) at 37° C. with shaking for 1 hour. Samples are then spread on LB agar plates containing 25 microgram/ml kanamycin sulfate for growth overnight. Transformed colonies of BL21 are then picked and analyzed to evaluate cloned inserts as described below.

Identification Of Recombinant Expression Vectors With K. pneumoniae Nucleic Acids Individual BL21 clones transformed with recombinant pET-28b K. pneumoniae ORFs are analyzed by PCR amplification of the cloned inserts using the same forward and reverse primers, specific for each K. pneumoniae sequence, that were used in the original PCR amplification cloning reactions. Successful amplification verifies the integration of the K. pneumoniae sequences in the expression vector (Current Protocols in Molecular Biology, John Wiley and Sons, Inc., F. Ausubel et al., eds., 1994).

Isolation and Preparation of Nucleic Acids From Transformants

Individual clones of recombinant pET-28b vectors carrying properly cloned K. pneumoniae ORFs are picked and incubated in 5 mls of LB broth plus 25 microgram/ml kanamycin sulfate overnight. The following day plasmid DNA is isolated and purified using the Qiagen plasmid purification protocol (Qiagen Inc., Chatsworth, Calif., USA).

Expression Of Recombinant K. pneumoniae Sequences In E. coli

The pET vector can be propagated in any E. coli K-12 strain e.g. HMS 174, HB101, JM109, DH5, etc. for the purpose of cloning or plasmid preparation. Hosts for expression include E. coli strains containing a chromosomal copy of the gene for T7 RNA polymerase. These hosts are lysogens of bacteriophage DE3, a lambda derivative that carries the lacI gene, the lacUV5 promoter and the gene for T7 RNA polymerase. T7 RNA polymnerase is induced by addition of isopropyl-B-D-thogalactoside (IPTG), and the T7 RNA polymerase transcribes any target plasmid, such as pET-28b, carrying its gene of interest. Strains used include: BL21(DE3) (Studier, F. W., Rosenberg, A. H., Dunn, J. J., and Dubendorff, J. W. (1990) Meth. Enzymol. 185, 60–89).

To express recombinant K. pneumoniae sequences, 50 nanogramns of plasmid DNA isolated as described above is used to transform competent BL21 (DE3) bacteria as described above (provided by Novagen as part of the pET expression system kit). The lacZ gene (beta-galactosidase) is expressed in the pET-System as described for the K. pneumoniae recombinant constructions. Transformed cells are cultured in SOC medium for 1 hour, and the culture is then plated on LB plates containing 25 micrograms/ml kanamycin sulfate. The following day, bacterial colonies are pooled and grown in LB medium containing kanamycin sulfate (25 micrograms/ml) to an optical density at 600 nM of 0.5 to 1.0 O.D. units, at which point, 1 millimolar IPTG was added to the culture for 3 hours to induce gene expression of the K. pneumoniae recombinant DNA constructions.

After induction of gene expression with IPTG, bacteria are pelleted by centrifugation in a Sorvall RC-3B centrifuge at 3500×g for 15 minutes at 4° C. Pellets are resuspended in 50 milliliters of cold 10 mM Tris-HCl, pH 8.0, 0.1 M NaCl and 0.1 mM EDTA (STE buffer). Cells are then centrifuged at 2000×g for 20 min at 4° C. Wet pellets are weighed and frozen at −80° C. until ready for protein purification.

A variety of methodologies known in the art can be utilized to purify the isolated proteins. (Current Protocols in Protein Science, John Wiley and Sons, Inc., J. E. Coligan et al., eds., 1995). For example, the frozen cells may be thawed, resuspended in buffer and ruptured by several passages through a small volume microfluidizer (Model M-110S, Microflulidics International Corporation, Newton, Mass.). The resultant homogenate may be centrifuged to yield a clear supernatant (crude extract) and following filtration the crude extract may be fractionated over columns. Fractions may be monitored by absorbance at $OD_{280}$ nm. and peak fractions may analyzed by SDS-PAGE The concentrations of purified protein preparations may be quantified spectrophotometrically using absorbance coefficients calculated from amino acid content (Perkins, S. J. 1986 Eur. J. Biochem, 157, 169–180). Protein concentrations are also measured by the method of Bradford, M. M. (I1976) Anal. Biochem. 72, 248–254, and Lowry, O. H., Rosebrough, N., Farr, A. L. & Randall, R. J. (I195 1) J. Biol. Chem. 193, pages 265–275, using bovine serum albumin as a standard.

SDS-polyacrylamide gels of various concentrations may be purchased from BioRad (Hercules, Calif., USA), and stained with Coomassie blue. Molecular weight markers may include rabbit skeletal muscle myosin (200 kDa), E. coli (-galactosidase (116 kDa), rabbit muscle phosphorylase B (97.4 kDa), bovine serum albumin (66.2 kDa), ovalbumin (45 kDa), bovine carbonic anhydrase (31 kDa), soybean trypsin inhibitor (21.5 kDa), egg white lysozyme (14.4 kDa) and bovine aprotinin (6.5 kDa).

EQUIVALENTS

Those skilled in the art will recognize, or be able to ascertain using no more than routine experimentation, many equivalents to the specific embodiments and methods described herein. The specific embodiments described herein are offered by way of example only, and the invention is to limited only by the terms of the appended claims, along with the full scope of equivalents to which such claims are entitled.

TABLE 2

| ORF Name | NT ID | AA ID | NT LN | AA LN | Score | P-value |
|---|---|---|---|---|---|---|
| 10042200_f1_6 | 1 | 7172 | 741 | 246 | 1153 | 5.5e-117 |

Description sp:[LN:PUR2_SALTY] [AC:P26977] [GN:PURD] [OR:Salmonella typhimurium]
[EC:6.3.4.13] [DE:RIBONUCLEOTIDE SYNTHETASE) (PHOSPHORIBOSYLGLYCINAMIDE
SYNTHETASE)] [SP:P26977] [DB:swissprot] >sp:[LN:S18489] [AC:S18489]
[PN:phosphoribosylamine--glycine ligase,] [CL:phosphoribosylamine--glycine
ligase:phosphoribosylamine--glycine ligase homology] [OR:Salmonella typhimurium]
[EC:6.3.4.13] [DB:pir1] >gp:[GI:g154288] [LN:STYPURHD] [AC:M66160]
[PN:5-phosphoribosylglycinamide synthetase] [GN:purD] [FN:purine biosynthesis]
[OR:Salmonella typhimurium] [SR:S.typhimurium (strain Q1) DNA] [DB:genpept-bct1]
[EC:6.3.4.13] [DE:S.typhimurium 5-phosphoribosyl
5-aminoimidazole-4-carboxamidetransformylase (purH), 3' end, and
5-phosphoribosylglycinamidesynthetase (purD) gene, complete cds.]
[NT:5-phosphoribosylglycinamide synthetase is involved] [LE:1539] [RE:2828]
[DI:direct]

| ORF Name | NT ID | AA ID | NT LN | AA LN | Score | P-value |
|---|---|---|---|---|---|---|
| 12369501_f2_64 | 2 | 7173 | 684 | 227 | 972 | 8.3e-98 |

Description sp:[LN:THIE_ECOLI] [AC:P30137] [GN:THIE] [OR:Escherichia coli] [EC:2.5.1.3]
[DE:PYROPHOSPHORYLASE) (TMP-PPASE) (THIAMINE-PHOSPHATE SYNTHASE)] [SP:P30137]
[DB:swissprot] >sp:[LN:S35118] [AC:S35118:D65206] [PN:thiamin-phosphate
pyrophosphorylase, thiE] [GN:thiE] [CL:thiE protein:thiamin-phosphate
pyrophosphorylase homology] [OR:Escherichia coli] [EC:2.5.1.3] [DB:pir1]
>gp:[GI:g1790426] [LN:AE000473] [AC:AE000473:U00096] [PN:thiamin biosynthesis,
thiazole moiety] [GN:thiE] [FN:enzyme; Biosynthesis of cofactors, carriers:]
[OR:Escherichia coli] [DB:genpept-bct2] [DE:Escherichia coli K-12 MG1655 section
363 of 400 of the completegenome.] [NT:f211; 100 pct identical amino acid
sequence and] [LE:3931] [RE:4566] [DI:complement] >gp:[GI:g396332] [LN:ECOUW89]
[AC:U00006] [GN:thiE] [FN:thiamine biosynthesis] [OR:Escherichia coli]
[SR:Escherichia coli (sub_strain MG1655, strain K-12) (library: lambda]
[DB:genpept-bct2] [DE:E. coli chromosomal region from 89.2 to 92.8 minutes.]
[LE:58810] [RE:59445] [DI:complement] >gp:[GI:g414233] [LN:ECTHICEFGH]
[AC:M88701] [GN:thiE] [OR:Escherichia coli] [DB:genpept-bct2] [DE:Escherichia
coli thiCEFSGH operon, complete cds.] [LE:2156] [RE:2791] [DI:direct]

| ORF Name | NT ID | AA ID | NT/LN | AA/LN | Score | P-value |
|---|---|---|---|---|---|---|
| 13129066_f3_122 | 3 | 7174 | 492 | 163 | 156 | 2.5e-11 |

Description sp:[LN:A71217] [AC:A71217] [PN:hypothetical protein PH2001] [GN:PH2001]
[CL:Pyrococcus horikoshii hypothetical protein PH2001] [OR:Pyrococcus horikoshii]
[DB:pir2] >gp:[GI:d1032901:g3130281] [LN:AP000001]
[AC:AP000001:AB009465:AB009464:AB009466:AB009467:AB009468:AB009469] [PN:147aa
long hypothetical protein] [GN:PH2001] [OR:Pyrococcus horikoshii] [SR:Pyrococcus
horikoshii (strain:OT3) DNA] [DB:genpept-bct1] [DE:Pyrococcus horikoshii OT3
genomic DNA, 1-287000 nt. position (1/7).] [LE:AP000007.1:253133:1]
[RE:253505:71] [DI:directJoin]

| ORF Name | NT ID | AA ID | NT/LN | AA/LN | Score | P-value |
|---|---|---|---|---|---|---|
| 13859792_c3_186 | 4 | 7175 | 459 | 152 | 703 | 2.7e-69 |

Description sp:[LN:R5EC11] [AC:S12572:A02786:B65205:C35139] [PN:ribosomal protein L11]
[GN:rplK] [CL:Escherichia coli ribosomal protein L11] [OR:Escherichia coli]
[DB:pir1] [MP:90 min] >gp:[GI:g2367334] [LN:AE000472] [AC:AE000472:U00096]
[PN:50S ribosomal subunit protein L11] [GN:rplK] [FN:structural component;
Ribosomal proteins -] [OR:Escherichia coli] [DB:genpept-bct2] [DE:Escherichia
coli K-12 MG1655 section 362 of 400 of the completegenome.] [NT:o142; 99 pct
identical amino acid sequence and] [LE:3410] [RE:3838] [DI:direct]

| ORF Name | NT ID | AA ID | NT/LN | AA/LN | Score | P-value |
|---|---|---|---|---|---|---|
| 14094452_c2_151 | 5 | 7176 | 366 | 121 | 557 | 7.9e-54 |

Description sp:[LN:R5EB12] [AC:S12828:S10896:S12165] [PN:ribosomal protein L7/L12] [GN:rplL]
[CL:Escherichia coli ribosomal protein L12] [OR:Salmonella typhimurium] [DB:pir1]
>gp:[GI:g47917] [LN:STRPLJL] [AC:X53072] [OR:Salmonella typhimurium]
[DB:genpept-bct1] [DE:S. typhimurium rplJ and rplL genes for ribosomal protein
L10 andL7/L12.] [NT:ribosomal protein L7 /L12 (AA 1-121)] [SP:P18081] [LE:754]
[RE:1119] [DI:direct]

| ORF Name | NT ID | AA ID | NT LN | AA LN | Score | P-value |
|---|---|---|---|---|---|---|
| 16257951_f3_104 | 6 | 7177 | 1908 | 635 | 3062 | 0.0 |

Description sp:[LN:THIC_ECOLI] [AC:P30136] [GN:THIC] [OR:Escherichia coli] [DE:THIAMINE
BIOSYNTHESIS PROTEIN THIC] [SP:P30136] [DB:swissprot] >sp:[LN:E65206]
[AC:E65206:S35117] [PN:thiC protein] [GN:thiC] [OR:Escherichia coli] [DB:pir2]
>gp:[GI:g1790427] [LN:AE000473] [AC:AE000473:U00096] [PN:thiamin biosynthesis,
pyrimidine moiety] [GN:thiC] [FN:enzyme; Biosynthesis of cofactors, carriers:]
[OR:Escherichia coli] [DB:genpept-bct2] [DE:Escherichia coli K-12 MG1655 section
363 of 400 of the completegenome.] [NT:f631; 100 pct identical to THIC_ECOLI SW:
P30136;] [LE:4566] [RE:6461] [DI:complement] >gp:[GI:g396333] [LN:ECOUW89]
[AC:U00006] [GN:thiC] [FN:thiamine biosynthesis] [OR:Escherichia coli]
[SR:Escherichia coli (sub_strain MG1655, strain K-12) (library: lambda]
[DB:genpept-bct2] [DE:E. coli chromosomal region from 89.2 to 92.8 minutes.]
[NT:CG Site No. 115] [LE:59445] [RE:61340] [DI:complement]

| ORF Name | NT ID | AA ID | NT LN | AA LN | Score | P-value |
|---|---|---|---|---|---|---|
| 16541416_c1_125 | 7 | 7178 | 4266 | 1421 | 6991 | 0.0 |

Description sp:[LN:RPOC_ECOLI] [AC:P00577:P00578:P78134] [GN:RPOC:TABB] [OR:Escherichia coli]
[EC:2.7.7.6] [DE:BETA' CHAIN) (RNA POLYMERASE BETA' SUBUNIT)]
[SP:P00577:P00578:P78134] [DB:swissprot] >sp:[LN:RNECC]
[AC:A00695:I52543:I65347:I52544:I65348:G65205:A00696] [PN:DNA-directed RNA
polymerase, beta' chain:transcriptase beta' chain] [GN:rpoC] [CL:Escherichia coli
DNA-directed RNA polymerase beta' chain] [OR:Escherichia coli] [EC:2.7.7.6]
[DB:pir1] [MP:90 min] >gp:[GI:e1192041:g581221] [LN:ECRPOBC]
[AC:V00339:J01678:K00449] [GN:rpoC] [OR:Escherichia coli] [DB:genpept-bct1]
[EC:2.7.7.6] [DE:E. coli operon rpoBC coding for the beta- and beta'-subunits of
RNApolymerase (genes rpoC and rpoB), and genes rplL, rlpJ, rplA, andrplK coding
for 50S ribosomal subunit proteins L7/L12, L10, L1, andL11, respectively. (Map
position 89-90 min.).] [SP:P00577] [LE:7074] [RE:11297] [DI:direct]
>gp:[GI:g2367335] [LN:AE000472] [AC:AE000472:U00096] [PN:RNA polymerase, beta
prime subunit] [GN:rpoC] [FN:enzyme; RNA synthesis, modification, DNA]
[OR:Escherichia coli] [DB:genpept-bct2] [EC:2.7.7.6] [DE:Escherichia coli K-12
MG1655 section 362 of 400 of the completegenome.] [NT:o1407; 99 pct identical
amino acid sequence and] [LE:10313] [RE:14536] [DI:direct]

| ORF Name | NT ID | AA ID | NT LN | AA LN | Score | P-value |
|---|---|---|---|---|---|---|
| 16831316_f2_69 | 8 | 7179 | 1539 | 512 | 263 | 5.2e-22 |

Description sp:[LN:C70324] [AC:C70324] [PN:conserved hypothetical protein aq_265] [GN:aq_265]
[OR:Aquifex aeolicus] [DB:pir2] >gp:[GI:g2982975] [LN:AE000681]
[AC:AE000681:AE000657] [PN:hypothetical protein] [GN:aq_265] [OR:Aquifex
aeolicus] [DB:genpept-bct2] [DE:Aquifex aeolicus section 13 of 109 of the
complete genome.] [LE:6617] [RE:7633] [DI:complement]

| ORF Name | NT ID | AA ID | NT/LN | AA/LN | Score | P-value |
|---|---|---|---|---|---|---|
| 16848913_c1_144 | 9 | 7180 | 708 | 235 | 953 | 8.6e-96 |

Description sp:[LN:YJAH_ECOLI] [AC:P32681] [GN:YJAH] [OR:Escherichia coli] [DE:HYPOTHETICAL 26.3 KD PROTEIN IN HUPA-HYDH INTERGENIC REGION (O231)] [SP:P32681] [DB:swissprot] >sp:[LN:D65207] [AC:D65207] [PN:hypothetical 26.3K protein (hupA-hydH intergenic region)] [GN:yjaH] [CL:Escherichia coli hypothetical 26.3K protein (hupA-hydH intergenic region)] [OR:Escherichia coli] [DB:pir2] >gp:[GI:g1790434] [LN:AE000473] [AC:AE000473:U00096] [PN:orf, hypothetical protein] [GN:yjaH] [FN:orf; Unknown] [OR:Escherichia coli] [DB:genpept-bct2] [DE:Escherichia coli K-12 MG1655 section 363 of 400 of the completegenome.] [NT:o231; 100 pct identical amino acid sequence and] [LE:10928] [RE:11623] [DI:direct] >gp:[GI:g409793] [LN:ECOUW89] [AC:U00006] [OR:Escherichia coli] [SR:Escherichia coli (sub_strain MG1655, strain K-12) (library: lambda] [DB:genpept-bct2] [DE:E. coli chromosomal region from 89.2 to 92.8 minutes.] [LE:65807] [RE:66502] [DI:direct]

| ORF Name | NT ID | AA ID | NT/LN | AA/LN | Score | P-value |
|---|---|---|---|---|---|---|
| 19563761_f2_60 | 10 | 7181 | 552 | 183 | 629 | 1.8e-61 |

Description sp:[LN:RSD_ECOLI] [AC:P31690] [GN:RSD] [OR:Escherichia coli] [DE:REGULATOR OF SIGMA D] [SP:P31690] [DB:swissprot] >sp:[LN:F65206] [AC:F65206] [PN:hypothetical protein b3995] [OR:Escherichia coli] [DB:pir2] >gp:[GI:g1790428] [LN:AE000473] [AC:AE000473:U00096] [PN:putative transcriptional regulator] [GN:yjaE] [FN:putative regulator; Not classified] [OR:Escherichia coli] [DB:genpept-bct2] [DE:Escherichia coli K-12 MG1655 section 363 of 400 of the completegenome.] [NT:f158; similar to Pseudomonas aeruginosa alginate] [LE:6694] [RE:7170] [DI:complement] >gp:[GI:g396334] [LN:ECOUW89] [AC:U00006] [OR:Escherichia coli] [SR:Escherichia coli (sub_strain MG1655, strain K-12) (library: lambda] [DB:genpept-bct2] [DE:E. coli chromosomal region from 89.2 to 92.8 minutes.] [NT:similar to Pseudomonas aeruginosa alginate] [LE:61573] [RE:62049] [DI:complement]

| ORF Name | NT ID | AA ID | NT/LN | AA/LN | Score | P-value |
|---|---|---|---|---|---|---|
| 19569166_f2_61 | 11 | 7182 | 306 | 101 | 80 | 0.030 |

Description gp:[GI:d1032176:g3287501] [LN:AB011665] [AC:AB011665] [PN:BAZF] [OR:Mus musculus] [SR:Mus musculus cDNA to mRNA] [DB:genpept-rod] [DE:Mus musculus mRNA for BAZF, complete cds.] [LE:25] [RE:1449] [DI:direct]

| ORF Name | NT ID | AA ID | NT/LN | AA/LN | Score | P-value |
|---|---|---|---|---|---|---|
| 2125035_c2_185 | 12 | 7183 | 1656 | 551 | | |

Description

NO-HIT

100

| ORF_Name | NT_ID | AA_ID | $\frac{NT}{LN}$ | $\frac{AA}{LN}$ | Score | P-value |
|---|---|---|---|---|---|---|
| 21601558_f3_89 | 13 | 7184 | 1644 | 547 | 2559 | 5.6e-266 |

Description sp:[LN:PUR9_ECOLI] [AC:P15639] [GN:PURH] [OR:Escherichia coli]
[EC:2.1.2.3:3.5.4.10] [DE:(IMP SYNTHETASE) (ATIC)]] [SP:P15639] [DB:swissprot]
>sp:[LN:DTECPH] [AC:B34193:S09571:A65208] [PN:purH bifunctional enzyme]
[GN:purH:purJ] [CL:purH bifunctional enzyme] [OR:Escherichia coli] [DB:pir1]
[MP:90 min] >gp:[GI:g147420] [LN:ECOPURHD] [AC:J05126] [OR:Escherichia coli]
[SR:E.coli (K12, isolate W3110) DNA, clone lambda-9B9] [DB:genpept-bct1]
[DE:E.coli 5-phosphoribosylglycinamide synthetase (purD) and5-phosphoribosyl
5-aminoimidazole-4-carboxamide transformylase(purH) genes, complete cds.]
[NT:purH (EC 2.1.2.3)] [LE:301] [RE:1890] [DI:direct] >gp:[GI:g42595]
[LN:ECPURHD] [AC:X51950:J02878:M32279] [PN:purH gene product] [GN:purH]
[OR:Escherichia coli] [DB:genpept-bct1] [DE:E. coli purHD operon for AICAR
transformylase-IMP cyclohydrolase(EC 2.1.2.3) and GAR synthetase (EC 6.3.4.13).]
[SP:P15639] [LE:258] [RE:1847] [DI:direct] >gp:[GI:g1790439] [LN:AE000473]
[AC:AE000473:U00096] [PN:phosphoribosylaminoimidazolecarboxamideformyltra]
[GN:purH] [FN:enzyme; Purine ribonucleotide biosynthesis] [OR:Escherichia coli]
[DB:genpept-bct2] [EC:2.1.2.3:3.5.4.10] [DE:Escherichia coli K-12 MG1655 section
363 of 400 of the completegenome.] [NT:f529; 100 pct identical to PUR9_ECOLI SW:
P15639;] [LE:16305] [RE:17894] [DI:complement] >gp:[GI:g396345] [LN:ECOUW89]
[AC:U00006] [PN:phosphoribosylaminoimidazolecarboxamide] [GN:purH]
[OR:Escherichia coli] [SR:Escherichia coli (sub_strain MG1655, strain K-12)
(library: lambda] [DB:genpept-bct2] [EC:2.1.2.3:3.5.4.10] [DE:E. coli chromosomal
region from 89.2 to 92.8 minutes.] [NT:CG Site No. 338] [LE:71184] [RE:72773]
[DI:complement]

| ORF_Name | NT_ID | AA_ID | $\frac{NT}{LN}$ | $\frac{AA}{LN}$ | Score | P-value |
|---|---|---|---|---|---|---|
| 21886017_c2_150 | 14 | 7185 | 546 | 181 | 797 | 2.9e-79 |

Description sp:[LN:R5EB10] [AC:S10895:S12827:S10011] [PN:ribosomal protein L10] [GN:rplJ]
[CL:Escherichia coli ribosomal protein L10] [OR:Salmonella typhimurium] [DB:pir1]
>gp:[GI:g47914] [LN:STRPLJ] [AC:X17216] [OR:Salmonella typhimurium]
[DB:genpept-bct1] [DE:Salmonella typhimurium rplJ gene for ribosomal protein
L10.] [NT:ribosomal protein L10 (AA 1-165)] [SP:P17352] [LE:1] [RE:498]
[DI:direct] >gp:[GI:g47916] [LN:STRPLJL] [AC:X53072] [OR:Salmonella typhimurium]
[DB:genpept-bct1] [DE:S. typhimurium rplJ and rplL genes for ribosomal protein
L10 andL7/L12.] [NT:ribosomal protein L10 (AA 1-165)] [SP:P17352] [LE:190]
[RE:687] [DI:direct]

| ORF Name | NT ID | AA ID | NT LN | AA LN | Score | P-value |
|---|---|---|---|---|---|---|
| 22869025_f3_90 | 15 | 7186 | 603 | 200 | 929 | 3.0e-93 |

Description sp:[LN:PUR2_SALTY] [AC:P26977] [GN:PURD] [OR:Salmonella typhimurium]
[EC:6.3.4.13] [DE:RIBONUCLEOTIDE SYNTHETASE) (PHOSPHORIBOSYLGLYCINAMIDE
SYNTHETASE)] [SP:P26977] [DB:swissprot] >sp:[LN:S18489] [AC:S18489]
[PN:phosphoribosylamine--glycine ligase,] [CL:phosphoribosylamine--glycine
ligase:phosphoribosylamine--glycine ligase homology] [OR:Salmonella typhimurium]
[EC:6.3.4.13] [DB:pir1] >gp:[GI:g154288] [LN:STYPURHD] [AC:M66160]
[PN:5-phosphoribosylglycinamide synthetase] [GN:purD] [FN:purine biosynthesis]
[OR:Salmonella typhimurium] [SR:S.typhimurium (strain Q1) DNA] [DB:genpept-bct1]
[EC:6.3.4.13] [DE:S.typhimurium 5-phosphoribosyl
5-aminoimidazole-4-carboxamidetransformylase (purH), 3' end, and
5-phosphoribosylglycinamidesynthetase (purD) gene, complete cds.]
[NT:5-phosphoribosylglycinamide synthetase is involved] [LE:1539] [RE:2828]
[DI:direct]

| ORF Name | NT ID | AA ID | NT LN | AA LN | Score | P-value |
|---|---|---|---|---|---|---|
| 23572188_c3_187 | 16 | 7187 | 708 | 235 | 1133 | 7.2e-115 |

Description sp:[LN:R5EC1] [AC:S12573:A02754:C65205] [PN:ribosomal protein L1] [GN:rplA]
[CL:Escherichia coli ribosomal protein L1] [OR:Escherichia coli] [DB:pir1] [MP:90
min] >gp:[GI:g42815] [LN:ECRPOBC] [AC:V00339:J01678:K00449] [GN:rplA (L1)]
[OR:Escherichia coli] [DB:genpept-bct1] [DE:E. coli operon rpoBC coding for the
beta- and beta'-subunits of RNApolymerase (genes rpoC and rpoB), and genes rplL,
rlpJ, rplA, andrplK coding for 50S ribosomal subunit proteins L7/L12, L10, L1,
andL11, respectively. (Map position 89-90 min.).] [SP:P02384] [LE:604] [RE:1308]
[DI:direct] >gp:[GI:g1790416] [LN:AE000472] [AC:AE000472:U00096] [PN:50S
ribosomal subunit protein L1, regulates] [GN:rplA] [FN:structural component;
Ribosomal proteins -] [OR:Escherichia coli] [DB:genpept-bct2] [DE:Escherichia
coli K-12 MG1655 section 362 of 400 of the completegenome.] [NT:o234b; 100 pct
identical to RL1_ECOLI SW: P02384;] [LE:3842] [RE:4546] [DI:direct]
>gp:[GI:g396323] [LN:ECOUW89] [AC:U00006] [PN:50S ribosomal subunit protein L1]
[GN:rplA] [OR:Escherichia coli] [SR:Escherichia coli (sub_strain MG1655, strain
K-12) (library: lambda] [DB:genpept-bct2] [DE:E. coli chromosomal region from
89.2 to 92.8 minutes.] [NT:CG Site No. 263] [LE:44120] [RE:44824] [DI:direct]

| ORF Name | NT ID | AA ID | NT LN | AA LN | Score | P-value |
|---|---|---|---|---|---|---|
| 24025251_c1_143 | 17 | 7188 | 276 | 91 | 428 | 3.7e-40 |

Description sp:[LN:DBHA_SALTY] [AC:P15148] [GN:HUPA] [OR:Salmonella typhimurium]
[DE:DNA-BINDING PROTEIN HU-ALPHA (NS2) (HU-2)] [SP:P15148] [DB:swissprot]
>sp:[LN:A31388] [AC:A31388] [PN:DNA-binding protein HU-2:DNA-binding protein
NS2:histone-like protein hupA] [GN:hupA] [CL:bacterial DNA-binding protein]
[OR:Salmonella typhimurium] [DB:pir2] >gp:[GI:g154139] [LN:STYHUPA] [AC:M22975]
[PN:histone-like protein] [GN:hupA] [OR:Salmonella typhimurium] [SR:S.typhimurium
(strain LT2) DNA] [DB:genpept-bct1] [DE:S. typhimurium histone-liking protein
(hupA) gene, complete cds.] [LE:211] [RE:483] [DI:direct]

102

| ORF Name | NT ID | AA ID | NT/LN | AA/LN | Score | P-value |
|---|---|---|---|---|---|---|
| 24267217_cl_140 | 18 | 7189 | 1077 | 358 | 1775 | 6.7e-183 |

Description sp:[LN:DCUP_ECOLI] [AC:P29680:P78135] [GN:HEME] [OR:Escherichia coli] [EC:4.1.1.37] [DE:UROPORPHYRINOGEN DECARBOXYLASE, (UPD)] [SP:P29680:P78135] [DB:swissprot] >sp:[LN:H65206] [AC:H65206:JN0894:JS0708] [PN:uroporphyrinogen decarboxylase,] [GN:hemE] [CL:uroporphyrinogen decarboxylase] [OR:Escherichia coli] [EC:4.1.1.37] [DB:pir2] [MP:90 min] >gp:[GI:g2367337] [LN:AE000473] [AC:AE000473:U00096] [PN:uroporphyrinogen decarboxylase] [GN:hemE] [FN:enzyme; Biosynthesis of cofactors, carriers:] [OR:Escherichia coli] [DB:genpept-bct2] [EC:4.1.1.37] [DE:Escherichia coli K-12 MG1655 section 363 of 400 of the completegenome.] [NT:o354; 100 pct identical to DCUP_ECOLI SW: P29680;] [LE:8078] [RE:9142] [DI:direct]

| ORF Name | NT ID | AA ID | NT/LN | AA/LN | Score | P-value |
|---|---|---|---|---|---|---|
| 24408458_f1_11 | 19 | 7190 | 588 | 195 | 484 | 4.3e-46 |

Description sp:[LN:E65207] [AC:E65207] [PN:hypothetical 20.4 kD protein in hupa-hydh intergenic region] [GN:yjaI] [OR:Escherichia coli] [DB:pir2] >gp:[GI:g1790435] [LN:AE000473] [AC:AE000473:U00096] [PN:orf, hypothetical protein] [GN:yjaI] [FN:orf; Unknown] [OR:Escherichia coli] [DB:genpept-bct2] [DE:Escherichia coli K-12 MG1655 section 363 of 400 of the completegenome.] [NT:f188; 100 pct identical amino acid sequence and] [LE:11625] [RE:12191] [DI:complement] >gp:[GI:g396341] [LN:ECOUW89] [AC:U00006] [OR:Escherichia coli] [SR:Escherichia coli (sub_strain MG1655, strain K-12) (library: lambda] [DB:genpept-bct2] [DE:E. coli chromosomal region from 89.2 to 92.8 minutes.] [LE:66504] [RE:67070] [DI:complement]

| ORF Name | NT ID | AA ID | NT/LN | AA/LN | Score | P-value |
|---|---|---|---|---|---|---|
| 24510218_f1_34 | 20 | 7191 | 2403 | 800 | 254 | 1.1e-21 |

Description gp:[GI:g5732624] [LN:AF121004] [AC:AF121004] [PN:hypothetical protein Jv0166c] [GN:Jv0166c] [OR:Mycobacterium tuberculosis H37Rv] [DB:genpept-bct2] [DE:Mycobacterium tuberculosis H37Rv hypothetical protein Jv0166c(Jv0166c) mRNA, complete cds.] [NT:probable regulatory protein of the LacI family of] [LE:1] [RE:1410] [DI:direct]

| ORF Name | NT ID | AA ID | NT LN | AA LN | Score | P-value |
|---|---|---|---|---|---|---|
| 24692781_f2_67 | 21 | 7192 | 906 | 301 | 1210 | 5.0e-123 |

Description sp:[LN:THIG_ECOLI] [AC:P30139:P76779] [GN:THIG] [OR:Escherichia coli] [DE:THIG
PROTEIN] [SP:P30139:P76779] [DB:swissprot] >sp:[LN:B65206]
[AC:B65206:D49695:S35120:S77701] [PN:thiG
protein:4-methyl-5-(beta-hydroxyethyl)thiazole monophosphate synthesis protein
thiG] [GN:thiG] [CL:thiamine biosynthesis protein thiG] [OR:Escherichia coli]
[DB:pir2] >gp:[GI:g1790424] [LN:AE000473] [AC:AE000473:U00096] [PN:thiamin
biosynthesis, thiazole moiety] [GN:thiG] [FN:enzyme; Biosynthesis of cofactors,
carriers:] [OR:Escherichia coli] [DB:genpept-bct2] [DE:Escherichia coli K-12
MG1655 section 363 of 400 of the completegenome.] [NT:f281; This 281 aa ORF is 99
pct identical to] [LE:2227] [RE:3072] [DI:complement] >gp:[GI:g409790]
[LN:ECOUW89] [AC:U00006] [GN:thiG] [FN:thiamine biosynthesis] [OR:Escherichia
coli] [SR:Escherichia coli (sub_strain MG1655, strain K-12) (library: lambda]
[DB:genpept-bct2] [DE:E. coli chromosomal region from 89.2 to 92.8 minutes.]
[LE:57106] [RE:57951] [DI:complement]

| ORF Name | NT ID | AA ID | NT LN | AA LN | Score | P-value |
|---|---|---|---|---|---|---|
| 2469687_c2_152 | 22 | 7193 | 4083 | 1360 | 6754 | 0.0 |

Description sp:[LN:RPOB_SALTY] [AC:P06173] [GN:RPOB] [OR:Salmonella typhimurium] [EC:2.7.7.6]
[DE:BETA CHAIN) (RNA POLYMERASE BETA SUBUNIT)] [SP:P06173] [DB:swissprot]
>sp:[LN:RNEBBT] [AC:S01794] [PN:DNA-directed RNA polymerase, beta chain]
[GN:rpoB] [CL:DNA-directed RNA polymerase beta chain] [OR:Salmonella typhimurium]
[EC:2.7.7.6] [DB:pir1] >gp:[GI:g47919] [LN:STRPOB]
[AC:X04642:M37431:X04860:X13854] [OR:Salmonella typhimurium] [DB:genpept-bct1]
[DE:S. typhimurium rpoB gene for RNA polymerase beta subunit.] [NT:beta subunit
rpoB (AA 1-1342)] [SP:P06173] [LE:21] [RE:4049] [DI:direct]

| ORF Name | NT ID | AA ID | NT LN | AA LN | Score | P-value |
|---|---|---|---|---|---|---|
| 25602187_c2_179 | 23 | 7194 | 1419 | 472 | 1428 | 4.0e-146 |

Description sp:[LN:HYDH_ECOLI] [AC:P14377] [GN:HYDH] [OR:Escherichia coli] [EC:2.7.3.-]
[DE:SENSOR PROTEIN HYDH,] [SP:P14377] [DB:swissprot] >sp:[LN:F65207]
[AC:F65207:A33862] [PN:hydH protein] [GN:hydH] [OR:Escherichia coli] [DB:pir2]
>gp:[GI:g1790436] [LN:AE000473] [AC:AE000473:U00096] [PN:sensor kinase for HydG,
hydrogenase 3 activity] [GN:hydH] [FN:enzyme; Energy metabolism, carbon:]
[OR:Escherichia coli] [DB:genpept-bct2] [DE:Escherichia coli K-12 MG1655 section
363 of 400 of the completegenome.] [NT:o465] [LE:12288] [RE:13685] [DI:direct]
>gp:[GI:g396342] [LN:ECOUW89] [AC:U00006] [GN:hydH] [FN:member of two-component
regulatory system] [OR:Escherichia coli] [SR:Escherichia coli (sub_strain MG1655,
strain K-12) (library: lambda] [DB:genpept-bct2] [DE:E. coli chromosomal region
from 89.2 to 92.8 minutes.] [LE:67167] [RE:68564] [DI:direct]

| ORF Name | NT ID | AA ID | NT LN | AA LN | Score | P-value |
|---|---|---|---|---|---|---|
| 26384705_f3_111 | 24 | 7195 | 321 | 106 | 251 | 2.1e-21 |

Description gp:[GI:g145484] [LN:ECOCELCA] [AC:M93570] [PN:PTS enzyme III cel] [GN:celC] [OR:Escherichia coli] [SR:Escherichia coli (individual_isolate RM74A/human/Iowa, strain ECO] [DB:genpept-bct1] [DE:Escherichia coli (strain ECOR 1, isolate RM74A/human/Iowa) PTSenzyme III cel (celC) gene, complete cds.] [NT:putative] [LE:1] [RE:351] [DI:direct]

| ORF Name | NT ID | AA ID | NT LN | AA LN | Score | P-value |
|---|---|---|---|---|---|---|
| 26823791_f3_105 | 25 | 7196 | 774 | 257 | 1040 | 5.2e-105 |

Description sp:[LN:THIF_ECOLI] [AC:P30138:P76780] [GN:THIF] [OR:Escherichia coli] [DE:THIF PROTEIN] [SP:P30138:P76780] [DB:swissprot]

| ORF Name | NT ID | AA ID | NT LN | AA LN | Score | P-value |
|---|---|---|---|---|---|---|
| 29770626_f3_121 | 26 | 7197 | 225 | 74 | | |

Description

NO-HIT

| ORF Name | NT ID | AA ID | NT LN | AA LN | Score | P-value |
|---|---|---|---|---|---|---|
| 29788590_f1_25 | 27 | 7198 | 351 | 116 | 210 | 4.6e-17 |

Description sp:[LN:THIS_ECOLI] [AC:O32583] [GN:THIS:THIG1] [OR:Escherichia coli] [DE:THIS PROTEIN] [SP:O32583] [DB:swissprot] >sp:[LN:S77700] [AC:S77700] [PN:thiG1 protein] [OR:Escherichia coli] [DB:pir2] >gp:[GI:g1469147] [LN:ECTHICEFGH] [AC:M88701] [GN:thiS] [OR:Escherichia coli] [DB:genpept-bct2] [DE:Escherichia coli thiCEFSGH operon, complete cds.] [LE:3520] [RE:3720] [DI:direct]

| ORF Name | NT ID | AA ID | NT LN | AA LN | Score | P-value |
|---|---|---|---|---|---|---|
| 2994076_f3_93 | 28 | 7199 | 468 | 155 | 178 | 1.1e-13 |

Description gp:[GI:g535941] [LN:STYSTN] [AC:L16014] [PN:enterotoxin] [GN:stn] [FN:stimulation of intestinal water and electrolyte] [OR:Salmonella typhimurium] [SR:Salmonella typhimurium (strain Q1) DNA] [DB:genpept-bct1] [DE:Salmonella typhimurium enterotoxin (stn) gene, complete cds.] [NT:initiation codon is TTG rather than ATG; identified] [LE:346] [RE:1095] [DI:direct]

| ORF_Name | NT ID | AA ID | NT/LN | AA/LN | Score | P-value |
|---|---|---|---|---|---|---|
| 31486667_f3_110 | 29 | 7200 | 372 | 123 | 225 | 1.2e-18 |

Description sp:[LN:PTCB_BACST] [AC:Q45399] [GN:CELA] [OR:Bacillus stearothermophilus]
[EC:2.7.1.69] [DE:(EC 2.7.1.69)] [SP:Q45399] [DB:swissprot] >sp:[LN:B49898]
[AC:B49898] [PN:cellobiose phosphotransferase system celA] [CL:phosphotransferase
system enzyme II cellobiose-specific factor IIB] [OR:Bacillus stearothermophilus]
[DB:pir2] >gp:[GI:g466473] [LN:BSU07818] [AC:U07818:S66216] [PN:cellobiose
phosphotransferase enzyme II'] [GN:celA] [OR:Bacillus stearothermophilus]
[DB:genpept-bct1] [DE:Bacillus stearothermophilus XL-65-6 PTS regulatory protein
(celR')gene, partial cds, and cellobiose phosphotransferase system operon(celA,
celB, celC, and celD) genes, complete cds.] [NT:cellobiose PTS enzyme II']
[LE:1541] [RE:1843] [DI:direct]

| ORF_Name | NT ID | AA ID | NT/LN | AA/LN | Score | P-value |
|---|---|---|---|---|---|---|
| 3219036_f3_118 | 30 | 7201 | 4206 | 1401 | | |

Description

NO-HIT

| ORF_Name | NT ID | AA ID | NT/LN | AA/LN | Score | P-value |
|---|---|---|---|---|---|---|
| 33492167_c3_215 | 31 | 7202 | 795 | 264 | 1240 | 3.3e-126 |

Description sp:[LN:YJAD_ECOLI] [AC:P32664] [GN:YJAD] [OR:Escherichia coli] [DE:HYPOTHETICAL
29.8 KD PROTEIN IN THIC-HEME INTERGENIC REGION] [SP:P32664] [DB:swissprot]
>sp:[LN:G65206] [AC:G65206] [PN:hypothetical 29.8 kD protein in thic-heme
intergenic region] [GN:yjaD] [CL:hypothetical protein HI0432:mutT domain
homology] [OR:Escherichia coli] [DB:pir1] >gp:[GI:g1790429] [LN:AE000473]
[AC:AE000473:U00096] [PN:orf, hypothetical protein] [GN:yjaD] [FN:orf; Unknown]
[OR:Escherichia coli] [DB:genpept-bct2] [DE:Escherichia coli K-12 MG1655 section
363 of 400 of the completegenome.] [NT:o257; 100 pct identical amino acid
sequence and] [LE:7265] [RE:8038] [DI:direct] >gp:[GI:g396335] [LN:ECOUW89]
[AC:U00006] [OR:Escherichia coli] [SR:Escherichia coli (sub_strain MG1655, strain
K-12) (library: lambda] [DB:genpept-bct2] [DE:E. coli chromosomal region from
89.2 to 92.8 minutes.] [LE:62144] [RE:62917] [DI:direct]

| ORF_Name | NT ID | AA ID | NT/LN | AA/LN | Score | P-value |
|---|---|---|---|---|---|---|
| 34266582_f1_26 | 32 | 7203 | 1488 | 495 | 1794 | 6.5e-185 |

Description gp:[GI:g5726353] [LN:AF154064] [AC:AF154064] [PN:ThiH] [GN:thiH] [OR:Salmonella
typhimurium] [DB:genpept-bct2] [DE:Salmonella typhimurium ThiH (thiH) gene,
complete cds.] [LE:295] [RE:1428] [DI:direct]

| ORF_Name | NT ID | AA ID | NT/LN | AA/LN | Score | P-value |
|---|---|---|---|---|---|---|
| 35266662_f3_119 | 33 | 7204 | 474 | 157 | | |

Description

NO-HIT

| ORF_Name | NT ID | AA ID | NT/LN | AA/LN | Score | P-value |
|---|---|---|---|---|---|---|
| 4313956_c2_157 | 34 | 7205 | 1437 | 478 | 2131 | 1.3e-220 |

Description sp:[LN:DCUB_ECOLI] [AC:P14409] [GN:DCUB:GENF] [OR:Escherichia coli] [DE:ANAEROBIC C4-DICARBOXYLATE TRANSPORTER DCUB] [SP:P14409] [DB:swissprot] >sp:[LN:S56352] [AC:S56352:S57341:A44511:B65222] [PN:dicarboxylate transport protein dcuB] [GN:dcuB:genF] [CL:dicarboxylate membrane-transporter protein A] [OR:Escherichia coli] [DB:pir2] >gp:[GI:g510886] [LN:ECDCUB] [AC:X79886] [PN:dicarboxylate membrane transporter protein] [GN:dcuB] [OR:Escherichia coli] [DB:genpept-bct1] [DE:E.coli dcuB gene.] [SP:P14409] [LE:170] [RE:1510] [DI:direct] >gp:[GI:g536968] [LN:ECOUW93] [AC:U14003] [GN:genF] [OR:Escherichia coli] [DB:genpept-bct1] [DE:Escherichia coli K-12 chromosomal region from 92.8 to 00.1 minutes.] [LE:38232] [RE:39572] [DI:complement] >gp:[GI:g1790565] [LN:AE000485] [AC:AE000485:U00096] [PN:anaerobic dicarboxylate transport] [GN:dcuB] [FN:transport; Transport of small molecules:] [OR:Escherichia coli] [DB:genpept-bct2] [DE:Escherichia coli K-12 MG1655 section 375 of 400 of the completegenome.] [NT:f446; 100 pct identical amino acid sequence and] [LE:1815] [RE:3155] [DI:complement]

| ORF_Name | NT ID | AA ID | NT/LN | AA/LN | Score | P-value |
|---|---|---|---|---|---|---|
| 5331955_c1_130 | 35 | 7206 | 225 | 74 | | |

Description

NO-HIT

| ORF_Name | NT ID | AA ID | NT/LN | AA/LN | Score | P-value |
|---|---|---|---|---|---|---|
| 6489582_f1_35 | 36 | 7207 | 1809 | 602 | | |

Description

NO-HIT

| ORF Name | NT ID | AA ID | NT/LN | AA/LN | Score | P-value |
|---|---|---|---|---|---|---|
| 820915_c3_222 | 37 | 7208 | 1440 | 479 | 1834 | 3.8e-189 |

Description sp:[LN:HYDG_SALTY] [AC:P25852] [GN:HYDG] [OR:Salmonella typhimurium]
[DE:TRANSCRIPTIONAL REGULATORY PROTEIN HYDG] [SP:P25852] [DB:swissprot]
>sp:[LN:S19606] [AC:S19606] [PN:hydrogenase regulatory protein hydG] [GN:hydG]
[CL:nitrogen assimilation regulatory protein ntrC:response regulator homology:RNA
polymerase sigma factor interaction domain homology] [OR:Salmonella typhimurium]
[DB:pir2] >gp:[GI:g154142] [LN:STYHYDGG] [AC:M64988] [PN:hydrogenase G] [GN:hydG]
[FN:regulation of labile hydrogenase activity] [OR:Salmonella typhimurium]
[SR:Salmonella typhimurium cDNA to mRNA] [DB:genpept-bct1] [DE:Salmonella
typhimurium hydrogenase G (hydG) mRNA, complete cds.] [NT:the complete hydG gene
of Salmonella typhimurium] [LE:635] [RE:1960] [DI:direct]

| ORF Name | NT ID | AA ID | NT/LN | AA/LN | Score | P-value |
|---|---|---|---|---|---|---|
| 9766462_c3_197 | 38 | 7209 | 210 | 69 | | |

Description

NO-HIT

| ORF Name | NT ID | AA ID | NT/LN | AA/LN | Score | P-value |
|---|---|---|---|---|---|---|
| 992626_c1_142 | 39 | 7210 | 606 | 201 | 957 | 3.2e-96 |

Description sp:[LN:YJAG_ECOLI] [AC:P32680] [GN:YJAG] [OR:Escherichia coli] [DE:HYPOTHETICAL
22.6 KD PROTEIN IN NFI-HUPA INTERGENIC REGION] [SP:P32680] [DB:swissprot]
>sp:[LN:B65207] [AC:B65207] [PN:hypothetical 22.6 kD protein in heme-hupa
intergenic region] [GN:yjaG] [OR:Escherichia coli] [DB:pir2] >gp:[GI:g1790432]
[LN:AE000473] [AC:AE000473:U00096] [PN:orf, hypothetical protein] [GN:yjaG]
[FN:orf; Unknown] [OR:Escherichia coli] [DB:genpept-bct2] [DE:Escherichia coli
K-12 MG1655 section 363 of 400 of the completegenome.] [NT:o196; 100 pct
identical amino acid sequence and] [LE:9866] [RE:10456] [DI:direct]
>gp:[GI:g396338] [LN:ECOUW89] [AC:U00006] [OR:Escherichia coli] [SR:Escherichia
coli (sub_strain MG1655, strain K-12) (library: lambda] [DB:genpept-bct2] [DE:E.
coli chromosomal region from 89.2 to 92.8 minutes.] [LE:64745] [RE:65335]
[DI:direct]

| ORF Name | NT ID | AA ID | NT LN | AA LN | Score | P-value |
|---|---|---|---|---|---|---|
| 10234692_f2_286 | 40 | 7211 | 828 | 275 | 201 | 4.2e-16 |

Description sp:[LN:YCAC_ECOLI] [AC:P21367] [GN:YCAC] [OR:Escherichia coli] [DE:23.1 KD
PROTEIN IN DMSC-PFLA INTERGENIC REGION] [SP:P21367] [DB:swissprot]
>sp:[LN:S09671] [AC:S09671:H64828] [PN:probable membrane protein ycaC] [GN:ycaC]
[OR:Escherichia coli] [DB:pir2] [MP:20 min] >gp:[GI:d1036615:g4062471]
[LN:D90727] [AC:D90727:AB001340] [PN:Hypothetical protein Z (dmsC 3' region)]
[GN:ycaC] [OR:Escherichia coli] [SR:Escherichia coli(strain:K12) DNA,
clone:Kohara clone #215] [DB:genpept-bct1] [DE:Escherichia coli genomic DNA.
(20.1 - 20.4 min).] [NT:ORF_ID:o216#1; similar to PIR Accession Number]
[LE:14114] [RE:14740] [DI:complement] >gp:[GI:d1036618:g4062473] [LN:D90728]
[AC:D90728:AB001340] [PN:Hypothetical protein Z (dmsC 3' region)]
[OR:Escherichia coli] [SR:Escherichia coli(strain:K12) DNA, clone:Kohara clone
216] [DB:genpept-bct1] [DE:Escherichia coli genomic DNA. (20.4 - 20.8 min).]
[NT:ORF_ID:o216#1; similar to PIR Accession Number] [LE:624] [RE:1250]
[DI:complement] >gp:[GI:g1128948] [LN:ECODMS] [AC:J03412] [OR:Escherichia coli]
[SR:Escherichia coli (strain C600) DNA] [DB:genpept-bct1] [DE:E.coli dmsA, dmsB
and dmsC genes encoding anaerobic dimethylsulfoxide reductase, complete cds.]
[NT:ORF Z; putative] [LE:4760] [RE:5386] [DI:complement] >gp:[GI:g1787124]
[LN:AE000191] [AC:AE000191:U00096] [PN:orf, hypothetical protein] [GN:ycaC]
[FN:orf; Unknown] [OR:Escherichia coli] [DB:genpept-bct2] [DE:Escherichia coli
K-12 MG1655 section 81 of 400 of the completegenome.] [NT:f208; 100 pct identical
to YCAC_ECOLI SW: P21367] [LE:12639] [RE:13265] [DI:complement]

| ORF Name | NT ID | AA ID | NT LN | AA LN | Score | P-value |
|---|---|---|---|---|---|---|
| 10581261_f3_534 | 41 | 7212 | 936 | 311 | 370 | 5.2e-34 |

Description sp:[LN:RPIR_ECOLI] [AC:P39266:P76791] [GN:RPIR:ALSR] [OR:Escherichia coli]
[DE:RPIR PROTEIN (ALS OPERON REPRESSOR)] [SP:P39266:P76791] [DB:swissprot]
>gp:[GI:e121648:g1197466] [LN:ECRPIRB] [AC:X82203] [GN:rpiR] [FN:regulatory
protein involved in rpiB gene] [OR:Escherichia coli] [DB:genpept-bct1] [DE:E.coli
rpiR and rpiB genes.] [SP:P39266] [LE:451] [RE:1341] [DI:complement]

| ORF Name | NT ID | AA ID | NT LN | AA LN | Score | P-value |
|---|---|---|---|---|---|---|
| 10583183_c3_1127 | 42 | 7213 | 1218 | 405 | | |

Description

NO-HIT

| ORF Name | NT ID | AA ID | NT LN | AA LN | Score | P-value |
|---|---|---|---|---|---|---|
| 11023455_c2_776 | 43 | 7214 | 732 | 243 | 764 | 9.1e-76 |

Description gp:[GI:g4768869] [LN:AF124757] [AC:AF124757] [PN:chloramphenicol acetyltransferase] [GN:cat] [OR:Zymomonas mobilis] [DB:genpept-bct2] [DE:Zymomonas mobilis fosmid clone 43D2, complete sequence.] [LE:26535] [RE:27188] [DI:direct]

| ORF Name | NT ID | AA ID | NT LN | AA LN | Score | P-value |
|---|---|---|---|---|---|---|
| 11064166_f3_520 | 44 | 7215 | 1071 | 356 | 1183 | 3.6e-120 |

Description gp:[GI:g2271497] [LN:AF009672] [AC:AF009672] [PN:unknown] [OR:Acinetobacter sp. ADP1] [DB:genpept-bct2] [DE:Acinetobacter sp. ADP1 VanR (vanR), vanillate demethylase (vanB),vanillate demethylase (vanA), and VanK (vanK) genes, complete cds;and unknown genes.] [NT:ORF3; putative oxo-ketoglutarate dioxygenase] [LE:2783] [RE:3784] [DI:direct]

| ORF Name | NT ID | AA ID | NT LN | AA LN | Score | P-value |
|---|---|---|---|---|---|---|
| 11073966_f3_528 | 45 | 7216 | 3147 | 1048 | 811 | 9.6e-81 |

Description sp:[LN:F71727] [AC:F71727] [PN:acriflavin resistance protein D (acrD) RP170] [GN:acrD:RP170] [CL:acriflavin resistance protein] [OR:Rickettsia prowazekii] [DB:pir2] >gp:[GI:e1342480:g3860736] [LN:RPXX01] [AC:AJ235270:AJ235269] [PN:ACRIFLAVIN RESISTANCE PROTEIN D (acrD)] [GN:RP170] [OR:Rickettsia prowazekii] [DB:genpept-bct1] [DE:Rickettsia prowazekii strain Madrid E, complete genome; segment1/4.] [LE:198629] [RE:201655] [DI:complement]

| ORF Name | NT ID | AA ID | NT LN | AA LN | Score | P-value |
|---|---|---|---|---|---|---|
| 119077_f3_401 | 46 | 7217 | 810 | 269 | 1111 | 1.5e-112 |

Description sp:[LN:MHPD_ECOLI] [AC:P77608:P77045:P71205] [GN:MHPD] [OR:Escherichia coli] [EC:4.2.1.-] [DE:HYDRATASE)] [SP:P77608:P77045:P71205] [DB:swissprot] >gp:[GI:e283068:g1702884] [LN:ECMHP] [AC:Y09555:X97450:X97451:Y09473] [PN:2-keto-4-pentenoate hydratase] [GN:mhpD] [OR:Escherichia coli] [DB:genpept-bct1] [DE:E.coli mhp cluster for 3-hydroxy-phenylpropionic acid degradation.] [SP:P77608] [LE:4547] [RE:5356] [DI:direct]

| ORF Name | NT ID | AA ID | NT LN | AA LN | Score | P-value |
|---|---|---|---|---|---|---|
| 11922626_f2_215 | 47 | 7218 | 1263 | 420 | 440 | 2.0e-41 |

Description sp:[LN:H69771] [AC:H69771] [PN:butyryl-CoA dehydrogenase homolog ydbM] [GN:ydbM] [OR:Bacillus subtilis] [DB:pir2] >gp:[GI:d1020042:g1881262] [LN:AB001488] [AC:AB001488] [GN:ydbM] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:SIMILAR TO ACYL-COA DEHYDROGENASE.] [LE:38215] [RE:39360] [DI:direct] >gp:[GI:e1182418:g2632752] [LN:BSUB0003] [AC:Z99106:AL009126] [GN:ydbM] [FN:unknown] [OR:Bacillus subtilis] [DB:genpept-bct1] [DE:Bacillus subtilis complete genome (section 3 of 21): from 402751 to611850.] [NT:similar to butyryl-CoA dehydrogenase] [LE:101959] [RE:103104] [DI:direct]

| ORF Name | NT ID | AA ID | NT LN | AA LN | Score | P-value |
|---|---|---|---|---|---|---|
| 12117138_c2_842 | 48 | 7219 | 1041 | 346 | 388 | 6.4e-36 |

Description sp:[LN:ARAL_STRAT] [AC:Q03320] [OR:Streptomyces antibioticus] [DE:PUTATIVE ARAC-LIKE TRANSCRIPTION REGULATOR] [SP:Q03320] [DB:swissprot] >sp:[LN:B47089] [AC:B47089] [PN:probable AraC-type regulatory protein] [OR:Streptomyces antibioticus] [DB:pir2] >gp:[GI:g153392] [LN:STMOXIARA] [AC:M96551] [OR:Streptomyces antibioticus] [SR:Streptomyces antibioticus (library: IMRU3720) DNA] [DB:genpept-bct1] [DE:Streptomyces antibioticus oxidoreductase and AraC-liketranscription regulator, complete cds.] [NT:AraC-like transcription regulator] [LE:1499] [RE:2410] [DI:direct]

| ORF Name | NT ID | AA ID | NT LN | AA LN | Score | P-value |
|---|---|---|---|---|---|---|
| 12345211_f1_35 | 49 | 7220 | 1359 | 452 | 418 | 4.2e-39 |

Description gp:[GI:g3420605] [LN:AF075709] [AC:AF075709] [PN:putative sulfonate binding protein precursor] [GN:ssuA] [OR:Pseudomonas putida] [DB:genpept-bct2] [DE:Pseudomonas putida LsfA (lsfA), complete cds; and ssu locus,complete sequence.] [NT:SsuA] [LE:1703] [RE:2668] [DI:direct]

| ORF Name | NT ID | AA ID | NT LN | AA LN | Score | P-value |
|---|---|---|---|---|---|---|
| 12364717_f2_279 | 50 | 7221 | 243 | 80 | 192 | 3.8e-15 |

Description gp:[GI:g4378407] [LN:AF103874] [AC:AF103874] [PN:CcmD] [GN:ccmD] [OR:Pantoea citrea] [DB:genpept-bct2] [DE:Pantoea citrea ccm operon, complete sequence.] [NT:similar to the Escherichia coli CcmD] [LE:2911] [RE:3144] [DI:direct]

| ORF Name | NT ID | AA ID | NT/LN | AA/LN | Score | P-value |
|---|---|---|---|---|---|---|
| 12536341_f3_475 | 51 | 7222 | 567 | 188 | 529 | 7.3e-51 |

Description sp:[LN:CCME_ECOLI] [AC:P33928] [GN:CCME] [OR:Escherichia coli] [DE:CYTOCHROME
C-TYPE BIOGENESIS PROTEIN CCME] [SP:P33928] [DB:swissprot] >sp:[LN:C64989]
[AC:C64989:A58862] [PN:cytochrome-c biosynthesis heme-carrier protein
ccmE:cytochrome c-type biogenesis protein ccmE] [GN:ccmE] [CL:Escherichia coli
cytochrome-c biosynthesis heme-carrier protein ccmE] [OR:Escherichia coli]
[DB:pir1] >gp:[GI:g405922] [LN:ECOHU49] [AC:U00008] [PN:yejS] [OR:Escherichia
coli] [SR:Escherichia coli K12 BHB2600] [DB:genpept-bct1] [DE:centisome 49 region
of E.coli K12 BHB2600.] [NT:may be part of aeg-46.5 operon.] [LE:21954]
[RE:22433] [DI:complement] >gp:[GI:g1788525] [LN:AE000309] [AC:AE000309:U00096]
[PN:cytochrome c biogenesis, possible subunit of a] [GN:ccmE] [FN:putative
enzyme; Energy metabolism, carbon:] [OR:Escherichia coli] [DB:genpept-bct2]
[DE:Escherichia coli K-12 MG1655 section 199 of 400 of the completegenome.]
[NT:f159; 100 pct identical to CCME_ECOLI SW: P33928] [LE:4625] [RE:5104]
[DI:complement]

| ORF Name | NT ID | AA ID | NT/LN | AA/LN | Score | P-value |
|---|---|---|---|---|---|---|
| 12679675_c3_973 | 52 | 7223 | 1299 | 432 | 1137 | 2.7e-115 |

Description sp:[LN:H69607] [AC:H69607] [PN:alpha-ketoglutarate permease csbX] [GN:csbX]
[OR:Bacillus subtilis] [DB:pir2] >gp:[GI:e1184025:g2635241] [LN:BSUB0015]
[AC:Z99118:AL009126] [PN:alpha-ketoglutarate permease] [GN:csbX] [OR:Bacillus
subtilis] [DB:genpept-bct1] [DE:Bacillus subtilis complete genome (section 15 of
21): from 2795131to 3013540.] [LE:41600] [RE:42907] [DI:complement]

| ORF Name | NT ID | AA ID | NT/LN | AA/LN | Score | P-value |
|---|---|---|---|---|---|---|
| 12681906_f3_399 | 53 | 7224 | 993 | 330 | 1426 | 6.5e-146 |

Description sp:[LN:MHPB_ECOLI] [AC:P54711:P77461:P77048] [GN:MHPB] [OR:Escherichia coli]
[EC:1.13.11.-] [DE:2,3-DIHYDROXYPHENYLPROPIONATE 1,2-DIOXYGENASE,]
[SP:P54711:P77461:P77048] [DB:swissprot] >sp:[LN:D64762] [AC:D64762:S38515]
[PN:2,3-dihydroxyphenylpropionate 1,2-dioxygenase,] [GN:mhpB] [OR:Escherichia
coli] [EC:1.13.11.-] [DB:pir2] >gp:[GI:e283066:g1702882] [LN:ECMHP]
[AC:Y09555:X97450:X97451:Y09473] [PN:3-(2,3-dihydroxyphenylpropionate)1,]
[GN:mhpB] [OR:Escherichia coli] [DB:genpept-bct1] [DE:E.coli mhp cluster for
3-hydroxy-phenylpropionic acid degradation.] [SP:P54711] [LE:2709] [RE:3653]
[DI:direct] >gp:[GI:g1786544] [LN:AE000142] [AC:AE000142:U00096]
[PN:2,3-dihydroxyphenylpropionate 1,2-dioxygenase] [GN:mhpB] [FN:enzyme;
Degradation of small molecules: Carbon] [OR:Escherichia coli] [DB:genpept-bct2]
[EC:1.13.11.-] [DE:Escherichia coli K-12 MG1655 section 32 of 400 of the
completegenome.] [NT:o314; 98 pct identical to MHPB_ECOLI SW: P54711] [LE:1735]
[RE:2679] [DI:direct] >gp:[GI:g1657544] [LN:ECU73857] [AC:U73857] [OR:Escherichia
coli] [DB:genpept-bct2] [DE:Escherichia coli chromosome minutes 6-8.] [NT:similar
to mcpI gene (catechol 2,3-dioxygenase) of] [LE:78072] [RE:79016] [DI:direct]

| ORF Name | NT ID | AA ID | NT/LN | AA/LN | Score | P-value |
|---|---|---|---|---|---|---|
| 12975327_f1_83 | 54 | 7225 | 903 | 300 | 633 | 7.0e-62 |

Description gp:[GI:g2584860] [LN:ECU97665] [AC:U97665] [PN:subunit III precursor] [OR:Erwinia cypripedii] [DB:genpept-bct2] [DE:Erwinia cypripedii membrane-bound gluconate dehydrogenase complex,subunit III precursor, dehydrogenase subunit precursor andcytochrome c precursor, genes, complete cds.] [NT:part of gluconate dehydrogenase complex] [LE:258] [RE:920] [DI:direct]

| ORF Name | NT ID | AA ID | NT/LN | AA/LN | Score | P-value |
|---|---|---|---|---|---|---|
| 12978806_c1_746 | 55 | 7226 | 927 | 308 | 474 | 4.9e-45 |

Description sp:[LN:YE70_HAEIN] [AC:Q57399:O05064] [GN:HI1470] [OR:Haemophilus influenzae] [DE:HYPOTHETICAL ABC TRANSPORTER ATP-BINDING PROTEIN HI1470] [SP:Q57399:O05064] [DB:swissprot] >sp:[LN:F64125] [AC:F64125] [PN:ferric enterobactin transport ATP-binding protein homolog HI1470] [CL:ATP-binding cassette homology] [OR:Haemophilus influenzae] [DB:pir2] >gp:[GI:g1574311] [LN:U32825] [AC:U32825:L42023] [PN:iron chelatin ABC transporter, ATP-binding] [GN:HI1470] [OR:Haemophilus influenzae Rd] [DB:genpept-bct2] [DE:Haemophilus influenzae Rd section 140 of 163 of the completegenome.] [NT:similar to GB:AE000511 SP:O05732 PID:2072456] [LE:3843] [RE:4604] [DI:complement]

| ORF Name | NT ID | AA ID | NT/LN | AA/LN | Score | P-value |
|---|---|---|---|---|---|---|
| 12985792_c3_942 | 56 | 7227 | 312 | 103 | 93 | 2.1e-05 |

Description gp:[GI:g5732634] [LN:AF121009] [AC:AF121009] [PN:hypothetical protein Jv0534] [GN:Jv0534] [OR:Mycobacterium tuberculosis H37Rv] [DB:genpept-bct2] [DE:Mycobacterium tuberculosis H37Rv hypothetical protein Jv0534(Jv0534) mRNA, complete cds.] [NT:similar to extensin like protein, Swiss-Prot] [LE:1] [RE:1029] [DI:direct]

| ORF Name | NT ID | AA ID | NT/LN | AA/LN | Score | P-value |
|---|---|---|---|---|---|---|
| 12988186_c1_702 | 57 | 7228 | 318 | 105 | 107 | 2.3e-05 |

Description sp:[LN:YT35_STRFR] [AC:P20186] [OR:Streptomyces fradiae] [DE:HYPOTHETICAL 35.5 KD PROTEIN IN TRANSPOSON TN4556] [SP:P20186] [DB:swissprot] >sp:[LN:JQ0431] [AC:JQ0431] [PN:hypothetical 35.5K protein] [OR:Streptomyces fradiae] [DB:pir2] >gp:[GI:g1196912] [LN:STMTN4556] [AC:M29297] [PN:unknown protein] [OR:Transposon Tn4556] [SR:Streptomyces fradiae (clone: #3 and #5.) (clone library: pUC1202] [DB:genpept-una] [DE:S.fradiae class II transposable element Tn4556 encoding pot.transposase (tnpA), pot. resolvase (tnpR) and pot. mercuryresistance, complete cds.] [NT:ORF 7; putative] [LE:411] [RE:1457] [DI:complement]

| ORF Name | NT ID | AA ID | NT/LN | AA/LN | Score | P-value |
|---|---|---|---|---|---|---|
| 12992781_c2_836 | 58 | 7229 | 240 | 79 | 121 | 2.9e-07 |

Description sp:[LN:BUDC_KLETE] [AC:Q04520] [GN:BUDC] [OR:Klebsiella terrigena] [EC:1.1.1.5]
[DE:ACETOIN(DIACETYL) REDUCTASE, (ACETOIN DEHYDROGENASE) (AR)] [SP:Q04520]
[DB:swissprot] >sp:[LN:E47069] [AC:E47069] [PN:(R,R)-butanediol
dehydrogenase,:acetoin (diacetyl) reductase] [GN:budC] [CL:butanediol
dehydrogenase:short-chain alcohol dehydrogenase homology] [OR:Klebsiella
terrigena] [EC:1.1.1.4] [DB:pir1] >gp:[GI:g149173] [LN:KPNBUDOPRN] [AC:L04507]
[PN:acetoin(diacetyl)reductase] [GN:budC] [OR:Klebsiella terrigena]
[SR:Klebsiella terrigena (library: VTT-E-74023) DNA] [DB:genpept-bct1]
[DE:Klebsiella terrigena budABC operon, including alpha-acetolactatedecarboxylase
(budA), alpha-acetolactate synthase (budB), andacetoin(diacetyl)reductase (budC)
genes, complete coding regions.] [LE:2671] [RE:3396] [DI:direct]

| ORF Name | NT ID | AA ID | NT/LN | AA/LN | Score | P-value |
|---|---|---|---|---|---|---|
| 13022308_c3_995 | 59 | 7230 | 684 | 227 | 148 | 5.2e-08 |

Description gp:[GI:g1118097] [LN:CELC50F7] [AC:U41557] [GN:C50F7.2] [OR:Caenorhabditis
elegans] [SR:Caenorhabditis elegans strain=Bristol N2] [DB:genpept-inv1]
[DE:Caenorhabditis elegans cosmid C50F7.] [NT:proline and glycine-rich]
[LE:16492:16638] [RE:16526:18372] [DI:directJoin]

| ORF Name | NT ID | AA ID | NT/LN | AA/LN | Score | P-value |
|---|---|---|---|---|---|---|
| 13022888_c1_636 | 60 | 7231 | 1020 | 339 | 433 | 1.1e-40 |

Description sp:[LN:C70817] [AC:C70817] [PN:probable 3-hydroxybutyryl-CoA dehydrogenase]
[GN:fadB3] [CL:3-hydroxyacyl-CoA dehydrogenase homology] [OR:Mycobacterium
tuberculosis] [DB:pir2] >gp:[GI:e1253946:g2916980] [LN:MTV048]
[AC:AL022003:AL123456] [PN:fadB3] [GN:fadB3] [OR:Mycobacterium tuberculosis]
[DB:genpept-bct1] [DE:Mycobacterium tuberculosis H37Rv complete genome; segment
77/162.] [NT:Rv1715, (MTV048.02), len: 304; fadB3, Probable] [LE:833] [RE:1747]
[DI:direct]

| ORF Name | NT ID | AA ID | NT/LN | AA/LN | Score | P-value |
|---|---|---|---|---|---|---|
| 13128966_f1_33 | 61 | 7232 | 669 | 222 | 138 | 3.3e-07 |

Description sp:[LN:S50754] [AC:S50754] [PN:hypothetical protein WP6] [OR:Chlamydomonas
eugametos] [DB:pir2] >gp:[GI:g530878] [LN:CREWP6A] [AC:L29028] [GN:WP6]
[OR:Chlamydomonas eugametos] [DB:genpept-pln2] [DE:Chlamydomonas eugametos WP6
mRNA, complete cds.] [NT:amino acid feature: N-glycosylation sites, aa 41 ..]
[LE:131] [RE:1186] [DI:direct]

| ORF_Name | NT ID | AA ID | NT/LN | AA/LN | Score | P-value |
|---|---|---|---|---|---|---|
| 13156342_c1_690 | 62 | 7233 | 429 | 142 | 131 | 1.1e-08 |

Description sp:[LN:T03486] [AC:T03486] [PN:conserved hypothetical protein] [OR:Rhodobacter capsulatus] [DB:pir2] [MP:1] >gp:[GI:g3128287] [LN:AF010496] [AC:AF010496] [PN:hypothetical protein] [OR:Rhodobacter capsulatus] [DB:genpept-bct2] [DE:Rhodobacter capsulatus strain SB1003, partial genome.] [LE:42561] [RE:42980] [DI:complement]

| ORF_Name | NT ID | AA ID | NT/LN | AA/LN | Score | P-value |
|---|---|---|---|---|---|---|
| 13678311_f1_81 | 63 | 7234 | 714 | 237 | 134 | 8.7e-09 |

Description sp:[LN:YRHA_ECOLI] [AC:P46856] [GN:YRHA] [OR:Escherichia coli] [DE:HYPOTHETICAL 16.0 KD PROTEIN IN GNTR-GGT INTERGENIC REGION (O138)] [SP:P46856] [DB:swissprot] >sp:[LN:F65140] [AC:F65140] [PN:hypothetical protein b3443] [CL:Escherichia coli hypothetical protein b3443] [OR:Escherichia coli] [DB:pir2] >gp:[GI:g1789851] [LN:AE000420] [AC:AE000420:U00096] [PN:orf, hypothetical protein] [GN:yrhA] [FN:orf; Unknown] [OR:Escherichia coli] [DB:genpept-bct2] [DE:Escherichia coli K-12 MG1655 section 310 of 400 of the completegenome.] [NT:o138] [LE:9428] [RE:9844] [DI:direct] >gp:[GI:g606378] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_o138; poor E. coli, good phage statistics] [LE:363775] [RE:364191] [DI:direct]

| ORF_Name | NT ID | AA ID | NT/LN | AA/LN | Score | P-value |
|---|---|---|---|---|---|---|
| 13678956_c2_918 | 64 | 7235 | 1635 | 544 | 121 | 8.7e-05 |

Description sp:[LN:E70526] [AC:E70526] [PN:hypothetical protein Rv0324] [GN:Rv0324] [OR:Mycobacterium tuberculosis] [DB:pir2] >gp:[GI:e321679:g2193945] [LN:MTCY63] [AC:Z96800:AL123456] [PN:hypothetical protein Rv0324] [GN:Rv0324] [OR:Mycobacterium tuberculosis] [DB:genpept-bct1] [DE:Mycobacterium tuberculosis H37Rv complete genome; segment 16/162.] [NT:Rv0324, (MTCY63.29), len: 226. Function: unknown,] [LE:30100] [RE:30780] [DI:direct]

| ORF Name | NT ID | AA ID | NT LN | AA LN | Score | P-value |
|---|---|---|---|---|---|---|
| 1385902_f3_473 | 65 | 7236 | 642 | 213 | 597 | 4.5e-58 |

Description sp:[LN:CCMA_ECOLI] [AC:P33931] [GN:CCMA] [OR:Escherichia coli] [DE:PROTEIN CCMA)]
[SP:P33931] [DB:swissprot] >sp:[LN:G64989] [AC:G64989] [PN:heme exporter protein
A] [GN:ccmA] [CL:cytochrome c biogenesis protein CycV:ATP-binding cassette
homology] [OR:Escherichia coli] [DB:pir2] >gp:[GI:g405926] [LN:ECOHU49]
[AC:U00008] [PN:yejW] [OR:Escherichia coli] [SR:Escherichia coli K12 BHB2600]
[DB:genpept-bct1] [DE:centisome 49 region of E.coli K12 BHB2600.] [NT:ABC-type
ATP-dependent transporter; may be part of] [LE:24073] [RE:24690] [DI:complement]
>gp:[GI:g1788529] [LN:AE000309] [AC:AE000309:U00096] [PN:ATP binding protein of
heme exporter A] [GN:ccmA] [FN:transport; Protein, peptide secretion]
[OR:Escherichia coli] [DB:genpept-bct2] [DE:Escherichia coli K-12 MG1655 section
199 of 400 of the completegenome.] [NT:f205; 100 pct identical to CCMA_ECOLI SW:
P33931] [LE:6745] [RE:7362] [DI:complement]

| ORF Name | NT ID | AA ID | NT LN | AA LN | Score | P-value |
|---|---|---|---|---|---|---|
| 1385916_f3_410 | 66 | 7237 | 1101 | 366 | 550 | 4.3e-53 |

Description gp:[GI:g2582422] [LN:AF026067] [AC:AF026067] [PN:FMNH2-dependent methanesulfonate
sulfonatase] [GN:msuD] [OR:Pseudomonas aeruginosa] [DB:genpept-bct1]
[DE:Pseudomonas aeruginosa NADH-dependent FMN reductase (msuE),FMNH2-dependent
methanesulfonate sulfonatase (msuD), and putativeFMNH2-dependent monooxygenase
(msuC) genes, complete cds.] [LE:1727] [RE:2872] [DI:direct]

| ORF Name | NT ID | AA ID | NT LN | AA LN | Score | P-value |
|---|---|---|---|---|---|---|
| 13861592_c2_832 | 67 | 7238 | 903 | 300 | 587 | 5.2e-57 |

Description gp:[GI:g4929323] [LN:AF145230] [AC:AF145230] [PN:beta-hydroxybutyrate
dehydrogenase] [GN:hbdh1] [OR:Ralstonia eutropha] [DB:genpept-bct2] [DE:Ralstonia
eutropha beta-hydroxybutyrate dehydrogenase (hbdh1) gene,complete cds.] [LE:60]
[RE:836] [DI:direct]

| ORF Name | NT ID | AA ID | NT LN | AA LN | Score | P-value |
|---|---|---|---|---|---|---|
| 14187661_c3_1141 | 68 | 7239 | 468 | 155 | 361 | 4.6e-33 |

Description sp:[LN:KPY1_SALTY] [AC:P77983] [GN:PYKF] [OR:Salmonella typhimurium]
[EC:2.7.1.40] [DE:PYRUVATE KINASE I, (PK-1)] [SP:P77983] [DB:swissprot]
>gp:[GI:e258633:g1526982] [LN:STPYKFORF] [AC:X99945] [PN:pyruvate kinase like
protein] [GN:pykF] [OR:Salmonella typhimurium] [DB:genpept-bct1]
[DE:S.typhimurium ORF's 32 & 48 & gene pykF.] [SP:P77983] [LE:2919] [RE:4331]
[DI:direct]

| ORF_Name | NT_ID | AA_ID | NT LN | AA LN | Score | P-value |
|---|---|---|---|---|---|---|
| 14192127_f3_506 | 69 | 7240 | 1155 | 384 | 200 | 2.6e-13 |

Description sp:[LN:CHRA_PSEAE] [AC:P14285] [GN:CHRA] [OR:Pseudomonas aeruginosa] [DE:CHROMATE TRANSPORT PROTEIN] [SP:P14285] [DB:swissprot] >gp:[GI:g151133] [LN:PSECHRA] [AC:M29034] [PN:chromate transport protein] [GN:crhO] [OR:Pseudomonas aeruginosa] [SR:Pseudomonas aeruginosa (individual_isolate clinical isolate] [DB:genpept-bct1] [DE:P.aeruginosa chromate transport protein (chrA) gene, complete cds.] [LE:220] [RE:1470] [DI:direct]

| ORF_Name | NT_ID | AA_ID | NT LN | AA LN | Score | P-value |
|---|---|---|---|---|---|---|
| 1425628_f1_73 | 70 | 7241 | 2670 | 889 | 479 | 4.1e-42 |

Description sp:[LN:YGCB_ECOLI] [AC:P38036:Q46902] [GN:YGCB] [OR:Escherichia coli] [DE:HYPOTHETICAL 100.5 KD PROTEIN IN IAP-CYSH INTERGENIC REGION] [SP:P38036:Q46902] [DB:swissprot] >sp:[LN:E65057] [AC:E65057] [PN:hypothetical protein in cysH 3' region] [GN:ygcB] [OR:Escherichia coli] [DB:pir2] >gp:[GI:g882654] [LN:ECU29579] [AC:U29579] [OR:Escherichia coli] [DB:genpept-bct1] [DE:Escherichia coli K-12 genome; approximately 61 to 62 minutes.] [NT:alternate gene name ygcB; ORF_f888] [LE:56855] [RE:59521] [DI:complement] >gp:[GI:g1789119] [LN:AE000359] [AC:AE000359:U00096] [PN:orf, hypothetical protein] [GN:ygcB] [FN:orf; Unknown] [OR:Escherichia coli] [DB:genpept-bct2] [DE:Escherichia coli K-12 MG1655 section 249 of 400 of the completegenome.] [NT:f888; 99 pct identical to fragment YGCB_ECOLI] [LE:8128] [RE:10794] [DI:complement]

| ORF_Name | NT_ID | AA_ID | NT LN | AA LN | Score | P-value |
|---|---|---|---|---|---|---|
| 14351031_c3_1079 | 71 | 7242 | 351 | 116 | | |

Description

NO-HIT

| ORF_Name | NT_ID | AA_ID | NT LN | AA LN | Score | P-value |
|---|---|---|---|---|---|---|
| 14352026_c2_812 | 72 | 7243 | 897 | 298 | 692 | 3.9e-68 |

Description gp:[GI:g2570206] [LN:SPU59236] [AC:U59236] [OR:Synechococcus PCC7942] [DB:genpept-bct2] [DE:Synechococcus PCC7942 ribosomal protein S1 of 30S ribosome (rps1),ORF271, ORF231, ORF341, carboxyltransferase alpha subunit (accA),ORF245, ORF227, and GTP cyclohydrolase I (folE) genes, completecds, and ORF205 gene, partial cds.] [NT:ORF271] [LE:1027] [RE:1842] [DI:direct]

| ORF_Name | NT_ID | AA_ID | NT LN | AA LN | Score | P-value |
|---|---|---|---|---|---|---|
| 14489705_c1_577 | 73 | 7244 | 483 | 160 | 258 | 3.8e-22 |

Description sp:[LN:YYAH_BACSU] [AC:P37516] [GN:YYAH] [OR:Bacillus subtilis] [DE:HYPOTHETICAL 14.4 KD PROTEIN IN TETB-EXOA INTERGENIC REGION (ORFF)] [SP:P37516] [DB:swissprot] >sp:[LN:I39921] [AC:I39921:S66010:G70084] [PN:hypothetical protein yyaH] [GN:yyaH] [OR:Bacillus subtilis] [DB:pir2] >gp:[GI:d1005758:g467370] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:44346] [RE:44726] [DI:complement] >gp:[GI:g438466] [LN:BACORFDEFG] [AC:L16865] [OR:Bacillus subtilis] [SR:Bacillus subtilis (strain BD99) DNA] [DB:genpept-bct1] [DE:Bacillus subtilis membrane transport protein homologue (orfD),acetyltransferase homologue (orfG), orfF, PurR repressor homologue(orfE), complete cds's.] [NT:Possible operon with orfG. Hydrophilic, no] [LE:2195] [RE:2575] [DI:complement] >gp:[GI:e1184812:g2636633] [LN:BSUB0021] [AC:Z99124:AL009126] [GN:yyaH] [FN:unknown] [OR:Bacillus subtilis] [DB:genpept-bct1] [DE:Bacillus subtilis complete genome (section 21 of 21): from 3999281to 4214814.] [SP:P37516] [LE:196278] [RE:196658] [DI:complement]

| ORF_Name | NT_ID | AA_ID | NT LN | AA LN | Score | P-value |
|---|---|---|---|---|---|---|
| 14900203_f1_112 | 74 | 7245 | 654 | 217 | 134 | 3.3e-08 |

Description gp:[GI:g6015894] [LN:SSU18930] [AC:Y18930] [PN:hypothetical protein] [GN:ORF-c21_020] [OR:Sulfolobus solfataricus] [DB:genpept-bct1] [DE:Sulfolobus solfataricus 281 kb genomic DNA fragment, strain P2.] [LE:216796] [RE:217362] [DI:complement]

| ORF_Name | NT_ID | AA_ID | NT LN | AA LN | Score | P-value |
|---|---|---|---|---|---|---|
| 14962656_c3_975 | 75 | 7246 | 351 | 116 | 239 | 3.9e-20 |

Description gp:[GI:d1036797:g4062594] [LN:D90740] [AC:D90740:AB001340] [OR:Escherichia coli] [SR:Escherichia coli(strain:K12) DNA, clone:Kohara clone #230] [DB:genpept-bct1] [DE:Escherichia coli genomic DNA. (23.5 - 23.8 min).] [NT:ORF_ID:o230#3] [LE:5244] [RE:5519] [DI:direct]

| ORF_Name | NT_ID | AA_ID | NT LN | AA LN | Score | P-value |
|---|---|---|---|---|---|---|
| 15114541_c2_900 | 76 | 7247 | 996 | 331 | 208 | 3.9e-15 |

Description sp:[LN:S55316] [AC:S55316] [PN:mucin (clone PGM-2B)] [OR:Sus scrofa domestica] [SR:, domestic pig] [DB:pir2] >gp:[GI:g915207] [LN:SSGMUC1] [AC:U12768] [PN:gastric mucin] [FN:gel formation, gastric epithelial protection] [OR:Sus scrofa] [SR:pig] [DB:genpept-mam] [DE:Sus scrofa Yorkshire/Chester White/Hampshire clone PGM-SS-2Agastric mucin mRNA, partial cds.] [NT:Bases 1-105 encode a cysteine rich, non-repeat] [LE:<1] [RE:>951] [DI:direct]

| ORF_Name | NT_ID | AA_ID | NT/LN | AA/LN | Score | P-value |
|---|---|---|---|---|---|---|
| 15741593_c3_968 | 77 | 7248 | 189 | 62 | | |

Description

NO-HIT

| ORF_Name | NT_ID | AA_ID | NT/LN | AA/LN | Score | P-value |
|---|---|---|---|---|---|---|
| 16022783_f2_322 | 78 | 7249 | 1035 | 344 | 110 | 8.9e-09 |

Description sp:[LN:C72369] [AC:C72369] [PN:hypothetical protein TM0484] [GN:TM0484]
[OR:Thermotoga maritima] [DB:pir2] >gp:[GI:g4980995] [LN:AE001726]
[AC:AE001726:AE000512] [PN:pyrimidine precursor biosynthesis enzyme,] [GN:TM0484]
[OR:Thermotoga maritima] [DB:genpept-bct2] [DE:Thermotoga maritima section 38 of
136 of the complete genome.] [NT:similar to SP:P42883 SP:P43534 SP:P47183]
[LE:5016] [RE:5966] [DI:complement]

| ORF_Name | NT_ID | AA_ID | NT/LN | AA/LN | Score | P-value |
|---|---|---|---|---|---|---|
| 16120416_c2_919 | 79 | 7250 | 1227 | 408 | 119 | 0.00024 |

Description gp:[GI:g5732654] [LN:AF121019] [AC:AF121019] [PN:hypothetical protein Jv0291c]
[GN:Jv0291c] [OR:Mycobacterium tuberculosis H37Rv] [DB:genpept-bct2]
[DE:Mycobacterium tuberculosis H37Rv hypothetical protein Jv0291c(Jv0291c) mRNA,
complete cds.] [LE:1] [RE:969] [DI:direct]

| ORF_Name | NT_ID | AA_ID | NT/LN | AA/LN | Score | P-value |
|---|---|---|---|---|---|---|
| 16193812_f2_280 | 80 | 7251 | 2013 | 670 | 2619 | 2.5e-272 |

Description gp:[GI:g4378409] [LN:AF103874] [AC:AF103874] [PN:CcmF] [GN:ccmF] [OR:Pantoea
citrea] [DB:genpept-bct2] [DE:Pantoea citrea ccm operon, complete sequence.]
[NT:similar to the Escherichia coli CcmF] [LE:3624] [RE:5591] [DI:direct]

| ORF_Name | NT_ID | AA_ID | NT/LN | AA/LN | Score | P-value |
|---|---|---|---|---|---|---|
| 16222781_c3_1004 | 81 | 7252 | 513 | 170 | 121 | 1.3e-07 |

Description sp:[LN:G75032] [AC:G75032] [PN:probable translation initiation inhibitor PAB0825]
[GN:PAB0825] [OR:Pyrococcus abyssi] [DB:pir2] >gp:[GI:g5458669] [LN:CNSPAX05]
[AC:AJ248287:AL096836] [PN:TRANSLATION INITIATION INHIBITOR, PUTATIVE.]
[OR:Pyrococcus abyssi] [DB:genpept-bct1] [DE:Pyrococcus abyssi complete genome;
segment 5/6.] [NT:PAB0825] [LE:13130] [RE:13513] [DI:direct]

| ORF_Name | NT ID | AA ID | NT/LN | AA/LN | Score | P-value |
|---|---|---|---|---|---|---|
| 16254717_f2_334 | 82 | 7253 | 1182 | 393 | 291 | 1.2e-25 |

Description sp:[LN:YEGM_ECOLI] [AC:P76397] [GN:YEGM] [OR:Escherichia coli] [DE:HYPOTHETICAL 44.5 KD PROTEIN IN ALKA-BAES INTERGENIC REGION PRECURSOR] [SP:P76397] [DB:swissprot]

| ORF_Name | NT ID | AA ID | NT/LN | AA/LN | Score | P-value |
|---|---|---|---|---|---|---|
| 16275952_f3_429 | 83 | 7254 | 1053 | 350 | 520 | 6.6e-50 |

Description sp:[LN:S74439] [AC:S74439] [PN:iron(III) dicitrate transport system permease protein fecD:protein slr1317:protein slr1317] [GN:fecD] [CL:vitamin B12 transport protein btuC] [OR:Synechocystis sp.] [SR:PCC 6803, , PCC 6803] [SR:PCC 6803, ] [DB:pir2] >gp:[GI:d1017324:g1651663] [LN:D90899] [AC:D90899:AB001339] [PN:iron(III) dicitrate transport system permease] [GN:fecD] [OR:Synechocystis sp.] [SR:Synechocystis sp. (strain:PCC6803) DNA] [DB:genpept-bct1] [DE:Synechocystis sp. PCC6803 complete genome, 1/27, 1-133859.] [NT:ORF_ID:slr1317] [LE:14626] [RE:15675] [DI:direct]

| ORF Name | NT ID | AA ID | NT/LN | AA/LN | Score | P-value |
|---|---|---|---|---|---|---|
| 16504380_f3_530 | 84 | 7255 | 363 | 120 | 443 | 9.5e-42 |

Description sp:[LN:A64845] [AC:A64845:B64786:E64765:G64975:B64756] [PN:hypothetical protein
b1027:hypothetical protein b0298:hypothetical protein b0373:hypothetical protein
b0540:hypothetical protein b2088] [OR:Escherichia coli] [DB:pir2]
>gp:[GI:g1778454] [LN:ECU82598] [AC:U82598] [OR:Escherichia coli]
[DB:genpept-bct1] [DE:Escherichia coli genomic sequence of minutes 9 to 12.]
[NT:hypothetical protein] [LE:7464] [RE:7772] [DI:direct] >gp:[GI:g1786489]
[LN:AE000137] [AC:AE000137:U00096] [PN:putative factor] [GN:b0298] [FN:putative
factor; Not classified] [OR:Escherichia coli] [DB:genpept-bct2] [DE:Escherichia
coli K-12 MG1655 section 27 of 400 of the completegenome.] [NT:o102; 33 pct
identical (5 gaps) to 90 residues of] [LE:2898] [RE:3206] [DI:direct]
>gp:[GI:g1786571] [LN:AE000144] [AC:AE000144:U00096] [PN:putative factor]
[GN:b0373] [FN:putative factor; Not classified] [OR:Escherichia coli]
[DB:genpept-bct2] [DE:Escherichia coli K-12 MG1655 section 34 of 400 of the
completegenome.] [NT:f102; This 102 aa ORF is 33 pct identical (5 gaps)]
[LE:2424] [RE:2732] [DI:complement] >gp:[GI:g1786752] [LN:AE000160]
[AC:AE000160:U00096] [PN:orf, hypothetical protein] [GN:b0540] [FN:orf; Unknown]
[OR:Escherichia coli] [DB:genpept-bct2] [DE:Escherichia coli K-12 MG1655 section
50 of 400 of the completegenome.] [NT:o102; This 102 aa ORF is 33 pct identical
(5 gaps)] [LE:181] [RE:489] [DI:direct] >gp:[GI:g1787264] [LN:AE000204]
[AC:AE000204:U00096] [PN:orf, hypothetical protein] [GN:b1027] [FN:orf; Unknown]
[OR:Escherichia coli] [DB:genpept-bct2] [DE:Escherichia coli K-12 MG1655 section
94 of 400 of the completegenome.] [NT:f102; This 102 aa ORF is 33 pct identical
(5 gaps)] [LE:10349] [RE:10657] [DI:complement] >gp:[GI:g1788404] [LN:AE000298]
[AC:AE000298:U00096] [PN:orf, hypothetical protein] [GN:b2088] [FN:orf; Unknown]
[OR:Escherichia coli] [DB:genpept-bct2] [DE:Escherichia coli K-12 MG1655 section
188 of 400 of the completegenome.] [NT:o102; This 102 aa ORF is 33 pct identical
(5 gaps)] [LE:5183] [RE:5491] [DI:direct] >gp:[GI:g1657498] [LN:ECU73857]
[AC:U73857] [OR:Escherichia coli] [DB:genpept-bct2] [DE:Escherichia coli
chromosome minutes 6-8.] [NT:hypothetical protein] [LE:23080] [RE:23388]
[DI:direct] >gp:[GI:g1657568] [LN:ECU73857] [AC:U73857] [OR:Escherichia coli]
[DB:genpept-bct2] [DE:Escherichia coli chromosome minutes 6-8.] [NT:hypothetical
protein] [LE:100192] [RE:100500] [DI:complement]

| ORF Name | NT ID | AA ID | NT/LN | AA/LN | Score | P-value |
|---|---|---|---|---|---|---|
| 16532092_c1_711 | 85 | 7256 | 297 | 98 | 138 | 1.8e-07 |

Description gp:[GI:e258467:g1491621] [LN:BHT1UL] [AC:Z78205] [PN:UL36] [OR:Bovine herpesvirus
1] [DB:genpept-vrl] [DE:Bovine herpesvirus type 1 UL22-35 genes.] [NT:very large
tegument protein] [LE:108] [RE:9851] [DI:direct] >gp:[GI:e1187307:g2653311]
[LN:BHV1CGEN] [AC:AJ004801] [PN:very large virion protein (tegument)] [GN:UL36]
[OR:Bovine herpesvirus type 1.1] [DB:genpept-vrl] [DE:Bovine herpesvirus 1
complete genome.] [LE:30908] [RE:40651] [DI:direct]

| ORF_Name | NT ID | AA ID | NT/LN | AA/LN | Score | P-value |
|---|---|---|---|---|---|---|
| 16535003_c1_697 | 86 | 7257 | 201 | 66 | | |

Description

NO-HIT

| ORF_Name | NT ID | AA ID | NT/LN | AA/LN | Score | P-value |
|---|---|---|---|---|---|---|
| 16602341_c3_1105 | 87 | 7258 | 414 | 137 | 140 | 1.2e-09 |

Description sp:[LN:G72510] [AC:G72510] [PN:hypothetical protein APE2061] [GN:APE2061]
[OR:Aeropyrum pernix] [DB:pir2] >gp:[GI:d1044857;g5105759] [LN:AP000063]
[AC:AP000063] [PN:114aa long hypothetical protein] [GN:APE2061] [OR:Aeropyrum
pernix] [SR:Aeropyrum pernix (strain:K1) DNA] [DB:genpept-bct1] [DE:Aeropyrum
pernix genomic DNA, section 6/7.] [NT:similar to OWL:AP00000656 percent
identity:52.747] [LE:58153] [RE:58497] [DI:direct]

| ORF_Name | NT ID | AA ID | NT/LN | AA/LN | Score | P-value |
|---|---|---|---|---|---|---|
| 16691682_c1_708 | 88 | 7259 | 1623 | 540 | 467 | 1.2e-46 |

Description gp:[GI:g3212228] [LN:U32825] [AC:U32825;L42023] [PN:H. influenzae predicted
coding region HI1466.1] [GN:HI1466.1] [OR:Haemophilus influenzae Rd]
[DB:genpept-bct2] [DE:Haemophilus influenzae Rd section 140 of 163 of the
completegenome.] [NT:Brute Force ORF; identified by GeneMark; putative] [LE:230]
[RE:1267] [DI:direct]

| ORF_Name | NT ID | AA ID | NT/LN | AA/LN | Score | P-value |
|---|---|---|---|---|---|---|
| 16698256_c1_682 | 89 | 7260 | 939 | 312 | 109 | 1.2e-05 |

Description sp:[LN:Y4KQ_RHISN] [AC:P55535] [GN:Y4KQ] [OR:Rhizobium sp] [SR:,strain NGR234]
[DE:VERY HYPOTHETICAL 15.3 KD PROTEIN Y4KQ] [SP:P55535] [DB:swissprot]
>sp:[LN:T10871] [AC:T10871] [PN:y4kQ protein] [GN:y4kQ] [CL:Rhizobium plasmid
pNGR234a y4kQ protein] [OR:Rhizobium sp.] [SR:strain NGR234, , strain NGR234]
[SR:strain NGR234, ] [DB:pir2] >gp:[GI:g2182494] [LN:AE000082]
[AC:AE000082;U00090] [PN:Y4kQ] [GN:y4kQ] [OR:Rhizobium sp. NGR234]
[DB:genpept-bct2] [DE:Rhizobium sp. NGR234 plasmid pNGR234a, section 19 of 46 of
thecomplete plasmid sequence.] [NT:hypothetical 15.3 kd protein (possibly)]
[LE:2589] [RE:3017] [DI:complement]

122

| ORF Name | NT ID | AA ID | NT/LN | AA/LN | Score | P-value |
|---|---|---|---|---|---|---|
| 16698277_c1_623 | 90 | 7261 | 999 | 332 | 129 | 1.2e-07 |

Description sp:[LN:C72369] [AC:C72369] [PN:hypothetical protein TM0484] [GN:TM0484]
[OR:Thermotoga maritima] [DB:pir2] >gp:[GI:g4980995] [LN:AE001726]
[AC:AE001726:AE000512] [PN:pyrimidine precursor biosynthesis enzyme,] [GN:TM0484]
[OR:Thermotoga maritima] [DB:genpept-bct2] [DE:Thermotoga maritima section 38 of
136 of the complete genome.] [NT:similar to SP:P42883 SP:P43534 SP:P47183]
[LE:5016] [RE:5966] [DI:complement]

| ORF Name | NT ID | AA ID | NT/LN | AA/LN | Score | P-value |
|---|---|---|---|---|---|---|
| 16849043_f2_298 | 91 | 7262 | 312 | 103 | 124 | 6.0e-08 |

Description sp:[LN:F72628] [AC:F72628] [PN:hypothetical protein APE1486] [GN:APE1486]
[OR:Aeropyrum pernix] [DB:pir2] >gp:[GI:d1044270:g5105170] [LN:AP000061]
[AC:AP000061] [PN:197aa long hypothetical protein] [GN:APE1486] [OR:Aeropyrum
pernix] [SR:Aeropyrum pernix (strain:K1) DNA] [DB:genpept-bct1] [DE:Aeropyrum
pernix genomic DNA, section 4/7.] [LE:226772] [RE:227365] [DI:direct]

| ORF Name | NT ID | AA ID | NT/LN | AA/LN | Score | P-value |
|---|---|---|---|---|---|---|
| 16893761_c2_771 | 92 | 7263 | 213 | 70 | | |

Description

NO-HIT

| ORF Name | NT ID | AA ID | NT/LN | AA/LN | Score | P-value |
|---|---|---|---|---|---|---|
| 16917793_c3_1013 | 93 | 7264 | 321 | 106 | | |

Description

NO-HIT

| ORF Name | NT ID | AA ID | NT/LN | AA/LN | Score | P-value |
|---|---|---|---|---|---|---|
| 16975155_f3_478 | 94 | 7265 | 651 | 216 | 448 | 2.8e-42 |

Description gp:[GI:g4378411] [LN:AF103874] [AC:AF103874] [PN:CcmH] [GN:ccmH] [OR:Pantoea
citrea] [DB:genpept-bct2] [DE:Pantoea citrea ccm operon, complete sequence.]
[NT:similar to Escherichia coli CcmH] [LE:6151] [RE:6708] [DI:direct]

| ORF_Name | NT_ID | AA_ID | NT/LN | AA/LN | Score | P-value |
|---|---|---|---|---|---|---|
| 17052041_c2_845 | 95 | 7266 | 594 | 197 | 187 | 6.1e-14 |

Description sp:[LN:SKXLAG] [AC:S07498;A34140] [PN:dermal gland protein APEG precursor]
[CL:dermal gland protein APEG;trefoil homology] [OR:Xenopus laevis] [SR:, African clawed frog] [DB:pir1]

| ORF_Name | NT_ID | AA_ID | NT/LN | AA/LN | Score | P-value |
|---|---|---|---|---|---|---|
| 17052041_c3_1039 | 96 | 7267 | 192 | 63 | | |

Description

NO-HIT

| ORF_Name | NT_ID | AA_ID | NT/LN | AA/LN | Score | P-value |
|---|---|---|---|---|---|---|
| 20079390_c1_605 | 97 | 7268 | 834 | 277 | 453 | 8.3e-43 |

Description gp:[GI:g1754720] [LN:SMU81296] [AC:U81296] [PN:survival protein surE] [GN:surE]
[OR:Sinorhizobium meliloti] [DB:genpept-bct2] [DE:Sinorhizobium meliloti survival protein surE homolog (surE),L-isoaspartyl protein carboxyl methyltransferase homolog (pcm),biotin transport regulator (biosS), and lipoprotein homolog (lppB)genes, complete cds.] [NT:homolog of E. coli survival protein surE, deposited] [LE:47] [RE:817] [DI:direct]

| ORF_Name | NT_ID | AA_ID | NT/LN | AA/LN | Score | P-value |
|---|---|---|---|---|---|---|
| 2051436_f1_8 | 98 | 7269 | 1356 | 451 | 972 | 8.3e-98 |

Description sp:[LN:DGOT_ECOLI] [AC:P31457] [GN:DGOT] [OR:Escherichia coli] [DE:D-GALACTONATE TRANSPORTER] [SP:P31457] [DB:swissprot] >sp:[LN:D65171] [AC:D65171]
[PN:hypothetical 48.8 kD protein in ibpA-gyrB intergenic region] [GN:yidT]
[CL:hexuronate transporter] [OR:Escherichia coli] [DB:pir1] >gp:[GI:g290540]
[LN:ECOUW82] [AC:L10328] [GN:f445] [FN:unknown] [OR:Escherichia coli]
[SR:Escherichia coli K12 strain MG1655; lambda clones EC14-52] [DB:genpept-bct1]
[DE:E. coli; the region from 81.5 to 84.5 minutes.] [LE:59832] [RE:61169]
[DI:complement] >gp:[GI:g1790126] [LN:AE000446] [AC:AE000446;U00096]
[PN:D-galactonate transport] [GN:dgoT] [FN:transport; Transport of small molecules;] [OR:Escherichia coli] [DB:genpept-bct2] [DE:Escherichia coli K-12 MG1655 section 336 of 400 of the completegenome.] [NT:f445; formerly designated yidT] [LE:3512] [RE:4849] [DI:complement]

| ORF_Name | NT_ID | AA_ID | NT LN | AA LN | Score | P-value |
|---|---|---|---|---|---|---|
| 20959577_f2_321 | 99 | 7270 | 981 | 326 | 408 | 4.8e-38 |

Description gp:[GI:g1439550] [LN:RLU39409] [AC:U39409] [OR:Rhizobium leguminosarum bv. trifolii] [DB:genpept-bct1] [DE:Rhizobium leguminosarum bv. trifolii TfuA (tfuA), gene, completecds.] [NT:ORF1; high similarity to members of the LysR] [LE:61] [RE:963] [DI:direct]

| ORF_Name | NT_ID | AA_ID | NT LN | AA LN | Score | P-value |
|---|---|---|---|---|---|---|
| 2149187_f2_233 | 100 | 7271 | 780 | 259 | 475 | 3.9e-45 |

Description sp:[LN:HISJ_NEIGO] [AC:Q06758] [GN:HISJ] [OR:Neisseria gonorrhoeae] [DE:HISTIDINE-BINDING PROTEIN PRECURSOR (HBP)] [SP:Q06758] [DB:swissprot] >sp:[LN:S19184] [AC:S19184] [PN:hypothetical protein] [CL:lysine-arginine-ornithine-binding protein] [OR:Neisseria gonorrhoeae] [DB:pir2] >gp:[GI:g49068] [LN:NGHISJHOM] [AC:X64421] [OR:Neisseria gonorrhoeae] [DB:genpept-bct1] [DE:N.gonorrhoeae gene homologous to hisJ and argT of E.coli andS.typhimurium.] [NT:gene homologous to hisJ (E.coli) and argT] [SP:Q06758] [LE:683] [RE:1489] [DI:direct]

| ORF_Name | NT_ID | AA_ID | NT LN | AA LN | Score | P-value |
|---|---|---|---|---|---|---|
| 21614791_f2_281 | 101 | 7272 | 906 | 301 | 361 | 4.6e-33 |

Description sp:[LN:CCMH_ECOLI] [AC:P33925] [GN:CCMH] [OR:Escherichia coli] [DE:CYTOCHROME C-TYPE BIOGENESIS PROTEIN CCMH PRECURSOR] [SP:P33925] [DB:swissprot] >sp:[LN:H64988] [AC:H64988] [PN:cytochrome c-type biogenesis protein CcmH precursor] [GN:ccmH] [OR:Escherichia coli] [DB:pir2] >gp:[GI:g405919] [LN:ECOHU49] [AC:U00008] [PN:yejP] [OR:Escherichia coli] [SR:Escherichia coli K12 BHB2600] [DB:genpept-bct1] [DE:centisome 49 region of E.coli K12 BHB2600.] [NT:probably part of aeg-46.5 operon; homolog of] [LE:18411] [RE:19463] [DI:complement] >gp:[GI:g1788522] [LN:AE000309] [AC:AE000309:U00096] [PN:possible subunit of heme lyase] [GN:ccmH] [FN:putative enzyme; Energy metabolism, carbon:] [OR:Escherichia coli] [DB:genpept-bct2] [DE:Escherichia coli K-12 MG1655 section 199 of 400 of the completegenome.] [NT:f350; 100 pct identical to CCMH_ECOLI SW: P33925] [LE:1082] [RE:2134] [DI:complement]

| ORF_Name | NT_ID | AA_ID | NT LN | AA LN | Score | P-value |
|---|---|---|---|---|---|---|
| 21619703_c1_586 | 102 | 7273 | 546 | 181 | | |

Description

NO-HIT

| ORF Name | NT ID | AA ID | NT/LN | AA/LN | Score | P-value |
|---|---|---|---|---|---|---|
| 21694157_c3_1035 | 103 | 7274 | 585 | 194 | 174 | 3.0e-13 |

Description sp:[LN:YP20_BACLI] [AC:P05332] [GN:P20] [OR:Bacillus licheniformis]
[DE:HYPOTHETICAL P20 PROTEIN] [SP:P05332] [DB:swissprot] >sp:[LN:S00875]
[AC:S00875] [PN:hypothetical protein P20] [CL:Escherichia coli
ribosomal-protein-alanine N-acetyltransferase rimJ] [OR:Bacillus licheniformis]
[DB:pir1] >gp:[GI:g39573] [LN:BLP20] [AC:X07542] [OR:Bacillus licheniformis]
[DB:genpept-bct1] [DE:Bacillus licheniformis p20 gene.] [NT:P20 (AA 1-178)]
[SP:P05332] [LE:106] [RE:642] [DI:direct]

| ORF Name | NT ID | AA ID | NT/LN | AA/LN | Score | P-value |
|---|---|---|---|---|---|---|
| 22079576_c3_1082 | 104 | 7275 | 270 | 89 | 197 | 3.1e-15 |

Description sp:[LN:YBIC_ECOLI] [AC:P30178:P75778] [GN:YBIC] [OR:Escherichia coli]
[DE:HYPOTHETICAL 38.9 KD PROTEIN IN DING-GLNQ INTERGENIC REGION (O361)]
[SP:P30178:P75778] [DB:swissprot] >sp:[LN:A64817] [AC:A64817] [PN:malate
dehydrogenase homolog ybiC] [GN:ybiC] [CL:ybiC protein] [OR:Escherichia coli]
[DB:pir2] >gp:[GI:d1036453:g4062362] [LN:D90717] [AC:D90717:AB001340]
[PN:Hypothetical 38.9 kd protein in ding/rarB] [GN:ybiC] [OR:Escherichia coli]
[SR:Escherichia coli(strain:K12) DNA, clone:Kohara clone #204] [DB:genpept-bct1]
[DE:Escherichia coli genomic DNA. (17.9 - 18.2 min).] [NT:ORF_ID:o204#7; similar
to SwissProt Accession] [LE:7653] [RE:8738] [DI:direct] >gp:[GI:g1787020]
[LN:AE000182] [AC:AE000182:U00096] [PN:putative dehydrogenase] [GN:ybiC]
[FN:putative enzyme; Not classified] [OR:Escherichia coli] [DB:genpept-bct2]
[DE:Escherichia coli K-12 MG1655 section 72 of 400 of the completegenome.]
[NT:o361; 99 pct identical to YBIC_ECOLI SW: P30178] [LE:5618] [RE:6703]
[DI:direct]

| ORF Name | NT ID | AA ID | NT/LN | AA/LN | Score | P-value |
|---|---|---|---|---|---|---|
| 2212950_f2_373 | 105 | 7276 | 489 | 162 | | |

Description

NO-HIT

| ORF_Name | NT_ID | AA_ID | NT/LN | AA/LN | Score | P-value |
|---|---|---|---|---|---|---|
| 22133516_c2_930 | 106 | 7277 | 1020 | 339 | 797 | 2.9e-79 |

Description sp:[LN:YE71_HAEIN] [AC:Q57130:O05065] [GN:HI1471] [OR:Haemophilus influenzae]
[DE:HYPOTHETICAL ABC TRANSPORTER PERMEASE PROTEIN HI1471] [SP:Q57130:O05065]
[DB:swissprot] >sp:[LN:G64125] [AC:G64125] [PN:hemin transport protein homolog
HI1471:hemin permease homolog HI1471] [CL:ferrichrome ABC transporter]
[OR:Haemophilus influenzae] [DB:pir1] >gp:[GI:g1574312] [LN:U32825]
[AC:U32825:L42023] [PN:iron chelatin ABC transporter, permease protein,]
[GN:HI1471] [OR:Haemophilus influenzae Rd] [DB:genpept-bct2] [DE:Haemophilus
influenzae Rd section 140 of 163 of the completegenome.] [NT:similar to
GB:AE000511 SP:O05731 PID:2072455] [LE:4597] [RE:5610] [DI:complement]

| ORF_Name | NT_ID | AA_ID | NT/LN | AA/LN | Score | P-value |
|---|---|---|---|---|---|---|
| 22157193_f2_340 | 107 | 7278 | 918 | 305 | 1334 | 3.6e-136 |

Description gp:[GI:g6009398] [LN:AB024946] [AC:AB024946] [PN:Transposase] [GN:orf22]
[FN:transposase of IS3] [OR:Escherichia coli] [SR:Escherichia coli
(sub_species:enteropathogenic, strain:B171] [DB:genpept-bct1] [DE:Escherichia
coli plasmid pB171 genomic DNA, complete sequence.] [LE:19071] [RE:19937]
[DI:complement] >gp:[GI:g6009410] [LN:AB024946] [AC:AB024946] [PN:Transposase]
[GN:orf34] [FN:transposase of IS3] [OR:Escherichia coli] [SR:Escherichia coli
(sub_species:enteropathogenic, strain:B171] [DB:genpept-bct1] [DE:Escherichia
coli plasmid pB171 genomic DNA, complete sequence.] [LE:30507] [RE:31373]
[DI:direct]

| ORF_Name | NT_ID | AA_ID | NT/LN | AA/LN | Score | P-value |
|---|---|---|---|---|---|---|
| 22159627_f3_564 | 108 | 7279 | 417 | 138 | 113 | 1.2e-05 |

Description sp:[LN:G70545] [AC:G70545] [PN:hypothetical glycine-rich protein Rv0532]
[GN:Rv0532] [OR:Mycobacterium tuberculosis] [DB:pir2] >gp:[GI:e316973:g2113994]
[LN:MTY25D10] [AC:Z95558:AL123456] [PN:PE_PGRS] [GN:PE_PGRS] [OR:Mycobacterium
tuberculosis] [DB:genpept-bct1] [DE:Mycobacterium tuberculosis H37Rv complete
genome; segment 28/162.] [NT:Rv0532, (MTCY25D10.11), len: 594 aa, member of the]
[LE:8779] [RE:10563] [DI:direct]

| ORF_Name | NT ID | AA ID | NT LN | AA LN | Score | P-value |
|---|---|---|---|---|---|---|
| 22162931_c2_862 | 109 | 7280 | 1770 | 589 | 108 | 0.0076 |

Description sp:[LN:ENDA_HALVO] [AC:O07118] [GN:ENDA] [OR:Halobacterium volcanii]
[SR:,Haloferax volcanii] [EC:3.1.27.9] [DE:TRNA-INTRON ENDONUCLEASE,] [SP:O07118]
[DB:swissprot] >gp:[GI:g2160792] [LN:AF001578] [AC:AF001578] [PN:tRNA intron
endonuclease] [GN:endA] [OR:Haloferax volcanii] [DB:genpept-bct2] [DE:Haloferax
volcanii tRNA intron endonuclease (endA) gene, completecds, and putative
tryptophanyl aminoacyl tRNA synthetase (trpS)gene, partial cds.] [NT:EndA]
[LE:190] [RE:1209] [DI:direct]

| ORF_Name | NT ID | AA ID | NT LN | AA LN | Score | P-value |
|---|---|---|---|---|---|---|
| 22270433_c3_1009 | 110 | 7281 | 876 | 291 | 516 | 1.7e-49 |

Description sp:[LN:Y412_METJA] [AC:Q57855] [GN:MJ0412] [OR:Methanococcus jannaschii]
[DE:HYPOTHETICAL ABC TRANSPORTER ATP-BINDING PROTEIN MJ0412] [SP:Q57855]
[DB:swissprot] >sp:[LN:D64351] [AC:D64351] [PN:nitrate transport ATP-binding
protein] [CL:unassigned ATP-binding cassette proteins:ATP-binding cassette
homology] [OR:Methanococcus jannaschii] [DB:pir2] [MP:REV372553-371750]
>gp:[GI:g1591118] [LN:U67493] [AC:U67493:L77117] [PN:nitrate transporter protein
(nrtC) homolog] [GN:MJ0412] [OR:Methanococcus jannaschii] [DB:genpept-bct2]
[DE:Methanococcus jannaschii section 35 of 150 of the complete genome.]
[NT:similar to PID:1019380 percent identity: 47.43;] [LE:6304] [RE:7107]
[DI:complement]

| ORF_Name | NT ID | AA ID | NT LN | AA LN | Score | P-value |
|---|---|---|---|---|---|---|
| 22400127_c1_681 | 111 | 7282 | 2280 | 759 | 2581 | 2.6e-268 |

Description sp:[LN:FDHF_ECOLI] [AC:P07658:P78137] [GN:FDHF] [OR:Escherichia coli]
[EC:1.2.1.2] [DE:SUBUNIT) (FDH-H)] [SP:P07658:P78137] [DB:swissprot]
>sp:[LN:DEECFS] [AC:A24145:F65216:A36088] [PN:formate dehydrogenase, H
(hydrogenase-linked):formate dehydrogenase H (benzylviologen-linked)
(FDH-H):formate hydrogenlyase complex selenocysteine-containing protein]
[GN:fdhF] [CL:formate dehydrogenase] [OR:Escherichia coli] [EC:1.2.1.2] [DB:pir1]
[MP:92 min]

| ORF Name | NT ID | AA ID | NT/LN | AA/LN | Score | P-value |
|---|---|---|---|---|---|---|
| 22458537_c1_680 | 112 | 7283 | 1086 | 361 | 1176 | 2.0e-119 |

Description sp:[LN:YBIC_ECOLI] [AC:P30178:P75778] [GN:YBIC] [OR:Escherichia coli]
[DE:HYPOTHETICAL 38.9 KD PROTEIN IN DING-GLNQ INTERGENIC REGION (O361)]
[SP:P30178:P75778] [DB:swissprot] >sp:[LN:A64817] [AC:A64817] [PN:malate
dehydrogenase homolog ybiC] [GN:ybiC] [CL:ybiC protein] [OR:Escherichia coli]
[DB:pir2] >gp:[GI:d1036453:g4062362] [LN:D90717] [AC:D90717:AB001340]
[PN:Hypothetical 38.9 kd protein in ding/rarB] [GN:ybiC] [OR:Escherichia coli]
[SR:Escherichia coli(strain:K12) DNA, clone:Kohara clone #204] [DB:genpept-bct1]
[DE:Escherichia coli genomic DNA. (17.9 - 18.2 min).] [NT:ORF_ID:o204#7; similar
to SwissProt Accession] [LE:7653] [RE:8738] [DI:direct] >gp:[GI:g1787020]
[LN:AE000182] [AC:AE000182:UC0096] [PN:putative dehydrogenase] [GN:ybiC]
[FN:putative enzyme; Not classified] [OR:Escherichia coli] [DB:genpept-bct2]
[DE:Escherichia coli K-12 MG1655 section 72 of 400 of the completegenome.]
[NT:o361; 99 pct identical to YBIC_ECOLI SW: P30178] [LE:5618] [RE:6703]
[DI:direct]

| ORF Name | NT ID | AA ID | NT/LN | AA/LN | Score | P-value |
|---|---|---|---|---|---|---|
| 22478430_f2_304 | 113 | 7284 | 912 | 303 | 233 | 1.7e-19 |

Description sp:[LN:S25264] [AC:S25264] [PN:virK protein] [GN:virK] [OR:Shigella flexneri]
[DB:pir2] >gp:[GI:d1002253:g216944] [LN:SHFVIRK] [AC:D11025] [PN:virulence
protein] [GN:virK] [OR:Shigella flexneri] [SR:Shigella flexneri plasmid:pMYSH6000
DNA] [DB:genpept-bct1] [DE:Shigella flexneri plasmid pMYSH6000 virulence protein
(virK) gene,complete cds.] [LE:373] [RE:1323] [DI:direct]

| ORF Name | NT ID | AA ID | NT/LN | AA/LN | Score | P-value |
|---|---|---|---|---|---|---|
| 22677090_c2_822 | 114 | 7285 | 198 | 65 | | |

Description

NO-HIT

| ORF Name | NT ID | AA ID | NT/LN | AA/LN | Score | P-value |
|---|---|---|---|---|---|---|
| 22757961_c3_1115 | 115 | 7286 | 615 | 204 | | |

Description

NO-HIT

| ORF Name | NT ID | AA ID | NT LN | AA LN | Score | P-value |
|---|---|---|---|---|---|---|
| 22760816_c1_689 | 116 | 7287 | 1308 | 435 | 1287 | 3.5e-131 |

Description sp:[LN:YJIO_ECOLI] [AC:P39386] [GN:YJIO] [OR:Escherichia coli] [DE:HYPOTHETICAL
44.7 KD PROTEIN IN IADA-MCRD INTERGENIC REGION (F410)] [SP:P39386] [DB:swissprot]
>sp:[LN:S56562] [AC:S56562:C65248] [PN:hypothetical 44.7K protein (iadA-mcrD
intergenic region):hypothetical protein f410] [GN:yjiO] [CL:Escherichia coli
hypothetical protein (iadA-mcrD intergenic region)] [OR:Escherichia coli]
[DB:pir2] >gp:[GI:g537178] [LN:ECOUW93] [AC:U14003] [OR:Escherichia coli]
[DB:genpept-bct1] [DE:Escherichia coli K-12 chromosomal region from 92.8 to 00.1
minutes.] [NT:ORF_f410] [LE:258119] [RE:259351] [DI:complement] >gp:[GI:g1790794]
[LN:AE000504] [AC:AE000504:U00096] [PN:putative transport protein] [GN:yjiO]
[FN:putative transport; Not classified] [OR:Escherichia coli] [DB:genpept-bct2]
[DE:Escherichia coli K-12 MG1655 section 394 of 400 of the completegenome.]
[NT:f410; 100 pct identical amino acid sequence and] [LE:4608] [RE:5840]
[DI:complement]

| ORF Name | NT ID | AA ID | NT LN | AA LN | Score | P-value |
|---|---|---|---|---|---|---|
| 22769677_c1_579 | 117 | 7288 | 1737 | 578 | 536 | 1.3e-51 |

Description sp:[LN:B71130] [AC:B71130] [PN:probable oligopeptide binding protein APPA]
[GN:PH0807] [CL:dipeptide transport protein] [OR:Pyrococcus horikoshii] [DB:pir2]
>gp:[GI:d1030843:g3257217] [LN:AP000003]
[AC:AP000003:AB009484:AB009485:AB009486:AB009487:AB009488:AB009489] [PN:597aa
long hypothetical oligopeptide binding] [GN:PH0807] [OR:Pyrococcus horikoshii]
[SR:Pyrococcus horikoshii (strain:OT3) DNA] [DB:genpept-bct1] [DE:Pyrococcus
horikoshii OT3 genomic DNA, 544001-777000 nt. position(3/7).] [NT:similar to
Swiss_Prot:P42061 percent identity:] [LE:172178] [RE:173971] [DI:direct]

| ORF Name | NT ID | AA ID | NT LN | AA LN | Score | P-value |
|---|---|---|---|---|---|---|
| 22786412_c3_1084 | 118 | 7289 | 552 | 183 | 149 | 1.1e-09 |

Description gp:[GI:g4262637] [LN:CELW03G1] [AC:AF125964] [GN:W03G1.5] [OR:Caenorhabditis
elegans] [DB:genpept-inv2] [DE:Caenorhabditis elegans cosmid W03G1.] [NT:contains
similarity to collagens] [LE:2183] [RE:3598] [DI:complement]

| ORF_Name | NT_ID | AA_ID | NT LN | AA LN | Score | P-value |
|---|---|---|---|---|---|---|
| 22829001_f2_344 | 119 | 7290 | 987 | 328 | 434 | 8.5e-41 |

Description sp:[LN:RBSK_HAEIN] [AC:P44331] [GN:RBSK:HI0505] [OR:Haemophilus influenzae]
[EC:2.7.1.15] [DE:RIBOKINASE,] [SP:P44331] [DB:swissprot] >sp:[LN:B64073]
[AC:B64073] [PN:ribokinase,] [CL:ribokinase] [OR:Haemophilus influenzae]
[EC:2.7.1.15] [DB:pir2] >gp:[GI:g1573486] [LN:U32732] [AC:U32732:L42023]
[PN:ribokinase (rbsK)] [GN:HI0505] [OR:Haemophilus influenzae Rd]
[DB:genpept-bct2] [DE:Haemophilus influenzae Rd section 47 of 163 of the complete
genome.] [NT:similar to GB:L10328 SP:P05054 GB:M13169 PID:147516] [LE:5416]
[RE:6336] [DI:direct]

| ORF_Name | NT_ID | AA_ID | NT LN | AA LN | Score | P-value |
|---|---|---|---|---|---|---|
| 22870308_f1_9 | 120 | 7291 | 852 | 283 | 529 | 7.3e-51 |

Description gp:[GI:g2792323] [LN:AF040570] [AC:AF040570] [PN:aminoquinate/shkimate
dehydrogenase] [GN:rifI] [OR:Amycolatopsis mediterranei] [DB:genpept-bct2]
[DE:Amycolatopsis mediterranei rifamycin biosynthetic gene cluster.] [NT:RifI]
[LE:57542] [RE:58333] [DI:direct]

| ORF_Name | NT_ID | AA_ID | NT LN | AA LN | Score | P-value |
|---|---|---|---|---|---|---|
| 23468811_f3_460 | 121 | 7292 | 1056 | 351 | 410 | 3.0e-38 |

Description gp:[GI:e1312339:g3341582] [LN:VCH231093] [AC:AJ231093] [GN:z35f] [OR:Vibrio
cholerae] [DB:genpept-bct1] [DE:Vibrio cholerae z35f gene.] [LE:49] [RE:339]
[DI:direct]

| ORF_Name | NT_ID | AA_ID | NT LN | AA LN | Score | P-value |
|---|---|---|---|---|---|---|
| 23550187_c2_765 | 122 | 7293 | 567 | 188 | | |

Description

NO-HIT

| ORF_Name | NT_ID | AA_ID | NT LN | AA LN | Score | P-value |
|---|---|---|---|---|---|---|
| 23910750_c1_677 | 123 | 7294 | 1287 | 428 | 117 | 2.2e-07 |

Description gp:[GI:e1371522:g4165446] [LN:DMBH61I5] [AC:AL035245] [GN:EG:133E12.2]
[OR:Drosophila melanogaster] [SR:fruit fly] [DB:genpept-invl] [DE:Drosophila
melanogaster BAC clone BACH61I5.] [NT:/prediction=(method:]
[LE:20845:21667:23810:24027] [RE:21503:23661:23958:25415] [DI:directJoin]

| ORF_Name | NT_ID | AA_ID | NT/LN | AA/LN | Score | P-value |
|---|---|---|---|---|---|---|
| 24068800_c2_889 | 124 | 7295 | 1269 | 422 | 216 | 4.1e-15 |

Description sp:[LN:B69808] [AC:B69808] [PN:multidrug-efflux transporter homolog yfkF]
[GN:yfkF] [OR:Bacillus subtilis] [DB:pir2] >gp:[GI:e1182781:g2633115]
[LN:BSUB0005] [AC:Z99108:AL009126] [GN:yfkF] [FN:unknown] [OR:Bacillus subtilis]
[DB:genpept-bct1] [DE:Bacillus subtilis complete genome (section 5 of 21): from
802821 to1011250.] [NT:similar to multidrug-efflux transporter] [LE:60549]
[RE:61724] [DI:complement] >gp:[GI:d1024275:g2626818] [LN:D83967] [AC:D83967]
[PN:YfkF] [OR:Bacillus subtilis] [SR:Bacillus subtilis (strain:AC327) DNA]
[DB:genpept-bct1] [DE:Bacillus subtilis genomic DNA, 74 degree region.] [LE:6197]
[RE:7372] [DI:direct]

| ORF_Name | NT_ID | AA_ID | NT/LN | AA/LN | Score | P-value |
|---|---|---|---|---|---|---|
| 24072508_c3_1034 | 125 | 7296 | 216 | 71 | | |

Description

NO-HIT

| ORF_Name | NT_ID | AA_ID | NT/LN | AA/LN | Score | P-value |
|---|---|---|---|---|---|---|
| 24082880_c2_902 | 126 | 7297 | 699 | 232 | 326 | 2.4e-29 |

Description sp:[LN:YE66_HAEIN] [AC:P45220] [GN:HI1466] [OR:Haemophilus influenzae]
[DE:HYPOTHETICAL PROTEIN HI1466] [SP:P45220] [DB:swissprot] >sp:[LN:C64125]
[AC:C64125] [PN:ferrichrome-iron receptor homolog] [OR:Haemophilus influenzae]
[DB:pir2] >gp:[GI:g1574305] [LN:U32824] [AC:U32824:L42023] [PN:H. influenzae
predicted coding region HI1466] [GN:HI1466] [OR:Haemophilus influenzae Rd]
[DB:genpept-bct2] [DE:Haemophilus influenzae Rd section 139 of 163 of the
completegenome.] [NT:hypothetical protein; identified by GeneMark;] [LE:8731]
[RE:9276] [DI:direct]

| ORF_Name | NT_ID | AA_ID | NT/LN | AA/LN | Score | P-value |
|---|---|---|---|---|---|---|
| 24119455_c2_825 | 127 | 7298 | 717 | 238 | 678 | 1.2e-66 |

Description gp:[GI:e1490471:g5139558] [LN:SC4C6] [AC:AL079355] [PN:putative 3-oxoadipate
CoA-transferase subunit B] [GN:SC4C6.12c] [OR:Streptomyces coelicolor]
[DB:genpept-bct1] [DE:Streptomyces coelicolor cosmid 4C6.] [NT:SC4C6.12c, pcaJ,
probable 3-oxoadipate] [LE:13399] [RE:14052] [DI:complement]

| ORF Name | NT ID | AA ID | NT LN | AA LN | Score | P-value |
|---|---|---|---|---|---|---|
| 24220010_f3_409 | 128 | 7299 | 951 | 316 | 228 | 5.7e-19 |

Description sp:[LN:GLTC_BACSU] [AC:P20668] [GN:GLTC] [OR:Bacillus subtilis]
[DE:TRANSCRIPTIONAL REGULATORY PROTEIN GLTC] [SP:P20668] [DB:swissprot]
>sp:[LN:A69635] [AC:A69635:A33951:A61642] [PN:transcription activator of
glutamate synthase operon gltC:regulatory protein gltC] [GN:gltC] [CL:probable
transcription regulator lsyR] [OR:Bacillus subtilis] [DB:pir2]
>gp:[GI:e1183504:g2634229] [LN:BSUB0010] [AC:Z99113:AL009126] [PN:transcriptional
regulator (LysR family)] [GN:gltC] [FN:positive regulation of the glutamate
synthase] [OR:Bacillus subtilis] [DB:genpept-bct1] [DE:Bacillus subtilis complete
genome (section 10 of 21): from 1781201to 2014980.] [SP:P20668] [LE:232835]
[RE:233737] [DI:direct] >gp:[GI:e1185319:g2634240] [LN:BSUB0011]
[AC:Z99114:AL009126] [PN:transcriptional regulator (LysR family)] [GN:gltC]
[FN:positive regulation of the glutamate synthase] [OR:Bacillus subtilis]
[DB:genpept-bct1] [DE:Bacillus subtilis complete genome (section 11 of 21): from
2000171to 2207900.] [SP:P20668] [LE:13865] [RE:14767] [DI:direct]
>gp:[GI:g457514] [LN:M28509] [AC:M28509] [GN:gltC] [FN:positive transcriptional
regulator] [OR:Bacillus subtilis] [DB:genpept-bct1] [DE:Bacillus subtilis (gltC)
gene, complete cds and glutamate synthase,large subunit (gltA) gene, partial cds.
gene.] [LE:34] [RE:936] [DI:complement]

| ORF Name | NT ID | AA ID | NT LN | AA LN | Score | P-value |
|---|---|---|---|---|---|---|
| 24507191_c3_1011 | 129 | 7300 | 1437 | 478 | 806 | 3.2e-80 |

Description sp:[LN:S75545] [AC:S75545] [PN:hypothetical protein slr0806] [OR:Synechocystis
sp.] [SR:PCC 6803, , PCC 6803] [SR:PCC 6803, ] [DB:pir2]
>gp:[GI:d1018839:g1653190] [LN:D90911] [AC:D90911:AB001339] [PN:hypothetical
protein] [OR:Synechocystis sp.] [SR:Synechocystis sp. (strain:PCC6803) DNA]
[DB:genpept-bct1] [DE:Synechocystis sp. PCC6803 complete genome, 13/27,
1576593-1719643.] [NT:ORF_ID:slr0806] [LE:109307] [RE:110626] [DI:direct]

| ORF Name | NT ID | AA ID | NT LN | AA LN | Score | P-value |
|---|---|---|---|---|---|---|
| 24511090_f3_464 | 130 | 7301 | 300 | 99 | 117 | 3.3e-07 |

Description sp:[LN:YGBF_ECOLI] [AC:P45956] [GN:YGBF] [OR:Escherichia coli] [DE:HYPOTHETICAL
13.2 KD PROTEIN IN IAP-CYSH INTERGENIC REGION] [SP:P45956] [DB:swissprot]
>sp:[LN:F65056] [AC:F65056] [PN:hypothetical protein in iap 3' region] [GN:ygbF]
[OR:Escherichia coli] [DB:pir2] >gp:[GI:g1789112] [LN:AE000359]
[AC:AE000359:U00096] [PN:orf, hypothetical protein] [GN:ygbF] [FN:orf; Unknown]
[OR:Escherichia coli] [DB:genpept-bct2] [DE:Escherichia coli K-12 MG1655 section
249 of 400 of the completegenome.] [NT:f94; 100 pct identical to YGBF_ECOLI SW:
P45956] [LE:2144] [RE:2494] [DI:complement]

| ORF_Name | NT_ID | AA_ID | NT LN | AA LN | Score | P-value |
|---|---|---|---|---|---|---|
| 24634502_c1_644 | 131 | 7302 | 294 | 97 | | |

Description

NO-HIT

| ORF_Name | NT_ID | AA_ID | NT LN | AA LN | Score | P-value |
|---|---|---|---|---|---|---|
| 24659427_f1_72 | 132 | 7303 | 186 | 61 | 53 | 0.014 |

Description gp:[GI:g4100138] [LN:PTU94473] [AC:U94473] [PN:cytochrome b] [OR:Mitochondrion Phlebotomus tobbi] [SR:Phlebotomus tobbi] [DB:genpept-inv2] [DE:Phlebotomus tobbi cytochrome b gene, partial cds, tRNAser(UCN)gene, and NADH1 gene, partial cds, mitochondrial genes formitochondrial products.] [LE:<1] [RE:282] [DI:direct]

| ORF_Name | NT_ID | AA_ID | NT LN | AA LN | Score | P-value |
|---|---|---|---|---|---|---|
| 24687662_f2_372 | 133 | 7304 | 309 | 102 | | |

Description

NO-HIT

| ORF_Name | NT_ID | AA_ID | NT LN | AA LN | Score | P-value |
|---|---|---|---|---|---|---|
| 24816275_f1_107 | 134 | 7305 | 1182 | 393 | | |

Description

NO-HIT

| ORF_Name | NT_ID | AA_ID | NT LN | AA LN | Score | P-value |
|---|---|---|---|---|---|---|
| 24820305_f1_46 | 135 | 7306 | 903 | 300 | 703 | 2.7e-69 |

Description gp:[GI:g5731362] [LN:VCU52150] [AC:U52150] [PN:ATPase] [GN:viuC] [OR:Vibrio cholerae] [DB:genpept-bct2] [DE:Vibrio cholerae vibriobactin gene cluster, complete sequence.] [NT:component of vibriobactin transport system] [LE:9745] [RE:10584] [DI:direct]

| ORF_Name | NT_ID | AA_ID | NT LN | AA LN | Score | P-value |
|---|---|---|---|---|---|---|
| 24822157_f1_74 | 136 | 7307 | 1527 | 508 | | |

Description

NO-HIT

| ORF Name | NT ID | AA ID | NT LN | AA LN | Score | P-value |
|---|---|---|---|---|---|---|
| 25516641_f3_526 | 137 | 7308 | 1218 | 405 | 377 | 1.7e-37 |

Description sp:[LN:BAES_ECOLI] [AC:P30847:P76401] [GN:BAES] [OR:Escherichia coli]
[EC:2.7.3.-] [DE:SENSOR PROTEIN BAES,] [SP:P30847:P76401] [DB:swissprot]
>sp:[LN:E64974] [AC:E64974:JX0282] [PN:sensory kinase BaeS,:signal transduction
protein] [GN:baeS] [CL:sensor histidine kinase homology] [OR:Escherichia coli]
[EC:2.7.3.-] [DB:pir2] >gp:[GI:d1016658:g1736787] [LN:D90846]
[AC:D90846:AB001340] [PN:Sensor protein BaeS (EC 2.7.3.-).] [GN:baeS]
[OR:Escherichia coli] [SR:Escherichia coli (strain:K12) DNA, clone_lib:Kohara
lambda minise] [DB:genpept-bct1] [DE:E.coli genomic DNA, Kohara clone
357(46.5-46.8 min.).] [NT:ORF_ID:o357#3; similar to [SwissProt Accession]
[LE:5628] [RE:7031] [DI:direct] >gp:[GI:d1016669:g1736799] [LN:D90847]
[AC:D90847:AB001340] [PN:Sensor protein BaeS (EC 2.7.3.-).] [GN:baeS]
[OR:Escherichia coli] [SR:Escherichia coli (strain:K12) DNA, clone_lib:Kohara
lambda minise] [DB:genpept-bct1] [DE:E.coli genomic DNA, Kohara clone
358(46.6-46.9 min.).] [NT:ORF_ID:o357#3; similar to [SwissProt Accession]
[LE:273] [RE:1676] [DI:direct] >gp:[GI:g1788393] [LN:AE000297]
[AC:AE000297:U00096] [PN:sensor protein (for BaeR)] [GN:baeS] [FN:enzyme; RNA
synthesis, modification, DNA] [OR:Escherichia coli] [DB:genpept-bct2]
[EC:2.7.3.-] [DE:Escherichia coli K-12 MG1655 section 187 of 400 of the
completegenome.] [NT:o467; 98 pct identical (1 gap) to BAES_ECOLI] [LE:16269]
[RE:17672] [DI:direct]

| ORF Name | NT ID | AA ID | NT LN | AA LN | Score | P-value |
|---|---|---|---|---|---|---|
| 25516656_c1_642 | 138 | 7309 | 837 | 278 | 1293 | 8.0e-132 |

Description gp:[GI:g3907616] [LN:AF098800] [AC:AF098800] [PN:acetoin reductase] [GN:budC]
[FN:catalyzes reversible reduction of acetoin to] [OR:Klebsiella pneumoniae]
[DB:genpept-bct2] [DE:Klebsiella pneumoniae acetoin reductase (budC) gene,
complete cds.] [NT:2,3-butanediol dehydrogenase; meso-2,3-butanediol] [LE:23]
[RE:793] [DI:direct]

| ORF Name | NT ID | AA ID | NT LN | AA LN | Score | P-value |
|---|---|---|---|---|---|---|
| 25516706_f3_420 | 139 | 7310 | 807 | 268 | 531 | 4.5e-51 |

Description gp:[GI:g4884722] [LN:AF126201] [AC:AF126201] [PN:AtsC] [GN:atsC] [FN:ATP-binding
component] [OR:Pseudomonas putida] [DB:genpept-bct2] [DE:Pseudomonas putida
strain S-313 sulfate ester desulfurization genelocus, complete sequence.]
[NT:sulfate ester transporter; ATP-binding component] [LE:9738] [RE:10601]
[DI:direct]

| ORF_Name | NT ID | AA ID | NT/LN | AA/LN | Score | P-value |
|---|---|---|---|---|---|---|
| 2557906_f2_184 | 140 | 7311 | 1866 | 621 | 395 | 2.9e-36 |

Description sp:[LN:VLLY_VIBVU] [AC:O06695] [GN:VLLY] [OR:Vibrio vulnificus] [DE:HEMOLYSIN VLLY] [SP:O06695] [DB:swissprot] >gp:[GI:g2108220] [LN:VVU97357] [AC:U97357] [PN:hemolysin] [GN:vlly] [OR:Vibrio vulnificus] [DB:genpept-bct2] [DE:Vibrio vulnificus hemolysin (vlly) gene, complete cds.] [NT:Vlly] [LE:172] [RE:1245] [DI:direct]

| ORF_Name | NT ID | AA ID | NT/LN | AA/LN | Score | P-value |
|---|---|---|---|---|---|---|
| 25677331_f3_560 | 141 | 7312 | 213 | 70 | | |

Description

NO-HIT

| ORF_Name | NT ID | AA ID | NT/LN | AA/LN | Score | P-value |
|---|---|---|---|---|---|---|
| 25781663_f1_114 | 142 | 7313 | 885 | 294 | 1114 | 7.4e-113 |

Description sp:[LN:BUDR_KLETE] [AC:P52666] [GN:BUDR] [OR:Klebsiella terrigena] [DE:BUD OPERON TRANSCRIPTIONAL REGULATOR] [SP:P52666] [DB:swissprot] >sp:[LN:T09630] [AC:T09630] [PN:transcription regulator budR] [GN:budR] [CL:Pseudomonas putida regulatory protein catR] [OR:Klebsiella terrigena] [DB:pir2] >gp:[GI:g727227] [LN:KTBUDRGN] [AC:Z48600] [PN:DNA-binding Protein] [GN:budR] [FN:regulator of the budABC operon] [OR:Klebsiella terrigena] [DB:genpept-bct1] [DE:K.terrigena budR gene encoding DNA-binding protein.] [SP:P52666] [LE:385] [RE:1257] [DI:direct]

| ORF_Name | NT ID | AA ID | NT/LN | AA/LN | Score | P-value |
|---|---|---|---|---|---|---|
| 25977216_c3_1000 | 143 | 7314 | 1089 | 362 | 615 | 5.6e-60 |

Description sp:[LN:VANB_PSES9] [AC:P12580] [GN:VANB] [OR:Pseudomonas sp] [SR:,strain ATCC 19151] [EC:1.14.13.-] [DE:DEGRADATION FERREDOXIN-LIKE PROTEIN)] [SP:P12580] [DB:swissprot] >sp:[LN:B43652] [AC:B43652] [PN:ferredoxin [2Fe-2S] homolog vanB] [CL:phthalate dioxygenase reductase:cytochrome-b5 reductase homology:ferredoxin [2Fe-2S] homology] [OR:Pseudomonas sp.] [DB:pir2] >gp:[GI:g151637] [LN:PSEVANDE] [AC:M22077] [OR:Pseudomonas sp.] [SR:Pseudomonas sp. (strain ATCC 19151) DNA] [DB:genpept-bct1] [DE:Pseudomonas sp. vanA gene encoding monooxygenase, complete cds, andvanB gene encoding ferredoxin, complete cds.] [NT:ferredoxin] [LE:1248] [RE:2192] [DI:direct]

| ORF_Name | NT ID | AA ID | NT/LN | AA/LN | Score | P-value |
|---|---|---|---|---|---|---|
| 25988538_f1_17 | 144 | 7315 | 189 | 62 | | |

Description

NO-HIT

| ORF Name | NT ID | AA ID | NT/LN | AA/LN | Score | P-value |
|---|---|---|---|---|---|---|
| 26267630_f3_428 | 145 | 7316 | 297 | 98 | 124 | 6.0e-08 |

Description gp:[GI:g3859822] [LN:AF059336] [AC:AF059336] [PN:circumsporozoite protein] [GN:CSP] [OR:Plasmodium vivax] [SR:malaria parasite P. vivax] [DB:genpept-inv2] [DE:Plasmodium vivax circumsporozoite protein (CSP) gene, partial cds.] [LE:<1] [RE:>558] [DI:direct]

| ORF Name | NT ID | AA ID | NT/LN | AA/LN | Score | P-value |
|---|---|---|---|---|---|---|
| 26619715_f3_461 | 146 | 7317 | 729 | 242 | 149 | 3.9e-09 |

Description sp:[LN:A65057] [AC:A65057] [PN:hypothetical protein b2757] [CL:Escherichia coli hypothetical protein b2757] [OR:Escherichia coli] [DB:pir2] >gp:[GI:g882650] [LN:ECU29579] [AC:U29579] [OR:Escherichia coli] [DB:genpept-bct1] [DE:Escherichia coli K-12 genome; approximately 61 to 62 minutes.] [NT:ORF_f226] [LE:52677] [RE:53357] [DI:complement] >gp:[GI:g1789115] [LN:AE000359] [AC:AE000359:U00096] [PN:orf, hypothetical protein] [GN:b2757] [FN:orf; Unknown] [OR:Escherichia coli] [DB:genpept-bct2] [DE:Escherichia coli K-12 MG1655 section 249 of 400 of the completegenome.] [NT:f226; This 226 aa ORF is 31 pct identical (8 gaps)] [LE:3949] [RE:4629] [DI:complement]

| ORF Name | NT ID | AA ID | NT/LN | AA/LN | Score | P-value |
|---|---|---|---|---|---|---|
| 26750055_f2_364 | 147 | 7318 | 789 | 262 | 392 | 2.4e-36 |

Description gp:[GI:e1541793:g5824091] [LN:SCF85] [AC:AL110470] [PN:regulator] [GN:SCF85.10] [OR:Streptomyces coelicolor A3(2)] [DB:genpept-bct1] [DE:Streptomyces coelicolor cosmid F85.] [NT:SCF85.10, probable regulator, Len 254 aa. similar] [LE:9054] [RE:9818] [DI:direct]

| ORF Name | NT ID | AA ID | NT/LN | AA/LN | Score | P-value |
|---|---|---|---|---|---|---|
| 26767292_f2_371 | 148 | 7319 | 297 | 98 | | |

Description

NO-HIT

| ORF Name | NT ID | AA ID | NT/LN | AA/LN | Score | P-value |
|---|---|---|---|---|---|---|
| 26804811_c2_774 | 149 | 7320 | 810 | 269 | 283 | 8.5e-25 |

Description sp:[LN:RHTC_ECOLI] [AC:P27846] [GN:RHTC] [OR:Escherichia coli] [DE:THREONINE EFFLUX PROTEIN] [SP:P27846] [DB:swissprot]

| ORF_Name | NT ID | AA ID | NT LN | AA LN | Score | P-value |
|---|---|---|---|---|---|---|
| 2734827_c3_972 | 150 | 7321 | 1092 | 363 | 189 | 3.1e-12 |

Description sp:[LN:A72299] [AC:A72299] [PN:sugar isomerase] [GN:TM1071] [OR:Thermotoga maritima] [DB:pir2] >gp:[GI:g4981615] [LN:AE001767] [AC:AE001767:AE000512] [PN:sugar isomerase] [GN:TM1071] [OR:Thermotoga maritima] [DB:genpept-bct2] [DE:Thermotoga maritima section 79 of 136 of the complete genome.] [NT:similar to SP:P12070 GB:X59466 PID:39059 percent] [LE:2785] [RE:3936] [DI:direct]

| ORF_Name | NT ID | AA ID | NT LN | AA LN | Score | P-value |
|---|---|---|---|---|---|---|
| 2823410_f3_469 | 151 | 7322 | 228 | 75 | | |

Description

NO-HIT

| ORF_Name | NT ID | AA ID | NT LN | AA LN | Score | P-value |
|---|---|---|---|---|---|---|
| 292918_c3_1129 | 152 | 7323 | 900 | 299 | 1051 | 3.5e-106 |

Description sp:[LN:MHPR_ECOLI] [AC:P77569:P71202] [GN:MHPR] [OR:Escherichia coli] [DE:MHP OPERON TRANSCRIPTIONAL ACTIVATOR] [SP:P77569:P71202] [DB:swissprot] >sp:[LN:B64762] [AC:B64762] [PN:mhp operon transcription regulator mhpR] [GN:mhpR] [OR:Escherichia coli] [DB:pir2] >gp:[GI:e283064:g1702880] [LN:ECMHP] [AC:Y09555:X97450:X97451:Y09473] [GN:mhpR] [FN:activator of the 3-hydroxyphenylpropionate] [OR:Escherichia coli] [DB:genpept-bct1] [DE:E.coli mhp cluster for 3-hydroxy-phenylpropionic acid degradation.] [SP:P77569] [LE:19] [RE:966] [DI:complement] >gp:[GI:g1786541] [LN:AE000141] [AC:AE000141:U00096] [PN:transcriptional regulator for mhp operon] [GN:mhpR] [FN:regulator; Not classified] [OR:Escherichia coli] [DB:genpept-bct2] [DE:Escherichia coli K-12 MG1655 section 31 of 400 of the completegenome.] [NT:f315; This 342 aa ORF is 27 pct identical (9 gaps)] [LE:9995] [RE:10942] [DI:complement] >gp:[GI:g1657542] [LN:ECU73857] [AC:U73857] [OR:Escherichia coli] [DB:genpept-bct2] [DE:Escherichia coli chromosome minutes 6-8.] [NT:hypothetical protein] [LE:75382] [RE:76329] [DI:complement]

| ORF Name | NT ID | AA ID | NT/LN | AA/LN | Score | P-value |
|---|---|---|---|---|---|---|
| 29401075_f1_48 | 153 | 7324 | 1110 | 369 | 189 | 2.4e-12 |

Description sp:[LN:F69831] [AC:F69831] [PN:iron(III) dicitrate-binding protein homolog yhfQ] [GN:yhfQ] [CL:iron(III) dicitrate transport protein] [OR:Bacillus subtilis] [DB:pir1] >gp:[GI:e1183035:g2633369] [LN:BSUB0006] [AC:Z99109:AL009126] [GN:yhfQ] [FN:unknown] [OR:Bacillus subtilis] [DB:genpept-bct1] [DE:Bacillus subtilis complete genome (section 6 of 21): from 999501 to1209940.] [NT:similar to iron(III) dicitrate-binding protein] [LE:107630] [RE:108676] [DI:direct] >gp:[GI:e324996:g2226253] [LN:BSY14084] [AC:Y14084] [PN:hypothetical protein] [GN:yhfQ] [OR:Bacillus subtilis] [DB:genpept-bct1] [DE:B.subtilis chromosomal DNA, region 78-80 degrees: aprE to comK.] [NT:Similarity to citrate-dependent iron transport] [LE:2058] [RE:3104] [DI:direct]

| ORF Name | NT ID | AA ID | NT/LN | AA/LN | Score | P-value |
|---|---|---|---|---|---|---|
| 29692561_f3_485 | 154 | 7325 | 930 | 309 | 838 | 1.3e-83 |

Description sp:[LN:A72308] [AC:A72308] [PN:oxidoreductase, aldo/keto reductase family] [GN:TM1009] [CL:aldehyde reductase] [OR:Thermotoga maritima] [DB:pir2] >gp:[GI:g4981536] [LN:AE001762] [AC:AE001762:AE000512] [PN:oxidoreductase, aldo/keto reductase family] [GN:TM1009] [OR:Thermotoga maritima] [DB:genpept-bct2] [DE:Thermotoga maritima section 74 of 136 of the complete genome.] [NT:similar to GB:AL009126 percent identity: 69.23;] [LE:8972] [RE:9832] [DI:direct]

| ORF Name | NT ID | AA ID | NT/LN | AA/LN | Score | P-value |
|---|---|---|---|---|---|---|
| 29736525_c3_1090 | 155 | 7326 | 636 | 211 | 516 | 1.7e-49 |

Description sp:[LN:T03486] [AC:T03486] [PN:conserved hypothetical protein] [OR:Rhodobacter capsulatus] [DB:pir2] [MP:1] >gp:[GI:g3128287] [LN:AF010496] [AC:AF010496] [PN:hypothetical protein] [OR:Rhodobacter capsulatus] [DB:genpept-bct2] [DE:Rhodobacter capsulatus strain SB1003, partial genome.] [LE:42561] [RE:42980] [DI:complement]

| ORF_Name | NT ID | AA ID | NT LN | AA LN | Score | P-value |
|---|---|---|---|---|---|---|
| 29766430_t3_436 | 156 | 7327 | 540 | 179 | 437 | 4.1e-41 |

Description sp:[LN:G69633] [AC:G69633] [PN:glutamine transport protein glnQ] [GN:glnQ]
[CL:inner membrane protein malK:ATP-binding cassette homology] [OR:Bacillus
subtilis] [DB:pir2] >gp:[GI:e1183972:g2635188] [LN:BSUB0014] [AC:Z99117:AL009126]
[PN:glutamine ABC transporter (ATP-binding protein)] [GN:glnQ] [OR:Bacillus
subtilis] [DB:genpept-bct1] [DE:Bacillus subtilis complete genome (section 14 of
21): from 2599451to 2812870.] [LE:202178] [RE:202906] [DI:direct]
>gp:[GI:e1183990:g2635206] [LN:BSUB0015] [AC:Z99118:AL009126] [PN:glutamine ABC
transporter (ATP-binding protein)] [GN:glnQ] [OR:Bacillus subtilis]
[DB:genpept-bct1] [DE:Bacillus subtilis complete genome (section 15 of 21): from
2795131to 3013540.] [LE:6498] [RE:7226] [DI:direct]

| ORF_Name | NT ID | AA ID | NT LN | AA LN | Score | P-value |
|---|---|---|---|---|---|---|
| 29812811_f2_193 | 157 | 7328 | 1713 | 570 | 2374 | 2.3e-246 |

Description sp:[LN:MHPA_ECOLI] [AC:P77397:P71203:P77047] [GN:MHPA] [OR:Escherichia coli]
[EC:1.14.13.-] [DE:3-(3-HYDROXY-PHENYL)PROPIONATE HYDROXYLASE,]
[SP:P77397:P71203:P77047] [DB:swissprot] >sp:[LN:C64762] [AC:C64762] [PN:probable
monooxygenase, mphA] [GN:mphA] [OR:Escherichia coli] [EC:1.14.13.-] [DB:pir2]
>gp:[GI:e283065:g1702881] [LN:ECMHP] [AC:Y09555:X97450:X97451:Y09473]
[PN:3-(3-hydroxy-phenyl)propionate hydroxylase] [GN:mhpA] [OR:Escherichia coli]
[DB:genpept-bct1] [DE:E.coli mhp cluster for 3-hydroxy-phenylpropionic acid
degradation.] [NT:putative] [SP:P77397] [LE:1043] [RE:2707] [DI:direct]
>gp:[GI:g1786543] [LN:AE000142] [AC:AE000142:U00096]
[PN:3-(3-hydroxyphenyl)propionate hydroxylase] [GN:mhpA] [FN:enzyme; Degradation
of small molecules: Carbon] [OR:Escherichia coli] [DB:genpept-bct2]
[DE:Escherichia coli K-12 MG1655 section 32 of 400 of the completegenome.]
[NT:o554; This 554 aa ORF is 23 pct identical (8 gaps)] [LE:69] [RE:1733]
[DI:direct] >gp:[GI:g1657543] [LN:ECU73857] [AC:U73857] [OR:Escherichia coli]
[DB:genpept-bct2] [DE:Escherichia coli chromosome minutes 6-8.] [NT:similar to
putative oxygenase of S. fradiae] [LE:76406] [RE:78070] [DI:direct]

| ORF_Name | NT_ID | AA_ID | NT LN | AA LN | Score | P-value |
|---|---|---|---|---|---|---|
| 29927032_c3_1107 | 158 | 7329 | 285 | 94 | 110 | 1.8e-06 |

Description gp:[GI:e303931:g2182079] [LN:RC09884] [AC:Y09884] [PN:hypothetical protein]
[GN:urf4] [OR:Rhodobacter capsulatus] [DB:genpept-bct1] [DE:R.capsulatus nuoD
gene (partial), nuoE, nuoF genes, nuoG gene(partial), urf4, urf5, urf6, urf7
genes.] [LE:1447] [RE:1890] [DI:direct] >gp:[GI:e311831:g1938239] [LN:RCNUOEF]
[AC:Y10142] [PN:hypothetical protein] [GN:orfA] [OR:Rhodobacter capsulatus]
[DB:genpept-bct1] [DE:R.capsulatus nuoE gene, nuoF gene and orfA.] [LE:1359]
[RE:1802] [DI:direct] >gp:[GI:g3282564] [LN:AF029365] [AC:AF029365:U25800:Z11611]
[PN:unknown] [GN:urf1] [OR:Rhodobacter capsulatus] [DB:genpept-bct2]
[DE:Rhodobacter capsulatus B10 nuo gene cluster, NADH-CoQ reductasesubunits NUOA
(nuoA), NUOB (nuoB), NUOC (nuoC), NUOD (nuoD), NUOE(nuoE), NUOF (nuoF), NUOG
(nuoG), NUOH (nuoH), NUOI (nuoI), NUOJ(nuoJ), NUOK (nuoK), NUOL (nuoL), NUOM
(nuoM), and NUON (nuoN)genes, and BIRA (birA) gene, complete cds.] [LE:4424]
[RE:4867] [DI:direct]

| ORF_Name | NT_ID | AA_ID | NT LN | AA LN | Score | P-value |
|---|---|---|---|---|---|---|
| 2994186_f3_489 | 159 | 7330 | 1596 | 531 | 123 | 0.00036 |

Description sp:[LN:YAV3_XANCV] [AC:P14729] [OR:Xanthomonas campestris] [SR:,pvvesicatoria]
[DE:HYPOTHETICAL 65 KD AVIRULENCE PROTEIN IN AVRBS3 REGION] [SP:P14729]
[DB:swissprot] >sp:[LN:JQ0318] [AC:JQ0318] [PN:hypothetical 65.3K protein]
[CL:Xanthomonas campestris hypothetical 65.3K protein] [OR:Xanthomonas campestris
pv. vesicatoria] [DB:pir2]

| ORF_Name | NT_ID | AA_ID | NT LN | AA LN | Score | P-value |
|---|---|---|---|---|---|---|
| 30207087_c1_743 | 160 | 7331 | 1194 | 397 | 1104 | 8.5e-112 |

Description sp:[LN:YE72_HAEIN] [AC:P44206] [GN:HI1472] [OR:Haemophilus influenzae]
[DE:HYPOTHETICAL PROTEIN HI1472 PRECURSOR] [SP:P44206] [DB:swissprot]
>sp:[LN:I64030] [AC:I64030] [PN:hypothetical protein HI1472] [OR:Haemophilus
influenzae] [DB:pir2] >gp:[GI:g1574313] [LN:U32825] [AC:U32825:L42023] [PN:iron
chelatin ABC transporter,] [GN:HI1472] [OR:Haemophilus influenzae Rd]
[DB:genpept-bct2] [DE:Haemophilus influenzae Rd section 140 of 163 of the
completegenome.] [NT:similar to GB:AE000511 PID:2314746 percent] [LE:5597]
[RE:6652] [DI:complement]

| ORF Name | NT ID | AA ID | NT LN | AA LN | Score | P-value |
|---|---|---|---|---|---|---|
| 30500708_f3_474 | 161 | 7332 | 744 | 247 | 1036 | 1.4e-104 |

Description sp:[LN:CCMC_ECOLI] [AC:P33929] [GN:CCMC] [OR:Escherichia coli] [DE:HEME EXPORTER PROTEIN C (CYTOCHROME C-TYPE BIOGENESIS PROTEIN CCMC)] [SP:P33929] [DB:swissprot] >sp:[LN:E64989] [AC:E64989] [PN:heme exporter protein C] [GN:ccmC] [CL:helC protein] [OR:Escherichia coli] [DB:pir2] >gp:[GI:g1788527] [LN:AE000309] [AC:AE000309:U00096] [PN:heme exporter protein C] [GN:ccmC] [FN:transport; Protein, peptide secretion] [OR:Escherichia coli] [DB:genpept-bct2] [DE:Escherichia coli K-12 MG1655 section 199 of 400 of the completegenome.] [NT:f245; 100 pct identical to CCMC_ECOLI SW: P33929] [LE:5307] [RE:6044] [DI:complement]

| ORF Name | NT ID | AA ID | NT LN | AA LN | Score | P-value |
|---|---|---|---|---|---|---|
| 30570306_c3_1025 | 162 | 7333 | 285 | 94 | 325 | 3.0e-29 |

Description gp:[GI:g4929323] [LN:AF145230] [AC:AF145230] [PN:beta-hydroxybutyrate dehydrogenase] [GN:hbdh1] [OR:Ralstonia eutropha] [DB:genpept-bct2] [DE:Ralstonia eutropha beta-hydroxybutyrate dehydrogenase (hbdh1) gene, complete cds.] [LE:60] [RE:836] [DI:direct]

| ORF Name | NT ID | AA ID | NT LN | AA LN | Score | P-value |
|---|---|---|---|---|---|---|
| 30667832_c2_834 | 163 | 7334 | 795 | 264 | 1274 | 8.3e-130 |

Description sp:[LN:ALDC_KLETE] [AC:Q04518] [GN:BUDA] [OR:Klebsiella terrigena] [EC:4.1.1.5] [DE:ALPHA-ACETOLACTATE DECARBOXYLASE,] [SP:Q04518] [DB:swissprot] >sp:[LN:C47069] [AC:C47069] [PN:acetolactate decarboxylase,] [CL:acetolactate decarboxylase] [OR:Klebsiella terrigena] [EC:4.1.1.5] [DB:pir1] >gp:[GI:g149171] [LN:KPNBUDOPRN] [AC:L04507] [PN:alpha-acetolactate decarboxylase] [GN:budA] [OR:Klebsiella terrigena] [SR:Klebsiella terrigena (library: VTT-E-74023) DNA] [DB:genpept-bct1] [EC:4.1.1.5] [DE:Klebsiella terrigena budABC operon, including alpha-acetolactatedecarboxylase (budA), alpha-acetolactate synthase (budB), andacetoin(diacetyl)reductase (budC) genes, complete coding regions.] [LE:179] [RE:958] [DI:direct]

| ORF Name | NT ID | AA ID | NT LN | AA LN | Score | P-value |
|---|---|---|---|---|---|---|
| 30754207_c2_936 | 164 | 7335 | 513 | 170 | 125 | 8.1e-08 |

Description sp:[LN:A44982] [AC:A44982] [PN:collagen UCOL1] [CL:unassigned collagens] [OR:Ascaris suum] [SR:, pig roundworm] [DB:pir2]

| ORF_Name | NT_ID | AA_ID | NT/LN | AA/LN | Score | P-value |
|---|---|---|---|---|---|---|
| 30760083_c2_855 | 165 | 7336 | 324 | 107 | 134 | 1.3e-08 |

Description sp:[LN:D34768] [AC:D34768] [PN:ORF4 protein] [OR:Orf virus] [DB:pir2]
>gp:[GI:g332566] [LN:ORFPRTPS] [AC:M30023:J04371:M37623] [OR:orf virus] [SR:Orf virus (strain NZ2) DNA] [DB:genpept-vrl] [DE:Orf virus homologue of retroviral pseudoprotease gene, completecds.] [NT:ORF4] [LE:1248] [RE:2042] [DI:complement]

| ORF_Name | NT_ID | AA_ID | NT/LN | AA/LN | Score | P-value |
|---|---|---|---|---|---|---|
| 31269090_f2_243 | 166 | 7337 | 225 | 74 | | |

Description

NO-HIT

| ORF_Name | NT_ID | AA_ID | NT/LN | AA/LN | Score | P-value |
|---|---|---|---|---|---|---|
| 31453961_c3_958 | 167 | 7338 | 1119 | 372 | 756 | 6.4e-75 |

Description sp:[LN:YDDP_ECOLI] [AC:P77268] [GN:YDDP] [OR:Escherichia coli] [DE:HYPOTHETICAL ABC TRANSPORTER ATP-BINDING PROTEIN YDDP] [SP:P77268] [DB:swissprot]
>sp:[LN:G64901] [AC:G64901] [PN:ABC-type transport protein b1484] [CL:ATP-binding cassette homology] [OR:Escherichia coli] [DB:pir2] >gp:[GI:d1015858:g1742424] [LN:D90789] [AC:D90789:AB001340] [PN:Dipeptide transport ATP-binding protein DppD.] [OR:Escherichia coli] [SR:Escherichia coli (strain:K12) DNA, clone_lib:Kohara lambda minise] [DB:genpept-bct1] [DE:E.coli genomic DNA, Kohara clone #278(33.3-33.7 min.).] [NT:ORF_ID:o279#2; similar to [SwissProt Accession] [LE:12211] [RE:13197] [DI:complement] >gp:[GI:d1015868:g1742435] [LN:D90790] [AC:D90790:AB001340] [PN:Dipeptide transport ATP-binding protein DppD.] [OR:Escherichia coli] [SR:Escherichia coli (strain:K12) DNA, clone_lib:Kohara lambda minise] [DB:genpept-bct1] [DE:E.coli genomic DNA, Kohara clone #279(33.5-33.9 min.).] [NT:ORF_ID:o279#2; similar to [SwissProt Accession] [LE:4314] [RE:5300] [DI:complement] >gp:[GI:g1787759] [LN:AE000245] [AC:AE000245:U00096] [PN:putative ATP-binding component of a transport] [GN:b1484] [FN:putative transport; Not classified] [OR:Escherichia coli] [DB:genpept-bct2] [DE:Escherichia coli K-12 MG1655 section 135 of 400 of the completegenome.] [NT:f328; This 328 aa ORF is 44 pct identical (3 gaps)] [LE:5267] [RE:6253] [DI:complement]

| ORF_Name | NT_ID | AA_ID | NT/LN | AA/LN | Score | P-value |
|---|---|---|---|---|---|---|
| 31455433_f2_302 | 168 | 7339 | 345 | 114 | 141 | 9.5e-10 |

Description gp:[GI:g3859822] [LN:AF059336] [AC:AF059336] [PN:circumsporozoite protein] [GN:CSP] [OR:Plasmodium vivax] [SR:malaria parasite P. vivax] [DB:genpept-inv2] [DE:Plasmodium vivax circumsporozoite protein (CSP) gene, partial cds.] [LE:<1] [RE:>558] [DI:direct]

| ORF_Name | NT_ID | AA_ID | NT LN | AA LN | Score | P-value |
|---|---|---|---|---|---|---|
| 31735156_c2_769 | 169 | 7340 | 762 | 253 | | |

Description

NO-HIT

| ORF_Name | NT_ID | AA_ID | NT LN | AA LN | Score | P-value |
|---|---|---|---|---|---|---|
| 31735643_f3_403 | 170 | 7341 | 1218 | 405 | 1517 | 1.5e-155 |

Description sp:[LN:MHPE_ECOLI] [AC:P51020:P77787] [GN:MHPE:MHPF] [OR:Escherichia coli] [EC:4.1.3.-] [DE:4-HYDROXY-2-OXOVALERATE ALDOLASE, (HOA)] [SP:P51020:P77787] [DB:swissprot] >sp:[LN:H64762] [AC:H64762] [PN:4-hydroxy-2-oxovalerate aldolase,] [OR:Escherichia coli] [EC:4.1.3.-] [DB:pir2] >gp:[GI:d1013744:g1665751] [LN:D86239] [AC:D86239] [PN:MhpF] [GN:mhpF] [OR:Escherichia coli] [SR:Escherichia coli (strain:K-12, sub_strain:W3110) DNA] [DB:genpept-bct1] [DE:Escherichia coli genes for MhpR, MhpA, MhpB, MhpC, MhpD, MhpE andMhpF, complete sequence of the mhp operon.] [LE:6281] [RE:7294] [DI:direct] >gp:[GI:g1786548] [LN:AE000142] [AC:AE000142:U00096] [PN:4-hydroxy-2-ketovalerate aldolase] [GN:mhpE] [FN:enzyme; Degradation of small molecules: Carbon] [OR:Escherichia coli] [DB:genpept-bct2] [EC:4.1.3.-] [DE:Escherichia coli K-12 MG1655 section 32 of 400 of the completegenome.] [NT:o337; This 337 aa ORF is 29 pct identical (18 gaps)] [LE:5326] [RE:6339] [DI:direct] >gp:[GI:g1657548] [LN:ECU73857] [AC:U73857] [OR:Escherichia coli] [DB:genpept-bct2] [DE:Escherichia coli chromosome minutes 6-8.] [NT:similar to P. put4-hydroxy-2-oxovalerate] [LE:81663] [RE:82676] [DI:direct]

| ORF_Name | NT_ID | AA_ID | NT LN | AA LN | Score | P-value |
|---|---|---|---|---|---|---|
| 31744431_f1_52 | 171 | 7342 | 288 | 95 | 334 | 3.4e-30 |

Description sp:[LN:H69334] [AC:H69334] [PN:glutamine transport protein glnQ] [GN:glnQ] [CL:inner membrane protein malK:ATP-binding cassette homology] [OR:Archaeoglobus fulgidus] [DB:pir2] >gp:[GI:g2649950] [LN:AE001058] [AC:AE001058:AE000782] [PN:glutamine ABC transporter, ATP-binding protein] [GN:AF0680] [OR:Archaeoglobus fulgidus] [DB:genpept-bct2] [DE:Archaeoglobus fulgidus section 49 of 172 of the complete genome.] [NT:similar to GB:M61017 SP:P27675 PID:142988 percent] [LE:10147] [RE:10875] [DI:complement]

| ORF Name | NT ID | AA ID | NT LN | AA LN | Score | P-value |
|---|---|---|---|---|---|---|
| 31812908_f2_276 | 172 | 7343 | 825 | 274 | 771 | 1.7e-76 |

Description sp:[LN:CCMB_ECOLI] [AC:P33930] [GN:CCMB] [OR:Escherichia coli] [DE:HEME EXPORTER PROTEIN B (CYTOCHROME C-TYPE BIOGENESIS PROTEIN CCMB)] [SP:P33930] [DB:swissprot] >sp:[LN:F64989] [AC:F64989] [PN:heme exporter protein B] [GN:ccmB] [CL:cytochrome c biogenesis protein CycW] [OR:Escherichia coli] [DB:pir2] >gp:[GI:g405925] [LN:ECOHU49] [AC:U00008] [PN:yejV] [OR:Escherichia coli] [SR:Escherichia coli K12 BHB2600] [DB:genpept-bct1] [DE:centisome 49 region of E.coli K12 BHB2600.] [NT:may be part of aeg-46.5 operon; homolog of] [LE:23414] [RE:24076] [DI:complement] >gp:[GI:g1788528] [LN:AE000309] [AC:AE000309:U00096] [PN:heme exporter protein B, cytochrome c-type] [GN:ccmB] [FN:transport; Protein, peptide secretion] [OR:Escherichia coli] [DB:genpept-bct2] [DE:Escherichia coli K-12 MG1655 section 199 of 400 of the completegenome.] [NT:f220; 100 pct identical to CCMB_ECOLI SW: P33930] [LE:6086] [RE:6748] [DI:complement]

| ORF Name | NT ID | AA ID | NT LN | AA LN | Score | P-value |
|---|---|---|---|---|---|---|
| 31835406_f3_426 | 173 | 7344 | 339 | 112 | 110 | 1.0e-05 |

Description sp:[LN:D69812] [AC:D69812] [PN:ferrichrome ABC transporter (permease) homolog yfmE] [GN:yfmE] [CL:vitamin B12 transport protein btuC] [OR:Bacillus subtilis] [DB:pir1] >gp:[GI:e1182740:g2633074] [LN:BSUB0005] [AC:Z99108:AL009126] [GN:yfmE] [FN:unknown] [OR:Bacillus subtilis] [DB:genpept-bct1] [DE:Bacillus subtilis complete genome (section 5 of 21): from 802821 to1011250.] [NT:similar to ferrichrome ABC transporter (permease)] [LE:20404] [RE:21405] [DI:complement] >gp:[GI:d1023182:g2443248] [LN:D86417] [AC:D86417] [PN:YfmE] [OR:Bacillus subtilis] [SR:Bacillus subtilis (strain:AC327) DNA] [DB:genpept-bct1] [DE:Bacillus subtilis 35.7 kb genomic DNA, 70-73 degree region,complete cds.] [LE:27116] [RE:28117] [DI:direct]

| ORF Name | NT ID | AA ID | NT LN | AA LN | Score | P-value |
|---|---|---|---|---|---|---|
| 31879167_c2_827 | 174 | 7345 | 297 | 98 | 397 | 7.1e-37 |

Description sp:[LN:YQEF_ECOLI] [AC:Q46939] [GN:YQEF] [OR:Escherichia coli] [EC:2.3.1.9] [DE:THIOLASE)] [SP:Q46939] [DB:swissprot] >sp:[LN:E65067] [AC:E65067] [PN:hypothetical protein b2844] [CL:acetyl-CoA acetyltransferase] [OR:Escherichia coli] [DB:pir2] >gp:[GI:g882737] [LN:ECU29581] [AC:U29581] [OR:Escherichia coli] [DB:genpept-bct1] [DE:Escherichia coli K-12 genome; approximately 63 to 64 minutes.] [NT:ORF_f394] [LE:65966] [RE:67150] [DI:complement] >gp:[GI:g1789210] [LN:AE000368] [AC:AE000368:U00096] [PN:putative acyltransferase] [GN:yqeF] [FN:putative enzyme; Not classified] [OR:Escherichia coli] [DB:genpept-bct2] [DE:Escherichia coli K-12 MG1655 section 258 of 400 of the completegenome.] [NT:f394; This 394 aa ORF is 61 pct identical (1 gap)] [LE:3742] [RE:4926] [DI:complement]

| ORF Name | NT ID | AA ID | NT LN | AA LN | Score | P-value |
|---|---|---|---|---|---|---|
| 31891077_c1_581 | 175 | 7346 | 1455 | 484 | 534 | 8.8e-58 |

Description sp:[LN:S75778] [AC:S75778] [PN:oligopeptide transport system permease protein appC:protein sll0833:protein sll0833] [GN:appC] [CL:oligopeptide permease protein oppB] [OR:Synechocystis sp.] [SR:PCC 6803, , PCC 6803] [SR:PCC 6803, ] [DB:pir2] >gp:[GI:d1011164:g1001269] [LN:SYCSLLE] [AC:D64003:AB001339] [PN:oligopeptide transport system permease protein] [GN:appC] [OR:Synechocystis sp.] [SR:Synechocystis sp. (strain:PCC6803) DNA] [DB:genpept-bct1] [DE:Synechocystis sp. PCC6803 complete genome, 22/27, 2755703-2868766.] [NT:ORF_ID:sll0833] [LE:82093] [RE:83208] [DI:complement]

| ORF Name | NT ID | AA ID | NT LN | AA LN | Score | P-value |
|---|---|---|---|---|---|---|
| 31894766_f3_417 | 176 | 7347 | 1062 | 353 | 125 | 7.0e-05 |

Description gp:[GI:g2150108] [LN:AF001333] [AC:AF001333] [PN:periplasmic substrate binding protein] [GN:cynA] [OR:Synechococcus PCC7942] [DB:genpept-bct2] [DE:Synechococcus PCC7942 periplasmic substrate binding protein (cynA),integral membrane protein (cynB) and ATP-binding protein (cynD)genes, complete cds.] [NT:NrtA-like protein] [LE:212] [RE:1534] [DI:direct]

| ORF Name | NT ID | AA ID | NT LN | AA LN | Score | P-value |
|---|---|---|---|---|---|---|
| 31897026_f3_431 | 177 | 7348 | 981 | 326 | 168 | 2.7e-10 |

Description sp:[LN:G64143] [AC:G64143] [PN:hypothetical protein HI0143] [CL:hypothetical protein ybbH] [OR:Haemophilus influenzae] [DB:pir1]

| ORF Name | NT ID | AA ID | NT LN | AA LN | Score | P-value |
|---|---|---|---|---|---|---|
| 31924090_c2_915 | 178 | 7349 | 219 | 72 | | |

Description

NO-HIT

| ORF Name | NT ID | AA ID | NT LN | AA LN | Score | P-value |
|---|---|---|---|---|---|---|
| 32041376_f2_367 | 179 | 7350 | 231 | 76 | | |

Description

NO-HIT

| ORF Name | NT ID | AA ID | NT LN | AA LN | Score | P-value |
|---|---|---|---|---|---|---|
| 32069066_c3_947 | 180 | 7351 | 1080 | 359 | 273 | 9.8e-24 |

Description gp:[GI:e1535112:g5708244] [LN:SCJ21] [AC:AL109747] [PN:hypothetical protein SCJ21.09] [GN:SCJ21.11] [OR:Streptomyces coelicolor A3(2)] [DB:genpept-bct1] [DE:Streptomyces coelicolor cosmid J21.] [NT:SCJ21.11, unknown, len; 304 aa; some similarity to] [LE:21461] [RE:22375] [DI:direct]

| ORF Name | NT ID | AA ID | NT LN | AA LN | Score | P-value |
|---|---|---|---|---|---|---|
| 3214052_f2_238 | 181 | 7352 | 216 | 71 | | |

Description

NO-HIT

| ORF Name | NT ID | AA ID | NT LN | AA LN | Score | P-value |
|---|---|---|---|---|---|---|
| 32324033_c1_727 | 182 | 7353 | 438 | 145 | 122 | 5.3e-07 |

Description sp:[LN:GBX2_HUMAN] [AC:P52951:O43833] [GN:GBX2] [OR:Homo sapiens] [SR:,Human] [DE:PROTEIN 2)] [SP:P52951:O43833] [DB:swissprot] >gp:[GI:g2896814] [LN:HSU31468] [AC:U31468] [PN:homeobox protein] [GN:GBX2] [OR:Homo sapiens] [SR:human] [DB:genpept-pri3] [DE:Homo sapiens homeobox protein (GBX2) gene, complete cds.] [LE:422] [RE:1465] [DI:direct]

| ORF Name | NT ID | AA ID | NT LN | AA LN | Score | P-value |
|---|---|---|---|---|---|---|
| 32557182_c3_1100 | 183 | 7354 | 273 | 90 | 85 | 1.3e-07 |

Description gp:[GI:g3641391] [LN:GGU34615] [AC:U34615] [PN:CMIX] [OR:Gallus gallus] [SR:chicken] [DB:genpept-vrt] [DE:Gallus gallus homeobox protein CMIX mRNA, complete cds.] [NT:homeobox protein; related to gooseberry and] [LE:2] [RE:634] [DI:direct]

| ORF Name | NT ID | AA ID | NT LN | AA LN | Score | P-value |
|---|---|---|---|---|---|---|
| 33384513_c1_663 | 184 | 7355 | 300 | 99 | | |

Description

NO-HIT

| ORF_Name | NT_ID | AA_ID | $\frac{NT}{LN}$ | $\frac{AA}{LN}$ | Score | P-value |
|---|---|---|---|---|---|---|
| 33458193_f3_545 | 185 | 7356 | 282 | 93 | 206 | 1.2e-16 |

Description sp:[LN:G72536] [AC:G72536] [PN:hypothetical protein APE1580] [GN:APE1580]
[OR:Aeropyrum pernix] [DB:pir2] >gp:[GI:d1044366:g5105267] [LN:AP000062]
[AC:AP000062] [PN:114aa long hypothetical protein] [GN:APE1580] [OR:Aeropyrum
pernix] [SR:Aeropyrum pernix (strain:K1) DNA] [DB:genpept-bct1] [DE:Aeropyrum
pernix genomic DNA, section 5/7.] [NT:similar to OWL:AB00946832 percent
identity:37.500] [LE:13911] [RE:14255] [DI:direct]

| ORF_Name | NT_ID | AA_ID | $\frac{NT}{LN}$ | $\frac{AA}{LN}$ | Score | P-value |
|---|---|---|---|---|---|---|
| 33630311_f3_404 | 186 | 7357 | 1254 | 417 | 1605 | 6.9e-165 |

Description sp:[LN:MHPT_ECOLI] [AC:P77589:P77037] [GN:MHPT] [OR:Escherichia coli]
[DE:PUTATIVE 3-HYDROXYPHENYLPROPIONIC ACID TRANSPORTER] [SP:P77589:P77037]
[DB:swissprot] >sp:[LN:A64763] [AC:A64763] [PN:probable transport protein mhpT]
[GN:mhpT] [OR:Escherichia coli] [DB:pir2] >gp:[GI:g1786549] [LN:AE000142]
[AC:AE000142:U00096] [PN:putative transport protein] [GN:mhpT] [FN:putative
transport; Not classified] [OR:Escherichia coli] [DB:genpept-bct2]
[DE:Escherichia coli K-12 MG1655 section 32 of 400 of the completegenome.]
[NT:o418; This 418 aa ORF is 21 pct identical (13 gaps)] [LE:6872] [RE:8128]
[DI:direct] >gp:[GI:g1657549] [LN:ECU73857] [AC:U73857] [OR:Escherichia coli]
[DB:genpept-bct2] [DE:Escherichia coli chromosome minutes 6-8.] [NT:similar to P.
putida pcaK] [LE:83003] [RE:84259] [DI:direct]

| ORF_Name | NT_ID | AA_ID | $\frac{NT}{LN}$ | $\frac{AA}{LN}$ | Score | P-value |
|---|---|---|---|---|---|---|
| 33757341_f3_509 | 187 | 7358 | 636 | 211 | 130 | 1.4e-08 |

Description sp:[LN:A71007] [AC:A71007] [PN:hypothetical protein PH1351] [GN:PH1351]
[OR:Pyrococcus horikoshii] [DB:pir2] >gp:[GI:d1031400:g3257774] [LN:AP000006]
[AC:AP000006:AB005215:AB009510:AB009511:AB009512:AB009513:AB009514] [PN:101aa
long hypothetical protein] [GN:PH1351] [OR:Pyrococcus horikoshii] [SR:Pyrococcus
horikoshii (strain:OT3) DNA, clone:Pyrococcus horikoshi] [DB:genpept-bct1]
[DE:Pyrococcus horikoshii OT3 genomic DNA, 1166001-1485000 nt. position(6/7).]
[LE:50986] [RE:51291] [DI:direct]

| ORF_Name | NT_ID | AA_ID | $\frac{NT}{LN}$ | $\frac{AA}{LN}$ | Score | P-value |
|---|---|---|---|---|---|---|
| 33806555_c1_589 | 188 | 7359 | 927 | 308 | 469 | 1.7e-44 |

Description sp:[LN:YHJC_ECOLI] [AC:P37641] [GN:YHJC] [OR:Escherichia coli] [DE:HYPOTHETICAL
TRANSCRIPTIONAL REGULATOR IN TREF-KDGK INTERGENIC REGION] [SP:P37641]
[DB:swissprot]

| ORF Name | NT ID | AA ID | NT LN | AA LN | Score | P-value |
|---|---|---|---|---|---|---|
| 3383281_f2_212 | 189 | 7360 | 339 | 112 | 95 | 1.7e-05 |

Description gp:[GI:e1311975:g3334814] [LN:SC5A7] [AC:AL031107] [PN:putative ABC transporter]
[GN:ramA] [OR:Streptomyces coelicolor] [DB:genpept-bct1] [DE:Streptomyces
coelicolor cosmid 5A7.] [NT:SC5A7.33, ramA, probable ABC transporter, len: 636]
[LE:36473] [RE:38383] [DI:direct]

| ORF Name | NT ID | AA ID | NT LN | AA LN | Score | P-value |
|---|---|---|---|---|---|---|
| 33879031_f1_63 | 190 | 7361 | 1752 | 583 | | |

Description

NO-HIT

| ORF Name | NT ID | AA ID | NT LN | AA LN | Score | P-value |
|---|---|---|---|---|---|---|
| 33886586_f1_148 | 191 | 7362 | 396 | 131 | 523 | 3.2e-50 |

Description gp:[GI:e1363847:g4138118] [LN:KPN9980] [AC:AJ009980] [GN:orf1] [OR:Klebsiella
pneumoniae] [DB:genpept-bct1] [DE:Klebsiella pneumoniae plasmid pGSH500 alpha
replicon, partial.] [NT:homology to yedG gene, D90833] [LE:2558] [RE:2974]
[DI:direct]

| ORF Name | NT ID | AA ID | NT LN | AA LN | Score | P-value |
|---|---|---|---|---|---|---|
| 34119137_f3_375 | 192 | 7363 | 198 | 65 | 72 | 0.034 |

Description gp:[GI:g431128] [LN:TRN916ENT] [AC:L15633] [OR:Transposon Tn916] [SR:Transposon
Tn916 DNA] [DB:genpept-una] [DE:Conjugative transposon Tn916 (from Enterococcus
faecalis, DS16), 3'end.] [NT:start] [LE:1168] [RE:1641] [DI:direct]

| ORF Name | NT ID | AA ID | NT/LN | AA/LN | Score | P-value |
|---|---|---|---|---|---|---|
| 34260801_f3_554 | 193 | 7364 | 657 | 218 | 732 | 2.2e-72 |

Description sp:[LN:CYNT_ECOLI] [AC:P17582:P78278] [GN:CYNT] [OR:Escherichia coli]
[EC:4.2.1.1] [DE:CARBONIC ANHYDRASE,] [SP:P17582:P78278] [DB:swissprot]
>sp:[LN:QRECTC] [AC:C64761:A31977:JS0143] [PN:carbonate dehydratase,:carbonic
anhydrase] [GN:cynT] [CL:Escherichia coli carbonate dehydratase] [OR:Escherichia
coli] [EC:4.2.1.1] [DB:pir1] [MP:8 min] >gp:[GI:g1786534] [LN:AE000141]
[AC:AE000141:U00096] [PN:carbonic anhydrase] [GN:cynT] [FN:enzyme; Central
intermediary metabolism: Pool,] [OR:Escherichia coli] [DB:genpept-bct2]
[EC:4.2.1.1] [DE:Escherichia coli K-12 MG1655 section 31 of 400 of the
completegenome.] [NT:o219; 97 pct identical (1 gap) to CYNT_ECOLI] [LE:1207]
[RE:1866] [DI:direct] >gp:[GI:g1657535] [LN:ECU73857] [AC:U73857] [PN:cyanate
anhydrase] [GN:cynT] [OR:Escherichia coli] [DB:genpept-bct2] [EC:4.2.1.1]
[DE:Escherichia coli chromosome minutes 6-8.] [LE:66594] [RE:67253] [DI:direct]

| ORF Name | NT ID | AA ID | NT/LN | AA/LN | Score | P-value |
|---|---|---|---|---|---|---|
| 34490691_f1_23 | 194 | 7365 | 1041 | 346 | 1359 | 8.1e-139 |

Description sp:[LN:MHPF_ECOLI] [AC:P77580] [GN:MHPF:MHPE] [OR:Escherichia coli] [EC:1.2.1.10]
[DE:[ACETYLATING])] [SP:P77580] [DB:swissprot] >sp:[LN:G64762] [AC:G64762]
[PN:acetaldehyde dehydrogenase (acetylating),] [GN:mhpE] [OR:Escherichia coli]
[EC:1.2.1.10] [DB:pir2] >gp:[GI:d1013743:g1665750] [LN:D86239] [AC:D86239]
[PN:MhpE] [GN:mhpE] [OR:Escherichia coli] [SR:Escherichia coli (strain:K-12,
sub_strain:W3110) DNA] [DB:genpept-bct1] [DE:Escherichia coli genes for MhpR,
MhpA, MhpB, MhpC, MhpD, MhpE andMhpF, complete sequence of the mhp operon.]
[LE:5334] [RE:6284] [DI:direct] >gp:[GI:e283069:g1702885] [LN:ECMHP]
[AC:Y09555:X97450:X97451:Y09473] [GN:mhpF] [FN:acetaldehyde dehydrogenase
(acylating)] [OR:Escherichia coli] [DB:genpept-bct1] [DE:E.coli mhp cluster for
3-hydroxy-phenylpropionic acid degradation.] [NT:putative] [SP:P77580] [LE:5353]
[RE:6303] [DI:direct] >gp:[GI:g1786547] [LN:AE000142] [AC:AE000142:U00096]
[PN:acetaldehyde dehydrogenase] [GN:mhpF] [FN:enzyme; Degradation of small
molecules: Carbon] [OR:Escherichia coli] [DB:genpept-bct2] [EC:1.2.1.10]
[DE:Escherichia coli K-12 MG1655 section 32 of 400 of the completegenome.]
[NT:o316; also called mhpE] [LE:4379] [RE:5329] [DI:direct] >gp:[GI:g1657547]
[LN:ECU73857] [AC:U73857] [OR:Escherichia coli] [DB:genpept-bct2] [DE:Escherichia
coli chromosome minutes 6-8.] [NT:similar to P. putida acetaldehyde
dehydrogenase] [LE:80716] [RE:81666] [DI:direct]

| ORF Name | NT ID | AA ID | NT/LN | AA/LN | Score | P-value |
|---|---|---|---|---|---|---|
| 34556528_f1_143 | 195 | 7366 | 702 | 233 | 403 | 1.6e-37 |

Description sp:[LN:H70592] [AC:H70592] [PN:probable mtrA protein] [GN:mtrA] [CL:ompR
protein:response regulator homology] [OR:Mycobacterium tuberculosis] [DB:pir2]
>gp:[GI:e314479:g2072713] [LN:MTY20B11] [AC:Z95121:AL123456] [PN:mtrA] [GN:mtrA]
[OR:Mycobacterium tuberculosis] [DB:genpept-bct1] [DE:Mycobacterium tuberculosis
H37Rv complete genome; segment 139/162.] [NT:Rv3246c, (MTCY20B11.21c), len: 228,
mtrA response] [LE:24189] [RE:24875] [DI:complement]

| ORF Name | NT ID | AA ID | NT/LN | AA/LN | Score | P-value |
|---|---|---|---|---|---|---|
| 34650157_f1_138 | 196 | 7367 | 1437 | 478 | 557 | 7.9e-54 |

Description sp:[LN:ATZB_PSESD] [AC:P95442] [GN:ATZB] [OR:Pseudomonas sp] [SR:,strain ADP]
[EC:3.-.-.-] [DE:HYDROXYATRAZINE HYDROLASE,] [SP:P95442] [DB:swissprot]
>gp:[GI:g1732206] [LN:PAU66917] [AC:U66917] [PN:AtzB] [GN:atzB] [FN:second enzyme
of a novel atrazine degradation] [OR:Pseudomonas sp. ADP] [DB:genpept-bct2]
[DE:Pseudomonas ADP atrazine degradation pathway enzyme AtzB (atzB)gene, complete
cds.] [LE:936] [RE:2381] [DI:direct]

| ORF Name | NT ID | AA ID | NT/LN | AA/LN | Score | P-value |
|---|---|---|---|---|---|---|
| 35178762_c2_768 | 197 | 7368 | 507 | 168 | | |

Description

NO-HIT

| ORF Name | NT ID | AA ID | NT/LN | AA/LN | Score | P-value |
|---|---|---|---|---|---|---|
| 35214050_f3_451 | 198 | 7369 | 1104 | 367 | 180 | 2.1e-11 |

Description gp:[GI:g3776222] [LN:AF030523] [AC:AF030523] [PN:putative periplasmic
iron-binding protein] [GN:afuA] [OR:Sinorhizobium meliloti] [DB:genpept-bct2]
[DE:Sinorhizobium meliloti putative periplasmic iron-binding protein(afuA), cold
shock protein CspA (cspA), and probable ribosomalprotein (rpsU) genes, complete
cds.] [NT:similar to AfuA of Actinobacillus pleuropneumonia,] [LE:18] [RE:998]
[DI:complement]

| ORF Name | NT ID | AA ID | NT/LN | AA/LN | Score | P-value |
|---|---|---|---|---|---|---|
| 35282267_f2_307 | 199 | 7370 | 189 | 62 | | |

Description

NO-HIT

| ORF Name | NT ID | AA ID | NT/LN | AA/LN | Score | P-value |
|---|---|---|---|---|---|---|
| 35285208_f1_47 | 200 | 7371 | 918 | 305 | 542 | 3.1e-52 |

Description sp:[LN:S74438] [AC:S74438] [PN:iron(III) dicitrate transport system permease
protein fecC:protein slr1316:protein slr1316] [GN:fecC] [OR:Synechocystis sp.]
[SR:PCC 6803, , PCC 6803] [DB:pir2] >gp:[GI:d1017323:g1651662]
[LN:D90899] [AC:D90899:AB001339] [PN:iron(III) dicitrate transport system
permease] [GN:fecC] [OR:Synechocystis sp.] [SR:Synechocystis sp. (strain:PCC6803)
DNA] [DB:genpept-bct1] [DE:Synechocystis sp. PCC6803 complete genome, 1/27,
1-133859.] [NT:ORF_ID:slr1316] [LE:13498] [RE:14529] [DI:direct]

| ORF Name | NT ID | AA ID | NT LN | AA LN | Score | P-value |
|---|---|---|---|---|---|---|
| 35632260_f3_405 | 201 | 7372 | 828 | 275 | 181 | 4.4e-19 |

Description sp:[LN:H71652] [AC:H71652] [PN:hypothetical protein RP494] [GN:RP494]
[OR:Rickettsia prowazekii] [DB:pir2] >gp:[GI:e1342790:g3861046] [LN:RPXX03]
[AC:AJ235272:AJ235269] [PN:unknown] [GN:RP494] [OR:Rickettsia prowazekii]
[DB:genpept-bct1] [DE:Rickettsia prowazekii strain Madrid E, complete genome;
segment3/4.] [LE:16267] [RE:16989] [DI:complement]

| ORF Name | NT ID | AA ID | NT LN | AA LN | Score | P-value |
|---|---|---|---|---|---|---|
| 35781566_c2_782 | 202 | 7373 | 993 | 330 | 691 | 1.3e-87 |

Description sp:[LN:C72371] [AC:C72371] [PN:oligopeptide ABC transporter, ATP-binding protein]
[GN:TM0500] [CL:inner membrane protein malK:ATP-binding cassette homology]
[OR:Thermotoga maritima] [DB:pir2] >gp:[GI:g4981011] [LN:AE001726]
[AC:AE001726:AE000512] [PN:oligopeptide ABC transporter, ATP-binding] [GN:TM0500]
[OR:Thermotoga maritima] [DB:genpept-bct2] [DE:Thermotoga maritima section 38 of
136 of the complete genome.] [NT:similar to SP:P42065 PID:677944 GB:AL009126
percent] [LE:16317] [RE:17471] [DI:complement]

| ORF Name | NT ID | AA ID | NT LN | AA LN | Score | P-value |
|---|---|---|---|---|---|---|
| 35807306_f3_389 | 203 | 7374 | 360 | 119 | 132 | 2.7e-07 |

Description gp:[GI:g3599478] [LN:AF085185] [AC:AF085185] [PN:Myosin-IA] [GN:MIA]
[OR:Acanthamoeba castellanii] [DB:genpept-inv2] [DE:Acanthamoeba castellanii
Myosin-IA (MIA) gene, complete cds.] [NT:myosin-I] [LE:164:352:550:737:934]
[RE:166:471:641:829:1111] [DI:directJoin]

| ORF Name | NT ID | AA ID | NT LN | AA LN | Score | P-value |
|---|---|---|---|---|---|---|
| 35815687_f2_224 | 204 | 7375 | 207 | 68 | | |

Description

NO-HIT

| ORF Name | NT ID | AA ID | NT LN | AA LN | Score | P-value |
|---|---|---|---|---|---|---|
| 35817708_c1_675 | 205 | 7376 | 393 | 130 | 103 | 1.0e-05 |

Description sp:[LN:A72556] [AC:A72556] [PN:hypothetical protein APE1733] [GN:APE1733]
[OR:Aeropyrum pernix] [DB:pir2] >gp:[GI:d1044520:g5105421] [LN:AP000062]
[AC:AP000062] [PN:145aa long hypothetical protein] [GN:APE1733] [OR:Aeropyrum
pernix] [SR:Aeropyrum pernix (strain:K1) DNA] [DB:genpept-bct1] [DE:Aeropyrum
pernix genomic DNA, section 5/7.] [NT:motif=prokaryotic membrane lipoprotein
lipid] [LE:112066] [RE:112503] [DI:complement]

| ORF Name | NT ID | AA ID | NT LN | AA LN | Score | P-value |
|---|---|---|---|---|---|---|
| 36063563_f1_98 | 206 | 7377 | 573 | 190 | 775 | 6.2e-77 |

Description sp:[LN:DSBE_ECOLI] [AC:P33926] [GN:DSBE:CCMG] [OR:Escherichia coli]
[DE:BIOGENESIS PROTEIN CCMG)] [SP:P33926] [DB:swissprot] >sp:[LN:A64989]
[AC:A64989] [PN:thiol:disulfide interchange protein DsbE precursor] [GN:dsbE]
[CL:cytochrome c biogenesis protein CycX] [OR:Escherichia coli] [DB:pir2]
>gp:[GI:g405920] [LN:ECOHU49] [AC:U00008] [PN:yejQ] [OR:Escherichia coli]
[SR:Escherichia coli K12 BHB2600] [DB:genpept-bct1] [DE:centisome 49 region of
E.coli K12 BHB2600.] [NT:probable thioredoxin; may be part of aeg-46.5]
[LE:19460] [RE:20017] [DI:complement] >gp:[GI:g1788523] [LN:AE000309]
[AC:AE000309:U00096] [PN:disulfide oxidoreductase (in biogenesis of] [GN:dsbE]
[FN:enzyme; Energy metabolism, carbon: Electron] [OR:Escherichia coli]
[DB:genpept-bct2] [DE:Escherichia coli K-12 MG1655 section 199 of 400 of the
completegenome.] [NT:f185; 100 pct identical to DSBE_ECOLI SW: P33926;] [LE:2131]
[RE:2688] [DI:complement]

| ORF Name | NT ID | AA ID | NT LN | AA LN | Score | P-value |
|---|---|---|---|---|---|---|
| 36428208_f2_265 | 207 | 7378 | 918 | 305 | 452 | 1.1e-42 |

Description gp:[GI:e1312341:g3341584] [LN:VCH231094] [AC:AJ231094] [GN:z35r] [OR:Vibrio
cholerae] [DB:genpept-bct1] [DE:Vibrio cholerae z35r gene.] [LE:168] [RE:482]
[DI:complement]

| ORF Name | NT ID | AA ID | NT LN | AA LN | Score | P-value |
|---|---|---|---|---|---|---|
| 36501893_f3_525 | 208 | 7379 | 210 | 69 | | |

Description

NO-HIT

| ORF Name | NT ID | AA ID | NT LN | AA LN | Score | P-value |
|---|---|---|---|---|---|---|
| 36539840_f3_470 | 209 | 7380 | 1803 | 600 | 2699 | 8.2e-281 |

Description gp:[GI:g2584862] [LN:ECU97665] [AC:U97665] [PN:dehydrogenase subunit precursor]
[OR:Erwinia cypripedii] [DB:genpept-bct2] [DE:Erwinia cypripedii membrane-bound
gluconate dehydrogenase complex,subunit III precursor, dehydrogenase subunit
precursor andcytochrome c precursor, genes, complete cds.] [NT:part of gluconate
dehydrogenase complex; putative] [LE:934] [RE:2781] [DI:direct]

| ORF Name | NT ID | AA ID | NT/LN | AA/LN | Score | P-value |
|---|---|---|---|---|---|---|
| 4001316_f3_387 | 210 | 7381 | 753 | 250 | 137 | 3.2e-07 |

Description gp:[GI:e291024:g1781030] [LN:MKFWUGDB] [AC:X98917] [GN:orf2] [OR:Methanopyrus kandleri] [DB:genpept-bct1] [DE:M.kandleri fwuG, fwuD and fwuB genes.] [LE:562] [RE:1317] [DI:direct]

| ORF Name | NT ID | AA ID | NT/LN | AA/LN | Score | P-value |
|---|---|---|---|---|---|---|
| 4027193_f2_234 | 211 | 7382 | 774 | 257 | 293 | 5.7e-37 |

Description sp:[LN:H69278] [AC:H69278] [PN:glutamine ABC transporter, permease protein (glnP) homolog] [CL:histidine permease protein M] [OR:Archaeoglobus fulgidus] [DB:pir2] >gp:[GI:g2650409] [LN:AE001090] [AC:AE001090:AE000782] [PN:glutamine ABC transporter, permease protein] [GN:AF0232] [OR:Archaeoglobus fulgidus] [DB:genpept-bct2] [DE:Archaeoglobus fulgidus section 17 of 172 of the complete genome.] [NT:similar to SP:P10345 PID:41572 GB:U00096] [LE:11883] [RE:12557] [DI:direct]

| ORF Name | NT ID | AA ID | NT/LN | AA/LN | Score | P-value |
|---|---|---|---|---|---|---|
| 4078443_f3_467 | 212 | 7383 | 1125 | 374 | 195 | 7.5e-13 |

Description sp:[LN:YHHZ_ECOLI] [AC:P46855] [GN:YHHZ] [OR:Escherichia coli] [DE:HYPOTHETICAL 44.2 KD PROTEIN IN GNTR-GGT INTERGENIC REGION (O392)] [SP:P46855] [DB:swissprot] >sp:[LN:E65140] [AC:E65140] [PN:hypothetical 44.2 kD protein in gntR-ggt intergenic region] [GN:yhhZ] [OR:Escherichia coli] [DB:pir2] >gp:[GI:g1789850] [LN:AE000420] [AC:AE000420:U00096] [PN:orf, hypothetical protein] [GN:yhhZ] [FN:orf; Unknown] [OR:Escherichia coli] [DB:genpept-bct2] [DE:Escherichia coli K-12 MG1655 section 310 of 400 of the completegenome.] [NT:o392; 100 pct identical amino acid sequence and] [LE:8253] [RE:9431] [DI:direct] >gp:[GI:g606377] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_o392; poor E. coli, good phage statistics] [LE:362600] [RE:363778] [DI:direct]

| ORF Name | NT ID | AA ID | NT/LN | AA/LN | Score | P-value |
|---|---|---|---|---|---|---|
| 4094813_f1_154 | 213 | 7384 | 456 | 151 | | |

Description

NO-HIT

| ORF_Name | NT_ID | AA_ID | NT LN | AA LN | Score | P-value |
|---|---|---|---|---|---|---|
| 4096033_f3_513 | 214 | 7385 | 183 | 60 | 49 | 0.034 |

Description sp:[LN:H72475] [AC:H72475] [PN:hypothetical protein APE2449] [GN:APE2449]
[OR:Aeropyrum pernix] [DB:pir2] >gp:[GI:d1045250:g5106153] [LN:AP000064]
[AC:AP000064] [PN:193aa long hypothetical protein] [GN:APE2449] [OR:Aeropyrum
pernix] [SR:Aeropyrum pernix (strain:K1) DNA] [DB:genpept-bct1] [DE:Aeropyrum
pernix genomic DNA, section 7/7.] [LE:131651] [RE:132232] [DI:direct]

| ORF_Name | NT_ID | AA_ID | NT LN | AA LN | Score | P-value |
|---|---|---|---|---|---|---|
| 4141301_c1_660 | 215 | 7386 | 441 | 146 | 240 | 3.1e-20 |

Description sp:[LN:T03486] [AC:T03486] [PN:conserved hypothetical protein] [OR:Rhodobacter
capsulatus] [DB:pir2] [MP:1] >gp:[GI:g3128287] [LN:AF010496] [AC:AF010496]
[PN:hypothetical protein] [OR:Rhodobacter capsulatus] [DB:genpept-bct2]
[DE:Rhodobacter capsulatus strain SB1003, partial genome.] [LE:42561] [RE:42980]
[DI:complement]

| ORF_Name | NT_ID | AA_ID | NT LN | AA LN | Score | P-value |
|---|---|---|---|---|---|---|
| 4188302_c3_988 | 216 | 7387 | 240 | 79 | 82 | 0.0068 |

Description sp:[LN:YIAT_ECOLI] [AC:P37681] [GN:YIAT] [OR:Escherichia coli] [DE:HYPOTHETICAL
27.4 KD PROTEIN IN AVTA-SELB INTERGENIC REGION PRECURSOR] [SP:P37681]
[DB:swissprot] >sp:[LN:S47805] [AC:S47805:B65158] [PN:hypothetical 27.4K protein
(avtA-selB intergenic region)] [GN:yiaT] [CL:hypothetical protein b1782]
[OR:Escherichia coli] [DB:pir2] >gp:[GI:g466722] [LN:ECOUW76] [AC:U00039]
[OR:Escherichia coli] [SR:Escherichia coli (sub_strain MG1655, strain K-12)
(library: lambda] [DB:genpept-bct1] [DE:E. coli chromosomal region from 76.0 to
81.5 minutes.] [LE:165381] [RE:166121] [DI:complement] >gp:[GI:g1790010]
[LN:AE000436] [AC:AE000436:U00096] [PN:putative outer membrane protein] [GN:yiaT]
[FN:putative membrane; Not classified] [OR:Escherichia coli] [DB:genpept-bct2]
[DE:Escherichia coli K-12 MG1655 section 326 of 400 of the completegenome.]
[NT:f246; 100 pct identical amino acid sequence and] [LE:204] [RE:944]
[DI:complement]

| ORF_Name | NT_ID | AA_ID | NT LN | AA LN | Score | P-value |
|---|---|---|---|---|---|---|
| 4312666_c1_655 | 217 | 7388 | 1278 | 425 | | |

Description

NO-HIT

| ORF_Name | NT ID | AA ID | $\frac{NT}{LN}$ | $\frac{AA}{LN}$ | Score | P-value |
|---|---|---|---|---|---|---|
| 4339193_c2_826 | 218 | 7389 | 894 | 297 | 988 | 1.7e-99 |

Description gp:[GI:d1037183:g4062964] [LN:AB014757] [AC:AB014757] [PN:beta-ketothiolase] [GN:phbA] [OR:Pseudomonas sp. 61-3] [SR:Pseudomonas sp. 61-3 (strain:61-3) DNA] [DB:genpept-bct1] [DE:Pseudomonas sp. 61-3 genes for PhbR, acetoacetyl-CoA reductase,beta-ketothiolase and PHB synthase, complete cds.] [LE:2585] [RE:3763] [DI:direct]

| ORF_Name | NT ID | AA ID | $\frac{NT}{LN}$ | $\frac{AA}{LN}$ | Score | P-value |
|---|---|---|---|---|---|---|
| 4471093_c2_835 | 219 | 7390 | 1689 | 562 | 2824 | 4.6e-294 |

Description sp:[LN:ILVB_KLEPN] [AC:P27696] [GN:ILVK] [OR:Klebsiella pneumoniae] [EC:4.1.3.18] [DE:(ALS)] [SP:P27696] [DB:swissprot] >sp:[LN:JC1218] [AC:JC1218] [PN:acetolactate synthase,, FAD-independent] [GN:ilvK] [CL:acetolactate synthase large chain:thiamine pyrophosphate-binding domain homology] [OR:Klebsiella pneumoniae] [EC:4.1.3.18] [DB:pir1] >gp:[GI:g149211] [LN:KPNILUK] [AC:M73842] [PN:acetolactate synthase] [GN:iluk] [OR:Klebsiella pneumoniae] [SR:Klebsiella pneumoniae DNA] [DB:genpept-bct1] [EC:4.1.3.18] [DE:Klebsiella pneumoniae acetolactate synthase (iluk) gene, completecds.] [LE:141] [RE:1820] [DI:direct]

| ORF_Name | NT ID | AA ID | $\frac{NT}{LN}$ | $\frac{AA}{LN}$ | Score | P-value |
|---|---|---|---|---|---|---|
| 4487768_c1_585 | 220 | 7391 | 540 | 179 | 564 | 1.4e-54 |

Description gp:[GI:g4324614] [LN:AF106566] [AC:AF106566] [PN:CigR] [GN:cigR] [OR:Salmonella typhimurium] [DB:genpept-bct2] [DE:Salmonella typhimurium pathogenicity island SPI-3, completesequence.] [LE:12100] [RE:12579] [DI:complement]

| ORF_Name | NT ID | AA ID | $\frac{NT}{LN}$ | $\frac{AA}{LN}$ | Score | P-value |
|---|---|---|---|---|---|---|
| 4502316_c2_798 | 221 | 7392 | 597 | 198 | | |

Description

NO-HIT

| ORF_Name | NT ID | AA ID | $\frac{NT}{LN}$ | $\frac{AA}{LN}$ | Score | P-value |
|---|---|---|---|---|---|---|
| 4566633_f3_497 | 222 | 7393 | 480 | 159 | 128 | 2.4e-08 |

Description sp:[LN:B44984] [AC:B44984] [PN:collagen] [CL:unassigned collagens] [OR:Haemonchus contortus] [DB:pir2]

| ORF_Name | NT_ID | AA_ID | NT LN | AA LN | Score | P-value |
|---|---|---|---|---|---|---|
| 4784375_f3_459 | 223 | 7394 | 606 | 201 | | |

Description

NO-HIT

| ORF_Name | NT_ID | AA_ID | NT LN | AA LN | Score | P-value |
|---|---|---|---|---|---|---|
| 4819508_c2_770 | 224 | 7395 | 288 | 95 | 108 | 3.0e-06 |

Description sp:[LN:YBIJ_ECOLI] [AC:P41038] [GN:YBIJ] [OR:Escherichia coli] [DE:HYPOTHETICAL
8.6 KD PROTEIN IN DING-GLNQ INTERGENIC REGION PRECURSOR] [SP:P41038]
[DB:swissprot] >sp:[LN:B64817] [AC:B64817] [PN:ybiJ protein precursor] [GN:ybiJ]
[CL:conserved hypothetical protein b3238] [OR:Escherichia coli] [DB:pir2]
>gp:[GI:d1036454;g4062363] [LN:D90717] [AC:D90717:AB001340] [PN:Hypothetical 8.6
kd protein in ding/rarB] [GN:ybiJ] [OR:Escherichia coli] [SR:Escherichia
coli(strain:K12) DNA, clone:Kohara clone #204] [DB:genpept-bct1] [DE:Escherichia
coli genomic DNA. (17.9 - 18.2 min).] [NT:ORF_ID:o204#8; similar to SwissProt
Accession] [LE:8967] [RE:9227] [DI:complement] >gp:[GI:g1787021] [LN:AE000182]
[AC:AE000182:U00096] [PN:orf, hypothetical protein] [GN:ybiJ] [FN:orf; Unknown]
[OR:Escherichia coli] [DB:genpept-bct2] [DE:Escherichia coli K-12 MG1655 section
72 of 400 of the completegenome.] [NT:f86; 100 pct identical to YBIJ_ECOLI SW:
P41038] [LE:6932] [RE:7192] [DI:complement]

| ORF_Name | NT_ID | AA_ID | NT LN | AA LN | Score | P-value |
|---|---|---|---|---|---|---|
| 4962812_f3_504 | 225 | 7396 | 894 | 297 | 385 | 1.3e-35 |

Description sp:[LN:YBHD_ECOLI] [AC:P52696:P75761] [GN:YBHD] [OR:Escherichia coli]
[DE:HYPOTHETICAL TRANSCRIPTIONAL REGULATOR IN MODC-BIOA INTERGENIC REGION]
[SP:P52696:P75761] [DB:swissprot] >sp:[LN:H64812] [AC:H64812] [PN:ybhD protein]
[GN:ybhD] [CL:hypothetical protein b2409] [OR:Escherichia coli] [DB:pir2]
>gp:[GI:d1036418;g4062335] [LN:D90715] [AC:D90715:AB001340] [PN:Hypothetical
transcriptional regulator in modC] [GN:ybhD] [OR:Escherichia coli]
[SR:Escherichia coli(strain:K12) DNA, clone:Kohara clone #180] [DB:genpept-bct1]
[DE:Escherichia coli genomic DNA. (17.1 - 17.4 min).] [NT:ORF_ID:o201#1; similar
to SwissProt Accession] [LE:6428] [RE:7444] [DI:complement] >gp:[GI:g1786984]
[LN:AE000179] [AC:AE000179:U00096] [PN:putative transcriptional regulator
LYSR-type] [GN:ybhD] [FN:putative regulator; Not classified] [OR:Escherichia
coli] [DB:genpept-bct2] [DE:Escherichia coli K-12 MG1655 section 69 of 400 of the
completegenome.] [NT:f338; last 108 residues are 100 pct identical to] [LE:4647]
[RE:5663] [DI:complement]

| ORF Name | NT ID | AA ID | NT/LN | AA/LN | Score | P-value |
|---|---|---|---|---|---|---|
| 4970011_f2_327 | 226 | 7397 | 444 | 147 | 149 | 1.4e-10 |

Description gp:[GI:g6002233] [LN:SC51A] [AC:AL121596] [PN:MarR-family protein] [GN:SCF51A.25]
[OR:Streptomyces coelicolor A3(2)] [DB:genpept-bct1] [DE:Streptomyces coelicolor
cosmid 51A.] [NT:SCF51A.25, MarR-family protein, len: 148 aa.] [LE:25723]
[RE:26169] [DI:direct]

| ORF Name | NT ID | AA ID | NT/LN | AA/LN | Score | P-value |
|---|---|---|---|---|---|---|
| 5096875_f3_562 | 227 | 7398 | 1119 | 372 | 408 | 4.8e-38 |

Description sp:[LN:GCVA_ECOLI] [AC:P32064] [GN:GCVA] [OR:Escherichia coli] [DE:ACTIVATOR)]
[SP:P32064] [DB:swissprot] >sp:[LN:I41065] [AC:I41065:I41229:D65063:S34371]
[PN:glycine cleavage system transcription activator] [GN:gcvA] [CL:regulatory
protein ampR] [OR:Escherichia coli] [DB:pir2] >gp:[GI:g312766] [LN:ECGCVA]
[AC:X73413] [PN:glycine cleavage activator protein] [GN:gcvA] [OR:Escherichia
coli] [DB:genpept-bct1] [DE:E.coli gene for glycine cleavage activator protein
and orf 2 and 3.] [SP:P32064] [LE:43] [RE:960] [DI:direct] >gp:[GI:g882703]
[LN:ECU29581] [AC:U29581] [GN:gcvA] [FN:regulatory protein for glycine cleavage]
[OR:Escherichia coli] [DB:genpept-bct1] [DE:Escherichia coli K-12 genome;
approximately 63 to 64 minutes.] [NT:CG Site No. 28676] [LE:23205] [RE:24122]
[DI:complement] >gp:[GI:g1789173] [LN:AE000364] [AC:AE000364:U00096] [PN:positive
regulator of gcv operon] [GN:gcvA] [FN:regulator; Central intermediary
metabolism:] [OR:Escherichia coli] [DB:genpept-bct2] [DE:Escherichia coli K-12
MG1655 section 254 of 400 of the completegenome.] [NT:f305; 100 pct identical to
GCVA_ECOLI SW: P32064;] [LE:7719] [RE:8636] [DI:complement] >gp:[GI:g523331]
[LN:ECOGCVA] [AC:U01030] [PN:GcvA] [FN:regulatory protein for glycine cleavage
enzyme] [OR:Escherichia coli] [DB:genpept-bct2] [DE:Escherichia coli K12 glycine
cleavage activator protein (gcvA)gene, complete cds.] [LE:304] [RE:1221]
[DI:direct]

| ORF Name | NT ID | AA ID | NT/LN | AA/LN | Score | P-value |
|---|---|---|---|---|---|---|
| 5113762_f2_255 | 228 | 7399 | 1077 | 358 | 762 | 1.5e-75 |

Description gp:[GI:e1247695:g2815336] [LN:SC10A5] [AC:AL021529] [PN:ABC-transporter
ATP-binding protein] [GN:SC10A5.28c] [OR:Streptomyces coelicolor]
[DB:genpept-bct1] [DE:Streptomyces coelicolor cosmid 10A5.] [NT:SC10A5.28c,
ABC-transporter ATP-binding protein,] [LE:30136] [RE:31221] [DI:complement]

| ORF Name | NT ID | AA ID | NT LN | AA LN | Score | P-value |
|---|---|---|---|---|---|---|
| 5115950_f3_376 | 229 | 7400 | 243 | 80 | 271 | 1.6e-23 |

Description sp:[LN:C64925] [AC:C64925] [PN:hypothetical protein b1675] [OR:Escherichia coli]
[DB:pir2] >gp:[GI:g1549286] [LN:ECU68703] [AC:U68703] [OR:Escherichia coli]
[DB:genpept-bct1] [DE:Escherichia coli K-12 MG1655 genome, ribC-pykF region.]
[NT:hypothetical protein] [LE:12336] [RE:12545] [DI:complement] >gp:[GI:g1787964]
[LN:AE000262] [AC:AE000262:U00096] [PN:orf, hypothetical protein] [GN:b1675]
[FN:orf; Unknown] [OR:Escherichia coli] [DB:genpept-bct2] [DE:Escherichia coli
K-12 MG1655 section 152 of 400 of the completegenome.] [NT:f69; This 69 aa ORF is
28 pct identical (2 gaps)] [LE:8673] [RE:8882] [DI:complement]

| ORF Name | NT ID | AA ID | NT LN | AA LN | Score | P-value |
|---|---|---|---|---|---|---|
| 5128538_c3_1023 | 230 | 7401 | 1401 | 466 | 1237 | 6.9e-126 |

Description sp:[LN:YXJC_BACSU] [AC:P42314] [GN:YXJC:N15J] [OR:Bacillus subtilis]
[DE:HYPOTHETICAL 48.3 KD PROTEIN IN KATB 3'REGION] [SP:P42314] [DB:swissprot]
>sp:[LN:A70079] [AC:A70079] [PN:conserved hypothetical protein yxjC] [GN:yxjC]
[OR:Bacillus subtilis] [DB:pir2] >gp:[GI:e1186399:g2636435] [LN:BSUB0020]
[AC:Z99123:AL009126] [GN:yxjC] [FN:unknown] [OR:Bacillus subtilis]
[DB:genpept-bct1] [DE:Bacillus subtilis complete genome (section 20 of 21): from
3798401to 4010550.] [NT:similar to hypothetical proteins from B. subtilis]
[SP:P42314] [LE:203159] [RE:204523] [DI:complement] >gp:[GI:e1184625:g2636446]
[LN:BSUB0021] [AC:Z99124:AL009126] [GN:yxjC] [FN:unknown] [OR:Bacillus subtilis]
[DB:genpept-bct1] [DE:Bacillus subtilis complete genome (section 21 of 21): from
3999281to 4214814.] [NT:similar to hypothetical proteins from B. subtilis]
[SP:P42314] [LE:2279] [RE:3643] [DI:complement] >gp:[GI:d1012371:g666001]
[LN:D83026] [AC:D83026:D45911] [GN:yxjC] [OR:Bacillus subtilis] [SR:Bacillus
subtilis (strain:BGSC 1A1) DNA] [DB:genpept-bct1] [DE:Bacillus subtilis genome
sequence covering lic-cel region.] [NT:hypothetical] [LE:19942] [RE:21306]
[DI:direct]

| ORF Name | NT ID | AA ID | NT LN | AA LN | Score | P-value |
|---|---|---|---|---|---|---|
| 5131930_f2_328 | 231 | 7402 | 1527 | 508 | 333 | 4.8e-28 |

Description sp:[LN:YLAB_ECOLI] [AC:P77473] [GN:YLAB] [OR:Escherichia coli] [DE:HYPOTHETICAL
58.9 KD PROTEIN IN TESB-HHA INTERGENIC REGION] [SP:P77473] [DB:swissprot]
>sp:[LN:H64775] [AC:H64775] [PN:probable membrane protein ylaB] [GN:ylaB]
[CL:probable membrane protein ylaB] [OR:Escherichia coli] [DB:pir2]
>gp:[GI:g1773140] [LN:ECU82664] [AC:U82664] [PN:similar to the 60.8kd protein in
SSB-SOXS] [OR:Escherichia coli] [DB:genpept-bct1] [DE:Escherichia coli minutes 9
to 11 genomic sequence.] [LE:56515] [RE:58071] [DI:complement] >gp:[GI:g1786662]
[LN:AE000152] [AC:AE000152:U00096] [PN:orf, hypothetical protein] [GN:ylaB]
[FN:orf; Unknown] [OR:Escherichia coli] [DB:genpept-bct2] [DE:Escherichia coli
K-12 MG1655 section 42 of 400 of the completegenome.] [NT:f518; This 518 aa ORF
is 33 pct identical (6 gaps)] [LE:481] [RE:2037] [DI:complement]

| ORF Name | NT ID | AA ID | NT LN | AA LN | Score | P-value |
|---|---|---|---|---|---|---|
| 5208291_f3_512 | 232 | 7403 | 1314 | 437 | 118 | 0.0015 |

Description sp:[LN:GLT4_WHEAT] [AC:P08489] [OR:Triticum aestivum] [SR:,Wheat] [DE:GLUTENIN, HIGH MOLECULAR WEIGHT SUBUNIT PW212 PRECURSOR] [SP:P08489] [DB:swissprot] >sp:[LN:EEWTHW] [AC:A24107] [PN:glutenin, high molecular weight chain precursor] [CL:glutenin] [OR:Triticum aestivum] [SR:, common wheat] [DB:pir1] >gp:[GI:g736319] [LN:TAGLUT1] [AC:X03346] [PN:glutenin] [OR:Triticum aestivum] [DB:genpept-pln1] [DE:Wheat gene for HMW glutenin subunit.] [SP:P08489] [LE:443] [RE:2959] [DI:direct]

| ORF Name | NT ID | AA ID | NT LN | AA LN | Score | P-value |
|---|---|---|---|---|---|---|
| 5350907_f1_178 | 233 | 7404 | 672 | 224 | 462 | 9.2e-44 |

Description sp:[LN:D70033] [AC:D70033] [PN:conserved hypothetical protein yvdD] [GN:yvdD] [CL:yeast conserved hypothetical protein YJL055w] [OR:Bacillus subtilis] [DB:pir2] >gp:[GI:e1186152:g2635977] [LN:BSUB0018] [AC:Z99121:AL009126] [GN:yvdD] [FN:unknown] [OR:Bacillus subtilis] [DB:genpept-bct1] [DE:Bacillus subtilis complete genome (section 18 of 21): from 3399551to 3609060.] [NT:similar to hypothetical proteins] [LE:158450] [RE:159025] [DI:complement] >gp:[GI:e313036:g1945663] [LN:BSZ94043] [AC:Z94043] [PN:hypothetical protein] [GN:yvdD] [OR:Bacillus subtilis] [DB:genpept-bct1] [DE:B.subtilis genomic DNA fragment (88 kb).] [NT:similar to YJF5_YEAST hypothetical 26.9 kd protein] [LE:22646] [RE:23221] [DI:direct]

| ORF Name | NT ID | AA ID | NT LN | AA LN | Score | P-value |
|---|---|---|---|---|---|---|
| 6058557_c2_811 | 234 | 7405 | 1449 | 482 | 407 | 6.2e-38 |

Description gp:[GI:g1439551] [LN:RLU39409] [AC:U39409] [OR:Rhizobium leguminosarum bv. trifolii] [DB:genpept-bct1] [DE:Rhizobium leguminosarum bv. trifolii TfuA (tfuA), gene, completecds.] [NT:ORF2; high similarity to the E. coli CodA protein] [LE:996] [RE:2348] [DI:direct]

| ORF Name | NT ID | AA ID | NT LN | AA LN | Score | P-value |
|---|---|---|---|---|---|---|
| 6100055_c3_1140 | 235 | 7406 | 681 | 226 | 141 | 9.7e-10 |

Description sp:[LN:S38906] [AC:S38906] [PN:hypothetical protein 4] [CL:Bacillus subtilis probable transcription regulator yrhI] [OR:Clostridium pasteurianum] [DB:pir2] >gp:[GI:g431950] [LN:CPDHYPRO] [AC:Z28353] [PN:similar to a B.subtilis gene (GB: BACHEMEHY_5)] [OR:Clostridium pasteurianum] [DB:genpept-bct1] [DE:C.pasteurianum (ATCC 6013) DNA for hydrogenase promoter;.] [NT:Putative gene product similar to several proteins] [LE:4608] [RE:5180] [DI:complement]

| ORF_Name | NT ID | AA ID | NT/LN | AA/LN | Score | P-value |
|---|---|---|---|---|---|---|
| 6338328_f3_465 | 236 | 7407 | 429 | 142 | | |

Description

NO-HIT

| ORF_Name | NT ID | AA ID | NT/LN | AA/LN | Score | P-value |
|---|---|---|---|---|---|---|
| 6355215_c1_624 | 237 | 7408 | 972 | 323 | 336 | 2.1e-30 |

Description sp:[LN:Y355_HAEIN] [AC:Q57306:O05017] [GN:HI0355] [OR:Haemophilus influenzae] [DE:HYPOTHETICAL ABC TRANSPORTER PERMEASE PROTEIN HI0355] [SP:Q57306:O05017] [DB:swissprot] >gp:[GI:g1573324] [LN:U32720] [AC:U32720:L42023] [PN:ABC transporter, permease protein] [GN:HI0355] [OR:Haemophilus influenzae Rd] [DB:genpept-bct2] [DE:Haemophilus influenzae Rd section 35 of 163 of the complete genome.] [NT:similar to GB:L16808 SP:P40401 PID:438473] [LE:2247] [RE:2984] [DI:direct]

| ORF_Name | NT ID | AA ID | NT/LN | AA/LN | Score | P-value |
|---|---|---|---|---|---|---|
| 6370390_c2_780 | 238 | 7409 | 972 | 323 | 634 | 5.5e-62 |

Description sp:[LN:B72367] [AC:B72367] [PN:oligopeptide ABC transporter, permease protein] [GN:TM0532] [CL:oligopeptide permease protein oppB] [OR:Thermotoga maritima] [DB:pir2] >gp:[GI:g4981045] [LN:AE001728] [AC:AE001728:AE000512] [PN:oligopeptide ABC transporter, permease protein] [GN:TM0532] [OR:Thermotoga maritima] [DB:genpept-bct2] [DE:Thermotoga maritima section 40 of 136 of the complete genome.] [NT:similar to PID:1001492 PID:1001545 percent] [LE:15061] [RE:16026] [DI:direct]

| ORF_Name | NT ID | AA ID | NT/LN | AA/LN | Score | P-value |
|---|---|---|---|---|---|---|
| 6384660_f1_62 | 239 | 7410 | 1161 | 386 | 719 | 5.4e-71 |

Description sp:[LN:S76858] [AC:S76858] [PN:hypothetical protein] [CL:hippurate hydrolase] [OR:Synechocystis sp.] [SR:PCC 6803, , PCC 6803] [SR:PCC 6803, ] [DB:pir2] >gp:[GI:d1019503:g1653860] [LN:D90917] [AC:D90917:AB001339] [PN:N-acyl-L-amino acid amidohydrolase] [GN:ama] [OR:Synechocystis sp.] [SR:Synechocystis sp. (strain:PCC6803) DNA] [DB:genpept-bct1] [DE:Synechocystis sp. PCC6803 complete genome, 27/27, 3418852-3573470.] [NT:ORF_ID:slr1653] [LE:34324] [RE:35574] [DI:direct]

| ORF Name | NT ID | AA ID | NT LN | AA LN | Score | P-value |
|---|---|---|---|---|---|---|
| 6417812_f2_235 | 240 | 7411 | 627 | 208 | 166 | 2.1e-12 |

Description gp:[GI:e1245748:g2808777] [LN:SC7H1] [AC:AL021411] [PN:hypothetical protein]
[GN:SC7H1.19] [OR:Streptomyces coelicolor] [DB:genpept-bct1] [DE:Streptomyces
coelicolor cosmid 7H1.] [NT:SC7H1.19, unknown, len: 182 aa] [LE:16921] [RE:17469]
[DI:direct]

| ORF Name | NT ID | AA ID | NT LN | AA LN | Score | P-value |
|---|---|---|---|---|---|---|
| 6447157_f1_68 | 241 | 7412 | 1773 | 590 | 646 | 4.1e-78 |

Description gp:[GI:e1247696:g2815337] [LN:SC10A5] [AC:AL021529] [PN:putative membrane
protein] [GN:SC10A5.29c] [OR:Streptomyces coelicolor] [DB:genpept-bct1]
[DE:Streptomyces coelicolor cosmid 10A5.] [NT:SC10A5.29c, probable integral
membrane protein,] [LE:31214] [RE:32983] [DI:complement]

| ORF Name | NT ID | AA ID | NT LN | AA LN | Score | P-value |
|---|---|---|---|---|---|---|
| 7088566_f2_179 | 242 | 7413 | 894 | 297 | 252 | 1.6e-21 |

Description sp:[LN:G71171] [AC:G71171] [PN:hypothetical protein PH0571] [GN:PH0571]
[OR:Pyrococcus horikoshii] [DB:pir2] >gp:[GI:d1030603:g3256977] [LN:AP000002]
[AC:AP000002:AB009475:AB009476:AB009477:AB009478:AB009479:AB009480] [PN:181aa
long hypothetical protein] [GN:PH0571] [OR:Pyrococcus horikoshii] [SR:Pyrococcus
horikoshii (strain:OT3) DNA] [DB:genpept-bct1] [DE:Pyrococcus horikoshii OT3
genomic DNA, 287001-544000 nt. position(2/7).] [LE:222071] [RE:222616]
[DI:direct]

| ORF Name | NT ID | AA ID | NT LN | AA LN | Score | P-value |
|---|---|---|---|---|---|---|
| 7113415_f2_257 | 243 | 7414 | 282 | 93 | | |

Description

NO-HIT

| ORF Name | NT ID | AA ID | NT LN | AA LN | Score | P-value |
|---|---|---|---|---|---|---|
| 7132808_c1_758 | 244 | 7415 | 1251 | 416 | 1914 | 1.3e-197 |

Description sp:[LN:KPY1_SALTY] [AC:P77983] [GN:PYKF] [OR:Salmonella typhimurium]
[EC:2.7.1.40] [DE:PYRUVATE KINASE I, (PK-1)] [SP:P77983] [DB:swissprot]
>gp:[GI:e258633:g1526982] [LN:STPYKFORF] [AC:X99945] [PN:pyruvate kinase like
protein] [GN:pykF] [OR:Salmonella typhimurium] [DB:genpept-bct1]
[DE:S.typhimurium ORF's 32 & 48 & gene pykF.] [SP:P77983] [LE:2919] [RE:4331]
[DI:direct]

| ORF Name | NT ID | AA ID | NT/LN | AA/LN | Score | P-value |
|---|---|---|---|---|---|---|
| 7284687_f1_87 | 245 | 7416 | 1380 | 459 | 1496 | 2.5e-153 |

Description gp:[GI:g2584861] [LN:ECU97665] [AC:U97665] [PN:cytochrome c precursor]
[OR:Erwinia cypripedii] [DB:genpept-bct2] [DE:Erwinia cypripedii membrane-bound gluconate dehydrogenase complex,subunit III precursor, dehydrogenase subunit precursor andcytochrome c precursor, genes, complete cds.] [NT:part of gluconate dehydrogenase complex] [LE:2793] [RE:4118] [DI:direct]

| ORF Name | NT ID | AA ID | NT/LN | AA/LN | Score | P-value |
|---|---|---|---|---|---|---|
| 7286555_f1_38 | 246 | 7417 | 1038 | 345 | 309 | 2.3e-30 |

Description sp:[LN:SSUC_BACSU] [AC:P40401] [GN:SSUC] [OR:Bacillus subtilis] [DE:PUTATIVE ALIPHATIC SULFONATES TRANSPORT PERMEASE PROTEIN SSUC] [SP:P40401] [DB:swissprot]
>sp:[LN:I39928] [AC:I39928:H69816] [PN:nitrate transport protein nrtB homolog ygaM] [GN:ygaM] [CL:Synechococcus nitrate transport protein nrtB] [OR:Bacillus subtilis] [DB:pir1] >gp:[GI:g438473] [LN:BACORFKLM] [AC:L16808] [OR:Bacillus subtilis] [SR:Bacillus subtilis (individual_isolate MS11) (library: Tn91] [DB:genpept-bct1] [DE:Bacillus subtilis orfK, orfL and orfM, complete cds's.] [NT:protein is hydrophobic, with homology to E. coli] [LE:1064] [RE:1894] [DI:direct] >gp:[GI:e1182874:g2633208] [LN:BSUB0005] [AC:Z99108:AL009126] [GN:ygaM] [FN:unknown] [OR:Bacillus subtilis] [DB:genpept-bct1] [DE:Bacillus subtilis complete genome (section 5 of 21): from 802821 to1011250.] [NT:alternate gene name: yzeB; similar to ABC] [SP:P40401] [LE:159863] [RE:160693] [DI:direct] >gp:[GI:e308631:g1903040] [LN:BSZ93102] [AC:Z93102] [PN:hypothetical 30.2 kd protein] [GN:ygaM] [OR:Bacillus subtilis] [DB:genpept-bct1] [DE:B.subtilis yga[L,M,N,O,P,Q,R,S,T], yzdB and yze[A,C] genes.] [NT:homology to nitrate permease protein] [SP:P40401] [LE:2189] [RE:3019] [DI:direct]

| ORF Name | NT ID | AA ID | NT/LN | AA/LN | Score | P-value |
|---|---|---|---|---|---|---|
| 797717_f2_196 | 247 | 7418 | 957 | 318 | 1411 | 2.5e-144 |

Description sp:[LN:MHPC_ECOLI] [AC:P77044:P71204:P77205] [GN:MHPC] [OR:Escherichia coli]
[EC:3.7.1.-] [DE:2-HYDROXY-6-KETONONA-2,4-DIENEDIOIC ACID HYDROLASE,]
[SP:P77044:P71204:P77205] [DB:swissprot] >sp:[LN:E64762] [AC:E64762] [PN:probable 2,6-dioxo-6-phenylhexa-3-enoate hydrolase,] [GN:mhpC] [CL:tropinesterase]
[OR:Escherichia coli] [EC:3.7.1.8] [DB:pir1] >gp:[GI:g1786545] [LN:AE000142]
[AC:AE000142:U00096] [PN:2-hydroxy-6-ketonona-2,4-dienedioic acid] [GN:mhpC]
[FN:enzyme; Degradation of small molecules: Carbon] [OR:Escherichia coli]
[DB:genpept-bct2] [DE:Escherichia coli K-12 MG1655 section 32 of 400 of the completegenome.] [NT:o309; This 309 aa ORF is 51 pct identical (2 gaps)]
[LE:2634] [RE:3563] [DI:direct] >gp:[GI:g1657545] [LN:ECU73857] [AC:U73857]
[OR:Escherichia coli] [DB:genpept-bct2] [DE:Escherichia coli chromosome minutes 6-8.] [NT:similar to Pseudomonas sp. pcbD] [LE:78971] [RE:79900] [DI:direct]

| ORF Name | NT ID | AA ID | NT LN | AA LN | Score | P-value |
|---|---|---|---|---|---|---|
| 876918_f3_538 | 248 | 7419 | 1659 | 552 | 500 | 8.6e-48 |

Description gp:[GI:g2613074] [LN:AF030288] [AC:AF030288] [PN:putative efflux protein] [GN:tmpA] [OR:Brevibacterium linens] [DB:genpept-bct2] [DE:Brevibacterium linens strain OC2 putative efflux protein (tmpA)gene, complete cds.] [NT:probably an integral membrane translocase; contains] [LE:714] [RE:2183] [DI:direct]

| ORF Name | NT ID | AA ID | NT LN | AA LN | Score | P-value |
|---|---|---|---|---|---|---|
| 9791563_c3_1041 | 249 | 7420 | 378 | 125 | | |

Description

NO-HIT

| ORF Name | NT ID | AA ID | NT LN | AA LN | Score | P-value |
|---|---|---|---|---|---|---|
| 9808291_f1_76 | 250 | 7421 | 783 | 260 | | |

Description

NO-HIT

| ORF Name | NT ID | AA ID | NT LN | AA LN | Score | P-value |
|---|---|---|---|---|---|---|
| 9960278_c1_631 | 251 | 7422 | 780 | 259 | 737 | 6.6e-73 |

Description sp:[LN:SCOA_BACSU] [AC:P42315] [GN:SCOA:N15K] [OR:Bacillus subtilis] [EC:2.8.3.5] [DE:(EC 2.8.3.5) (SUCCINYL COA:3-OXOACID COA-TRANSFERASE) (OXCT A)] [SP:P42315] [DB:swissprot] >sp:[LN:B70079] [AC:B70079] [PN:3-oxoadipate CoA-transferase homolog yxjD] [GN:yxjD] [CL:3-oxoadipate CoA-transferase alpha chain:3-oxoadipate CoA-transferase alpha chain homology] [OR:Bacillus subtilis] [DB:pir2] >gp:[GI:e1186398:g2636434] [LN:BSUB0020] [AC:Z99123:AL009126] [GN:yxjD] [FN:unknown] [OR:Bacillus subtilis] [DB:genpept-bct1] [DE:Bacillus subtilis complete genome (section 20 of 21): from 3798401to 4010550.] [NT:similar to 3-oxoadipate CoA-transferase] [SP:P42315] [LE:202364] [RE:203080] [DI:complement] >gp:[GI:e1184624:g2636445] [LN:BSUB0021] [AC:Z99124:AL009126] [GN:yxjD] [FN:unknown] [OR:Bacillus subtilis] [DB:genpept-bct1] [DE:Bacillus subtilis complete genome (section 21 of 21): from 3999281to 4214814.] [NT:similar to 3-oxoadipate CoA-transferase] [SP:P42315] [LE:1484] [RE:2200] [DI:complement] >gp:[GI:d1012372:g666002] [LN:D83026] [AC:D83026:D45911] [GN:yxjD] [OR:Bacillus subtilis] [SR:Bacillus subtilis (strain:BGSC 1A1) DNA] [DB:genpept-bct1] [DE:Bacillus subtilis genome sequence covering lic-cel region.] [NT:homologous to 3-oxoadipate CoA-transferase (EC] [LE:21385] [RE:22101] [DI:direct]

| ORF_Name | NT_ID | AA_ID | NT LN | AA LN | Score | P-value |
|---|---|---|---|---|---|---|
| 10281262_c2_783 | 252 | 7423 | 693 | 230 | 927 | 4.9e-93 |

Description sp:[LN:YCFH_ECOLI] [AC:P37346:P78057] [GN:YCFH] [OR:Escherichia coli]
[DE:HYPOTHETICAL 29.8 KD PROTEIN IN HOLB-PTSG INTERGENIC REGION]
[SP:P37346:P78057] [DB:swissprot] >sp:[LN:A64854] [AC:A64854] [PN:probable
metal-dependent hydrolase, ycfH] [GN:ycfH] [CL:hypothetical protein HI0454]
[OR:Escherichia coli] [EC:3.-.-.-] [DB:pir2] >gp:[GI:d1036893:g4062666]
[LN:D90745] [AC:D90745:AB001340] [PN:Hypothetical protein in holB 3'region .]
[GN:ycfH] [OR:Escherichia coli] [SR:Escherichia coli(strain:K12) DNA,
clone:Kohara clone #236] [DB:genpept-bct1] [DE:Escherichia coli genomic DNA.
(24.8 - 25.2 min).] [NT:ORF_ID:o236#9; similar to SwissProt Accession] [LE:7419]
[RE:8216] [DI:direct] >gp:[GI:g1787342] [LN:AE000210] [AC:AE000210:U00096]
[PN:orf, hypothetical protein] [GN:ycfH] [FN:orf; Unknown] [OR:Escherichia coli]
[DB:genpept-bct2] [DE:Escherichia coli K-12 MG1655 section 100 of 400 of the
completegenome.] [NT:o265; 99 pct identical to fragment YCFH_ECOLI] [LE:8082]
[RE:8879] [DI:direct]

| ORF_Name | NT_ID | AA_ID | NT LN | AA LN | Score | P-value |
|---|---|---|---|---|---|---|
| 10438543_c2_765 | 253 | 7424 | 210 | 69 | 122 | 9.8e-08 |

Description gp:[GI:g5732924] [LN:AF167709] [AC:AF167709] [PN:excretory/secretory mucin MUC-4]
[GN:muc-4] [OR:Toxocara canis] [DB:genpept-inv2] [DE:Toxocara canis
excretory/secretory mucin MUC-4 (muc-4) mRNA,complete cds.] [NT:putative TES-120
surface coat mucin family member] [LE:14] [RE:589] [DI:direct]

| ORF_Name | NT_ID | AA_ID | NT LN | AA LN | Score | P-value |
|---|---|---|---|---|---|---|
| 10554788_f1_43 | 254 | 7425 | 741 | 246 | 894 | 1.5e-89 |

Description sp:[LN:YMDD_ECOLI] [AC:P75920] [GN:YMDD] [OR:Escherichia coli] [DE:HYPOTHETICAL
44.7 KD PROTEIN IN CSGC-MODG INTERGENIC REGION] [SP:P75920] [DB:swissprot]
>sp:[LN:D64847] [AC:D64847] [PN:probable membrane protein ymdD] [GN:ymdD]
[OR:Escherichia coli] [DB:pir2] >gp:[GI:d1036823:g4062618] [LN:D90741]
[AC:D90741:AB001340] [OR:Escherichia coli] [SR:Escherichia coli(strain:K12) DNA,
clone:Kohara clone #231] [DB:genpept-bct1] [DE:Escherichia coli genomic DNA.
(23.7 - 24.0 min).] [NT:ORF_ID:o232#5] [LE:12386] [RE:13543] [DI:complement]
>gp:[GI:d1036831:g4062624] [LN:D90742] [AC:D90742:AB001340] [OR:Escherichia coli]
[SR:Escherichia coli(strain:K12) DNA, clone:Kohara clone #232] [DB:genpept-bct1]
[DE:Escherichia coli genomic DNA. (23.8 - 24.2 min).] [NT:ORF_ID:o232#5]
[LE:4404] [RE:5561] [DI:complement] >gp:[GI:g1787285] [LN:AE000206]
[AC:AE000206:U00096] [PN:orf, hypothetical protein] [GN:ymdD] [FN:orf; Unknown]
[OR:Escherichia coli] [DB:genpept-bct2] [DE:Escherichia coli K-12 MG1655 section
96 of 400 of the completegenome.] [NT:f385; This 385 aa ORF is 24 pct identical
(21 gaps)] [LE:2042] [RE:3199] [DI:complement]

| ORF Name | NT ID | AA ID | NT LN | AA LN | Score | P-value |
|---|---|---|---|---|---|---|
| 10629693_f3_443 | 255 | 7426 | 330 | 109 | 101 | 1.7e-05 |

Description sp:[LN:G65201] [AC:G65201] [PN:hypothetical 11.8 kD protein in ptsa-frwc intergenic region] [GN:yijI] [OR:Escherichia coli] [DB:pir2] >gp:[GI:g1790384] [LN:AE000468] [AC:AE000468:U00096] [PN:orf, hypothetical protein] [GN:yijI] [FN:orf; Unknown] [OR:Escherichia coli] [DB:genpept-bct2] [DE:Escherichia coli K-12 MG1655 section 358 of 400 of the completegenome.] [NT:o109; 100 pct identical amino acid sequence and] [LE:13408] [RE:13737] [DI:direct] >gp:[GI:g409788] [LN:ECOUW89] [AC:U00006] [OR:Escherichia coli] [SR:Escherichia coli (sub_strain MG1655, strain K-12) (library: lambda] [DB:genpept-bct2] [DE:E. coli chromosomal region from 89.2 to 92.8 minutes.] [LE:7099] [RE:7428] [DI:direct]

| ORF Name | NT ID | AA ID | NT LN | AA LN | Score | P-value |
|---|---|---|---|---|---|---|
| 10648912_f2_194 | 256 | 7427 | 498 | 165 | 138 | 1.6e-08 |

Description gp:[GI:g4263745] [LN:AC004912] [AC:AC004912] [GN:WUGSC:H_DJ0871B15.2] [OR:Homo sapiens] [SR:INFORMATION] [DB:genpept-pri4] [DE:Homo sapiens PAC clone DJ0871B15 from 7p15.3-7p14, completesequence.] [NT:similar to CR16, SH3 domain binding protein;] [LE:47332:57486:72441] [RE:47355:57562:72542] [DI:complementJoin]

| ORF Name | NT ID | AA ID | NT LN | AA LN | Score | P-value |
|---|---|---|---|---|---|---|
| 10802337_c3_876 | 257 | 7428 | 1353 | 450 | 1874 | 2.2e-193 |

Description sp:[LN:YCDB_ECOLI] [AC:P31545:P75903] [GN:YCDB] [OR:Escherichia coli] [DE:(ORF1)] [SP:P31545:P75903] [DB:swissprot] >sp:[LN:A64844] [AC:A64844:A47065] [PN:ycdB protein precursor] [GN:ycdB] [CL:hypothetical protein ycdB] [OR:Escherichia coli] [DB:pir2] >gp:[GI:d1036786:g4062584] [LN:D90739] [AC:D90739:AB001340] [PN:Orf1 5' of phoH.] [GN:ycdB] [OR:Escherichia coli] [SR:Escherichia coli(strain:K12) DNA, clone:Kohara clone #229] [DB:genpept-bct1] [DE:Escherichia coli genomic DNA. (23.3 - 23.6 min).] [NT:ORF_ID:o229#3; similar to PIR Accession Number] [LE:2771] [RE:4042] [DI:direct] >gp:[GI:g1787255] [LN:AE000203] [AC:AE000203:U00096] [PN:orf, hypothetical protein] [GN:ycdB] [FN:orf; Unknown] [OR:Escherichia coli] [DB:genpept-bct2] [DE:Escherichia coli K-12 MG1655 section 93 of 400 of the completegenome.] [NT:o423; 100 pct identical to 228 aa fragment of] [LE:9280] [RE:10551] [DI:direct]

| ORF Name | NT ID | AA ID | NT LN | AA LN | Score | P-value |
|---|---|---|---|---|---|---|
| 10939808_c2_690 | 258 | 7429 | 1452 | 483 | 2162 | 6.6e-224 |

Description sp:[LN:C64878] [AC:C64878] [PN:probable amino acid permease ycjJ] [GN:ymjJ]
[OR:Escherichia coli] [DB:pir2] >gp:[GI:g1787553] [LN:AE000227]
[AC:AE000227:U00096] [PN:putative amino acid/amine transport protein] [GN:ycjJ]
[FN:putative transport; Not classified] [OR:Escherichia coli] [DB:genpept-bct2]
[DE:Escherichia coli K-12 MG1655 section 117 of 400 of the completegenome.]
[NT:f479; This 479 aa ORF is 63 pct identical (1 gap)] [LE:8886] [RE:10325]
[DI:complement]

| ORF Name | NT ID | AA ID | NT LN | AA LN | Score | P-value |
|---|---|---|---|---|---|---|
| 10970312_f2_182 | 259 | 7430 | 591 | 196 | 856 | 1.6e-85 |

Description sp:[LN:YCEF_ECOLI] [AC:P27244] [GN:YCEF] [OR:Escherichia coli] [DE:HYPOTHETICAL
23.2 KD PROTEIN IN RNE-RPMF INTERGENIC REGION (ORFY)] [SP:P27244] [DB:swissprot]
>sp:[LN:D64852] [AC:D64852] [PN:yceF protein] [GN:yceF] [CL:septum formation
protein maf] [OR:Escherichia coli] [DB:pir2] >gp:[GI:d1036881:g4062661]
[LN:D90744] [AC:D90744:AB001340] [PN:Hypothetical 23.2 kd protein in rne-rpmF]
[GN:yceF] [OR:Escherichia coli] [SR:Escherichia coli(strain:K12) DNA,
clone:Kohara clone #234] [DB:genpept-bct1] [DE:Escherichia coli genomic DNA.
(24.5 - 24.8 min).] [NT:ORF_ID:o235#5; similar to SwissProt Accession] [LE:12965]
[RE:13588] [DI:complement] >gp:[GI:g146051] [LN:ECOG30K] [AC:M96791] [GN:orfY]
[FN:Unknown] [OR:Escherichia coli] [SR:Escherichia coli (strain K-12) (library:
Kohara) DNA] [DB:genpept-bct1] [DE:Escherichia coli ORFX, (3' end), ORFY,
(complete cds), and g30kprotein (5' end) genes.] [LE:296] [RE:919]
[DI:complement] >gp:[GI:g1787328] [LN:AE000209] [AC:AE000209:U00096] [PN:orf,
hypothetical protein] [GN:yceF] [FN:orf; Unknown] [OR:Escherichia coli]
[DB:genpept-bct2] [DE:Escherichia coli K-12 MG1655 section 99 of 400 of the
completegenome.] [NT:f207; 100 pct identical to YCEF_ECOLI SW: P27244] [LE:7696]
[RE:8319] [DI:complement]

| ORF_Name | NT_ID | AA_ID | NT LN | AA LN | Score | P-value |
|---|---|---|---|---|---|---|
| 11209818_c1_627 | 260 | 7431 | 186 | 61 | 288 | 2.5e-25 |

Description sp:[LN:R5EC32] [AC:JV0048:A02832:A30419:F64852] [PN:ribosomal protein L32]
[GN:rpmF] [CL:Escherichia coli ribosomal protein L32] [OR:Escherichia coli]
[DB:pir1] [MP:24 min] >gp:[GI:d1036883:g1651531] [LN:D90744] [AC:D90744:AB001340]
[PN:Ribosomal protein L32.] [GN:rpmF] [OR:Escherichia coli] [SR:Escherichia
coli(strain:K12) DNA, clone:Kohara clone #234] [DB:genpept-bct1] [DE:Escherichia
coli genomic DNA. (24.5 - 24.8 min).] [NT:ORF_ID:o235#7; similar to PIR Accession
Number] [LE:14321] [RE:14494] [DI:direct] >gp:[GI:g147712] [LN:ECORPMFA]
[AC:M29698] [PN:ribosomal protein L32] [GN:rpmF] [OR:Escherichia coli] [SR:E.coli
DNA, clone pAY2-5] [DB:genpept-bct1] [DE:E.coli g30k protein and ribosomal
protein L32 (rpmF) genes,complete cds.] [LE:868] [RE:1041] [DI:direct]
>gp:[GI:g1787330] [LN:AE000209] [AC:AE000209:U00096] [PN:50S ribosomal subunit
protein L32] [GN:rpmF] [FN:structural component; Ribosomal proteins -]
[OR:Escherichia coli] [DB:genpept-bct2] [DE:Escherichia coli K-12 MG1655 section
99 of 400 of the completegenome.] [NT:o57; 100 pct identical to RL32_ECOLI SW:
P02435 but] [LE:9052] [RE:9225] [DI:direct] >gp:[GI:g3282800] [LN:AF044668]
[AC:AF044668] [PN:50S ribosomal protein L32] [GN:rpmF] [OR:Salmonella
typhimurium] [DB:genpept-bct2] [DE:Salmonella typhimurium (g30k) gene, partial
cds; and 50S ribosomalprotein L32 (rpmF), PlsX (plsX), 3-oxoacyl-acyl carrier
proteinsynthase III (fabH), malonyl CoA-acyl carrier protein transacylase(fabD),
and 3-oxoacyl-acyl carrier protein reductase (fabG) genes,complete cds.]
[NT:similar to Escherichia coli rpmF] [LE:196] [RE:369] [DI:direct]

| ORF_Name | NT_ID | AA_ID | NT LN | AA LN | Score | P-value |
|---|---|---|---|---|---|---|
| 1194006_c1_572 | 261 | 7432 | 702 | 233 | 365 | 1.7e-33 |

Description gp:[GI:g4928923] [LN:AF139107] [AC:AF139107] [PN:hypothetical transcriptional
activator] [GN:act] [OR:Pseudomonas aeruginosa] [DB:genpept-bct2] [DE:Pseudomonas
aeruginosa hypothetical multidrug resistance protein(mdr) gene, partial cds;
hypothetical transcriptional activator(act) and glutamyl-tRNA synthetase (gltX)
genes, complete cds; andtRNA-Ala and tRNA-Glu genes, complete sequence.] [LE:956]
[RE:1876] [DI:direct]

| ORF Name | NT ID | AA ID | NT/LN | AA/LN | Score | P-value |
|---|---|---|---|---|---|---|
| 1203413_c1_636 | 262 | 7433 | 324 | 107 | 299 | 1.7e-26 |

Description sp:[LN:YCFH_ECOLI] [AC:P37346:P78057] [GN:YCFH] [OR:Escherichia coli]
[DE:HYPOTHETICAL 29.8 KD PROTEIN IN HOLB-PTSG INTERGENIC REGION]
[SP:P37346:P78057] [DB:swissprot] >sp:[LN:A64854] [AC:A64854] [PN:probable
metal-dependent hydrolase, ycfH] [GN:ycfH] [CL:hypothetical protein HI0454]
[OR:Escherichia coli] [EC:3.-.-.-] [DB:pir2] >gp:[GI:d1036893:g4062666]
[LN:D90745] [AC:D90745:AB001340] [PN:Hypothetical protein in holB 3'region .]
[GN:ycfH] [OR:Escherichia coli] [SR:Escherichia coli(strain:K12) DNA,
clone:Kohara clone #236] [DB:genpept-bct1] [DE:Escherichia coli genomic DNA.
(24.8 - 25.2 min).] [NT:ORF_ID:o236#9; similar to SwissProt Accession] [LE:7419]
[RE:8216] [DI:direct] >gp:[GI:g1787342] [LN:AE000210] [AC:AE000210:U00096]
[PN:orf, hypothetical protein] [GN:ycfH] [FN:orf; Unknown] [OR:Escherichia coli]
[DB:genpept-bct2] [DE:Escherichia coli K-12 MG1655 section 100 of 400 of the
completegenome.] [NT:o265; 99 pct identical to fragment YCFH_ECOLI] [LE:8082]
[RE:8879] [DI:direct]

| ORF Name | NT ID | AA ID | NT/LN | AA/LN | Score | P-value |
|---|---|---|---|---|---|---|
| 1206562_f3_470 | 263 | 7434 | 336 | 111 | 502 | 5.3e-48 |

Description sp:[LN:H64837] [AC:H64837] [PN:probable sulfite reductase gamma chain] [GN:yccK]
[CL:sulfite reductase gamma chain] [OR:Escherichia coli] [DB:pir2]
>gp:[GI:g1787204] [LN:AE000199] [AC:AE000199:U00096] [PN:putative sulfite
reductase (EC 1.8.-.-)] [GN:yccK] [FN:orf; Not classified] [OR:Escherichia coli]
[DB:genpept-bct2] [DE:Escherichia coli K-12 MG1655 section 89 of 400 of the
completegenome.] [NT:f128; 100 pct identical to fragment YCCK_ECOLI] [LE:396]
[RE:782] [DI:complement]

| ORF_Name | NT_ID | AA_ID | NT LN | AA LN | Score | P-value |
|---|---|---|---|---|---|---|
| 12109530_f3_372 | 264 | 7435 | 1398 | 465 | 1758 | 4.3e-181 |

Description sp:[LN:YCEE_ECOLI] [AC:P25744] [GN:YCEE] [OR:Escherichia coli] [DE:HYPOTHETICAL
43.9 KD PROTEIN IN MSYB-HTRB INTERGENIC REGION (ORF1)] [SP:P25744] [DB:swissprot]
>sp:[LN:B42290] [AC:B42290:B64848] [PN:probable membrane protein b1053] [GN:yceE]
[CL:Escherichia coli probable integral membrane protein] [OR:Escherichia coli]
[DB:pir2] >gp:[GI:d1036837:g4062627] [LN:D90742] [AC:D90742:AB001340]
[PN:Probable integral membrane protein.] [GN:yceE] [OR:Escherichia coli]
[SR:Escherichia coli(strain:K12) DNA, clone:Kohara clone #232] [DB:genpept-bct1]
[DE:Escherichia coli genomic DNA. (23.8 - 24.2 min).] [NT:ORF_ID:o233#2; similar
to PIR Accession Number] [LE:10884] [RE:12110] [DI:complement]
>gp:[GI:d1036848:g4062636] [LN:D90743] [AC:D90743:AB001340] [PN:Probable integral
membrane protein.] [GN:yceE] [OR:Escherichia coli] [SR:Escherichia
coli(strain:K12) DNA, clone:Kohara clone #233] [DB:genpept-bct1] [DE:Escherichia
coli genomic DNA. (24.1 - 24.5 min).] [NT:ORF_ID:o233#2; similar to PIR Accession
Number] [LE:630] [RE:1856] [DI:complement] >gp:[GI:g42029] [LN:ECMSYB]
[AC:X59939:S83617] [GN:ORF1] [OR:Escherichia coli] [DB:genpept-bct1] [DE:E.coli
ORF1 and msyB gene for membrane protein and multicopysuppressor of secY24
mutation protein.] [SP:P25744] [LE:496] [RE:1722] [DI:direct] >gp:[GI:g1787291]
[LN:AE000206] [AC:AE000206:U00096] [PN:putative transport protein] [GN:yceE]
[FN:putative transport; Not classified] [OR:Escherichia coli] [DB:genpept-bct2]
[DE:Escherichia coli K-12 MG1655 section 96 of 400 of the completegenome.]
[NT:f408; 100 pct identical to YCEE_ECOLI SW: P25744] [LE:8522] [RE:9748]
[DI:complement]

| ORF_Name | NT_ID | AA_ID | NT LN | AA LN | Score | P-value |
|---|---|---|---|---|---|---|
| 12136550_f2_259 | 265 | 7436 | 438 | 145 | 166 | 2.1e-12 |

Description sp:[LN:YUR5_RHIME] [AC:P42879] [OR:Rhizobium meliloti] [DE:HYPOTHETICAL 15.0 KD
PROTEIN IN UREB-UREC INTERGENIC REGION (ORF5)] [SP:P42879] [DB:swissprot]
>sp:[LN:S42605] [AC:S42605] [PN:hypothetical protein 5] [OR:Rhizobium meliloti]
[DB:pir2] >gp:[GI:g545800] [LN:S69145] [AC:S69145] [GN:orf5 3' of ureB]
[OR:Sinorhizobium meliloti] [SR:Sinorhizobium meliloti AK631] [DB:genpept-bct1]
[DE:ureA=UreA...ureC=UreC [Rhizobium meliloti, AK631, Genomic, 7 genes,4617 nt].]
[NT:This sequence comes from Fig. 2.] [LE:1247] [RE:1666] [DI:direct]

| ORF Name | NT ID | AA ID | NT/LN | AA/LN | Score | P-value |
|---|---|---|---|---|---|---|
| 12369760_c3_922 | 266 | 7437 | 534 | 177 | 828 | 1.5e-82 |

Description sp:[LN:YCED_ECOLI] [AC:P14189] [GN:YCED:G30K] [OR:Escherichia coli]
[DE:HYPOTHETICAL 19.3 KD PROTEIN IN RNE-RPMF INTERGENIC REGION (G30K)]
[SP:P14189] [DB:swissprot] >sp:[LN:JV0047] [AC:JV0047:E64852] [PN:probable
membrane protein yceD] [GN:yceD] [OR:Escherichia coli] [DB:pir2] [MP:23 min]
>gp:[GI:d1036882:g4062662] [LN:D90744] [AC:D90744:AB001340] [PN:Hypothetical 19.3
kd protein in rne-rpmF] [GN:g30K] [OR:Escherichia coli] [SR:Escherichia
coli(strain:K12) DNA, clone:Kohara clone #234] [DB:genpept-bct1] [DE:Escherichia
coli genomic DNA. (24.5 - 24.8 min).] [NT:ORF_ID:o235#6; similar to SwissProt
Accession] [LE:13748] [RE:14269] [DI:direct] >gp:[GI:g147711] [LN:ECORPMFA]
[AC:M29698] [OR:Escherichia coli] [SR:E.coli DNA, clone pAY2-5] [DB:genpept-bct1]
[DE:E.coli g30k protein and ribosomal protein L32 (rpmF) genes,complete cds.]
[NT:g30k protein] [LE:295] [RE:816] [DI:direct] >gp:[GI:g1787329] [LN:AE000209]
[AC:AE000209:U00096] [PN:orf, hypothetical protein] [GN:yceD] [FN:orf; Unknown]
[OR:Escherichia coli] [DB:genpept-bct2] [DE:Escherichia coli K-12 MG1655 section
99 of 400 of the completegenome.] [NT:o173; 100 pct identical to YCED_ECOLI SW:
P14189] [LE:8479] [RE:9000] [DI:direct]

| ORF Name | NT ID | AA ID | NT/LN | AA/LN | Score | P-value |
|---|---|---|---|---|---|---|
| 12380187_f2_200 | 267 | 7438 | 324 | 107 | 337 | 1.6e-30 |

Description gp:[GI:d1036844:g4062634] [LN:D90742] [AC:D90742:AB001340] [OR:Escherichia coli]
[SR:Escherichia coli(strain:K12) DNA, clone:Kohara clone #232] [DB:genpept-bct1]
[DE:Escherichia coli genomic DNA. (23.8 - 24.2 min).] [NT:ORF_ID:o233#9]
[LE:17862] [RE:18239] [DI:complement] >gp:[GI:d1036855:g4062642] [LN:D90743]
[AC:D90743:AB001340] [OR:Escherichia coli] [SR:Escherichia coli(strain:K12) DNA,
clone:Kohara clone #233] [DB:genpept-bct1] [DE:Escherichia coli genomic DNA.
(24.1 - 24.5 min).] [NT:ORF_ID:o233#9] [LE:7608] [RE:7985] [DI:complement]

| ORF Name | NT ID | AA ID | NT/LN | AA/LN | Score | P-value |
|---|---|---|---|---|---|---|
| 12944503_f2_254 | 268 | 7439 | 405 | 134 | 137 | 5.4e-08 |

Description sp:[LN:B70694] [AC:B70694] [PN:probable infB] [GN:infB] [CL:translation
elongation factor Tu homology] [OR:Mycobacterium tuberculosis] [DB:pir2]
>gp:[GI:e276776:g1648881] [LN:MTCY16B7] [AC:Z81331:AL123456] [PN:infB] [GN:infB]
[OR:Mycobacterium tuberculosis] [DB:genpept-bct1] [DE:Mycobacterium tuberculosis
H37Rv complete genome; segment 123/162.] [NT:Rv2839c, (MTCY16B7.03), len: 900.
Probable infB,] [LE:40248] [RE:42950] [DI:complement]

| ORF Name | NT ID | AA ID | NT/LN | AA/LN | Score | P-value |
|---|---|---|---|---|---|---|
| 12994087_c3_838 | 269 | 7440 | 471 | 156 | 212 | 2.9e-17 |

Description gp:[GI:g642965] [LN:ABCARRA] [AC:X70360] [GN:carR] [OR:Azospirillum brasilense]
[DB:genpept-bct1] [DE:A.brasilense carR gene.] [NT:ORF2] [LE:59] [RE:580]
[DI:direct]

| ORF Name | NT ID | AA ID | NT/LN | AA/LN | Score | P-value |
|---|---|---|---|---|---|---|
| 13010887_c2_733 | 270 | 7441 | 990 | 329 | 1268 | 3.6e-129 |

Description sp:[LN:YCDW_ECOLI] [AC:P75913] [GN:YCDW] [OR:Escherichia coli] [DE:PUTATIVE
2-HYDROXYACID DEHYDROGENASE IN PHOH-CSGG INTERGENIC REGION] [SP:P75913]
[DB:swissprot] >sp:[LN:F64845] [AC:F64845] [PN:probable 2-hydroxyacid
dehydrogenase ycdW] [GN:ycdW] [OR:Escherichia coli] [DB:pir2] >gp:[GI:g1787270]
[LN:AE000205] [AC:AE000205:U00096] [PN:putative dehydrogenase] [GN:ycdW]
[FN:putative enzyme; Not classified] [OR:Escherichia coli] [DB:genpept-bct2]
[DE:Escherichia coli K-12 MG1655 section 95 of 400 of the completegenome.]
[NT:o325; This 325 aa ORF is 32 pct identical (2 gaps)] [LE:2393] [RE:3370]
[DI:direct]

| ORF Name | NT ID | AA ID | NT/LN | AA/LN | Score | P-value |
|---|---|---|---|---|---|---|
| 13129682_f3_446 | 271 | 7442 | 1056 | 351 | 1105 | 6.7e-112 |

Description gp:[GI:g396299] [LN:ECOUW89] [AC:U00006] [OR:Escherichia coli] [SR:Escherichia
coli (sub_strain MG1655, strain K-12) (library: lambda] [DB:genpept-bct2] [DE:E.
coli chromosomal region from 89.2 to 92.8 minutes.] [NT:similar to E. coli
pyruvate formate-lyase] [LE:11430] [RE:12377] [DI:direct]

| ORF Name | NT ID | AA ID | NT/LN | AA/LN | Score | P-value |
|---|---|---|---|---|---|---|
| 13130058_c3_925 | 272 | 7443 | 771 | 256 | 1146 | 3.0e-116 |

Description sp:[LN:FABD_ECOLI] [AC:P25715] [GN:FABD:TFPA] [OR:Escherichia coli] [EC:2.3.1.39]
[DE:MALONYL COA-ACYL CARRIER PROTEIN TRANSACYLASE, (MCT)] [SP:P25715]
[DB:swissprot]

| ORF Name | NT ID | AA ID | NT/LN | AA/LN | Score | P-value |
|---|---|---|---|---|---|---|
| 1359561_c3_788 | 273 | 7444 | 636 | 211 | 503 | 4.2e-48 |

Description sp:[LN:YCCR_ECOLI] [AC:P75869] [GN:YCCR] [OR:Escherichia coli] [DE:HYPOTHETICAL 24.1 KD PROTEIN IN SULA-HELD INTERGENIC REGION] [SP:P75869] [DB:swissprot] >sp:[LN:F64836] [AC:F64836] [PN:probable membrane protein b0959] [OR:Escherichia coli] [DB:pir2] >gp:[GI:d1036703:g4062523] [LN:D90733] [AC:D90733:AB001340] [OR:Escherichia coli] [SR:Escherichia coli(strain:K12) DNA, clone:Kohara clone #222] [DB:genpept-bct1] [DE:Escherichia coli genomic DNA. (21.7 - 22.1 min).] [NT:ORF_ID:o223#4] [LE:14490] [RE:15119] [DI:direct] >gp:[GI:d1036710:g4062527] [LN:D90734] [AC:D90734:AB001340] [OR:Escherichia coli] [SR:Escherichia coli(strain:K12) DNA, clone:Kohara clone #223] [DB:genpept-bct1] [DE:Escherichia coli genomic DNA. (22.0 - 22.3 min).] [NT:ORF_ID:o223#4] [LE:2661] [RE:3290] [DI:direct] >gp:[GI:g1787193] [LN:AE000198] [AC:AE000198:U00096] [PN:orf, hypothetical protein] [GN:b0959] [FN:orf; Unknown] [OR:Escherichia coli] [DB:genpept-bct2] [DE:Escherichia coli K-12 MG1655 section 88 of 400 of the completegenome.] [NT:o209; This 209 aa ORF is 31 pct identical (8 gaps)] [LE:2776] [RE:3405] [DI:direct]

| ORF Name | NT ID | AA ID | NT/LN | AA/LN | Score | P-value |
|---|---|---|---|---|---|---|
| 13673285_f1_86 | 274 | 7445 | 645 | 214 | 794 | 6.1e-79 |

Description sp:[LN:F64842] [AC:F64842] [PN:hypothetical protein b1008] [OR:Escherichia coli] [DB:pir2] >gp:[GI:d1036761:g4062562] [LN:D90737] [AC:D90737:AB001340] [OR:Escherichia coli] [SR:Escherichia coli(strain:K12) DNA, clone:Kohara clone #227] [DB:genpept-bct1] [DE:Escherichia coli genomic DNA. (22.8 - 23.1 min).] [NT:ORF_ID:o228#6] [LE:15862] [RE:16452] [DI:complement] >gp:[GI:d1036771:g4062571] [LN:D90738] [AC:D90738:AB001340] [OR:Escherichia coli] [SR:Escherichia coli(strain:K12) DNA, clone:Kohara clone #228] [DB:genpept-bct1] [DE:Escherichia coli genomic DNA. (23.0 - 23.4 min).] [NT:ORF_ID:o228#6] [LE:4326] [RE:4916] [DI:complement] >gp:[GI:g1787243] [LN:AE000202] [AC:AE000202:U00096] [PN:putative enzyme] [GN:b1008] [FN:putative enzyme; Not classified] [OR:Escherichia coli] [DB:genpept-bct2] [DE:Escherichia coli K-12 MG1655 section 92 of 400 of the completegenome.] [NT:f196; This 196 aa ORF is 26 pct identical (25 gaps)] [LE:7921] [RE:8511] [DI:complement]

| ORF Name | NT ID | AA ID | NT/LN | AA/LN | Score | P-value |
|---|---|---|---|---|---|---|
| 13676966_c2_717 | 275 | 7446 | 858 | 285 | 1257 | 5.2e-128 |

Description sp:[LN:YCDN_ECOLI] [AC:P75901:P75900] [GN:YCDN] [OR:Escherichia coli] [DE:HYPOTHETICAL 30.3 KD PROTEIN IN PUTP-PHOH INTERGENIC REGION] [SP:P75901:P75900] [DB:swissprot]

| ORF Name | NT ID | AA ID | NT/LN | AA/LN | Score | P-value |
|---|---|---|---|---|---|---|
| 13785406_c2_764 | 276 | 7447 | 204 | 67 | 115 | 5.7e-07 |

Description gp:[GI:g5732924] [LN:AF167709] [AC:AF167709] [PN:excretory/secretory mucin MUC-4] [GN:muc-4] [OR:Toxocara canis] [DB:genpept-inv2] [DE:Toxocara canis excretory/secretory mucin MUC-4 (muc-4) mRNA,complete cds.] [NT:putative TES-120 surface coat mucin family member] [LE:14] [RE:589] [DI:direct]

| ORF Name | NT ID | AA ID | NT/LN | AA/LN | Score | P-value |
|---|---|---|---|---|---|---|
| 1379702_c1_584 | 277 | 7448 | 555 | 184 | 811 | 9.6e-81 |

Description sp:[LN:YCDY_ECOLI] [AC:P75915] [GN:YCDY] [OR:Escherichia coli] [DE:HYPOTHETICAL 20.7 KD PROTEIN IN PHOH-CSGG INTERGENIC REGION] [SP:P75915] [DB:swissprot] >sp:[LN:H64845] [AC:H64845] [PN:ycdY protein] [GN:ycdY] [CL:Escherichia coli ycdY protein] [OR:Escherichia coli] [DB:pir1] >gp:[GI:d1036802:g4062599] [LN:D90740] [AC:D90740:AB001340] [PN:Hypothetical protein HI1543] [OR:Escherichia coli] [SR:Escherichia coli(strain:K12) DNA, clone:Kohara clone #230] [DB:genpept-bct1] [DE:Escherichia coli genomic DNA. (23.5 - 23.8 min).] [NT:ORF_ID:o231#3; similar to PIR Accession Number] [LE:9705] [RE:10259] [DI:direct] >gp:[GI:d1036811:g4062608] [LN:D90741] [AC:D90741:AB001340] [PN:Hypothetical protein HI1543] [OR:Escherichia coli] [SR:Escherichia coli(strain:K12) DNA, clone:Kohara clone #231] [DB:genpept-bct1] [DE:Escherichia coli genomic DNA. (23.7 - 24.0 min).] [NT:ORF_ID:o231#3; similar to PIR Accession Number] [LE:2906] [RE:3460] [DI:direct] >gp:[GI:g1787272] [LN:AE000205] [AC:AE000205:U00096] [PN:putative oxidoreductase component] [GN:ycdY] [FN:putative enzyme; Not classified] [OR:Escherichia coli] [DB:genpept-bct2] [DE:Escherichia coli K-12 MG1655 section 95 of 400 of the completegenome.] [NT:o184; This 184 aa ORF is 40 pct identical (12 gaps)] [LE:4186] [RE:4740] [DI:direct]

| ORF Name | NT ID | AA ID | NT/LN | AA/LN | Score | P-value |
|---|---|---|---|---|---|---|
| 13836557_f2_290 | 278 | 7449 | 2382 | 793 | 3414 | 0.0 |

Description sp:[LN:PFLD_ECOLI] [AC:P32674] [GN:PFLD] [OR:Escherichia coli] [EC:2.3.1.54] [DE:FORMATE ACETYLTRANSFERASE 2, (PYRUVATE FORMATE-LYASE 2)] [SP:P32674] [DB:swissprot] >sp:[LN:B65202] [AC:B65202] [PN:formate C-acetyltransferase, 2:pyruvate formate-lyase II] [GN:pflD] [CL:formate C-acetyltransferase 2:glycyl radical homology] [OR:Escherichia coli] [EC:2.3.1.54] [DB:pir1] [MP:89.3] >gp:[GI:g1790388] [LN:AE000469] [AC:AE000469:U00096] [PN:formate acetyltransferase 2] [GN:pflD] [FN:enzyme; Energy metabolism, carbon: Anaerobic] [OR:Escherichia coli] [DB:genpept-bct2] [EC:2.3.1.54] [DE:Escherichia coli K-12 MG1655 section 359 of 400 of the completegenome.] [NT:o765; 100 pct identical amino acid sequence and] [LE:1763] [RE:4060] [DI:direct] >gp:[GI:g396298] [LN:ECOUW89] [AC:U00006] [OR:Escherichia coli] [SR:Escherichia coli (sub_strain MG1655, strain K-12) (library: lambda] [DB:genpept-bct2] [DE:E. coli chromosomal region from 89.2 to 92.8 minutes.] [NT:similar to E. coli pyruvate formate-lyase] [LE:9236] [RE:11533] [DI:direct]

| ORF Name | NT ID | AA ID | NT LN | AA LN | Score | P-value |
|---|---|---|---|---|---|---|
| 14065643_c1_623 | 279 | 7450 | 1473 | 490 | | |

Description

NO-HIT

| ORF Name | NT ID | AA ID | NT LN | AA LN | Score | P-value |
|---|---|---|---|---|---|---|
| 14117061_f3_484 | 280 | 7451 | 1158 | 385 | 1873 | 2.8e-193 |

Description sp:[LN:JC6558] [AC:JC6558] [PN:outer membrane protein A precursor] [GN:ompA] [CL:outer membrane protein A] [OR:Klebsiella pneumoniae] [DB:pir2]

| ORF Name | NT ID | AA ID | NT LN | AA LN | Score | P-value |
|---|---|---|---|---|---|---|
| 14190882_c2_759 | 281 | 7452 | 1602 | 533 | 2423 | 1.4e-251 |

Description sp:[LN:MVIN_SALTY] [AC:P37169] [GN:MVIN] [OR:Salmonella typhimurium] [DE:VIRULENCE FACTOR MVIN] [SP:P37169] [DB:swissprot] >sp:[LN:S40271] [AC:S40271] [PN:virulence factor mviN] [GN:mviN] [CL:mviN protein] [OR:Salmonella typhimurium] [DB:pir1] >gp:[GI:g438252] [LN:STMVIMN] [AC:Z26133] [GN:mviB] [OR:Salmonella typhimurium] [DB:genpept-bct1] [DE:S.typhimurium mviB gene and ORF34.] [SP:P37169] [LE:1462] [RE:3036] [DI:direct] >gp:[GI:d1005521:g505363] [LN:STYFLGA] [AC:D25292] [PN:ORF2] [GN:orf2] [OR:Salmonella typhimurium] [SR:Salmonella typhimurium (strain:LT2) DNA] [DB:genpept-bct1] [DE:Salmonella typhimurium flg (A,B,M,N) and orf (2,3) genes forflagella.] [LE:1907] [RE:3481] [DI:complement]

| ORF Name | NT ID | AA ID | NT LN | AA LN | Score | P-value |
|---|---|---|---|---|---|---|
| 14220265_f3_455 | 282 | 7453 | 414 | 137 | 124 | 2.3e-07 |

Description gp:[GI:g805006] [LN:PPHP1G] [AC:X80272] [GN:pprB] [OR:Pseudomonas putida] [DB:genpept-bct1] [DE:P.putida pprB gene.] [LE:77] [RE:973] [DI:direct]

| ORF Name | NT ID | AA ID | NT LN | AA LN | Score | P-value |
|---|---|---|---|---|---|---|
| 14457637_f2_273 | 283 | 7454 | 315 | 104 | | |

Description

NO-HIT

| ORF Name | NT ID | AA ID | NT LN | AA LN | Score | P-value |
|---|---|---|---|---|---|---|
| 1464087_c1_505 | 284 | 7455 | 204 | 67 | | |

Description

NO-HIT

| ORF Name | NT ID | AA ID | NT LN | AA LN | Score | P-value |
|---|---|---|---|---|---|---|
| 14652212_c3_926 | 285 | 7456 | 318 | 105 | 476 | 3.0e-45 |

Description gp:[GI:g3282804] [LN:AF044668] [AC:AF044668] [PN:3-oxoacyl-acyl carrier protein reductase] [GN:fabG] [OR:Salmonella typhimurium] [DB:genpept-bct2] [DE:Salmonella typhimurium (g30k) gene, partial cds; and 50S ribosomalprotein L32 (rpmF), PlsX (plsX), 3-oxoacyl-acyl carrier proteinsynthase III (fabH), malonyl CoA-acyl carrier protein transacylase(fabD), and 3-oxoacyl-acyl carrier protein reductase (fabG) genes,complete cds.] [NT:similar to Escherichia coli fabG] [LE:3573] [RE:4307] [DI:direct]

| ORF Name | NT ID | AA ID | NT LN | AA LN | Score | P-value |
|---|---|---|---|---|---|---|
| 14665902_c2_689 | 286 | 7457 | 699 | 232 | 1045 | 1.5e-105 |

Description sp:[LN:YCJK_ECOLI] [AC:P78061] [GN:YCJK] [OR:Escherichia coli] [EC:6.3.1.2] [DE:LIGASE)] [SP:P78061] [DB:swissprot] >sp:[LN:D64878] [AC:D64878] [PN:probable glutamate--ammonia ligase,:probable glutamine synthetase] [OR:Escherichia coli] [EC:6.3.1.2] [DB:pir2] >gp:[GI:g1787555] [LN:AE000228] [AC:AE000228:U00096] [PN:putative glutamine synthetase (EC 6.3.1.2)] [GN:b1297] [FN:putative enzyme; Not classified] [OR:Escherichia coli] [DB:genpept-bct2] [DE:Escherichia coli K-12 MG1655 section 118 of 400 of the completegenome.] [NT:f498; This 498 aa ORF is 31 pct identical (29 gaps)] [LE:155] [RE:1651] [DI:complement]

| ORF Name | NT ID | AA ID | NT LN | AA LN | Score | P-value |
|---|---|---|---|---|---|---|
| 14667336_c1_496 | 287 | 7458 | 426 | 141 | 668 | 1.4e-65 |

Description sp:[LN:D64837] [AC:D64837] [PN:hypothetical protein b0965] [CL:hypothetical protein yneT] [OR:Escherichia coli] [DB:pir1] >gp:[GI:g1787199] [LN:AE000198] [AC:AE000198:U00096] [PN:orf, hypothetical protein] [GN:b0965] [FN:orf; Unknown] [OR:Escherichia coli] [DB:genpept-bct2] [DE:Escherichia coli K-12 MG1655 section 88 of 400 of the completegenome.] [NT:o164; This 164 aa ORF is 27 pct identical (5 gaps)] [LE:9503] [RE:9997] [DI:direct]

| ORF Name | NT ID | AA ID | NT LN | AA LN | Score | P-value |
|---|---|---|---|---|---|---|
| 14728562_f2_282 | 288 | 7459 | 1101 | 366 | 1729 | 5.0e-178 |

Description sp:[LN:TTUC_ECOLI] [AC:P76251:O08475:O08474] [GN:YEAU] [OR:Escherichia coli]
[EC:1.1.1.93] [DE:PROBABLE TARTRATE DEHYDROGENASE, (TDH)]
[SP:P76251:O08475:O08474] [DB:swissprot] >sp:[LN:H64940] [AC:H64940] [PN:tartrate
dehydrogenase,] [CL:3-isopropylmalate dehydrogenase] [OR:Escherichia coli]
[EC:1.1.1.93] [DB:pir2] >gp:[GI:d1016319:g1736423] [LN:D90823]
[AC:D90823:AB001340] [PN:3-isopropylmalate dehydrogenase (EC 1.1.1.85)]
[OR:Escherichia coli] [SR:Escherichia coli (strain:K12) DNA, clone_lib:Kohara
lambda minise] [DB:genpept-bct1] [DE:E.coli genomic DNA, Kohara clone
332(40.4-40.7 min.).] [NT:ORF_ID:o332#8; similar to [SwissProt Accession]
[LE:8108] [RE:9193] [DI:direct] >gp:[GI:d1016328:g1736433] [LN:D90824]
[AC:D90824:AB001340] [PN:3-isopropylmalate dehydrogenase (EC 1.1.1.85)]
[OR:Escherichia coli] [SR:Escherichia coli (strain:K12) DNA, clone_lib:Kohara
lambda minise] [DB:genpept-bct1] [DE:E.coli genomic DNA, Kohara clone
333(40.5-40.8 min.).] [NT:ORF_ID:o332#8; similar to [SwissProt Accession]
[LE:3578] [RE:4663] [DI:direct] >gp:[GI:g1788101] [LN:AE000274]
[AC:AE000274:U00096] [PN:putative tartrate dehydrogenase] [GN:yeaU] [FN:putative
enzyme; Not classified] [OR:Escherichia coli] [DB:genpept-bct2] [DE:Escherichia
coli K-12 MG1655 section 164 of 400 of the completegenome.] [NT:o361; This 361 aa
ORF is 40 pct identical (17 gaps)] [LE:7651] [RE:8736] [DI:direct]

| ORF Name | NT ID | AA ID | NT LN | AA LN | Score | P-value |
|---|---|---|---|---|---|---|
| 14862510_c1_563 | 289 | 7460 | 471 | 156 | | |

Description

NO-HIT

| ORF Name | NT ID | AA ID | NT LN | AA LN | Score | P-value |
|---|---|---|---|---|---|---|
| 14939756_c2_655 | 290 | 7461 | 1332 | 443 | 1199 | 7.3e-122 |

Description sp:[LN:OPPA_SALTY] [AC:P06202] [GN:OPPA] [OR:Salmonella typhimurium]
[DE:PERIPLASMIC OLIGOPEPTIDE-BINDING PROTEIN PRECURSOR] [SP:P06202]
[DB:swissprot] >sp:[LN:QREBOA] [AC:A25011] [PN:oligopeptide-binding protein
precursor] [GN:oppA] [CL:dipeptide transport protein] [OR:Salmonella typhimurium]
[DB:pir1] [MP:34 min] >gp:[GI:g47802] [LN:STOPPAF] [AC:X05491] [OR:Salmonella
typhimurium] [DB:genpept-bct1] [DE:Salmonella typhimurium opp operon for
oligopeptide permeaseoppA-oppF.] [NT:Opp A (AA1-542)] [SP:P06202] [LE:150]
[RE:1778] [DI:direct] >gp:[GI:g47808] [LN:STOPPAG] [AC:X04194] [OR:Salmonella
typhimurium] [DB:genpept-bct1] [DE:Salmonella typhimurium OppA gene for
periplasmic component ofoligopeptide permease.] [NT:precursor polypeptide]
[SP:P06202] [LE:1] [RE:1629] [DI:direct]

| ORF Name | NT ID | AA ID | NT/LN | AA/LN | Score | P-value |
|---|---|---|---|---|---|---|
| 15097706_f2_318 | 291 | 7462 | 528 | 175 | 687 | 1.3e-67 |

Description sp:[LN:YCCF_ECOLI] [AC:P37065:P75871] [GN:YCCF] [OR:Escherichia coli]
[DE:HYPOTHETICAL 16.3 KD PROTEIN IN SULA-HELD INTERGENIC REGION]
[SP:P37065:P75871] [DB:swissprot] >sp:[LN:H64836] [AC:H64836] [PN:probable
membrane protein yccF] [GN:yccF] [OR:Escherichia coli] [DB:pir2]
>gp:[GI:d1036705:g4062525] [LN:D90733] [AC:D90733:AB001340] [PN:Hypothetical
protein in held 5'region .] [GN:yccF] [OR:Escherichia coli] [SR:Escherichia
coli(strain:K12) DNA, clone:Kohara clone #222] [DB:genpept-bct1] [DE:Escherichia
coli genomic DNA. (21.7 - 22.1 min).] [NT:ORF_ID:o223#6; similar to SwissProt
Accession] [LE:17254] [RE:17700] [DI:complement] >gp:[GI:d1036712:g4062529]
[LN:D90734] [AC:D90734:AB001340] [PN:Hypothetical protein in held 5'region .]
[GN:yccF] [OR:Escherichia coli] [SR:Escherichia coli(strain:K12) DNA,
clone:Kohara clone #223] [DB:genpept-bct1] [DE:Escherichia coli genomic DNA.
(22.0 - 22.3 min).] [NT:ORF_ID:o223#6; similar to SwissProt Accession] [LE:5425]
[RE:5871] [DI:complement] >gp:[GI:g1787195] [LN:AE000198] [AC:AE000198:U00096]
[PN:orf, hypothetical protein] [GN:yccF] [FN:orf; Unknown] [OR:Escherichia coli]
[DB:genpept-bct2] [DE:Escherichia coli K-12 MG1655 section 88 of 400 of the
completegenome.] [NT:f148; 100 pct to fragment YCCF_ECOLI SW: P37065] [LE:5540]
[RE:5986] [DI:complement]

| ORF Name | NT ID | AA ID | NT/LN | AA/LN | Score | P-value |
|---|---|---|---|---|---|---|
| 15134787_c2_758 | 292 | 7463 | 927 | 308 | 1238 | 5.4e-126 |

Description gp:[GI:d1005522:g984656] [LN:STYFLGA] [AC:D25292] [PN:ORF3] [GN:orf3]
[OR:Salmonella typhimurium] [SR:Salmonella typhimurium (strain:LT2) DNA]
[DB:genpept-bct1] [DE:Salmonella typhimurium flg (A,B,M,N) and orf (2,3) genes
forflagella.] [LE:3746] [RE:4669] [DI:complement]

| ORF Name | NT ID | AA ID | NT/LN | AA/LN | Score | P-value |
|---|---|---|---|---|---|---|
| 16250056_c1_514 | 293 | 7464 | 957 | 318 | 242 | 1.9e-20 |

Description gp:[GI:g4895124] [LN:AF127374] [AC:AF127374] [PN:MmcH] [GN:mmcH] [OR:Streptomyces
lavendulae] [DB:genpept-bct2] [DE:Streptomyces lavendulae LinA homolog,
cytochrome P450 hydroxylaseORF4, cytochrome P450 hydroxylase ORF3, MitT (mitT),
MitS (mitS),MitR (mitR), MitQ (mitQ), MitP (mitP), MitO (mitO), MitN (mitN),MitM
(mitM), MitL (mitL), MitK (mitK), MitJ (mitJ), MitI (mitI),MitH (mitH), MitG
(mitG), MitF (mitF), MitE (mitE), MitD (mitD),MitC (mitC), MitB (mitB), MitA
(mitA), MmcA (mmcA), MmcB (mmcB),MmcC (mmcC), MmcD (mmcD), MmcE (mmcE), MmcF
(mmcF), MmcG (mmcG),MmcH (mmcH), MmcI (mmcI), MmcJ (mmcJ), MmcK (mmcK), MmcL
(mmcL),MmcM (mmcM), MmcN (mmcN), MmcO (mmcO), Mrd (mrd), MmcP (mmcP), MmcQ(mmcQ),
MmcR (mmcR), MmcS (mmcS), MmcT (mmcT), MmcU (mmcU), MmcV(mmcV), Mct (mct), MmcW
(mmcW), MmcX (mmcX), and MmcY (mmcY) genes,complete cds; and unknown genes.]
[LE:36350] [RE:37114] [DI:complement]

| ORF Name | NT ID | AA ID | NT LN | AA LN | Score | P-value |
|---|---|---|---|---|---|---|
| 16257667_f1_154 | 294 | 7465 | 2181 | 726 | 3065 | 0.0 |

Description sp:[LN:YCCS_ECOLI] [AC:P75870] [GN:YCCS] [OR:Escherichia coli] [DE:HYPOTHETICAL 82.0 KD PROTEIN IN SULA-HELD INTERGENIC REGION] [SP:P75870] [DB:swissprot] >sp:[LN:G64836] [AC:G64836] [PN:probable membrane protein yccS] [GN:yccS] [CL:hypothetical protein HI1680] [OR:Escherichia coli] [DB:pir1] >gp:[GI:d1036704:g4062524] [LN:D90733] [AC:D90733:AB001340] [PN:Hypothetical protein HI1680] [OR:Escherichia coli] [SR:Escherichia coli(strain:K12) DNA, clone:Kohara clone #222] [DB:genpept-bct1] [DE:Escherichia coli genomic DNA. (21.7 - 22.1 min).] [NT:ORF_ID:o223#5; similar to PIR Accession Number] [LE:15082] [RE:17244] [DI:complement] >gp:[GI:d1036711:g4062528] [LN:D90734] [AC:D90734:AB001340] [PN:Hypothetical protein HI1680] [OR:Escherichia coli] [SR:Escherichia coli(strain:K12) DNA, clone:Kohara clone #223] [DB:genpept-bct1] [DE:Escherichia coli genomic DNA. (22.0 - 22.3 min).] [NT:ORF_ID:o223#5; similar to PIR Accession Number] [LE:3253] [RE:5415] [DI:complement] >gp:[GI:g1787194] [LN:AE000198] [AC:AE000198:U00096] [PN:orf, hypothetical protein] [GN:b0960] [FN:orf; Unknown] [OR:Escherichia coli] [DB:genpept-bct2] [DE:Escherichia coli K-12 MG1655 section 88 of 400 of the completegenome.] [NT:f720; This 720 aa ORF is 38 pct identical (20 gaps)] [LE:3368] [RE:5530] [DI:complement]

| ORF Name | NT ID | AA ID | NT LN | AA LN | Score | P-value |
|---|---|---|---|---|---|---|
| 16316_c1_502 | 295 | 7466 | 414 | 137 | 121 | 1.4e-06 |

Description sp:[LN:OPPA_SALTY] [AC:P06202] [GN:OPPA] [OR:Salmonella typhimurium] [DE:PERIPLASMIC OLIGOPEPTIDE-BINDING PROTEIN PRECURSOR] [SP:P06202] [DB:swissprot] >sp:[LN:QREBOA] [AC:A25011] [PN:oligopeptide-binding protein precursor] [GN:oppA] [CL:dipeptide transport protein] [OR:Salmonella typhimurium] [DB:pir1] [MP:34 min] >gp:[GI:g47802] [LN:STOPPAF] [AC:X05491] [OR:Salmonella typhimurium] [DB:genpept-bct1] [DE:Salmonella typhimurium opp operon for oligopeptide permeaseoppA-oppF.] [NT:Opp A (AA1-542)] [SP:P06202] [LE:150] [RE:1778] [DI:direct] >gp:[GI:g47808] [LN:STOPPAG] [AC:X04194] [OR:Salmonella typhimurium] [DB:genpept-bct1] [DE:Salmonella typhimurium OppA gene for periplasmic component ofoligopeptide permease.] [NT:precursor polypeptide] [SP:P06202] [LE:1] [RE:1629] [DI:direct]

| ORF Name | NT ID | AA ID | NT LN | AA LN | Score | P-value |
|---|---|---|---|---|---|---|
| 16489041_c3_931 | 296 | 7467 | 1080 | 359 | 1245 | 9.8e-127 |

Description sp:[LN:HOLB_ECOLI] [AC:P28631] [GN:HOLB] [OR:Escherichia coli] [EC:2.7.7.7]
[DE:DNA POLYMERASE III, DELTA' SUBUNIT,] [SP:P28631] [DB:swissprot]
>sp:[LN:S35523] [AC:S35523:S36926:B46738:A47123:H64853] [PN:DNA-directed DNA
polymerase, III delta' chain] [GN:holB] [CL:DNA-directed DNA polymerase III
delta' chain] [OR:Escherichia coli] [EC:2.7.7.7] [DB:pir2] [MP:24 min]
>gp:[GI:d1036892:g1651540] [LN:D90745] [AC:D90745:AB001340] [PN:DNA-directed dna
polymerase (EC 2.7.7.7) III] [GN:holB] [OR:Escherichia coli] [SR:Escherichia
coli(strain:K12) DNA, clone:Kohara clone #236] [DB:genpept-bct1] [DE:Escherichia
coli genomic DNA. (24.8 - 25.2 min).] [NT:ORF_ID:o236#8; similar to PIR Accession
Number] [LE:6404] [RE:7408] [DI:direct] >gp:[GI:g145783] [LN:ECODNAPDPS]
[AC:L01483] [PN:DNA polymerase III delta prime subunit] [GN:holB] [FN:accessory
protein involved in replication] [OR:Escherichia coli] [SR:Escherichia coli
(strain MAF102) DNA] [DB:genpept-bct1] [DE:E. coli DNA polymerase III delta prime
subunit (holB) gene,complete cds.] [LE:385] [RE:1389] [DI:direct]
>gp:[GI:g1787341] [LN:AE000210] [AC:AE000210:U00096] [PN:DNA polymerase III,
delta prime subunit] [GN:holB] [FN:enzyme; DNA - replication, repair,]
[OR:Escherichia coli] [DB:genpept-bct2] [EC:2.7.7.7] [DE:Escherichia coli K-12
MG1655 section 100 of 400 of the completegenome.] [NT:o334; 99 pct identical to
HOLB_ECOLI SW: P28631] [LE:7067] [RE:8071] [DI:direct]

| ORF Name | NT ID | AA ID | NT LN | AA LN | Score | P-value |
|---|---|---|---|---|---|---|
| 16495826_f3_341 | 297 | 7468 | 366 | 121 | 265 | 6.9e-23 |

Description gp:[GI:g644857] [LN:HIU20229] [AC:U20229] [PN:unknown] [OR:Haemophilus
influenzae] [DB:genpept-bct1] [DE:Haemophilus influenzae BOLA (bolA), glutathione
reductase (gor),phosphatidylserine decarboxylase (psd), 30K protein (rpmF),
genes,complete cds.] [NT:orf121] [LE:4561] [RE:>4926] [DI:complement]

| ORF Name | NT ID | AA ID | NT LN | AA LN | Score | P-value |
|---|---|---|---|---|---|---|
| 16925756_c1_557 | 298 | 7469 | 486 | 161 | 123 | 1.3e-06 |

Description gp:[GI:e1286174:g3036883] [LN:SC5B8] [AC:AL022374] [PN:putative ABC transporter]
[GN:SC5B8.08] [OR:Streptomyces coelicolor] [DB:genpept-bct1] [DE:Streptomyces
coelicolor cosmid 5B8.] [NT:SC5B8.08, probable ABC transporter, len: 744 aa;]
[LE:8005] [RE:10239] [DI:direct]

| ORF Name | NT ID | AA ID | NT LN | AA LN | Score | P-value |
|---|---|---|---|---|---|---|
| 19663577_c3_881 | 299 | 7470 | 300 | 99 | 127 | 2.9e-08 |

Description sp:[LN:YAGP_ECOLI] [AC:P75684] [GN:YAGP] [OR:Escherichia coli] [DE:HYPOTHETICAL 15.4 KD PROTEIN IN INTF-EAEH INTERGENIC REGION] [SP:P75684] [DB:swissprot] >sp:[LN:B64754] [AC:B64754] [PN:yagP protein] [GN:yagP] [OR:Escherichia coli] [DB:pir2] >gp:[GI:g1786476] [LN:AE000136] [AC:AE000136:U00096] [PN:putative transcriptional regulator LYSR-type] [GN:yagP] [FN:putative regulator; Not classified] [OR:Escherichia coli] [DB:genpept-bct2] [DE:Escherichia coli K-12 MG1655 section 26 of 400 of the completegenome.] [NT:f136; 25 pct identical (4 gaps) to 107 residues of] [LE:1762] [RE:2172] [DI:complement]

| ORF Name | NT ID | AA ID | NT LN | AA LN | Score | P-value |
|---|---|---|---|---|---|---|
| 19688390_c3_877 | 300 | 7471 | 1119 | 372 | 1376 | 1.3e-140 |

Description sp:[LN:PHOH_ECOLI] [AC:P31544] [GN:PHOH:PSIH] [OR:Escherichia coli] [DE:PHOH PROTEIN (PHOSPHATE STARVATION-INDUCIBLE PROTEIN PSIH)] [SP:P31544] [DB:swissprot] >sp:[LN:B47065] [AC:B47065:B64844] [PN:phosphate starvation-inducible protein psiH:nucleotide-binding protein phoH:phoH protein] [GN:phoH:psiH] [OR:Escherichia coli] [DB:pir2] >gp:[GI:d1036787:g1651507] [LN:D90739] [AC:D90739:AB001340] [PN:PhoH protein (phosphate starvation-inducible)] [GN:phoH] [OR:Escherichia coli] [SR:Escherichia coli(strain:K12) DNA, clone:Kohara clone #229] [DB:genpept-bct1] [DE:Escherichia coli genomic DNA. (23.3 - 23.6 min).] [NT:ORF_ID:o229#4; similar to SwissProt Accession] [LE:4387] [RE:5451] [DI:direct] >gp:[GI:d1001700:g285774] [LN:ECOPHOH] [AC:D10391:D90448] [PN:PhoH protein] [GN:phoH] [OR:Escherichia coli] [SR:Escherichia coli (strain:K-12) DNA, clone_lib:W3110 clone:10E11] [DB:genpept-bct1] [DE:Escherichia coli gene for PhoH protein, complete cds.] [LE:1032] [RE:2096] [DI:direct] >gp:[GI:g1787257] [LN:AE000204] [AC:AE000204:U00096] [PN:PhoB-dependent, ATP-binding pho regulon] [GN:phoH] [FN:regulator; Central intermediary metabolism:] [OR:Escherichia coli] [DB:genpept-bct2] [DE:Escherichia coli K-12 MG1655 section 94 of 400 of the completegenome.] [NT:o354; 100 pct identical to PHOH_ECOLI SW: P31544] [LE:203] [RE:1267] [DI:direct]

| ORF Name | NT ID | AA ID | NT LN | AA LN | Score | P-value |
|---|---|---|---|---|---|---|
| 19720052_f2_227 | 301 | 7472 | 222 | 73 | | |

Description

NO-HIT

| ORF Name | NT ID | AA ID | NT/LN | AA/LN | Score | P-value |
|---|---|---|---|---|---|---|
| 19724186_f3_367 | 302 | 7473 | 1143 | 380 | 1499 | 1.2e-153 |

Description sp:[LN:SAOX_ECOLI] [AC:P40874:Q47144] [GN:SOLA] [OR:Escherichia coli]
[EC:1.5.3.1] [DE:PUTATIVE SARCOSINE OXIDASE,] [SP:P40874:Q47144] [DB:swissprot]
>sp:[LN:JC5371] [AC:JC5371:H64848] [PN:probable sarcosine oxidase,] [GN:solA]
[CL:sarcosine oxidase] [OR:Escherichia coli] [EC:1.5.3.-] [DB:pir2]
>gp:[GI:d1036842:g4062632] [LN:D90742] [AC:D90742:AB001340] [PN:Sarcosine oxidase
(EC 1.5.3.1).] [GN:soxA] [OR:Escherichia coli] [SR:Escherichia coli(strain:K12)
DNA, clone:Kohara clone #232] [DB:genpept-bct1] [DE:Escherichia coli genomic DNA.
(23.8 - 24.2 min).] [NT:ORF_ID:o233#7; similar to SwissProt Accession] [LE:16088]
[RE:17206] [DI:complement] >gp:[GI:d1036853:g4062640] [LN:D90743]
[AC:D90743:AB001340] [PN:Sarcosine oxidase (EC 1.5.3.1).] [GN:soxA]
[OR:Escherichia coli] [SR:Escherichia coli(strain:K12) DNA, clone:Kohara clone
233] [DB:genpept-bct1] [DE:Escherichia coli genomic DNA. (24.1 - 24.5 min).]
[NT:ORF_ID:o233#7; similar to SwissProt Accession] [LE:5834] [RE:6952]
[DI:complement] >gp:[GI:d1007087:g1236737] [LN:ECODINI] [AC:D31709] [PN:SolA, a
sarcosine oxidase-like protein] [GN:solA] [OR:Escherichia coli] [SR:Escherichia
coli (strain:K-12, sub_strain:W3110) DNA] [DB:genpept-bct1] [DE:Escherichia coli
dinI and solA genes for DinI and SolA, completecds.] [LE:1768] [RE:2886]
[DI:direct] >gp:[GI:g1787298] [LN:AE000207] [AC:AE000207:U00096] [PN:sarcosine
oxidase-like protein] [GN:solA] [FN:putative enzyme; Not classified]
[OR:Escherichia coli] [DB:genpept-bct2] [DE:Escherichia coli K-12 MG1655 section
97 of 400 of the completegenome.] [NT:f372; This 372 aa ORF is 43 pct identical
(10 gaps)] [LE:2804] [RE:3922] [DI:complement]

| ORF Name | NT ID | AA ID | NT/LN | AA/LN | Score | P-value |
|---|---|---|---|---|---|---|
| 19942641_f3_352 | 303 | 7474 | 615 | 204 | 143 | 2.0e-08 |

Description gp:[GI:g1280073] [LN:CELF41F3] [AC:U55366] [GN:F41F3.4] [OR:Caenorhabditis
elegans] [SR:Caenorhabditis elegans strain=Bristol N2] [DB:genpept-inv1]
[DE:Caenorhabditis elegans cosmid F41F3.] [NT:Similar to cuticle collagen]
[LE:13544:14336:14512] [RE:14272:14458:14592] [DI:complementJoin]

| ORF Name | NT ID | AA ID | NT/LN | AA/LN | Score | P-value |
|---|---|---|---|---|---|---|
| 19944708_c2_718 | 304 | 7475 | 1158 | 385 | 1681 | 6.1e-173 |

Description sp:[LN:YCDO_ECOLI] [AC:P75902] [GN:YCDO] [OR:Escherichia coli] [DE:HYPOTHETICAL
41.1 KD PROTEIN IN PUTP-PHOH INTERGENIC REGION] [SP:P75902] [DB:swissprot]
>sp:[LN:H64843] [AC:H64843] [PN:ycdO protein] [GN:ycdO] [OR:Escherichia coli]
[DB:pir2] >gp:[GI:g1787254] [LN:AE000203] [AC:AE000203:U00096] [PN:orf,
hypothetical protein] [GN:ycdO] [FN:orf; Unknown] [OR:Escherichia coli]
[DB:genpept-bct2] [DE:Escherichia coli K-12 MG1655 section 93 of 400 of the
completegenome.] [NT:o375; This 375 aa ORF is 45 pct identical (4 gaps)]
[LE:8147] [RE:9274] [DI:direct]

| ORF Name | NT ID | AA ID | NT/LN | AA/LN | Score | P-value |
|---|---|---|---|---|---|---|
| 203426_c1_580 | 305 | 7476 | 504 | 167 | 179 | 9.0e-14 |

Description sp:[LN:E64845] [AC:E64845] [PN:ycdV protein] [GN:ycdV] [OR:Escherichia coli]
[DB:pir2] >gp:[GI:g1787269] [LN:AE000205] [AC:AE000205:U00096] [PN:putative
ribosomal protein] [GN:ycdV] [FN:putative structure; Not classified]
[OR:Escherichia coli] [DB:genpept-bct2] [DE:Escherichia coli K-12 MG1655 section
95 of 400 of the completegenome.] [NT:o137; This 137 aa ORF is 27 pct identical
(1 gap)] [LE:1513] [RE:1926] [DI:direct]

| ORF Name | NT ID | AA ID | NT/LN | AA/LN | Score | P-value |
|---|---|---|---|---|---|---|
| 20495962_f3_388 | 306 | 7477 | 726 | 241 | 96 | 0.022 |

Description sp:[LN:YC8A_METJA] [AC:P81318] [GN:MJ1282.1] [OR:Methanococcus jannaschii]
[DE:HYPOTHETICAL PROTEIN MJ1282.1] [SP:P81318] [DB:swissprot] >gp:[GI:g2826389]
[LN:U67569] [AC:U67569:L77117] [PN:M. jannaschii predicted coding region
MJ1282.1] [GN:MJ1282.1] [OR:Methanococcus jannaschii] [DB:genpept-bct2]
[DE:Methanococcus jannaschii section 111 of 150 of the complete genome.]
[NT:hypothetical protein; identified by GeneMark;] [LE:1604] [RE:2368]
[DI:complement]

| ORF Name | NT ID | AA ID | NT/LN | AA/LN | Score | P-value |
|---|---|---|---|---|---|---|
| 20511312_c1_486 | 307 | 7478 | 414 | 137 | 630 | 1.4e-61 |

Description sp:[LN:YCBG_ECOLI] [AC:P45569:P75868] [GN:YCBG] [OR:Escherichia coli]
[DE:HYPOTHETICAL 17.7 KD PROTEIN IN FABA-OMPA INTERGENIC REGION]
[SP:P45569:P75868] [DB:swissprot] >sp:[LN:C64836] [AC:C64836] [PN:ycbG protein]
[GN:ycbG] [OR:Escherichia coli] [DB:pir2] >gp:[GI:d1036700:g4062522] [LN:D90733]
[AC:D90733:AB001340] [PN:Hypothetical protein in ompA 3'region .] [GN:ycbG]
[OR:Escherichia coli] [SR:Escherichia coli(strain:K12) DNA, clone:Kohara clone
222] [DB:genpept-bct1] [DE:Escherichia coli genomic DNA. (21.7 - 22.1 min).]
[NT:ORF_ID:o223#1; similar to SwissProt Accession] [LE:11837] [RE:12289]
[DI:direct] >gp:[GI:d1036707:g4062526] [LN:D90734] [AC:D90734:AB001340]
[PN:Hypothetical protein in ompA 3'region .] [GN:ycbG] [OR:Escherichia coli]
[SR:Escherichia coli(strain:K12) DNA, clone:Kohara clone #223] [DB:genpept-bct1]
[DE:Escherichia coli genomic DNA. (22.0 - 22.3 min).] [NT:ORF_ID:o223#1; similar
to SwissProt Accession] [LE:8] [RE:460] [DI:direct] >gp:[GI:g1787190]
[LN:AE000198] [AC:AE000198:U00096] [PN:putative dehydrogenase] [GN:ycbG]
[FN:putative enzyme; Not classified] [OR:Escherichia coli] [DB:genpept-bct2]
[DE:Escherichia coli K-12 MG1655 section 88 of 400 of the completegenome.]
[NT:o150; 100 pct identical to fragment YCBG_ECOLI] [LE:123] [RE:575] [DI:direct]

| ORF Name | NT ID | AA ID | NT/LN | AA/LN | Score | P-value |
|---|---|---|---|---|---|---|
| 20738833_c2_774 | 308 | 7479 | 960 | 319 | 1455 | 5.5e-149 |

Description sp:[LN:FABH_ECOLI] [AC:P24249] [GN:FABH] [OR:Escherichia coli] [EC:2.3.1.41]
[DE:KETOACYL-ACP SYNTHASE III} (KAS III)] [SP:P24249] [DB:swissprot]
>sp:[LN:A42431] [AC:A42431:A41856:S30131:H64852]
[PN:3-oxoacyl-[acyl-carrier-protein] synthase, III:beta-ketoacyl-acyl carrier
protein synthase III] [GN:fabH] [CL:3-oxoacyl-[acyl-carrier-protein] synthase
III] [OR:Escherichia coli] [EC:2.3.1.41] [DB:pir1] [MP:24.5 min] >gp:[GI:g145898]
[LN:ECOFABH] [AC:M77744] [PN:beta-ketoacyl-acyl carrier protein synthase III]
[GN:fabH] [FN:fatty acid biosynthesis] [OR:Escherichia coli] [SR:Escherichia coli
DNA] [DB:genpept-bct1] [DE:Escherichia coli beta-ketoacyl-acyl carrier protein
synthase III(fabH) gene, complete cds.] [LE:196] [RE:1149] [DI:direct]
>gp:[GI:g1787333] [LN:AE000210] [AC:AE000210:U00096]
[PN:3-oxoacyl-[acyl-carrier-protein] synthase III;] [GN:fabH] [FN:enzyme; Fatty
acid and phosphatidic acid] [OR:Escherichia coli] [DB:genpept-bct2] [EC:2.3.1.41]
[DE:Escherichia coli K-12 MG1655 section 100 of 400 of the completegenome.]
[NT:o317; 100 pct identical to FABH_ECOLI SW: P24249] [LE:64] [RE:1017]
[DI:direct]

| ORF Name | NT ID | AA ID | NT/LN | AA/LN | Score | P-value |
|---|---|---|---|---|---|---|
| 22005416_c2_709 | 309 | 7480 | 2049 | 682 | | |

Description

NO-HIT

| ORF Name | NT ID | AA ID | NT/LN | AA/LN | Score | P-value |
|---|---|---|---|---|---|---|
| 22113375_c2_656 | 310 | 7481 | 2475 | 824 | 1949 | 2.4e-201 |

Description sp:[LN:PHS3_RAT] [AC:P53534] [GN:PYGB] [OR:Rattus norvegicus] [SR:,Rat]
[EC:2.4.1.1] [DE:GLYCOGEN PHOSPHORYLASE, BRAIN FORM, (FRAGMENT)] [SP:P53534]
[DB:swissprot] >gp:[GI:g204421] [LN:RATGLYPHOA] [AC:L10668] [PN:glycogen
phosphorylase] [OR:Rattus norvegicus] [SR:Rattus norvegicus (strain
Sprague-Dawley) Adult Testis cDNA t] [DB:genpept-rod] [DE:Rat glycogen
phosphorylase brain isozyme mRNA, 5' end of cds.] [NT:brain isozyme; putative]
[LE:10] [RE:>2522] [DI:direct]

| ORF Name | NT ID | AA ID | NT/LN | AA/LN | Score | P-value |
|---|---|---|---|---|---|---|
| 22135255_f2_313 | 311 | 7482 | 1254 | 417 | 1857 | 1.4e-191 |

Description gp:[GI:d1036718:g4062534] [LN:D90734] [AC:D90734:AB001340] [PN:Hypothetical
protein] [OR:Escherichia coli] [SR:Escherichia coli(strain:K12) DNA, clone:Kohara
clone #223] [DB:genpept-bct1] [DE:Escherichia coli genomic DNA. (22.0 - 22.3
min).] [NT:ORF_ID:o223#12; similar to PIR Accession Number] [LE:10302] [RE:11492]
[DI:complement]

| ORF Name | NT ID | AA ID | NT LN | AA LN | Score | P-value |
|---|---|---|---|---|---|---|
| 22163180_c2_704 | 312 | 7483 | 1203 | 400 | | |

Description

NO-HIT

| ORF Name | NT ID | AA ID | NT LN | AA LN | Score | P-value |
|---|---|---|---|---|---|---|
| 2237962_c3_804 | 313 | 7484 | 801 | 266 | 414 | 1.1e-38 |

Description sp:[LN:YBCM_ECOLI] [AC:P77634] [GN:YBCM] [OR:Escherichia coli] [DE:HYPOTHETICAL
TRANSCRIPTIONAL REGULATOR IN EMRE-RUS INTERGENIC REGION] [SP:P77634]
[DB:swissprot] >sp:[LN:H64786] [AC:H64786] [PN:ybcM protein] [GN:ybcM]
[OR:Escherichia coli] [DB:pir2] >gp:[GI:g1778460] [LN:ECU82598] [AC:U82598]
[OR:Escherichia coli] [DB:genpept-bct1] [DE:Escherichia coli genomic sequence of
minutes 9 to 12.] [NT:hypothetical protein] [LE:12085] [RE:12882] [DI:direct]
>gp:[GI:g1786758] [LN:AE000160] [AC:AE000160:U00096] [PN:putative ARAC-type
regulatory protein] [GN:ybcM] [FN:putative regulator; Not classified]
[OR:Escherichia coli] [DB:genpept-bct2] [DE:Escherichia coli K-12 MG1655 section
50 of 400 of the completegenome.] [NT:o265; phage stats; 28 pct identical (8
gaps) to 171] [LE:4802] [RE:5599] [DI:direct]

| ORF Name | NT ID | AA ID | NT LN | AA LN | Score | P-value |
|---|---|---|---|---|---|---|
| 22461007_c1_494 | 314 | 7485 | 2094 | 697 | 2883 | 2.6e-300 |

Description sp:[LN:HELD_ECOLI] [AC:P15038:P77623] [GN:HELD] [OR:Escherichia coli]
[EC:3.6.1.-] [DE:HELICASE IV, (75 KD HELICASE)] [SP:P15038:P77623] [DB:swissprot]
>sp:[LN:HJECD4] [AC:A64837:JV0021] [PN:helicase, IV:75K helicase] [GN:helD]
[CL:helicase IV] [OR:Escherichia coli] [EC:3.6.1.-] [DB:pir1] [MP:22 min]
>gp:[GI:d1036713:g1651471] [LN:D90734] [AC:D90734:AB001340] [PN:Helicase (EC
3.6.1.-) IV.] [GN:helD] [OR:Escherichia coli] [SR:Escherichia coli(strain:K12)
DNA, clone:Kohara clone #223] [DB:genpept-bct1] [DE:Escherichia coli genomic DNA.
(22.0 - 22.3 min).] [NT:ORF_ID:o223#7; similar to PIR Accession Number] [LE:5994]
[RE:8048] [DI:direct] >gp:[GI:g1787196] [LN:AE000198] [AC:AE000198:U00096]
[PN:DNA helicase IV] [GN:helD] [FN:enzyme; DNA - replication, repair,]
[OR:Escherichia coli] [DB:genpept-bct2] [EC:3.6.1.-] [DE:Escherichia coli K-12
MG1655 section 88 of 400 of the completegenome.] [NT:o684; 98 pct identical to
HELD_ECOLI SW: P15038] [LE:6109] [RE:8163] [DI:direct]

| ORF Name | NT ID | AA ID | NT LN | AA LN | Score | P-value |
|---|---|---|---|---|---|---|
| 22462951_c1_526 | 315 | 7486 | 966 | 321 | 1419 | 3.6e-145 |

Description sp:[LN:G64940] [AC:G64940] [PN:hypothetical protein b1799] [CL:conserved hypothetical protein HI1364] [OR:Escherichia coli] [DB:pir2] >gp:[GI:g1788100] [LN:AE000274] [AC:AE000274:U00096] [PN:putative transcriptional regulator LYSR-type] [GN:yeaT] [FN:putative regulator; Not classified] [OR:Escherichia coli] [DB:genpept-bct2] [DE:Escherichia coli K-12 MG1655 section 164 of 400 of the completegenome.] [NT:f314; This 314 aa ORF is 34 pct identical (6 gaps)] [LE:6625] [RE:7569] [DI:complement]

| ORF Name | NT ID | AA ID | NT LN | AA LN | Score | P-value |
|---|---|---|---|---|---|---|
| 22463437_f1_146 | 316 | 7487 | 372 | 123 | 500 | 8.6e-48 |

Description sp:[LN:YCCV_ECOLI] [AC:P75875] [GN:YCCV] [OR:Escherichia coli] [DE:HYPOTHETICAL 13.8 KD PROTEIN IN MGSA-HYAA INTERGENIC REGION] [SP:P75875] [DB:swissprot] >sp:[LN:E64837] [AC:E64837] [PN:yccV protein] [GN:yccV] [OR:Escherichia coli] [DB:pir2] >gp:[GI:d1036717:g4062533] [LN:D90734] [AC:D90734:AB001340] [OR:Escherichia coli] [SR:Escherichia coli(strain:K12) DNA, clone:Kohara clone #223] [DB:genpept-bct1] [DE:Escherichia coli genomic DNA. (22.0 - 22.3 min).] [NT:ORF_ID:o223#11] [LE:9927] [RE:10295] [DI:complement] >gp:[GI:g1787200] [LN:AE000198] [AC:AE000198:U00096] [PN:orf, hypothetical protein] [GN:yccV] [FN:orf; Unknown] [OR:Escherichia coli] [DB:genpept-bct2] [DE:Escherichia coli K-12 MG1655 section 88 of 400 of the completegenome.] [NT:f122; This 122 aa ORF is 32 pct identical (1 gap)] [LE:10042] [RE:10410] [DI:complement]

| ORF Name | NT ID | AA ID | NT LN | AA LN | Score | P-value |
|---|---|---|---|---|---|---|
| 22945842_c3_824 | 317 | 7488 | 288 | 95 | | |

Description

NO-HIT

| ORF Name | NT ID | AA ID | NT LN | AA LN | Score | P-value |
|---|---|---|---|---|---|---|
| 23448752_f2_272 | 318 | 7489 | 828 | 275 | 397 | 7.1e-37 |

Description gp:[GI:e1316488:g3449276] [LN:SC6G4] [AC:AL031317] [PN:putative dehydrogenase] [GN:SC6G4.42c] [OR:Streptomyces coelicolor] [DB:genpept-bct1] [DE:Streptomyces coelicolor cosmid 6G4.] [NT:SC6G4.42c, probable dehydrogenase, len: 257 aa;] [LE:37093] [RE:37866] [DI:complement]

| ORF Name | NT ID | AA ID | NT LN | AA LN | Score | P-value |
|---|---|---|---|---|---|---|
| 2346031_c3_888 | 319 | 7490 | 783 | 260 | 1095 | 7.7e-111 |

Description sp:[LN:YCDX_ECOLI] [AC:P75914] [GN:YCDX] [OR:Escherichia coli] [DE:HYPOTHETICAL 26.9 KD PROTEIN IN PHOH-CSGG INTERGENIC REGION PRECURSOR] [SP:P75914] [DB:swissprot] >sp:[LN:G64845] [AC:G64845] [PN:ycdX protein] [GN:ycdX] [OR:Escherichia coli] [DB:pir2] >gp:[GI:d1036801:g4062598] [LN:D90740] [AC:D90740:AB001340] [OR:Escherichia coli] [SR:Escherichia coli(strain:K12) DNA, clone:Kohara clone #230] [DB:genpept-bct1] [DE:Escherichia coli genomic DNA. (23.5 - 23.8 min).] [NT:ORF_ID:o231#2] [LE:8944] [RE:9681] [DI:direct] >gp:[GI:d1036810:g4062607] [LN:D90741] [AC:D90741:AB001340] [OR:Escherichia coli] [SR:Escherichia coli(strain:K12) DNA, clone:Kohara clone #231] [DB:genpept-bct1] [DE:Escherichia coli genomic DNA. (23.7 - 24.0 min).] [NT:ORF_ID:o231#2] [LE:2145] [RE:2882] [DI:direct] >gp:[GI:g1787271] [LN:AE000205] [AC:AE000205:U00096] [PN:orf, hypothetical protein] [GN:ycdX] [FN:orf; Unknown] [OR:Escherichia coli] [DB:genpept-bct2] [DE:Escherichia coli K-12 MG1655 section 95 of 400 of the completegenome.] [NT:o245] [LE:3425] [RE:4162] [DI:direct]

| ORF Name | NT ID | AA ID | NT LN | AA LN | Score | P-value |
|---|---|---|---|---|---|---|
| 23563828_f2_315 | 320 | 7491 | 588 | 195 | 720 | 4.2e-71 |

Description sp:[LN:MGSA_ECOLI] [AC:P37066:P75872] [GN:MGSA] [OR:Escherichia coli] [EC:4.2.99.11] [DE:METHYLGLYOXAL SYNTHASE, (MGS)] [SP:P37066:P75872] [DB:swissprot] >gp:[GI:e303015:g1845161] [LN:ECMETGLYS] [AC:Y11249] [PN:methylglyoxal synthase] [OR:Escherichia coli] [DB:genpept-bct1] [DE:E.coli methylglyoxal synthase structural gene, partial.] [SP:P37066] [LE:1] [RE:>456] [DI:direct]

| ORF Name | NT ID | AA ID | NT LN | AA LN | Score | P-value |
|---|---|---|---|---|---|---|
| 23634625_c2_730 | 321 | 7492 | 222 | 73 | | |

Description

NO-HIT

| ORF_Name | NT_ID | AA_ID | NT/LN | AA/LN | Score | P-value |
|---|---|---|---|---|---|---|
| 23651437_c1_625 | 322 | 7493 | 582 | 193 | 680 | 7.3e-67 |

Description sp:[LN:RLUC_ECOLI] [AC:P23851] [GN:RLUC] [OR:Escherichia coli] [EC:4.2.1.70]
[DE:(PSEUDOURIDYLATE SYNTHASE) (URACIL HYDROLYASE)] [SP:P23851] [DB:swissprot]
>sp:[LN:C64852] [AC:C64852:B23747] [PN:probable pseudouridylate synthase yceC]
[GN:yceC] [CL:conserved hypothetical protein HI0176] [OR:Escherichia coli]
[DB:pir2] >gp:[GI:d1036880:g4062660] [LN:D90744] [AC:D90744:AB001340]
[PN:Hypothetical 36.0 kd protein in rne-rpmF] [GN:yceC] [OR:Escherichia coli]
[SR:Escherichia coli(strain:K12) DNA, clone:Kohara clone #234] [DB:genpept-bct1]
[DE:Escherichia coli genomic DNA. (24.5 - 24.8 min).] [NT:ORF_ID:o235#4; similar
to SwissProt Accession] [LE:11894] [RE:12853] [DI:direct] >gp:[GI:g1787327]
[LN:AE000209] [AC:AE000209:U00096] [PN:orf, hypothetical protein] [GN:yceC]
[FN:orf; Unknown] [OR:Escherichia coli] [DB:genpept-bct2] [DE:Escherichia coli
K-12 MG1655 section 99 of 400 of the completegenome.] [NT:o319; 100 pct identical
to YCEC_ECOLI SW: P23851] [LE:6625] [RE:7584] [DI:direct]

| ORF_Name | NT_ID | AA_ID | NT/LN | AA/LN | Score | P-value |
|---|---|---|---|---|---|---|
| 23939687_c1_637 | 323 | 7494 | 783 | 260 | 1250 | 2.9e-127 |

Description sp:[LN:PTGB_ECOLI] [AC:P05053] [GN:PTSG:GLCA:UMG] [OR:Escherichia coli]
[EC:2.7.1.69] [DE:(EC 2.7.1.69) (EII-GLC)] [SP:P05053] [DB:swissprot]
>sp:[LN:WQEC2G] [AC:A25336:B64854] [PN:phosphotransferase system enzyme II,,
glucose-specific, factor II:glucose-permease, factor II:phosphotransferase system
enzyme II-Glc:protein-N(pi)-phosphohistidine-glucose phosphotransferase, factor
II] [GN:ptsG:glcA:umg] [CL:phosphotransferase system glucose-specific enzyme II,
factor II:phosphotransferase system glucose-specific enzyme II, factor II
homology] [OR:Escherichia coli] [EC:2.7.1.69] [DB:pir1] [MP:24 min]
>gp:[GI:d1036894:g1651541] [LN:D90745] [AC:D90745:AB001340] [PN:PTS system,
glucose-specific IIBC component] [GN:glcA] [OR:Escherichia coli] [SR:Escherichia
coli(strain:K12) DNA, clone:Kohara clone #236] [DB:genpept-bct1] [DE:Escherichia
coli genomic DNA. (24.8 - 25.2 min).] [NT:ORF_ID:o236#10; similar to SwissProt
Accession] [LE:8511] [RE:9944] [DI:direct] >gp:[GI:g147393] [LN:ECOPTSG]
[AC:J02618] [GN:ptsG] [OR:Escherichia coli] [SR:E.coli DNA strain ptsG4]
[DB:genpept-bct1] [DE:E. coli ptsG gene encoding glucose-specific enzyme II
ofphosphotransferase system.] [NT:glucose-specific enzyme II of
phosphotransferase] [LE:39] [RE:1472] [DI:direct] >gp:[GI:g1787343] [LN:AE000210]
[AC:AE000210:U00096] [PN:PTS system, glucose-specific IIBC component] [GN:ptsG]
[FN:transport; Transport of small molecules:] [OR:Escherichia coli]
[DB:genpept-bct2] [EC:2.7.1.69] [DE:Escherichia coli K-12 MG1655 section 100 of
400 of the completegenome.] [NT:o477; 100 pct identical to PTGB_ECOLI SW: P05053]
[LE:9174] [RE:10607] [DI:direct]

| ORF_Name | NT_ID | AA_ID | NT/LN | AA/LN | Score | P-value |
|---|---|---|---|---|---|---|
| 23990927_c2_729 | 324 | 7495 | 255 | 84 | | |

Description

NO-HIT

| ORF_Name | NT_ID | AA_ID | NT/LN | AA/LN | Score | P-value |
|---|---|---|---|---|---|---|
| 24345318_f1_107 | 325 | 7496 | 570 | 189 | 922 | 1.7e-92 |

Description sp:[LN:YCJC_ECOLI] [AC:P38522:P77417:P76839] [GN:YCJC] [OR:Escherichia coli]
[DE:HYPOTHETICAL 20.1 KD PROTEIN IN SAPA-ALDH INTERGENIC REGION]
[SP:P38522:P77417:P76839] [DB:swissprot] >sp:[LN:F64878] [AC:F64878] [PN:aldehyde
dehydrogenase-related protein ycjC:ycjC protein] [GN:ycjC] [OR:Escherichia coli]
[DB:pir2] >gp:[GI:d1015584:g1742129] [LN:D90768] [AC:D90768:AB001340]
[PN:Immunity repressor protein.] [GN:ycjC] [OR:Escherichia coli] [SR:Escherichia
coli (strain:K12) DNA, clone_lib:Kohara lambda minise] [DB:genpept-bct1]
[DE:E.coli genomic DNA, Kohara clone #257(29.1-29.6 min.).] [NT:ORF_ID:o257#8;
similar to [SwissProt Accession] [LE:9281] [RE:9838] [DI:direct]
>gp:[GI:g1787557] [LN:AE000228] [AC:AE000228:U00096] [PN:orf, hypothetical
protein] [GN:ycjC] [FN:orf; Unknown] [OR:Escherichia coli] [DB:genpept-bct2]
[DE:Escherichia coli K-12 MG1655 section 118 of 400 of the completegenome.]
[NT:o185; 100 pct identical to 121 aa] [LE:2576] [RE:3133] [DI:direct]

| ORF_Name | NT_ID | AA_ID | NT/LN | AA/LN | Score | P-value |
|---|---|---|---|---|---|---|
| 24347080_f1_96 | 326 | 7497 | 534 | 177 | 223 | 1.9e-18 |

Description sp:[LN:F70918] [AC:F70918] [PN:probable regulatoryprotein] [GN:Rv3095]
[OR:Mycobacterium tuberculosis] [DB:pir2] >gp:[GI:e314984:g2076670] [LN:MTCY164]
[AC:Z95150:AL123456] [PN:hypothetical protein Rv3095] [GN:Rv3095]
[OR:Mycobacterium tuberculosis] [DB:genpept-bct1] [DE:Mycobacterium tuberculosis
H37Rv complete genome; segment 135/162.] [NT:Rv3095, (MTCY164.06), len: 158.
possible] [LE:6670] [RE:7146] [DI:direct]

| ORF Name | NT ID | AA ID | NT LN | AA LN | Score | P-value |
|---|---|---|---|---|---|---|
| 24422778_c2_654 | 327 | 7498 | 300 | 99 | 170 | 7.5e-12 |

Description sp:[LN:OPPA_ECOLI] [AC:P23843:P76829] [GN:OPPA] [OR:Escherichia coli]
[DE:PERIPLASMIC OLIGOPEPTIDE-BINDING PROTEIN PRECURSOR] [SP:P23843:P76829]
[DB:swissprot] >sp:[LN:F64871] [AC:F64871:A36263] [PN:oligopeptide-binding
protein precursor] [GN:oppA] [CL:dipeptide transport protein] [OR:Escherichia
coli] [DB:pir1] >gp:[GI:d1016766:g1805524] [LN:D90852] [AC:D90852:AB001340]
[PN:Periplasmic oligopeptide-binding protein] [GN:oppA] [OR:Escherichia coli]
[SR:Escherichia coli (strain:K12) DNA, clone_lib:Kohara lambda minise]
[DB:genpept-bct1] [DE:E.coli genomic DNA, Kohara clone #251(27.7-28.2 min.).]
[NT:ORF_ID:o251#4; similar to [SwissProt Accession] [LE:18315] [RE:19946]
[DI:direct] >gp:[GI:g304925] [LN:ECOOPPAA] [AC:M60918] [PN:periplasmic
oligopeptide binding protein] [GN:oppA] [OR:Escherichia coli] [SR:Escherichia
coli (strain K-12) DNA] [DB:genpept-bct1] [DE:Escherichia coli periplasmic
oligopeptide binding protein (oppA)gene, complete cds.] [NT:putative] [LE:1095]
[RE:2726] [DI:direct] >gp:[GI:g1787495] [LN:AE000222] [AC:AE000222:U00096]
[PN:oligopeptide transport; periplasmic binding] [GN:oppA] [FN:transport;
Protein, peptide secretion] [OR:Escherichia coli] [DB:genpept-bct2]
[DE:Escherichia coli K-12 MG1655 section 112 of 400 of the completegenome.]
[NT:o543; 100 pct identical to OPPA_ECOLI SW: P23843] [LE:9817] [RE:11448]
[DI:direct]

| ORF Name | NT ID | AA ID | NT LN | AA LN | Score | P-value |
|---|---|---|---|---|---|---|
| 24495931_f3_413 | 328 | 7499 | 408 | 135 | 578 | 4.7e-56 |

Description sp:[LN:YCDK_ECOLI] [AC:P75896] [GN:YCDK] [OR:Escherichia coli] [DE:HYPOTHETICAL
13.8 KD PROTEIN IN WRBA-PUTA INTERGENIC REGION] [SP:P75896] [DB:swissprot]
>sp:[LN:H64842] [AC:H64842] [PN:probable translation initiation regulator b1010]
[CL:hypothetical protein HI0719] [OR:Escherichia coli] [DB:pir1]
>gp:[GI:d1036763:g4062564] [LN:D90737] [AC:D90737:AB001340] [PN:Hypothetical
protein 1 (vnfA 5' region)] [OR:Escherichia coli] [SR:Escherichia
coli(strain:K12) DNA, clone:Kohara clone #227] [DB:genpept-bct1] [DE:Escherichia
coli genomic DNA. (22.8 - 23.1 min).] [NT:ORF_ID:o228#8; similar to PIR Accession
Number] [LE:17270] [RE:16656] [DI:complement] >gp:[GI:d1036773:g4062573]
[LN:D90738] [AC:D90738:AB001340] [PN:Hypothetical protein 1 (vnfA 5' region)]
[OR:Escherichia coli] [SR:Escherichia coli(strain:K12) DNA, clone:Kohara clone
228] [DB:genpept-bct1] [DE:Escherichia coli genomic DNA. (23.0 - 23.4 min).]
[NT:ORF_ID:o228#8; similar to PIR Accession Number] [LE:5734] [RE:6120]
[DI:complement] >gp:[GI:g1787245] [LN:AE000202] [AC:AE000202:U00096] [PN:orf,
hypothetical protein] [GN:b1010] [FN:orf; Unknown] [OR:Escherichia coli]
[DB:genpept-bct2] [DE:Escherichia coli K-12 MG1655 section 92 of 400 of the
completegenome.] [NT:f128; residues 3-119 are 35 pct identical to] [LE:9329]
[RE:9715] [DI:complement]

| ORF Name | NT ID | AA ID | NT/LN | AA/LN | Score | P-value |
|---|---|---|---|---|---|---|
| 24609705_c3_815 | 329 | 7500 | 531 | 176 | 159 | 1.2e-11 |

Description sp:[LN:G72252] [AC:G72252] [PN:hypothetical protein TM1442] [GN:TM1442]
[OR:Thermotoga maritima] [DB:pir2] >gp:[GI:g4982007] [LN:AE001796]
[AC:AE001796:AE000512] [PN:anti-sigma factor antagonist, putative] [GN:TM1442]
[OR:Thermotoga maritima] [DB:genpept-bct2] [DE:Thermotoga maritima section 108 of
136 of the complete genome.] [NT:similar to GP:2660753 percent identity: 53.33;]
[LE:2620] [RE:2952] [DI:direct]

| ORF Name | NT ID | AA ID | NT/LN | AA/LN | Score | P-value |
|---|---|---|---|---|---|---|
| 24647211_c1_575 | 330 | 7501 | 189 | 62 | | |

Description

NO-HIT

| ORF Name | NT ID | AA ID | NT/LN | AA/LN | Score | P-value |
|---|---|---|---|---|---|---|
| 24650878_f1_19 | 331 | 7502 | 3240 | 1079 | 3895 | 0.0 |

Description sp:[LN:S27311] [AC:A64852:S45572:S27311:A23747:JG0009:A40661:S13127;]
[PN:ribonuclease E,:cell shape-determining protein:message stability-altering
protein:RNase E] [GN:rne:ams:hmp1] [CL:ribonuclease E] [OR:Escherichia coli]
[EC:3.1.4.-] [DB:pir1] [MP:24 min] >gp:[GI:d1036879:g1651530] [LN:D90744]
[AC:D90744:AB001340] [PN:Ribonuclease e (EC 3.1.4.-) (RNase E).] [GN:ams]
[OR:Escherichia coli] [SR:Escherichia coli(strain:K12) DNA, clone:Kohara clone
234] [DB:genpept-bct1] [DE:Escherichia coli genomic DNA. (24.5 - 24.8 min).]
[NT:ORF_ID:o235#3; similar to SwissProt Accession] [LE:8136] [RE:11321]
[DI:complement] >gp:[GI:g1787325] [LN:AE000209] [AC:AE000209:U00096] [PN:RNase E,
membrane attachment, mRNA turnover,] [GN:rne] [FN:enzyme; Degradation of RNA]
[OR:Escherichia coli] [DB:genpept-bct2] [EC:3.1.4.-] [DE:Escherichia coli K-12
MG1655 section 99 of 400 of the completegenome.] [NT:f1061; 99 pct identical to
RNE_ECOLI SW: P21513] [LE:2867] [RE:6052] [DI:complement]

| ORF Name | NT ID | AA ID | NT/LN | AA/LN | Score | P-value |
|---|---|---|---|---|---|---|
| 25433593_c3_878 | 332 | 7503 | 297 | 98 | 107 | 3.8e-06 |

Description sp:[LN:D64845] [AC:D64845] [PN:hypothetical protein b1030] [OR:Escherichia coli]
[DB:pir2] >gp:[GI:g1787268] [LN:AE000205] [AC:AE000205:U00096] [PN:orf,
hypothetical protein] [GN:b1030] [FN:orf; Unknown] [OR:Escherichia coli]
[DB:genpept-bct2] [DE:Escherichia coli K-12 MG1655 section 95 of 400 of the
completegenome.] [NT:o83; This 83 aa ORF is 25 pct identical (7 gaps)] [LE:1494]
[RE:1745] [DI:direct]

| ORF Name | NT ID | AA ID | NT LN | AA LN | Score | P-value |
|---|---|---|---|---|---|---|
| 25558535_f3_371 | 333 | 7504 | 933 | 310 | 1480 | 1.2e-151 |

Description sp:[LN:HTRB_ECOLI] [AC:P24187] [GN:HTRB:WAAM] [OR:Escherichia coli] [EC:2.3.1.-]
[DE:PROTEIN B)] [SP:P24187] [DB:swissprot] >sp:[LN:S16888]
[AC:S16888:A42290:C64848] [PN:lipid A biosynthesis lauroyl acyltransferase,:htrB
protein] [GN:htrB] [OR:Escherichia coli] [EC:2.3.1.-] [DB:pir2]
>gp:[GI:d1036838:g4062628] [LN:D90742] [AC:D90742:AB001340] [PN:HtrB protein.]
[GN:htrB] [OR:Escherichia coli] [SR:Escherichia coli(strain:K12) DNA,
clone:Kohara clone #232] [DB:genpept-bct1] [DE:Escherichia coli genomic DNA.
(23.8 - 24.2 min).] [NT:ORF_ID:o233#3; similar to PIR Accession Number]
[LE:12282] [RE:13202] [DI:complement] >gp:[GI:d1036849:g1651522] [LN:D90743]
[AC:D90743:AB001340] [PN:HtrB protein.] [GN:htrB] [OR:Escherichia coli]
[SR:Escherichia coli(strain:K12) DNA, clone:Kohara clone #233] [DB:genpept-bct1]
[DE:Escherichia coli genomic DNA. (24.1 - 24.5 min).] [NT:ORF_ID:o233#3; similar
to PIR Accession Number] [LE:2028] [RE:2948] [DI:complement] >gp:[GI:g48957]
[LN:ECHTRB] [AC:X61000:S76453] [PN:HtrB protein] [GN:HtrB] [OR:Escherichia coli]
[DB:genpept-bct1] [DE:E. coli K12 HtrB gene.] [SP:P24187] [LE:1960] [RE:2880]
[DI:direct] >gp:[GI:g1787292] [LN:AE000206] [AC:AE000206:U00096] [PN:heat shock
protein] [GN:htrB] [FN:factor; Adaptations, atypical conditions] [OR:Escherichia
coli] [DB:genpept-bct2] [DE:Escherichia coli K-12 MG1655 section 96 of 400 of the
completegenome.] [NT:f306; 96 pct identical to HTRB_ECOLI SW: P24187] [LE:9920]
[RE:10840] [DI:complement]

| ORF Name | NT ID | AA ID | NT LN | AA LN | Score | P-value |
|---|---|---|---|---|---|---|
| 25660331_c2_778 | 334 | 7505 | 834 | 277 | 870 | 5.3e-87 |

Description sp:[LN:PABC_ECOLI] [AC:P28305] [GN:PABC] [OR:Escherichia coli] [EC:4.-.-.-]
[DE:4-AMINO-4-DEOXYCHORISMATE LYASE, (ADC LYASE)] [SP:P28305] [DB:swissprot]
>sp:[LN:A42954] [AC:A42954:S27566:E64853] [PN:4-amino-4-deoxychorismate lyase,]
[GN:pabC] [OR:Escherichia coli] [EC:4.-.-.-] [DB:pir2] >gp:[GI:d1036890:g1651539]
[LN:D90745] [AC:D90745:AB001340] [PN:4-amino-4-deoxychorismate lyase.] [GN:pabC]
[OR:Escherichia coli] [SR:Escherichia coli(strain:K12) DNA, clone:Kohara clone
236] [DB:genpept-bct1] [DE:Escherichia coli genomic DNA. (24.8 - 25.2 min).]
[NT:ORF_ID:o236#5; similar to PIR Accession Number] [LE:3943] [RE:4752]
[DI:direct] >gp:[GI:g147060] [LN:ECOPABC] [AC:M93135]
[PN:4-amino-4-deoxychorismate lyase] [GN:pabC] [FN:4-amino-4-deoxychorismate -->
4-aminobenzoate +] [OR:Escherichia coli] [SR:Escherichia coli (sub_strain W3110,
strain K-12) (library: Kohar] [DB:genpept-bct1] [DE:Escherichia coli
aminodeoxychorismate lyase (pabC) gene, completecds.] [NT:amino-terminal sequence
-] [LE:127] [RE:936] [DI:direct] >gp:[GI:g1787338] [LN:AE000210]
[AC:AE000210:U00096] [PN:4-amino-4-deoxychorismate lyase] [GN:pabC] [FN:enzyme;
Biosynthesis of cofactors, carriers:] [OR:Escherichia coli] [DB:genpept-bct2]
[EC:4.-.-.-] [DE:Escherichia coli K-12 MG1655 section 100 of 400 of the
completegenome.] [NT:o269; 100 pct identical to PABC_ECOLI SW: P28305] [LE:4605]
[RE:5414] [DI:direct]

| ORF_Name | NT ID | AA ID | NT/LN | AA/LN | Score | P-value |
|---|---|---|---|---|---|---|
| 25673751_f3_380 | 335 | 7506 | 525 | 174 | 665 | 2.8e-65 |

Description sp:[LN:YMDD_ECOLI] [AC:P75920] [GN:YMDD] [OR:Escherichia coli] [DE:HYPOTHETICAL 44.7 KD PROTEIN IN CSGC-MODG INTERGENIC REGION] [SP:P75920] [DB:swissprot] >sp:[LN:D64847] [AC:D64847] [PN:probable membrane protein ymdD] [GN:ymdD] [OR:Escherichia coli] [DB:pir2] >gp:[GI:d1036823:g4062618] [LN:D90741] [AC:D90741:AB001340] [OR:Escherichia coli] [SR:Escherichia coli(strain:K12) DNA, clone:Kohara clone #231] [DB:genpept-bct1] [DE:Escherichia coli genomic DNA. (23.7 - 24.0 min).] [NT:ORF_ID:o232#5] [LE:12386] [RE:13543] [DI:complement] >gp:[GI:d1036831:g4062624] [LN:D90742] [AC:D90742:AB001340] [OR:Escherichia coli] [SR:Escherichia coli(strain:K12) DNA, clone:Kohara clone #232] [DB:genpept-bct1] [DE:Escherichia coli genomic DNA. (23.8 - 24.2 min).] [NT:ORF_ID:o232#5] [LE:4404] [RE:5561] [DI:complement] >gp:[GI:g1787285] [LN:AE000206] [AC:AE000206:U00096] [PN:orf, hypothetical protein] [GN:ymdD] [FN:orf; Unknown] [OR:Escherichia coli] [DB:genpept-bct2] [DE:Escherichia coli K-12 MG1655 section 96 of 400 of the completegenome.] [NT:f385; This 385 aa ORF is 24 pct identical (21 gaps)] [LE:2042] [RE:3199] [DI:complement]

| ORF_Name | NT ID | AA ID | NT/LN | AA/LN | Score | P-value |
|---|---|---|---|---|---|---|
| 25839540_c2_684 | 336 | 7507 | 1029 | 342 | 124 | 8.1e-06 |

Description gp:[GI:g642964] [LN:ABCARRA] [AC:X70360] [GN:carR] [OR:Azospirillum brasilense] [DB:genpept-bct1] [DE:A.brasilense carR gene.] [LE:<1] [RE:588] [DI:direct]

| ORF_Name | NT ID | AA ID | NT/LN | AA/LN | Score | P-value |
|---|---|---|---|---|---|---|
| 25910155_c3_841 | 337 | 7508 | 774 | 257 | 1240 | 3.3e-126 |

Description sp:[LN:YCJK_ECOLI] [AC:P78061] [GN:YCJK] [OR:Escherichia coli] [EC:6.3.1.2] [DE:LIGASE)] [SP:P78061] [DB:swissprot] >sp:[LN:D64878] [AC:D64878] [PN:probable glutamate--ammonia ligase,:probable glutamine synthetase] [OR:Escherichia coli] [EC:6.3.1.2] [DB:pir2] >gp:[GI:g1787555] [LN:AE000228] [AC:AE000228:U00096] [PN:putative glutamine synthetase (EC 6.3.1.2)] [GN:b1297] [FN:putative enzyme; Not classified] [OR:Escherichia coli] [DB:genpept-bct2] [DE:Escherichia coli K-12 MG1655 section 118 of 400 of the completegenome.] [NT:f498; This 498 aa ORF is 31 pct identical (29 gaps)] [LE:155] [RE:1651] [DI:complement]

| ORF_Name | NT ID | AA ID | NT/LN | AA/LN | Score | P-value |
|---|---|---|---|---|---|---|
| 2628165_f2_181 | 338 | 7509 | 288 | 95 | | |

Description

NO-HIT

| ORF Name | NT ID | AA ID | NT LN | AA LN | Score | P-value |
|---|---|---|---|---|---|---|
| 2632026_f3_427 | 339 | 7510 | 1410 | 469 | 120 | 0.0014 |

Description sp:[LN:REPT_MOUSE] [AC:P97347] [GN:RPTN] [OR:Mus musculus] [SR:,Mouse]
[DE:REPETIN] [SP:P97347] [DB:swissprot] >gp:[GI:e264335:g1806132] [LN:MMREPETIN]
[AC:X99251] [PN:repetin] [OR:Mus musculus] [SR:house mouse] [DB:genpept-rod]
[DE:M.musculus gene encoding repetin.] [SP:P97347] [LE:4359:4880] [RE:4496:8134]
[DI:directJoin]

| ORF Name | NT ID | AA ID | NT LN | AA LN | Score | P-value |
|---|---|---|---|---|---|---|
| 26649012_c3_892 | 340 | 7511 | 1602 | 533 | 2495 | 3.4e-259 |

Description sp:[LN:MDOG_ECOLI] [AC:P33136] [GN:MDOG] [OR:Escherichia coli] [DE:PERIPLASMIC
GLUCANS BIOSYNTHESIS PROTEIN MDOG PRECURSOR] [SP:P33136] [DB:swissprot]
>sp:[LN:S35417] [AC:S35417:S39649:E64847] [PN:glucans biosynthesis protein G
precursor, periplasmic] [GN:mdoG] [CL:periplasmic glucans biosynthesis protein
mdoG] [OR:Escherichia coli] [DB:pir2] >gp:[GI:d1036832:g1651515] [LN:D90742]
[AC:D90742:AB001340] [PN:MdoG protein.] [GN:mdoG] [OR:Escherichia coli]
[SR:Escherichia coli(strain:K12) DNA, clone:Kohara clone #232] [DB:genpept-bct1]
[DE:Escherichia coli genomic DNA. (23.8 - 24.2 min).] [NT:ORF_ID:o232#6; similar
to PIR Accession Number] [LE:5955] [RE:7490] [DI:direct] >gp:[GI:g396490]
[LN:ECMDOGH] [AC:X64197] [GN:MdoG] [OR:Escherichia coli] [DB:genpept-bct1]
[DE:E.coli mdoGH gene.] [SP:P33136] [LE:423] [RE:1958] [DI:direct]
>gp:[GI:g1787286] [LN:AE000206] [AC:AE000206:U00096] [PN:periplasmic glucans
biosynthesis protein] [GN:mdoG] [FN:enzyme; Osmotic adaptation] [OR:Escherichia
coli] [DB:genpept-bct2] [DE:Escherichia coli K-12 MG1655 section 96 of 400 of the
completegenome.] [NT:o511; 100 pct identical to MDOG_ECOLI SW: P33136] [LE:3593]
[RE:5128] [DI:direct]

| ORF Name | NT ID | AA ID | NT LN | AA LN | Score | P-value |
|---|---|---|---|---|---|---|
| 26750952_c3_847 | 341 | 7512 | 1266 | 421 | 1717 | 9.4e-177 |

Description sp:[LN:AGP_ECOLI] [AC:P19926] [GN:AGP] [OR:Escherichia coli] [EC:3.1.3.10]
[DE:GLUCOSE-1-PHOSPHATASE PRECURSOR, (G1PASE)] [SP:P19926] [DB:swissprot]
>sp:[LN:JV0087] [AC:JV0087:H64841] [PN:glucose-1-phosphatase, precursor] [GN:agp]
[OR:Escherichia coli] [EC:3.1.3.10] [DB:pir2] [MP:23 min]
>gp:[GI:d1036755:g1651498] [LN:D90737] [AC:D90737:AB001340]
[PN:Glucose-1-phosphatase precursor (EC 3.1.3.10)] [GN:agp] [OR:Escherichia coli]
[SR:Escherichia coli(strain:K12) DNA, clone:Kohara clone #227] [DB:genpept-bct1]
[DE:Escherichia coli genomic DNA. (22.8 - 23.1 min).] [NT:ORF_ID:o227#9; similar
to SwissProt Accession] [LE:11082] [RE:12323] [DI:direct] >gp:[GI:g145218]
[LN:ECOAGPA] [AC:M33807] [OR:Escherichia coli] [SR:E.coli DNA, clone pEP1376]
[DB:genpept-bct1] [DE:E.coli periplasmic acid glucose-1-phosphatase (agp) gene,
completecds.] [NT:glucose-1-phosphatase precursor (agp)] [LE:167] [RE:1408]
[DI:direct] >gp:[GI:g1787237] [LN:AE000202] [AC:AE000202:U00096] [PN:periplasmic
glucose-1-phosphatase] [GN:agp] [FN:enzyme; Central intermediary metabolism:
Pool,] [OR:Escherichia coli] [DB:genpept-bct2] [EC:3.1.3.10] [DE:Escherichia coli
K-12 MG1655 section 92 of 400 of the completegenome.] [NT:o413; 100 pct identical
to AGP_ECOLI SW: P19926] [LE:3141] [RE:4382] [DI:direct]

| ORF Name | NT ID | AA ID | NT LN | AA LN | Score | P-value |
|---|---|---|---|---|---|---|
| 26757807_c3_882 | 342 | 7513 | 315 | 104 | 76 | 0.039 |

Description sp:[LN:C70390] [AC:C70390] [PN:formate dehydrogenase formation protein FdhE]
[GN:fdhE] [OR:Aquifex aeolicus] [DB:pir2] >gp:[GI:g2983531] [LN:AE000720]
[AC:AE000720:AE000657] [PN:formate dehydrogenase formation protein FdhE]
[GN:fdhE] [OR:Aquifex aeolicus] [DB:genpept-bct2] [DE:Aquifex aeolicus section 52
of 109 of the complete genome.] [LE:7327] [RE:8178] [DI:direct]

| ORF Name | NT ID | AA ID | NT LN | AA LN | Score | P-value |
|---|---|---|---|---|---|---|
| 26776416_f3_447 | 343 | 7514 | 357 | 118 | 304 | 5.1e-27 |

Description sp:[LN:PTWX_ECOLI] [AC:P32676] [GN:FRWD] [OR:Escherichia coli] [EC:2.7.1.69]
[DE:II, B COMPONENT),] [SP:P32676] [DB:swissprot] >sp:[LN:D65202] [AC:D65202]
[PN:PTS system, fructose-like-2 IIB component 2 (phosphotransferase)] [GN:frwD]
[CL:phosphotransferase system, fructose-like component IIB] [OR:Escherichia coli]
[DB:pir2] >gp:[GI:g1790390] [LN:AE000469] [AC:AE000469:U00096] [PN:PTS system
fructose-like IIB component 2] [GN:frwD] [FN:enzyme; Degradation of small
molecules: Carbon] [OR:Escherichia coli] [DB:genpept-bct2] [DE:Escherichia coli
K-12 MG1655 section 359 of 400 of the completegenome.] [NT:o113; 100 pct
identical amino acid sequence and] [LE:4906] [RE:5247] [DI:direct]
>gp:[GI:g396300] [LN:ECOUW89] [AC:U00006] [OR:Escherichia coli] [SR:Escherichia
coli (sub_strain MG1655, strain K-12) (library: lambda] [DB:genpept-bct2] [DE:E.
coli chromosomal region from 89.2 to 92.8 minutes.] [NT:similar to
phosphotransferase system enzyme II] [LE:12379] [RE:12720] [DI:direct]

| ORF Name | NT ID | AA ID | NT LN | AA LN | Score | P-value |
|---|---|---|---|---|---|---|
| 29725925_c3_884 | 344 | 7515 | 1209 | 402 | 514 | 2.8e-49 |

Description sp:[LN:YBEQ_ECOLI] [AC:P77234] [GN:YBEQ] [OR:Escherichia coli] [DE:HYPOTHETICAL 37.3 KD PROTEIN IN LEUS-GLTL INTERGENIC REGION] [SP:P77234] [DB:swissprot] >sp:[LN:B64799] [AC:B64799] [PN:hypothetical protein b0644] [OR:Escherichia coli] [DB:pir2] >gp:[GI:d1036277:g4062259] [LN:D90704] [AC:D90704:AB001340] [PN:Sel-1 protein] [OR:Escherichia coli] [SR:Escherichia coli(strain:K12) DNA, clone:Kohara clone #169] [DB:genpept-bct1] [DE:Escherichia coli genomic DNA. (14.3 - 14.7 min).] [NT:ORF_ID:o169#12; similar to PIR Accession Number] [LE:11818] [RE:12801] [DI:complement] >gp:[GI:g1778562] [LN:ECU82598] [AC:U82598] [OR:Escherichia coli] [DB:genpept-bct1] [DE:Escherichia coli genomic sequence of minutes 9 to 12.] [NT:hypothetical protein] [LE:116200] [RE:117183] [DI:complement] >gp:[GI:g1786864] [LN:AE000169] [AC:AE000169:U00096] [PN:orf, hypothetical protein] [GN:ybeQ] [FN:orf; Unknown] [OR:Escherichia coli] [DB:genpept-bct2] [DE:Escherichia coli K-12 MG1655 section 59 of 400 of the completegenome.] [NT:f327; This 327 aa ORF is 31 pct identical (15 gaps)] [LE:700] [RE:1683] [DI:complement]

| ORF Name | NT ID | AA ID | NT LN | AA LN | Score | P-value |
|---|---|---|---|---|---|---|
| 29897801_f1_119 | 345 | 7516 | 345 | 114 | 474 | 4.9e-45 |

Description sp:[LN:PTWB_ECOLI] [AC:P32673] [GN:FRWB] [OR:Escherichia coli] [EC:2.7.1.69] [DE:II, B COMPONENT),] [SP:P32673] [DB:swissprot] >sp:[LN:A65202] [AC:A65202] [PN:pts system, fructose-like-2 IIb component 1] [GN:frwB] [CL:phosphotransferase system, fructose-like component IIB] [OR:Escherichia coli] [DB:pir2] >gp:[GI:g1790387] [LN:AE000469] [AC:AE000469:U00096] [PN:PTS system fructose-like IIB component 1] [GN:frwB] [FN:enzyme; Degradation of small molecules: Carbon] [OR:Escherichia coli] [DB:genpept-bct2] [DE:Escherichia coli K-12 MG1655 section 359 of 400 of the completegenome.] [NT:o106; 100 pct identical amino acid sequence and] [LE:1392] [RE:1712] [DI:direct] >gp:[GI:g396297] [LN:ECOUW89] [AC:U00006] [OR:Escherichia coli] [SR:Escherichia coli (sub_strain MG1655, strain K-12) (library: lambda] [DB:genpept-bct2] [DE:E. coli chromosomal region from 89.2 to 92.8 minutes.] [NT:similar to phosphotransferase system enzyme II] [LE:8865] [RE:9185] [DI:direct]

| ORF_Name | NT_ID | AA_ID | NT LN | AA LN | Score | P-value |
|---|---|---|---|---|---|---|
| 29979700_c2_772 | 346 | 7517 | 582 | 193 | 730 | 3.7e-72 |

Description sp:[LN:RLUC_ECOLI] [AC:P23851] [GN:RLUC] [OR:Escherichia coli] [EC:4.2.1.70]
[DE:(PSEUDOURIDYLATE SYNTHASE) (URACIL HYDROLYASE)] [SP:P23851] [DB:swissprot]
>sp:[LN:C64852] [AC:C64852:B23747] [PN:probable pseudouridylate synthase yceC]
[GN:yceC] [CL:conserved hypothetical protein HI0176] [OR:Escherichia coli]
[DB:pir2] >gp:[GI:d1036880:g4062660] [LN:D90744] [AC:D90744:AB001340]
[PN:Hypothetical 36.0 kd protein in rne-rpmF] [GN:yceC] [OR:Escherichia coli]
[SR:Escherichia coli(strain:K12) DNA, clone:Kohara clone #234] [DB:genpept-bct1]
[DE:Escherichia coli genomic DNA. (24.5 - 24.8 min).] [NT:ORF_ID:o235#4; similar
to SwissProt Accession] [LE:11894] [RE:12853] [DI:direct] >gp:[GI:g1787327]
[LN:AE000209] [AC:AE000209:U00096] [PN:orf, hypothetical protein] [GN:yceC]
[FN:orf; Unknown] [OR:Escherichia coli] [DB:genpept-bct2] [DE:Escherichia coli
K-12 MG1655 section 99 of 400 of the completegenome.] [NT:o319; 100 pct identical
to YCEC_ECOLI SW: P23851] [LE:6625] [RE:7584] [DI:direct]

| ORF_Name | NT_ID | AA_ID | NT LN | AA LN | Score | P-value |
|---|---|---|---|---|---|---|
| 30363325_c2_707 | 347 | 7518 | 1257 | 418 | | |

Description

NO-HIT

| ORF_Name | NT_ID | AA_ID | NT LN | AA LN | Score | P-value |
|---|---|---|---|---|---|---|
| 30367842_c1_555 | 348 | 7519 | 651 | 216 | 897 | 7.4e-90 |

Description sp:[LN:YCDC_ECOLI] [AC:P75899] [GN:YCDC] [OR:Escherichia coli] [DE:HYPOTHETICAL
TRANSCRIPTIONAL REGULATOR IN WRBA-PUTA INTERGENIC REGION] [SP:P75899]
[DB:swissprot] >sp:[LN:C64843] [AC:C64843] [PN:probable transcription regulator
ycdC] [GN:ycdC] [OR:Escherichia coli] [DB:pir2] >gp:[GI:d1036776:g4062576]
[LN:D90738] [AC:D90738:AB001340] [PN:OrfA 3' of hemY] [GN:yixD] [OR:Escherichia
coli] [SR:Escherichia coli(strain:K12) DNA, clone:Kohara clone #228]
[DB:genpept-bct1] [DE:Escherichia coli genomic DNA. (23.0 - 23.4 min).]
[NT:ORF_ID:o228#11; similar to PIR Accession Number] [LE:8203] [RE:8841]
[DI:direct] >gp:[GI:g1787249] [LN:AE000203] [AC:AE000203:U00096] [PN:putative tet
operon regulator] [GN:ycdC] [FN:putative regulator; Not classified]
[OR:Escherichia coli] [DB:genpept-bct2] [DE:Escherichia coli K-12 MG1655 section
93 of 400 of the completegenome.] [NT:o212; This 212 aa ORF is 22 pct identical
(1 gap)] [LE:146] [RE:784] [DI:direct]

| ORF Name | NT ID | AA ID | NT/LN | AA/LN | Score | P-value |
|---|---|---|---|---|---|---|
| 30554752_f1_36 | 349 | 7520 | 429 | 142 | 551 | 3.4e-53 |

Description sp:[LN:MSYB_ECOLI] [AC:P25738:P75922] [GN:MSYB] [OR:Escherichia coli] [DE:ACIDIC PROTEIN MSYB] [SP:P25738:P75922] [DB:swissprot] >gp:[GI:d1036836:g1651517] [LN:D90742] [AC:D90742:AB001340] [PN:MsyB protein.] [GN:msyB] [OR:Escherichia coli] [SR:Escherichia coli(strain:K12) DNA, clone:Kohara clone #232] [DB:genpept-bct1] [DE:Escherichia coli genomic DNA. (23.8 - 24.2 min).] [NT:ORF_ID:o233#1; similar to PIR Accession Number] [LE:10427] [RE:10801] [DI:complement] >gp:[GI:d1036847:g1651521] [LN:D90743] [AC:D90743:AB001340] [PN:MsyB protein.] [GN:msyB] [OR:Escherichia coli] [SR:Escherichia coli(strain:K12) DNA, clone:Kohara clone #233] [DB:genpept-bct1] [DE:Escherichia coli genomic DNA. (24.1 - 24.5 min).] [NT:ORF_ID:o233#1; similar to PIR Accession Number] [LE:173] [RE:547] [DI:complement] >gp:[GI:g42030] [LN:ECMSYB] [AC:X59939:S83617] [GN:msyB] [OR:Escherichia coli] [DB:genpept-bct1] [DE:E.coli ORF1 and msyB gene for membrane protein and multicopysuppressor of secY24 mutation protein.] [SP:P25738] [LE:1805] [RE:2179] [DI:direct]

| ORF Name | NT ID | AA ID | NT/LN | AA/LN | Score | P-value |
|---|---|---|---|---|---|---|
| 3126583_c3_805 | 350 | 7521 | 330 | 109 | 339 | 9.9e-31 |

Description sp:[LN:ACYP_ECOLI] [AC:P75877] [GN:YCCX] [OR:Escherichia coli] [EC:3.6.1.7] [DE:PHOSPHOHYDROLASE)] [SP:P75877] [DB:swissprot] >sp:[LN:G64837] [AC:G64837] [PN:probable acylphosphatase,] [GN:yccX] [CL:acylphosphatase] [OR:Escherichia coli] [EC:3.6.1.7] [DB:pir2] >gp:[GI:g1787203] [LN:AE000199] [AC:AE000199:U00096] [PN:orf, hypothetical protein] [GN:b0968] [FN:orf; Unknown] [OR:Escherichia coli] [DB:genpept-bct2] [DE:Escherichia coli K-12 MG1655 section 89 of 400 of the completegenome.] [NT:o93; 44 pct identical (2 gaps) to 85 residues] [LE:121] [RE:399] [DI:direct]

| ORF Name | NT ID | AA ID | NT/LN | AA/LN | Score | P-value |
|---|---|---|---|---|---|---|
| 31369791_c1_546 | 351 | 7522 | 1101 | 366 | 270 | 2.0e-23 |

Description sp:[LN:F72219] [AC:F72219] [PN:conserved hypothetical protein] [GN:TM1722] [OR:Thermotoga maritima] [DB:pir2] >gp:[GI:g4982299] [LN:AE001811] [AC:AE001811:AE000512] [PN:conserved hypothetical protein] [GN:TM1722] [OR:Thermotoga maritima] [DB:genpept-bct2] [DE:Thermotoga maritima section 123 of 136 of the complete genome.] [NT:similar to GB:Pyro_h percent identity: 61.40;] [LE:7297] [RE:8163] [DI:direct]

| ORF Name | NT ID | AA ID | NT LN | AA LN | Score | P-value |
|---|---|---|---|---|---|---|
| 31433162_f3_411 | 352 | 7523 | 1194 | 397 | 1801 | 1.2e-185 |

Description sp:[LN:B64843] [AC:B64843] [PN:hypothetical protein b1012] [OR:Escherichia coli]
[DB:pir2] >gp:[GI:d1036775:g4062575] [LN:D90738] [AC:D90738:AB001340]
[PN:Hypothetical 49.3 kd protein in idh-deoR] [GN:yxeK] [OR:Escherichia coli]
[SR:Escherichia coli(strain:K12) DNA, clone:Kohara clone #228] [DB:genpept-bct1]
[DE:Escherichia coli genomic DNA. (23.0 - 23.4 min).] [NT:ORF_ID:o228#10; similar
to SwissProt Accession] [LE:6824] [RE:7972] [DI:complement] >gp:[GI:g1787247]
[LN:AE000202] [AC:AE000202:U00096] [PN:orf, hypothetical protein] [GN:b1012]
[FN:orf; Unknown] [OR:Escherichia coli] [DB:genpept-bct2] [DE:Escherichia coli
K-12 MG1655 section 92 of 400 of the completegenome.] [NT:f382; This 382 aa ORF
is 23 pct identical (14 gaps)] [LE:10419] [RE:11567] [DI:complement]

| ORF Name | NT ID | AA ID | NT LN | AA LN | Score | P-value |
|---|---|---|---|---|---|---|
| 31462776_f2_309 | 353 | 7524 | 663 | 220 | 1031 | 4.6e-104 |

Description sp:[LN:YCCA_ECOLI] [AC:P06967] [GN:YCCA] [OR:Escherichia coli] [DE:HYPOTHETICAL
23.4 KD PROTEIN IN HELD-SERT INTERGENIC REGION] [SP:P06967] [DB:swissprot]
>sp:[LN:S07180] [AC:S07180:A64838] [PN:probable glutamate receptor yccA]
[GN:yccA] [CL:Escherichia coli ybhL protein] [OR:Escherichia coli] [DB:pir2]
[MP:22 min] >gp:[GI:d1036721:g4062537] [LN:D90734] [AC:D90734:AB001340]
[PN:Hypothetical protein, 23.5k] [GN:yccA] [OR:Escherichia coli] [SR:Escherichia
coli(strain:K12) DNA, clone:Kohara clone #223] [DB:genpept-bct1] [DE:Escherichia
coli genomic DNA. (22.0 - 22.3 min).] [NT:ORF_ID:o224#3; similar to PIR Accession
Number] [LE:12282] [RE:12941] [DI:complement] >gp:[GI:g41284] [LN:ECDIVE]
[AC:X00547] [OR:Escherichia coli] [DB:genpept-bct1] [DE:E.coli tRNA-Ser-1 and
put. 23.5kD protein gene.] [NT:put. 23.5-kd protein] [SP:P06967] [LE:422]
[RE:1081] [DI:direct] >gp:[GI:g1787205] [LN:AE000199] [AC:AE000199:U00096]
[PN:putative carrier/transport protein] [GN:yccA] [FN:putative transport; Not
classified] [OR:Escherichia coli] [DB:genpept-bct2] [DE:Escherichia coli K-12
MG1655 section 89 of 400 of the completegenome.] [NT:f219; 100 pct identical to
YCCA_ECOLI SW: P06967] [LE:816] [RE:1475] [DI:complement]

| ORF Name | NT ID | AA ID | NT LN | AA LN | Score | P-value |
|---|---|---|---|---|---|---|
| 31645177_f1_59 | 354 | 7525 | 1623 | 540 | 399 | 4.4e-37 |

Description gp:[GI:e274873:g1907076] [LN:HSPIRIN1] [AC:Y07867] [PN:pirin] [OR:Homo sapiens]
[SR:human] [DB:genpept-pri1] [DE:H.sapiens mRNA for Pirin, isolate 1.] [LE:205]
[RE:1077] [DI:direct] >gp:[GI:e274874:g1907078] [LN:HSPIRIN17] [AC:Y07868]
[PN:pirin] [OR:Homo sapiens] [SR:human] [DB:genpept-pri1] [DE:H.sapiens mRNA for
Pirin, isolate 17.] [LE:231] [RE:1103] [DI:direct]

| ORF Name | NT ID | AA ID | NT LN | AA LN | Score | P-value |
|---|---|---|---|---|---|---|
| 31723755_c1_587 | 355 | 7526 | 603 | 200 | 610 | 1.9e-59 |

Description sp:[LN:B64847] [AC:B64847] [PN:hypothetical protein b1045] [OR:Escherichia coli]
[DB:pir2] >gp:[GI:d1036821:g4062616] [LN:D90741] [AC:D90741:AB001340] [PN:ORF2]
[OR:Escherichia coli] [SR:Escherichia coli(strain:K12) DNA, clone:Kohara clone
231] [DB:genpept-bct1] [DE:Escherichia coli genomic DNA. (23.7 - 24.0 min).]
[NT:ORF_ID:o232#3; similar to PIR Accession Number] [LE:10422] [RE:10955]
[DI:direct] >gp:[GI:d1036829:g4062622] [LN:D90742] [AC:D90742:AB001340] [PN:ORF2]
[OR:Escherichia coli] [SR:Escherichia coli(strain:K12) DNA, clone:Kohara clone
232] [DB:genpept-bct1] [DE:Escherichia coli genomic DNA. (23.8 - 24.2 min).]
[NT:ORF_ID:o232#3; similar to PIR Accession Number] [LE:2440] [RE:2973]
[DI:direct] >gp:[GI:g1787283] [LN:AE000206] [AC:AE000206:U00096] [PN:putative
polyprotein] [GN:b1045] [FN:orf; Unknown function] [OR:Escherichia coli]
[DB:genpept-bct2] [DE:Escherichia coli K-12 MG1655 section 96 of 400 of the
completegenome.] [NT:o177; This 177 aa ORF is 31 pct identical (4 gaps)] [LE:78]
[RE:611] [DI:direct]

| ORF Name | NT ID | AA ID | NT LN | AA LN | Score | P-value |
|---|---|---|---|---|---|---|
| 31756256_f2_266 | 356 | 7527 | 1344 | 447 | 1922 | 1.8e-198 |

Description sp:[LN:YCDG_ECOLI] [AC:P75892] [GN:YCDG] [OR:Escherichia coli] [DE:HYPOTHETICAL
48.1 KD PROTEIN IN WRBA-PUTA INTERGENIC REGION] [SP:P75892] [DB:swissprot]
>sp:[LN:D64842] [AC:D64842] [PN:probable transport protein ycdG:probable permease
ycdG] [GN:ycdG] [CL:uracil transport protein uraA] [OR:Escherichia coli]
[DB:pir2] >gp:[GI:g1787241] [LN:AE000202] [AC:AE000202:U00096] [PN:putative
transport protein] [GN:ycdG] [FN:putative transport; Not classified]
[OR:Escherichia coli] [DB:genpept-bct2] [DE:Escherichia coli K-12 MG1655 section
92 of 400 of the completegenome.] [NT:f464; This 464 aa ORF is 41 pct identical
(30 gaps)] [LE:6067] [RE:7461] [DI:complement]

| ORF Name | NT ID | AA ID | NT LN | AA LN | Score | P-value |
|---|---|---|---|---|---|---|
| 32110468_c3_811 | 357 | 7528 | 195 | 64 | | |

Description

NO-HIT

| ORF Name | NT ID | AA ID | NT/LN | AA/LN | Score | P-value |
|---|---|---|---|---|---|---|
| 32157277_f2_279 | 358 | 7529 | 1347 | 448 | 2015 | 2.5e-208 |

Description sp:[LN:ORDL_ECOLI] [AC:P37906] [GN:ORDL] [OR:Escherichia coli] [EC:1.-.-.-]
[DE:PROBABLE OXIDOREDUCTASE ORDL,] [SP:P37906] [DB:swissprot] >sp:[LN:H64878]
[AC:H64878] [PN:probable oxidoreductase, ordL] [GN:ordL] [CL:hypothetical protein
HI0499] [OR:Escherichia coli] [EC:1.-.-.-] [DB:pir2] >gp:[GI:d1015586:g1742131]
[LN:D90768] [AC:D90768:AB001340] [PN:Probable oxidoreductase OrdL (EC 1.-.-.-).]
[GN:ordL] [OR:Escherichia coli] [SR:Escherichia coli (strain:K12) DNA,
clone_lib:Kohara lambda minise] [DB:genpept-bct1] [DE:E.coli genomic DNA, Kohara
clone #257(29.1-29.6 min.).] [NT:ORF_ID:o257#10; similar to [SwissProt Accession]
[LE:11602] [RE:12882] [DI:direct] >gp:[GI:g1787559] [LN:AE000228]
[AC:AE000228:U00096] [PN:probable oxidoreductase] [GN:ordL] [FN:putative enzyme;
Not classified] [OR:Escherichia coli] [DB:genpept-bct2] [DE:Escherichia coli K-12
MG1655 section 118 of 400 of the completegenome.] [NT:o426; 100 pct identical to
GB: ECU38543_1] [LE:4897] [RE:6177] [DI:direct] >gp:[GI:g1054921] [LN:ECU38543]
[AC:U38543] [PN:oxidoreductase] [GN:ordL] [OR:Escherichia coli] [SR:Escherichia
coli strain=K-12] [DB:genpept-bct2] [DE:Escherichia coli oxidoreductase (ordL)
and GABA-aminotransferase(goaG) genes, complete cds.] [NT:hypothetical 47.1kDa
protein; OrdL; ORFY] [LE:1] [RE:1281] [DI:direct]

| ORF Name | NT ID | AA ID | NT/LN | AA/LN | Score | P-value |
|---|---|---|---|---|---|---|
| 32204550_c3_928 | 359 | 7530 | 1356 | 451 | 2039 | 7.1e-211 |

Description sp:[LN:I41060] [AC:I41060:I84544:D64853] [PN:3-oxoacyl-[acyl-carrier-protein]
synthase, II] [GN:fabF:fabJ] [CL:3-oxoacyl-[acyl-carrier-protein] synthase
I:3-oxoacyl-[acyl-carrier-protein] synthase I homology] [OR:Escherichia coli]
[EC:2.3.1.41] [DB:pir2] >gp:[GI:d1036889:g4062664] [LN:D90745]
[AC:D90745:AB001340] [PN:3-oxoacyl-[acyl-carrier-protein] synthase (EC] [GN:fabF]
[OR:Escherichia coli] [SR:Escherichia coli(strain:K12) DNA, clone:Kohara clone
236] [DB:genpept-bct1] [DE:Escherichia coli genomic DNA. (24.8 - 25.2 min).]
[NT:ORF_ID:o236#4; similar to PIR Accession Number] [LE:2582] [RE:3823]
[DI:direct] >gp:[GI:g572680] [LN:ECFABJ] [AC:Z34979] [PN:beta ketoacyl-acyl
carrier protein synthase] [GN:fabF] [FN:condensation of malonyl-ACP with
acyl-ACP] [OR:Escherichia coli] [DB:genpept-bct1] [EC:2.3.1.41] [DE:E.coli fabJ
gene encoding beta ketoacyl-acyl carrier proteinsynthase.] [NT:alternative name,
fabJ] [SP:P39435] [LE:73] [RE:1314] [DI:direct] >gp:[GI:g664870] [LN:ECU20767]
[AC:U20767:L39768] [PN:beta-ketoacyl-acyl carrier protein synthase II] [GN:fabF]
[OR:Escherichia coli] [DB:genpept-bct1] [DE:Escherichia coli beta-ketoacyl-acyl
carrier protein synthase II(fabF) gene, complete cds.] [NT:Allele: wild type;
3-oxoacyl-acyl carrier] [LE:91] [RE:1332] [DI:direct] >gp:[GI:g1787337]
[LN:AE000210] [AC:AE000210:U00096] [PN:3-oxoacyl-[acyl-carrier-protein] synthase
II] [GN:fabF] [FN:enzyme; Fatty acid and phosphatidic acid] [OR:Escherichia coli]
[DB:genpept-bct2] [EC:2.3.1.41] [DE:Escherichia coli K-12 MG1655 section 100 of
400 of the completegenome.] [NT:o413; 100 pct identical amino to FABF_ECOLI]
[LE:3244] [RE:4485] [DI:direct]

| ORF_Name | NT ID | AA ID | NT LN | AA LN | Score | P-value |
|---|---|---|---|---|---|---|
| 3255407_f2_264 | 360 | 7531 | 891 | 296 | 904 | 1.3e-90 |

Description sp:[LN:G64842] [AC:G64842] [PN:probable hydrolase b1009] [OR:Escherichia coli]
[DB:pir2] >gp:[GI:d1036762:g4062563] [LN:D90737] [AC:D90737:AB001340] [PN:BchO
protein] [GN:bchO] [OR:Escherichia coli] [SR:Escherichia coli(strain:K12) DNA,
clone:Kohara clone #227] [DB:genpept-bct1] [DE:Escherichia coli genomic DNA.
(22.8 - 23.1 min).] [NT:ORF_ID:o228#7; similar to PIR Accession Number]
[LE:16462] [RE:17262] [DI:complement] >gp:[GI:d1036772:g4062572] [LN:D90738]
[AC:D90738:AB001340] [PN:BchO protein] [GN:bchO] [OR:Escherichia coli]
[SR:Escherichia coli(strain:K12) DNA, clone:Kohara clone #228] [DB:genpept-bct1]
[DE:Escherichia coli genomic DNA. (23.0 - 23.4 min).] [NT:ORF_ID:o228#7; similar
to PIR Accession Number] [LE:4926] [RE:5726] [DI:complement] >gp:[GI:g1787244]
[LN:AE000202] [AC:AE000202:U00096] [PN:putative acetyltransferase] [GN:b1009]
[FN:putative enzyme; Not classified] [OR:Escherichia coli] [DB:genpept-bct2]
[DE:Escherichia coli K-12 MG1655 section 92 of 400 of the completegenome.]
[NT:f266; This 266 aa ORF is 38 pct identical (3 gaps)] [LE:8521] [RE:9321]
[DI:complement]

| ORF_Name | NT ID | AA ID | NT LN | AA LN | Score | P-value |
|---|---|---|---|---|---|---|
| 32616580_c2_756 | 361 | 7532 | 930 | 309 | 987 | 2.1e-99 |

Description sp:[LN:RIMJ_ECOLI] [AC:P09454] [GN:RIMJ] [OR:Escherichia coli] [EC:2.3.1.128]
[DE:(ACETYLATING ENZYME FOR N-TERMINAL OF RIBOSOMAL PROTEIN S5)] [SP:P09454]
[DB:swissprot] >sp:[LN:S01084] [AC:S01084:A45250:G64849]
[PN:ribosomal-protein-alanine N-acetyltransferase, rimJ] [GN:rimJ]
[CL:Escherichia coli ribosomal-protein-alanine N-acetyltransferase rimJ]
[OR:Escherichia coli] [EC:2.3.1.128] [DB:pir2] [MP:23.7 min]
>gp:[GI:d1036860:g1651524] [LN:D90743] [AC:D90743:AB001340]
[PN:Ribosomal-protein-alanine acetyltransferase (EC) [GN:rimJ] [OR:Escherichia
coli] [SR:Escherichia coli(strain:K12) DNA, clone:Kohara clone #233]
[DB:genpept-bct1] [DE:Escherichia coli genomic DNA. (24.1 - 24.5 min).]
[NT:ORF_ID:o233#14; similar to SwissProt Accession] [LE:11928] [RE:12512]
[DI:direct] >gp:[GI:g147655] [LN:ECORIMJA] [AC:M99278] [PN:acetylase] [GN:rimJ]
[OR:Escherichia coli] [SR:Escherichia coli (individual_isolate MC4100, strain
K-12) DNA] [DB:genpept-bct1] [DE:E. coli acetylase (rimJ) gene, complete cds.]
[LE:289] [RE:873] [DI:direct] >gp:[GI:g42744] [LN:ECRIMJ] [AC:X06118]
[OR:Escherichia coli] [DB:genpept-bct1] [DE:E.coli rimJ gene for acetylation of
ribosomal protein S5.] [NT:S5 (AA 1-194)] [SP:P09454] [LE:227] [RE:811]
[DI:direct] >gp:[GI:g1787305] [LN:AE000207] [AC:AE000207:U00096] [PN:acetylation
of N-terminal alanine of 30S] [GN:rimJ] [FN:enzyme; Ribosomes - maturation and]
[OR:Escherichia coli] [DB:genpept-bct2] [EC:2.3.1.128] [DE:Escherichia coli K-12
MG1655 section 97 of 400 of the completegenome.] [NT:o194; 100 pct identical to
RIMJ_ECOLI SW: P09454] [LE:8898] [RE:9482] [DI:direct]

| ORF Name | NT ID | AA ID | NT LN | AA LN | Score | P-value |
|---|---|---|---|---|---|---|
| 32627302_c2_728 | 362 | 7533 | 384 | 127 | 369 | 6.6e-34 |

Description sp:[LN:G25035] [AC:G25035] [PN:hypothetical protein 2] [OR:Escherichia coli]
[DB:pir2] >gp:[GI:g455439] [LN:CIAIAIMM] [AC:M13819] [OR:Plasmid ColIa]
[SR:Plasmid ColIa-CA53 DNA] [DB:genpept-bct1] [DE:Plasmid ColIa-CA53 colicin Ia
structural and immunity genes,complete cds.] [NT:ORF2] [LE:3335] [RE:3643]
[DI:direct]

| ORF Name | NT ID | AA ID | NT LN | AA LN | Score | P-value |
|---|---|---|---|---|---|---|
| 32660286_c1_499 | 363 | 7534 | 690 | 229 | 587 | 5.2e-57 |

Description sp:[LN:YBCL_ECOLI] [AC:P77368] [GN:YBCL] [OR:Escherichia coli] [DE:HYPOTHETICAL
19.5 KD PROTEIN IN EMRE-RUS INTERGENIC REGION] [SP:P77368] [DB:swissprot]
>sp:[LN:G64786] [AC:G64786] [PN:ybcL protein] [GN:ybcL] [CL:conserved
hypothetical protein ybhB] [OR:Escherichia coli] [DB:pir2] >gp:[GI:g1778459]
[LN:ECU82598] [AC:U82598] [PN:YbhB homolog] [OR:Escherichia coli]
[DB:genpept-bct1] [DE:Escherichia coli genomic sequence of minutes 9 to 12.]
[NT:similar to E. coli YbhB] [LE:11524] [RE:12075] [DI:direct] >gp:[GI:g1786757]
[LN:AE000160] [AC:AE000160:U00096] [PN:orf, hypothetical protein] [GN:ybcL]
[FN:orf; Unknown] [OR:Escherichia coli] [DB:genpept-bct2] [DE:Escherichia coli
K-12 MG1655 section 50 of 400 of the completegenome.] [NT:o183; phage stats]
[LE:4241] [RE:4792] [DI:direct]

| ORF Name | NT ID | AA ID | NT LN | AA LN | Score | P-value |
|---|---|---|---|---|---|---|
| 3304627_c3_901 | 364 | 7535 | 1131 | 376 | 1610 | 2.1e-165 |

Description gp:[GI:g48958] [LN:ECHTRB] [AC:X61000:S76453] [PN:Orf39.9] [OR:Escherichia coli]
[DB:genpept-bct1] [DE:E. coli K12 HtrB gene.] [SP:P24188] [LE:683] [RE:1735]
[DI:complement]

| ORF Name | NT ID | AA ID | NT LN | AA LN | Score | P-value |
|---|---|---|---|---|---|---|
| 33212757_f2_323 | 365 | 7536 | 513 | 170 | 634 | 5.5e-62 |

Description sp:[LN:SULA_ENTAE] [AC:P08848] [GN:SULA] [OR:Enterobacter aerogenes]
[SR:,Aerobacter aerogenes] [DE:CELL DIVISION INHIBITOR] [SP:P08848]
[DB:swissprot] >sp:[LN:C29016] [AC:C29016] [PN:cell division inhibitor sulA]
[GN:sulA] [CL:cell division inhibitor sulA] [OR:Enterobacter aerogenes] [DB:pir2]
>gp:[GI:g148377] [LN:ENTSULA] [AC:M16467] [OR:Enterobacter aerogenes]
[SR:E.aerogenes DNA, clone pTU7En] [DB:genpept-bct1] [DE:E.aerogenes sulA gene
encoding inhibition of cell division,complete cds.] [NT:sulA protein] [LE:147]
[RE:656] [DI:direct]

| ORF Name | NT ID | AA ID | NT LN | AA LN | Score | P-value |
|---|---|---|---|---|---|---|
| 33364532_f3_432 | 366 | 7537 | 810 | 269 | 1168 | 1.4e-118 |

Description sp:[LN:E64878] [AC:E64878] [PN:ycjL protein:conserved hypothetical protein b1298]
[OR:Escherichia coli] [DB:pir2] >gp:[GI:g1787556] [LN:AE000228]
[AC:AE000228:U00096] [PN:probable amidotransferase subunit] [GN:ycjL]
[FN:putative enzyme; Not classified] [OR:Escherichia coli] [DB:genpept-bct2]
[DE:Escherichia coli K-12 MG1655 section 118 of 400 of the completegenome.]
[NT:o258; This 258 aa ORF is 35 pct identical (9 gaps)] [LE:1773] [RE:2549]
[DI:direct]

| ORF Name | NT ID | AA ID | NT LN | AA LN | Score | P-value |
|---|---|---|---|---|---|---|
| 33401568_c2_638 | 367 | 7538 | 1251 | 416 | | |

Description

NO-HIT

| ORF Name | NT ID | AA ID | NT LN | AA LN | Score | P-value |
|---|---|---|---|---|---|---|
| 3382257_f3_423 | 368 | 7539 | 261 | 86 | 359 | 7.5e-33 |

Description sp:[LN:YCCJ_ECOLI] [AC:P46131] [GN:YCCJ] [OR:Escherichia coli] [DE:HYPOTHETICAL
8.5 KD PROTEIN IN AGP-WRBA INTERGENIC REGION] [SP:P46131] [DB:swissprot]
>sp:[LN:A64842] [AC:A64842] [PN:yccJ protein] [GN:yccJ] [OR:Escherichia coli]
[DB:pir2] >gp:[GI:d1036756:g4062557] [LN:D90737] [AC:D90737:AB001340]
[PN:Hypothetical 8.5 kd protein in agp 3'region.] [GN:yccJ] [OR:Escherichia coli]
[SR:Escherichia coli(strain:K12) DNA, clone:Kohara clone #227] [DB:genpept-bct1]
[DE:Escherichia coli genomic DNA. (22.8 - 23.1 min).] [NT:ORF_ID:o228#1; similar
to SwissProt Accession] [LE:12361] [RE:12588] [DI:complement]
>gp:[GI:d1036766:g4062566] [LN:D90738] [AC:D90738:AB001340] [PN:Hypothetical 8.5
kd protein in agp 3'region.] [GN:yccJ] [OR:Escherichia coli] [SR:Escherichia
coli(strain:K12) DNA, clone:Kohara clone #228] [DB:genpept-bct1] [DE:Escherichia
coli genomic DNA. (23.0 - 23.4 min).] [NT:ORF_ID:o228#1; similar to SwissProt
Accession] [LE:825] [RE:1052] [DI:complement] >gp:[GI:g1787238] [LN:AE000202]
[AC:AE000202:U00096] [PN:orf, hypothetical protein] [GN:yccJ] [FN:orf; Unknown]
[OR:Escherichia coli] [DB:genpept-bct2] [DE:Escherichia coli K-12 MG1655 section
92 of 400 of the completegenome.] [NT:f75; 100 pct identical to YCCJ_ECOLI SW:
P46131] [LE:4420] [RE:4647] [DI:complement]

| ORF Name | NT ID | AA ID | NT LN | AA LN | Score | P-value |
|---|---|---|---|---|---|---|
| 33988837_c1_633 | 369 | 7540 | 660 | 219 | 871 | 3.4e-89 |

Description gp:[GI:g1246364] [LN:SYNSUICC] [AC:L37442] [PN:thymidylate:zeocin resistance protein:NDP kinase] [GN:tmk:Sh ble:ndk] [OR:Cloning vector pZEO-SG4] [SR:Cloning vector pZEO-SG4 DNA] [DB:genpept-syn] [DE:Expression vector pZEO-SG4 cytosine deaminase:uracilphosphoribosyltransferase fusion protein (codA:upp) gene, completecds; thymidylate:zeocin resistance protein:NDP kinase fusionprotein (tmk:Sh ble:ndk) gene, complete cds.] [NT:Streptoalloteicchus hindustanus Sh ble gene fused] [LE:4767] [RE:6251] [DI:direct]

| ORF Name | NT ID | AA ID | NT LN | AA LN | Score | P-value |
|---|---|---|---|---|---|---|
| 34612562_c3_870 | 370 | 7541 | 1527 | 508 | 2456 | 4.6e-255 |

Description sp:[LN:PUTP_ECOLI] [AC:P07117] [GN:PUTP] [OR:Escherichia coli] [DE:SODIUM/PROLINE SYMPORTER (PROLINE PERMEASE)] [SP:P07117] [DB:swissprot] >sp:[LN:JGECPP] [AC:A30258:I54981:E64843] [PN:sodium/proline symporter:proline carrier protein:proline permease:proline transport protein] [GN:putP] [CL:proline carrier protein] [OR:Escherichia coli] [DB:pir1] [MP:23 min] >gp:[GI:d1036779:g1651504] [LN:D90738] [AC:D90738:AB001340] [PN:Proline carrier protein] [GN:putP] [OR:Escherichia coli] [SR:Escherichia coli(strain:K12) DNA, clone:Kohara clone #228] [DB:genpept-bct1] [DE:Escherichia coli genomic DNA. (23.0 - 23.4 min).] [NT:ORF_ID:o228#14; similar to PIR Accession Number] [LE:13266] [RE:14774] [DI:direct] >gp:[GI:g42602] [LN:ECPUTP] [AC:X05653:X06415] [OR:Escherichia coli] [DB:genpept-bct1] [DE:E.coli putP gene for proline carrier and regulatory region putC.] [NT:putP proline carrier (AA 1-502)] [SP:P07117] [LE:602] [RE:2110] [DI:direct] >gp:[GI:g1787251] [LN:AE000203] [AC:AE000203:U00096] [PN:major sodium/proline symporter] [GN:putP] [FN:transport; Transport of small molecules:] [OR:Escherichia coli] [DB:genpept-bct2] [DE:Escherichia coli K-12 MG1655 section 93 of 400 of the completegenome.] [NT:o502; 99 pct identical to PUTP_ECOLI SW: P07117] [LE:5209] [RE:6717] [DI:direct]

| ORF Name | NT ID | AA ID | NT LN | AA LN | Score | P-value |
|---|---|---|---|---|---|---|
| 35237753_f3_387 | 371 | 7542 | 378 | 125 | 157 | 1.1e-10 |

Description sp:[LN:T03567] [AC:T03567] [PN:probable integrase] [CL:satellite phage P4 integrase] [OR:Rhodobacter capsulatus] [DB:pir2] [MP:1] >gp:[GI:g3128368] [LN:AF010496] [AC:AF010496] [PN:prophage cp4-57 integrase] [OR:Rhodobacter capsulatus] [DB:genpept-bct2] [DE:Rhodobacter capsulatus strain SB1003, partial genome.] [LE:148606] [RE:149814] [DI:direct]

| ORF Name | NT ID | AA ID | NT LN | AA LN | Score | P-value |
|---|---|---|---|---|---|---|
| 35250808_c3_799 | 372 | 7543 | 207 | 68 | 71 | 0.036 |

Description gp:[GI:g664944] [LN:PVGAM1] [AC:X82416] [GN:GAM1] [OR:Plasmodium vivax]
[SR:malaria parasite P. vivax] [DB:genpept-invl] [DE:P.vivax GAM1 gene.] [LE:<1]
[RE:441] [DI:direct]

| ORF Name | NT ID | AA ID | NT LN | AA LN | Score | P-value |
|---|---|---|---|---|---|---|
| 35257833_c1_592 | 373 | 7544 | 2559 | 852 | 4076 | 0.0 |

Description sp:[LN:MDOH_ECOLI] [AC:P33137;P77371] [GN:MDOH] [OR:Escherichia coli]
[DE:PERIPLASMIC GLUCANS BIOSYNTHESIS PROTEIN MDOH] [SP:P33137;P77371]
[DB:swissprot] >sp:[LN:F64847] [AC:F64847;S35418;S39650] [PN:glucan biosynthesis
protein H] [GN:mdoH] [OR:Escherichia coli] [DB:pir2] >gp:[GI:d1036834;g1651516]
[LN:D90742] [AC:D90742;AB001340] [PN:MdoH protein.] [GN:mdoH] [OR:Escherichia
coli] [SR:Escherichia coli(strain:K12) DNA, clone:Kohara clone #232]
[DB:genpept-bct1] [DE:Escherichia coli genomic DNA. (23.8 - 24.2 min).]
[NT:ORF_ID:o232#8; similar to PIR Accession Number] [LE:7483] [RE:10026]
[DI:direct] >gp:[GI:g1787287] [LN:AE000206] [AC:AE000206;U00096] [PN:membrane
glycosyltransferase; synthesis of] [GN:mdoH] [FN:enzyme; Osmotic adaptation]
[OR:Escherichia coli] [DB:genpept-bct2] [DE:Escherichia coli K-12 MG1655 section
96 of 400 of the completegenome.] [NT:o847; 99 pct identical to MDOH_ECOLI SW:
P33137] [LE:5121] [RE:7664] [DI:direct]

| ORF Name | NT ID | AA ID | NT LN | AA LN | Score | P-value |
|---|---|---|---|---|---|---|
| 35345318_c3_832 | 374 | 7545 | 2532 | 843 | 2977 | 0.0 |

Description sp:[LN:PT1A_ECOLI] [AC:P32670] [GN:PTSA] [OR:Escherichia coli] [EC:2.7.3.9]
[DE:(PHOSPHOTRANSFERASE SYSTEM, ENZYME I) (ENZYME I-ANI)] [SP:P32670]
[DB:swissprot] >sp:[LN:F65201] [AC:F65201] [PN:phosphoenolpyruvate-protein
phosphotransferase ptsa,] [GN:ptsA] [CL:phosphotransferase system enzyme I
homology] [OR:Escherichia coli] [EC:2.7.3.-] [DB:pir2] >gp:[GI:g1790383]
[LN:AE000468] [AC:AE000468;U00096] [PN:PEP-protein phosphotransferase system
enzyme I] [GN:ptsA] [FN:enzyme; Transport of small molecules:] [OR:Escherichia
coli] [DB:genpept-bct2] [EC:2.7.3.-] [DE:Escherichia coli K-12 MG1655 section 358
of 400 of the completegenome.] [NT:f711; 100 pct identical amino acid sequence
and] [LE:11271] [RE:13406] [DI:complement] >gp:[GI:g409787] [LN:ECOUW89]
[AC:U00006] [OR:Escherichia coli] [SR:Escherichia coli (sub_strain MG1655, strain
K-12) (library: lambda] [DB:genpept-bct2] [DE:E. coli chromosomal region from
89.2 to 92.8 minutes.] [NT:similar to phosphotransferase system enzyme I]
[LE:4962] [RE:7097] [DI:complement]

| ORF Name | NT ID | AA ID | NT LN | AA LN | Score | P-value |
|---|---|---|---|---|---|---|
| 36069215_c1_588 | 375 | 7546 | 615 | 204 | 148 | 1.7e-10 |

Description sp:[LN:UIDR_ECOLI] [AC:Q59431] [GN:UIDR:GUSR] [OR:Escherichia coli] [DE:UID
OPERON REPRESSOR (GUS OPERON REPRESSOR)] [SP:Q59431] [DB:swissprot]
>sp:[LN:D64918] [AC:D64918] [PN:glucuronide repressor gusR] [GN:gusR:uidR]
[OR:Escherichia coli] [DB:pir2] >gp:[GI:d1016090:g1742672] [LN:D90805]
[AC:D90805:AB001340] [PN:Potential acrAB operon repressor.] [OR:Escherichia coli]
[SR:Escherichia coli (strain:K12) DNA, clone_lib:Kohara lambda minise]
[DB:genpept-bct1] [DE:E.coli genomic DNA, Kohara clone #314(36.3-36.7 min.).]
[NT:ORF_ID:o314#4; similar to [SwissProt Accession] [LE:11146] [RE:11736]
[DI:complement] >gp:[GI:g868019] [LN:ECOGUSRABC] [AC:M14641] [PN:glucuronide
repressor] [GN:gusR] [OR:Escherichia coli] [DB:genpept-bct1] [DE:Escherichia coli
K-12 gusRABC operon.] [NT:start codon is uncertain, could be 488 or 497] [LE:485]
[RE:1075] [DI:direct] >gp:[GI:g1787904] [LN:AE000257] [AC:AE000257:U00096]
[PN:repressor for uid operon] [GN:uidR] [FN:regulator; Degradation of small
molecules:] [OR:Escherichia coli] [DB:genpept-bct2] [DE:Escherichia coli K-12
MG1655 section 147 of 400 of the completegenome.] [NT:f196; 100 pct identical to
GB: ECOGUSRABC_2] [LE:8039] [RE:8629] [DI:complement]

| ORF Name | NT ID | AA ID | NT LN | AA LN | Score | P-value |
|---|---|---|---|---|---|---|
| 36131555_c2_727 | 376 | 7547 | 252 | 83 | | |

Description

NO-HIT

| ORF Name | NT ID | AA ID | NT LN | AA LN | Score | P-value |
|---|---|---|---|---|---|---|
| 36192165_f1_93 | 377 | 7548 | 618 | 205 | 927 | 4.9e-93 |

Description sp:[LN:B64842] [AC:B64842:I59246] [PN:trp repressor-binding protein:tryptophan
repressor-binding protein] [GN:wrbA] [CL:trp repressor-binding protein]
[OR:Escherichia coli] [DB:pir1] >gp:[GI:d1036757:g4062558] [LN:D90737]
[AC:D90737:AB001340] [PN:Trp repressor binding protein] [OR:Escherichia coli]
[SR:Escherichia coli(strain:K12) DNA, clone:Kohara clone #227] [DB:genpept-bct1]
[DE:Escherichia coli genomic DNA. (22.8 - 23.1 min).] [NT:ORF_ID:o228#2; similar
to PIR Accession Number] [LE:12609] [RE:13205] [DI:complement]
>gp:[GI:d1036767:g4062567] [LN:D90738] [AC:D90738:AB001340] [PN:Trp repressor
binding protein] [OR:Escherichia coli] [SR:Escherichia coli(strain:K12) DNA,
clone:Kohara clone #228] [DB:genpept-bct1] [DE:Escherichia coli genomic DNA.
(23.0 - 23.4 min).] [NT:ORF_ID:o228#2; similar to PIR Accession Number] [LE:1073]
[RE:1669] [DI:complement] >gp:[GI:g1787239] [LN:AE000202] [AC:AE000202:U00096]
[PN:trp repressor binding protein; affects] [GN:wrbA] [FN:regulator; Amino acid
biosynthesis: Tryptophan] [OR:Escherichia coli] [DB:genpept-bct2] [DE:Escherichia
coli K-12 MG1655 section 92 of 400 of the completegenome.] [NT:f198; 99 pct
identical to WRBA_ECOLI SW: P30849] [LE:4668] [RE:5264] [DI:complement]

| ORF Name | NT ID | AA ID | NT LN | AA LN | Score | P-value |
|---|---|---|---|---|---|---|
| 36214012_c1_577 | 378 | 7549 | 237 | 78 | 139 | 1.6e-09 |

Description sp:[LN:Y9K_BPP4] [AC:P12552] [OR:Bacteriophage P4] [DE:HYPOTHETICAL 9.7 KD
PROTEIN (ORF88) (PUTATIVE DNA-BINDING PROTEIN)] [SP:P12552] [DB:swissprot]
>sp:[LN:JW0029] [AC:JW0029] [PN:hypothetical 9.7K protein:orf88 protein:orf88
protein] [CL:Escherichia coli prophage cp4-57 regulatory protein alpA]
[OR:satellite phage P4] [DB:pir2] >gp:[GI:g15163] [LN:MYP4CG] [AC:X51522]
[OR:Bacteriophage P4] [DB:genpept-phg] [DE:Bacteriophage P4 complete DNA genome.]
[NT:ORF88 product (AA 1-88) (put. DNA-binding protein)] [SP:P12552] [LE:8764]
[RE:9030] [DI:complement] >gp:[GI:g15171] [LN:MYP4ER] [AC:X02534:M11913:M11914]
[OR:Bacteriophage P4] [DB:genpept-phg] [DE:Bacteriophage P4 (E.coli) essential
region DNA ( early genes).] [NT:unidentified reading frame (aa 1-88)] [SP:P12552]
[LE:2041] [RE:2307] [DI:direct]

| ORF Name | NT ID | AA ID | NT LN | AA LN | Score | P-value |
|---|---|---|---|---|---|---|
| 36431413_c1_630 | 379 | 7550 | 327 | 108 | 383 | 2.2e-35 |

Description sp:[LN:AYEC] [AC:C42147:A92042:A26935:C64853:S28389:A03398] [PN:acyl carrier
protein] [GN:acpP] [CL:acyl carrier protein:acyl carrier protein homology]
[OR:Escherichia coli] [DB:pir1] [MP:24 min] >gp:[GI:g1036888:g1651537]
[LN:D90745] [AC:D90745:AB001340] [PN:Acyl carrier protein] [GN:acpP]
[OR:Escherichia coli] [SR:Escherichia coli(strain:K12) DNA, clone:Kohara clone
236] [DB:genpept-bct1] [DE:Escherichia coli genomic DNA. (24.8 - 25.2 min).]
[NT:ORF_ID:o236#3; similar to PIR Accession Number] [LE:2258] [RE:2494]
[DI:direct] >gp:[GI:g145882] [LN:ECOFABACP] [AC:M84991] [PN:acyl carrier protein]
[GN:acpP] [OR:Escherichia coli] [SR:Escherichia coli (strain K-12) DNA]
[DB:genpept-bct1] [DE:Escherichia coli 3-ketoacyl-acyl carrier protein reductase
(fabG)and acyl carrier protein (acpP) genes, complete cds, and malonylCoA-acyl
carrier protein transacylase (fabD) gene, 5' end.] [LE:1024] [RE:1260]
[DI:direct] >gp:[GI:g1787336] [LN:AE000210] [AC:AE000210:U00096] [PN:acyl carrier
protein] [GN:acpP] [FN:carrier; Fatty acid and phosphatidic acid] [OR:Escherichia
coli] [DB:genpept-bct2] [DE:Escherichia coli K-12 MG1655 section 100 of 400 of
the completegenome.] [NT:o78; 100 pct identical to ACP_ECOLI SW: P02901 but]
[LE:2920] [RE:3156] [DI:direct] >gp:[GI:g3249737] [LN:AF072368]
[AC:AF072368:S81112] [PN:acyl carrier protein] [OR:synthetic construct]
[DB:genpept-syn] [DE:Synthetic construct acyl carrier protein mRNA, complete
cds.] [NT:ACP] [LE:10] [RE:246] [DI:direct]

| ORF_Name | NT ID | AA ID | NT LN | AA LN | Score | P-value |
|---|---|---|---|---|---|---|
| 36456302_c3_923 | 380 | 7551 | 1182 | 393 | 1596 | 6.2e-164 |

Description sp:[LN:PLSX_ECOLI] [AC:P27247] [GN:PLSX] [OR:Escherichia coli] [DE:FATTY
ACID/PHOSPHOLIPID SYNTHESIS PROTEIN PLSX HOMOLOG] [SP:P27247] [DB:swissprot]
>sp:[LN:G64852] [AC:G64852] [PN:fatty acid/phospholipid synthesis protein plsX
homolog] [GN:plsX] [CL:phospholipid synthesis protein] [OR:Escherichia coli]
[DB:pir1] >gp:[GI:g1787331] [LN:AE000209] [AC:AE000209:U00096]
[PN:glycerolphosphate auxotrophy in plsB background] [GN:plsX] [FN:phenotype;
Macromolecule synthesis,] [OR:Escherichia coli] [DB:genpept-bct2] [DE:Escherichia
coli K-12 MG1655 section 99 of 400 of the completegenome.] [NT:o346; 100 pct
identical to PLSX_ECOLI SW: P27247] [LE:9336] [RE:10376] [DI:direct]
>gp:[GI:g147301] [LN:ECOPLSFABA] [AC:M96793] [GN:plsX] [FN:fatty acid or
phospholipid synthesis] [OR:Escherichia coli] [SR:Escherichia coli (strain K-12)
DNA] [DB:genpept-bct2] [DE:Escherichia coli PlsX gene, complete cds and
beta-ketoacyl-acylcarrier protein synthase III (fabH) gene, 5' end.] [LE:93]
[RE:1133] [DI:direct]

| ORF_Name | NT ID | AA ID | NT LN | AA LN | Score | P-value |
|---|---|---|---|---|---|---|
| 36570827_c2_763 | 381 | 7552 | 1029 | 342 | 403 | 1.6e-37 |

Description sp:[LN:S74869] [AC:S74869] [PN:transcription regulator slr1245:protein
slr1245:protein slr1245] [CL:conserved hypothetical protein HI1364]
[OR:Synechocystis sp.] [SR:PCC 6803, , PCC 6803] [SR:PCC 6803, ] [DB:pir2]
>gp:[GI:d1018563:g1652912] [LN:D90909] [AC:D90909:AB001339] [PN:transcriptional
regulator] [OR:Synechocystis sp.] [SR:Synechocystis sp. (strain:PCC6803) DNA]
[DB:genpept-bct1] [DE:Synechocystis sp. PCC6803 complete genome, 11/27,
1311235-1430418.] [NT:ORF_ID:slr1245] [LE:72594] [RE:73502] [DI:direct]

| ORF_Name | NT ID | AA ID | NT LN | AA LN | Score | P-value |
|---|---|---|---|---|---|---|
| 36582966_f1_85 | 382 | 7553 | 423 | 140 | 119 | 9.2e-07 |

Description sp:[LN:A61183] [AC:A61183:S27643] [PN:hypothetical protein (sdsB region)]
[OR:Pseudomonas sp.] [DB:pir2]

| ORF_Name | NT ID | AA ID | NT LN | AA LN | Score | P-value |
|---|---|---|---|---|---|---|
| 3938337_c1_568 | 383 | 7554 | 282 | 93 | 98 | 3.4e-05 |

Description sp:[LN:D64845] [AC:D64845] [PN:hypothetical protein b1030] [OR:Escherichia coli]
[DB:pir2] >gp:[GI:g1787268] [LN:AE000205] [AC:AE000205:U00096] [PN:orf,
hypothetical protein] [GN:b1030] [FN:orf; Unknown] [OR:Escherichia coli]
[DB:genpept-bct2] [DE:Escherichia coli K-12 MG1655 section 95 of 400 of the
completegenome.] [NT:o83; This 83 aa ORF is 25 pct identical (7 gaps)] [LE:1494]
[RE:1745] [DI:direct]

| ORF Name | NT ID | AA ID | NT/LN | AA/LN | Score | P-value |
|---|---|---|---|---|---|---|
| 397902_c2_736 | 384 | 7555 | 522 | 173 | 694 | 2.4e-68 |

Description sp:[LN:YCDZ_ECOLI] [AC:P75916] [GN:YCDZ] [OR:Escherichia coli] [DE:HYPOTHETICAL
18.8 KD PROTEIN IN PHOH-CSGG INTERGENIC REGION] [SP:P75916] [DB:swissprot]
>sp:[LN:A64846] [AC:A64846] [PN:probable membrane protein ycdZ] [GN:ycdZ]
[OR:Escherichia coli] [DB:pir2] >gp:[GI:d1036803;g4062600] [LN:D90740]
[AC:D90740;AB001340] [OR:Escherichia coli] [SR:Escherichia coli(strain:K12) DNA,
clone:Kohara clone #230] [DB:genpept-bct1] [DE:Escherichia coli genomic DNA.
(23.5 - 23.8 min).] [NT:ORF_ID:o231#4] [LE:10313] [RE:10852] [DI:direct]
>gp:[GI:d1036812;g4062609] [LN:D90741] [AC:D90741;AB001340] [OR:Escherichia coli]
[SR:Escherichia coli(strain:K12) DNA, clone:Kohara clone #231] [DB:genpept-bct1]
[DE:Escherichia coli genomic DNA. (23.7 - 24.0 min).] [NT:ORF_ID:o231#4]
[LE:3514] [RE:4053] [DI:direct] >gp:[GI:g1787273] [LN:AE000205]
[AC:AE000205;U00096] [PN:orf, hypothetical protein] [GN:ycdZ] [FN:orf; Unknown]
[OR:Escherichia coli] [DB:genpept-bct2] [DE:Escherichia coli K-12 MG1655 section
95 of 400 of the completegenome.] [NT:o179; This 179 aa ORF is 27 pct identical
(12 gaps)] [LE:4794] [RE:5333] [DI:direct]

| ORF Name | NT ID | AA ID | NT/LN | AA/LN | Score | P-value |
|---|---|---|---|---|---|---|
| 402081_c2_665 | 385 | 7556 | 1074 | 357 | 1028 | 9.7e-104 |

Description sp:[LN:SFUC_SERMA] [AC:P21410] [GN:SFUC] [OR:Serratia marcescens]
[DE:IRON(III)-TRANSPORT ATP-BINDING PROTEIN SFUC] [SP:P21410] [DB:swissprot]
>sp:[LN:QRSEUC] [AC:C35108] [PN:nucleotide-binding protein sfuC] [GN:sfuC]
[CL:inner membrane protein malK:ATP-binding cassette homology] [OR:Serratia
marcescens] [DB:pir1] >gp:[GI:g152862] [LN:SMASFUABC] [AC:M33815] [OR:Serratia
marcescens] [SR:S.marcescens DNA, clone pSZ1] [DB:genpept-bct1] [DE:S.marcescens
periplasmic-binding-protein-dependent iron transportprotein (sfuABC) genes,
complete cds.] [NT:iron transport protein (sufC)] [LE:2798] [RE:3835] [DI:direct]

| ORF Name | NT ID | AA ID | NT/LN | AA/LN | Score | P-value |
|---|---|---|---|---|---|---|
| 4035288_c2_667 | 386 | 7557 | 930 | 309 | 223 | 1.9e-18 |

Description gp:[GI:e1313954;g3392922] [LN:LLNISG] [AC:AJ000993] [PN:hypothetical protein]
[GN:orfC] [OR:Lactococcus lactis] [DB:genpept-bct1] [DE:Lactococcus lactis nisG
gene, orfA, orfB, orfC, and orfD.] [LE:2262] [RE:2981] [DI:direct]

| ORF Name | NT ID | AA ID | NT/LN | AA/LN | Score | P-value |
|---|---|---|---|---|---|---|
| 4041307_f2_265 | 387 | 7558 | 585 | 194 | 750 | 2.8e-74 |

Description gp:[GI:d1036760:g4062561] [LN:D90737] [AC:D90737:AB001340]
[PN:4-hydroxyphenylacetate 3-monooxygenase (EC] [GN:nmoB] [OR:Escherichia coli]
[SR:Escherichia coli(strain:K12) DNA, clone:Kohara clone #227] [DB:genpept-bct1]
[DE:Escherichia coli genomic DNA. (22.8 - 23.1 min).] [NT:ORF_ID:o228#5; similar
to PIR Accession Number] [LE:15357] [RE:15932] [DI:complement]
>gp:[GI:d1036770:g4062570] [LN:D90738] [AC:D90738:AB001340]
[PN:4-hydroxyphenylacetate 3-monooxygenase (EC] [GN:nmoB] [OR:Escherichia coli]
[SR:Escherichia coli(strain:K12) DNA, clone:Kohara clone #228] [DB:genpept-bct1]
[DE:Escherichia coli genomic DNA. (23.0 - 23.4 min).] [NT:ORF_ID:o228#5; similar
to PIR Accession Number] [LE:3821] [RE:4396] [DI:complement]

| ORF Name | NT ID | AA ID | NT/LN | AA/LN | Score | P-value |
|---|---|---|---|---|---|---|
| 4114090_c3_927 | 388 | 7559 | 336 | 111 | 451 | 1.3e-42 |

Description sp:[LN:FABG_ECOLI] [AC:P25716:P78221] [GN:FABG] [OR:Escherichia coli]
[EC:1.1.1.100] [DE:ACYL CARRIER PROTEIN REDUCTASE)] [SP:P25716:P78221]
[DB:swissprot] >sp:[LN:B42147] [AC:B64853:B42147:C41856]
[PN:3-oxoacyl-[acyl-carrier-protein] reductase,:3-ketoacyl-ACP reductase]
[GN:fabG] [CL:ribitol dehydrogenase:short-chain alcohol dehydrogenase homology]
[OR:Escherichia coli] [EC:1.1.1.100] [DB:pir1] [MP:24 min]
>gp:[GI:d1036887:g1651536] [LN:D90745] [AC:D90745:AB001340]
[PN:3-oxoacyl-[acyl-carrier-protein] reductase (EC] [GN:fabG] [OR:Escherichia
coli] [SR:Escherichia coli(strain:K12) DNA, clone:Kohara clone #236]
[DB:genpept-bct1] [DE:Escherichia coli genomic DNA. (24.8 - 25.2 min).]
[NT:ORF_ID:o236#2; similar to PIR Accession Number] [LE:2047]
[DI:direct] >gp:[GI:g1787335] [LN:AE000210] [AC:AE000210:U00096]
[PN:3-oxoacyl-[acyl-carrier-protein] reductase] [GN:fabG] [FN:enzyme; Fatty acid
and phosphatidic acid] [OR:Escherichia coli] [DB:genpept-bct2] [EC:1.1.1.100]
[DE:Escherichia coli K-12 MG1655 section 100 of 400 of the completegenome.]
[NT:o244; 99 pct identical to FABG_ECOLI SW: P25716] [LE:1975] [RE:2709]
[DI:direct]

| ORF Name | NT ID | AA ID | NT/LN | AA/LN | Score | P-value |
|---|---|---|---|---|---|---|
| 4350713_c1_539 | 389 | 7560 | 231 | 76 | | |

Description

NO-HIT

211

| ORF Name | NT ID | AA ID | NT LN | AA LN | Score | P-value |
|---|---|---|---|---|---|---|
| 4397812_c1_504 | 390 | 7561 | 246 | 81 | 202 | 3.3e-16 |

Description gp:[GI:d1036722:g4062538] [LN:D90734] [AC:D90734:AB001340] [OR:Escherichia coli]
[SR:Escherichia coli(strain:K12) DNA, clone:Kohara clone #223] [DB:genpept-bct1]
[DE:Escherichia coli genomic DNA. (22.0 - 22.3 min).] [NT:ORF_ID:o224#4]
[LE:13143] [RE:13319] [DI:complement]

| ORF Name | NT ID | AA ID | NT LN | AA LN | Score | P-value |
|---|---|---|---|---|---|---|
| 4548281_f1_21 | 391 | 7562 | 1242 | 413 | 596 | 5.8e-58 |

Description sp:[LN:D69779] [AC:D69779] [PN:antibiotic resistance protein homolog ydeR]
[GN:ydeR] [OR:Bacillus subtilis] [DB:pir2] >gp:[GI:d1020118:g1881338]
[LN:AB001488] [AC:AB001488] [GN:ydeR] [OR:Bacillus subtilis] [SR:Bacillus
subtilis (strain:168) DNA] [DB:genpept-bct1] [DE:Bacillus subtilis genome
sequence, 148 kb sequence of the regionbetween 35 and 47 degree.] [NT:PROBABLE
INTEGRAL MEMBRANE PROTEIN, SIMILAR TO] [LE:110164] [RE:111351] [DI:complement]
>gp:[GI:e1182497:g2632831] [LN:BSUB0003] [AC:Z99106:AL009126] [GN:ydeR]
[FN:unknown] [OR:Bacillus subtilis] [DB:genpept-bct1] [DE:Bacillus subtilis
complete genome (section 3 of 21): from 402751 to611850.] [NT:similar to
antibiotic resistance protein] [LE:173910] [RE:175097] [DI:complement]

| ORF Name | NT ID | AA ID | NT LN | AA LN | Score | P-value |
|---|---|---|---|---|---|---|
| 4577_f2_289 | 392 | 7563 | 1170 | 389 | 1578 | 5.0e-162 |

Description sp:[LN:PTWC_ECOLI] [AC:P32672] [GN:FRWC] [OR:Escherichia coli] [DE:II, C
COMPONENT)] [SP:P32672] [DB:swissprot] >sp:[LN:H65201] [AC:H65201] [PN:pts
system, fructose-like-2 IIc component] [GN:frwC] [OR:Escherichia coli] [DB:pir2]
>gp:[GI:g1790386] [LN:AE000469] [AC:AE000469:U00096] [PN:PTS system,
fructose-like enzyme II component] [GN:frwC] [FN:transport; Transport of small
molecules:] [OR:Escherichia coli] [DB:genpept-bct2] [DE:Escherichia coli K-12
MG1655 section 359 of 400 of the completegenome.] [NT:o359; 100 pct identical
amino acid sequence and] [LE:298] [RE:1377] [DI:direct] >gp:[GI:g396296]
[LN:ECOUW89] [AC:U00006] [OR:Escherichia coli] [SR:Escherichia coli (sub_strain
MG1655, strain K-12) (library: lambda] [DB:genpept-bct2] [DE:E. coli chromosomal
region from 89.2 to 92.8 minutes.] [NT:similar to phosphotransferase system
enzyme II] [LE:7771] [RE:8850] [DI:direct]

| ORF Name | NT ID | AA ID | NT LN | AA LN | Score | P-value |
|---|---|---|---|---|---|---|
| 4881462_c3_883 | 393 | 7564 | 288 | 95 | 115 | 5.4e-07 |

Description sp:[LN:S02776] [AC:S02776] [PN:DNA-binding protein H-NS] [GN:hns] [CL:DNA-binding
protein H-NS] [OR:Proteus vulgaris] [DB:pir2]

212

| ORF Name | NT ID | AA ID | NT LN | AA LN | Score | P-value |
|---|---|---|---|---|---|---|
| 4957811_c1_551 | 394 | 7565 | 1287 | 428 | 89 | 0.0028 |

Description sp:[LN:Y112_ADE02] [AC:P03289] [OR:Human adenovirus type 2] [DE:HYPOTHETICAL
PROTEIN F-112] [SP:P03289] [DB:swissprot] >sp:[LN:A03861]
[AC:G92351;G92352;A03861] [PN:hypothetical protein F-112] [OR:Mastadenovirus h2]
[SR:, human adenovirus 2] [DB:pir2]

| ORF Name | NT ID | AA ID | NT LN | AA LN | Score | P-value |
|---|---|---|---|---|---|---|
| 4960843_f1_126 | 395 | 7566 | 843 | 280 | 789 | 2.0e-78 |

Description sp:[LN:YIJO_ECOLI] [AC:P32677] [GN:YIJO] [OR:Escherichia coli] [DE:HYPOTHETICAL
TRANSCRIPTIONAL REGULATOR IN GLDA-PPC INTERGENIC REGION] [SP:P32677]
[DB:swissprot] >sp:[LN:E65202] [AC:E65202] [PN:hypothetical transcription
regulator glda-ppc intergenic] [GN:yijO] [CL:hypothetical protein b2382]
[OR:Escherichia coli] [DB:pir2] >gp:[GI:g1790391] [LN:AE000469]
[AC:AE000469;U00096] [PN:putative ARAC-type regulatory protein] [GN:yijO]
[FN:putative regulator; Not classified] [OR:Escherichia coli] [DB:genpept-bct2]
[DE:Escherichia coli K-12 MG1655 section 359 of 400 of the completegenome.]
[NT:f283; 100 pct identical to YIJO_ECOLI SW:] [LE:5234] [RE:6085]
[DI:complement] >gp:[GI:g396301] [LN:ECOUW89] [AC:U00006] [OR:Escherichia coli]
[SR:Escherichia coli (sub_strain MG1655, strain K-12) (library: lambda]
[DB:genpept-bct2] [DE:E. coli chromosomal region from 89.2 to 92.8 minutes.]
[NT:matches PS00041: Bacterial regulatory proteins,] [LE:12707] [RE:13558]
[DI:complement]

| ORF Name | NT ID | AA ID | NT LN | AA LN | Score | P-value |
|---|---|---|---|---|---|---|
| 5099143_f2_263 | 396 | 7567 | 720 | 239 | 1068 | 5.6e-108 |

Description sp:[LN:A64843] [AC:A64843] [PN:hypothetical protein b1011] [CL:hypothetical
protein b1011] [OR:Escherichia coli] [DB:pir1] >gp:[GI:g1787246] [LN:AE000202]
[AC:AE000202;U00096] [PN:putative synthetase] [GN:b1011] [FN:putative enzyme; Not
classified] [OR:Escherichia coli] [DB:genpept-bct2] [DE:Escherichia coli K-12
MG1655 section 92 of 400 of the completegenome.] [NT:f244; This 244 aa ORF is 25
pct identical (17 gaps)] [LE:9727] [RE:10461] [DI:complement]

| ORF Name | NT ID | AA ID | NT LN | AA LN | Score | P-value |
|---|---|---|---|---|---|---|
| 5109843_f1_30 | 397 | 7568 | 264 | 87 | 384 | 1.7e-35 |

Description gp:[GI:d1036843:g4062633] [LN:D90742] [AC:D90742:AB001340] [OR:Escherichia coli]
[SR:Escherichia coli(strain:K12) DNA, clone:Kohara clone #232] [DB:genpept-bct1]
[DE:Escherichia coli genomic DNA. (23.8 - 24.2 min).] [NT:ORF_ID:o233#8]
[LE:17321] [RE:17578] [DI:complement] >gp:[GI:d1036854:g4062641] [LN:D90743]
[AC:D90743:AB001340] [OR:Escherichia coli] [SR:Escherichia coli(strain:K12) DNA,
clone:Kohara clone #233] [DB:genpept-bct1] [DE:Escherichia coli genomic DNA.
(24.1 - 24.5 min).] [NT:ORF_ID:o233#8] [LE:7067] [RE:7324] [DI:complement]

| ORF Name | NT ID | AA ID | NT LN | AA LN | Score | P-value |
|---|---|---|---|---|---|---|
| 5112943_f3_433 | 398 | 7569 | 1497 | 498 | 2154 | 4.6e-223 |

Description sp:[LN:DHAL_ECOLI] [AC:P23883:P78250] [GN:ALDH] [OR:Escherichia coli]
[EC:1.2.1.3] [DE:PUTATIVE ALDEHYDE DEHYDROGENASE,] [SP:P23883:P78250]
[DB:swissprot] >sp:[LN:G64878] [AC:G64878:JU0397] [PN:aldehyde dehydrogenase
(NAD+),] [GN:aldH] [CL:aldehyde dehydrogenase (NAD+):aldehyde dehydrogenase
homology] [OR:Escherichia coli] [EC:1.2.1.3] [DB:pir1] >gp:[GI:d1015585:g1742130]
[LN:D90768] [AC:D90768:AB001340] [PN:Aldehyde dehydrogenase homolog] [GN:aldH]
[OR:Escherichia coli] [SR:Escherichia coli (strain:K12) DNA, clone_lib:Kohara
lambda minise] [DB:genpept-bct1] [DE:E.coli genomic DNA, Kohara clone
257(29.1-29.6 min.).] [NT:ORF_ID:o257#9; similar to [PIR Accession Number]
[LE:10113] [RE:11600] [DI:direct] >gp:[GI:g1787558] [LN:AE000228]
[AC:AE000228:U00096] [PN:aldehyde dehydrogenase, prefers NADP over NAD] [GN:aldH]
[FN:enzyme; Energy metabolism, carbon:] [OR:Escherichia coli] [DB:genpept-bct2]
[EC:1.2.1.3] [DE:Escherichia coli K-12 MG1655 section 118 of 400 of the
completegenome.] [NT:o495; 99 pct identical to DHAL_ECOLI SW: P23883] [LE:3408]
[RE:4895] [DI:direct]

| ORF Name | NT ID | AA ID | NT LN | AA LN | Score | P-value |
|---|---|---|---|---|---|---|
| 5112961_f3_364 | 399 | 7570 | 615 | 204 | 742 | 2.0e-73 |

Description sp:[LN:YCEB_ECOLI] [AC:P09995] [GN:YCEB] [OR:Escherichia coli] [DE:20.5 KD PROTEIN IN PYRC-GRXB INTERGENIC REGION] [SP:P09995] [DB:swissprot]
>sp:[LN:QQECP5] [AC:B25008:D64849] [PN:yceB protein] [GN:yceB] [CL:Escherichia coli yceB protein] [OR:Escherichia coli] [DB:pir1] [MP:23 min]
>gp:[GI:d1036857:g4062643] [LN:D90743] [AC:D90743:AB001340] [PN:Hypothetical 20.5 kd protein in pyrC 3'region.] [GN:yceB] [OR:Escherichia coli] [SR:Escherichia coli(strain:K12) DNA, clone:Kohara clone #233] [DB:genpept-bct1] [DE:Escherichia coli genomic DNA. (24.1 - 24.5 min).] [NT:ORF_ID:o233#11; similar to SwissProt Accession] [LE:9079] [RE:9639] [DI:complement] >gp:[GI:g42606] [LN:ECPYRC] [AC:X04469:D00002:N00002] [OR:Escherichia coli] [DB:genpept-bct1] [DE:E. coli pyrC gene for dihydroorotase.] [NT:URF] [SP:P09995] [LE:215] [RE:775] [DI:direct]
>gp:[GI:g1787302] [LN:AE000207] [AC:AE000207:U00096] [PN:orf, hypothetical protein] [GN:yceB] [FN:orf; Unknown] [OR:Escherichia coli] [DB:genpept-bct2] [DE:Escherichia coli K-12 MG1655 section 97 of 400 of the completegenome.] [NT:f186; 99 pct identical to YCEB_ECOLI SW: P09995] [LE:6049] [RE:6609] [DI:complement]

| ORF Name | NT ID | AA ID | NT LN | AA LN | Score | P-value |
|---|---|---|---|---|---|---|
| 5194465_c1_498 | 400 | 7571 | 201 | 66 | 160 | 9.2e-12 |

Description gp:[GI:d1036719:g4062535] [LN:D90734] [AC:D90734:AB001340] [PN:Acylphosphatase (EC 3.6.1.7) Ch2, skeletal] [OR:Escherichia coli] [SR:Escherichia coli(strain:K12) DNA, clone:Kohara clone #223] [DB:genpept-bct1] [DE:Escherichia coli genomic DNA. (22.0 - 22.3 min).] [NT:ORF_ID:o224#1; similar to PIR Accession Number] [LE:11374] [RE:11865] [DI:direct]

| ORF Name | NT ID | AA ID | NT LN | AA LN | Score | P-value |
|---|---|---|---|---|---|---|
| 5198916_f2_213 | 401 | 7572 | 708 | 235 | 267 | 4.2e-23 |

Description gp:[GI:d1036825:g4062619] [LN:D90741] [AC:D90741:AB001340] [GN:mdoG] [OR:Escherichia coli] [SR:Escherichia coli(strain:K12) DNA, clone:Kohara clone #231] [DB:genpept-bct1] [DE:Escherichia coli genomic DNA. (23.7 - 24.0 min).] [NT:ORF_ID:o232#7] [LE:14039] [RE:14296] [DI:complement]
>gp:[GI:d1036833:g4062625] [LN:D90742] [AC:D90742:AB001340] [GN:mdoG] [OR:Escherichia coli] [SR:Escherichia coli(strain:K12) DNA, clone:Kohara clone #232] [DB:genpept-bct1] [DE:Escherichia coli genomic DNA. (23.8 - 24.2 min).] [NT:ORF_ID:o232#7] [LE:6057] [RE:6314] [DI:complement]

| ORF Name | NT ID | AA ID | NT LN | AA LN | Score | P-value |
|---|---|---|---|---|---|---|
| 5207_f1_50 | 402 | 7573 | 186 | 61 | | |

Description

NO-HIT

| ORF Name | NT ID | AA ID | NT LN | AA LN | Score | P-value |
|---|---|---|---|---|---|---|
| 526077_f3_403 | 403 | 7574 | 1218 | 405 | 1428 | 4.0e-146 |

Description sp:[LN:NUPC_ECOLI] [AC:P33031:P77236] [GN:NUPC:CRU] [OR:Escherichia coli]
[DE:NUCLEOSIDE PERMEASE NUPC (NUCLEOSIDE-TRANSPORT SYSTEM PROTEIN NUPC)]
[SP:P33031:P77236] [DB:swissprot] >sp:[LN:F65013] [AC:F65013:I41111:S37076]
[PN:nucleoside transport protein nupC:nucleoside permease nupC] [GN:nupC]
[CL:pyrimidine nucleoside transport protein nupC] [OR:Escherichia coli] [DB:pir2]
>gp:[GI:d1016991:g1799805] [LN:D90869] [AC:D90869:AB001340] [PN:NUCLEOSIDE
PERMEASE NUPC (NUCLEOSIDE-TRANSPORT] [GN:cru] [OR:Escherichia coli]
[SR:Escherichia coli (strain:K12) DNA, clone_lib:Kohara lambda minise]
[DB:genpept-bct1] [DE:E.coli genomic DNA, Kohara clone #416(54.1-54.5 min.).]
[NT:similar to [SwissProt Accession Number P33031]] [LE:5886] [RE:7088]
[DI:direct] >gp:[GI:g1788737] [LN:AE000327] [AC:AE000327:U00096] [PN:permease of
transport system for 3 nucleosides] [GN:nupC] [FN:transport; Transport of small
molecules:] [OR:Escherichia coli] [DB:genpept-bct2] [DE:Escherichia coli K-12
MG1655 section 217 of 400 of the completegenome.] [NT:o400; 99 pct identical (2
gaps) to NUPC_ECOLI] [LE:4721] [RE:5923] [DI:direct]

| ORF Name | NT ID | AA ID | NT LN | AA LN | Score | P-value |
|---|---|---|---|---|---|---|
| 5266916_c1_576 | 404 | 7575 | 666 | 221 | | |

Description

NO-HIT

| ORF Name | NT ID | AA ID | NT LN | AA LN | Score | P-value |
|---|---|---|---|---|---|---|
| 5289077_f1_136 | 405 | 7576 | 1536 | 511 | 1277 | 4.0e-130 |

Description sp:[LN:E64862] [AC:E64862] [PN:probable membrane protein b1168] [OR:Escherichia
coli] [DB:pir2] >gp:[GI:d1036986:g4062746] [LN:D90750] [AC:D90750:AB001340]
[PN:Hypothetical 60.8 kd protein in ssb-soxS] [OR:Escherichia coli]
[SR:Escherichia coli(strain:K12) DNA, clone:Kohara clone #241] [DB:genpept-bct1]
[DE:Escherichia coli genomic DNA. (26.0 - 26.3 min).] [NT:ORF_ID:o242#3; similar
to SwissProt Accession] [LE:15484] [RE:17049] [DI:direct]
>gp:[GI:d1036990:g4062750] [LN:D90751] [AC:D90751:AB001340] [PN:Hypothetical 60.8
kd protein in ssb-soxS] [OR:Escherichia coli] [SR:Escherichia coli(strain:K12)
DNA, clone:Kohara clone #242] [DB:genpept-bct1] [DE:Escherichia coli genomic DNA.
(26.2 - 26.6 min).] [NT:ORF_ID:o242#3; similar to SwissProt Accession] [LE:3621]
[RE:5186] [DI:direct] >gp:[GI:g1787415] [LN:AE000215] [AC:AE000215:U00096]
[PN:putative proteases] [GN:b1168] [FN:putative enzyme; Not classified]
[OR:Escherichia coli] [DB:genpept-bct2] [DE:Escherichia coli K-12 MG1655 section
105 of 400 of the completegenome.] [NT:o521 was o322 and 0191; This 322 aa ORF is
30 pct] [LE:7024] [RE:8589] [DI:direct]

| ORF Name | NT ID | AA ID | NT/LN | AA/LN | Score | P-value |
|---|---|---|---|---|---|---|
| 5354012_c1_593 | 406 | 7577 | 243 | 80 | 345 | 2.3e-31 |

Description sp:[LN:G64847] [AC:G64847] [PN:yceK protein precursor] [GN:yceK] [CL:hypothetical protein HI0650] [OR:Escherichia coli] [DB:pir2] >gp:[GI:g1787288] [LN:AE000206] [AC:AE000206:U00096] [PN:orf, hypothetical protein] [GN:yceK] [FN:orf; Unknown] [OR:Escherichia coli] [DB:genpept-bct2] [DE:Escherichia coli K-12 MG1655 section 96 of 400 of the completegenome.] [NT:o75; 100 pct identical to YCEK_ECOLI SW: P45806 but] [LE:7837] [RE:8064] [DI:direct]

| ORF Name | NT ID | AA ID | NT/LN | AA/LN | Score | P-value |
|---|---|---|---|---|---|---|
| 5354818_c2_757 | 407 | 7578 | 663 | 220 | 872 | 3.3e-87 |

Description sp:[LN:YCEH_ECOLI] [AC:P29217:P75930] [GN:YCEH] [OR:Escherichia coli] [DE:HYPOTHETICAL 24.2 KD PROTEIN IN RIMJ-MVIM INTERGENIC REGION (G20.3)] [SP:P29217:P75930] [DB:swissprot] >sp:[LN:H64849] [AC:H64849:B45250] [PN:yceH protein] [GN:yceH] [OR:Escherichia coli] [DB:pir2] >gp:[GI:d1036861:g4062646] [LN:D90743] [AC:D90743:AB001340] [PN:Hypothetical 25.6 kd protein in rimJ 3'region] [GN:yceH] [OR:Escherichia coli] [SR:Escherichia coli(strain:K12) DNA, clone:Kohara clone #233] [DB:genpept-bct1] [DE:Escherichia coli genomic DNA. (24.1 - 24.5 min).] [NT:ORF_ID:o233#15; similar to SwissProt Accession] [LE:12523] [RE:13170] [DI:direct] >gp:[GI:g1787306] [LN:AE000207] [AC:AE000207:U00096] [PN:orf, hypothetical protein] [GN:yceH] [FN:orf; Unknown] [OR:Escherichia coli] [DB:genpept-bct2] [DE:Escherichia coli K-12 MG1655 section 97 of 400 of the completegenome.] [NT:o215; 100 pct identical to N-ter 109 aa of] [LE:9493] [RE:10140] [DI:direct]

| ORF Name | NT ID | AA ID | NT/LN | AA/LN | Score | P-value |
|---|---|---|---|---|---|---|
| 5354833_f2_301 | 408 | 7579 | 228 | 75 | | |

Description

NO-HIT

| ORF Name | NT ID | AA ID | NT/LN | AA/LN | Score | P-value |
|---|---|---|---|---|---|---|
| 6062765_c1_574 | 409 | 7580 | 1293 | 430 | 472 | 8.0e-45 |

Description gp:[GI:g563255] [LN:DIHINTA] [AC:L31763] [PN:integrase] [GN:intA] [OR:Dichelobacter nodosus] [DB:genpept-bct1] [DE:Dichelobacter nodosus integrase (intA) gene, complete cds;virulence-associated protein (vap) genes, complete cds, repeatregions.] [NT:putative] [LE:418] [RE:1623] [DI:direct]

| ORF Name | NT ID | AA ID | NT LN | AA LN | Score | P-value |
|---|---|---|---|---|---|---|
| 6064693_c1_510 | 410 | 7581 | 1590 | 529 | 1934 | 9.5e-200 |

Description sp:[LN:SFUB_SERMA] [AC:P21409] [GN:SFUB] [OR:Serratia marcescens]
[DE:IRON(III)-TRANSPORT SYSTEM PERMEASE PROTEIN SFUB] [SP:P21409] [DB:swissprot]
>gp:[GI:g152861] [LN:SMASFUABC] [AC:M33815] [OR:Serratia marcescens]
[SR:S.marcescens DNA, clone pSZ1] [DB:genpept-bct1] [DE:S.marcescens
periplasmic-binding-protein-dependent iron transportprotein (sfuABC) genes,
complete cds.] [NT:protein (sufB)] [LE:1218] [RE:2801] [DI:direct]

| ORF Name | NT ID | AA ID | NT LN | AA LN | Score | P-value |
|---|---|---|---|---|---|---|
| 6093906_c3_930 | 411 | 7582 | 1050 | 349 | 1483 | 5.9e-152 |

Description sp:[LN:YCEG_ECOLI] [AC:P28306:P75944] [GN:YCEG] [OR:Escherichia coli]
[DE:HYPOTHETICAL 38.2 KD PROTEIN IN PABC-HOLB INTERGENIC REGION]
[SP:P28306:P75944] [DB:swissprot] >sp:[LN:F64853]
[AC:F64853:B42954:PC6002:S27567] [PN:yceG protein precursor] [GN:yceG] [CL:yceG
protein] [OR:Escherichia coli] [DB:pir2] >gp:[GI:g1787339] [LN:AE000210]
[AC:AE000210:U00096] [PN:putative thymidylate kinase (EC 2.7.4.9)] [GN:yceG]
[FN:putative enzyme; Not classified] [OR:Escherichia coli] [DB:genpept-bct2]
[DE:Escherichia coli K-12 MG1655 section 100 of 400 of the completegenome.]
[NT:o340; 100 pct identical to fragment YCEG_ECOLI] [LE:5417] [RE:6439]
[DI:direct]

| ORF Name | NT ID | AA ID | NT LN | AA LN | Score | P-value |
|---|---|---|---|---|---|---|
| 6730340_c1_545 | 412 | 7583 | 186 | 61 | 293 | 7.4e-26 |

Description gp:[GI:d1036758:g4062559] [LN:D90737] [AC:D90737:AB001340] [PN:Hypothetical
protein 1 (trpA-tonB intergenic] [OR:Escherichia coli] [SR:Escherichia
coli(strain:K12) DNA, clone:Kohara clone #227] [DB:genpept-bct1] [DE:Escherichia
coli genomic DNA. (22.8 - 23.1 min).] [NT:ORF_ID:o228#3; similar to PIR Accession
Number] [LE:13548] [RE:13751] [DI:direct] >gp:[GI:d1036768:g4062568] [LN:D90738]
[AC:D90738:AB001340] [PN:Hypothetical protein 1 (trpA-tonB intergenic]
[OR:Escherichia coli] [SR:Escherichia coli(strain:K12) DNA, clone:Kohara clone
228] [DB:genpept-bct1] [DE:Escherichia coli genomic DNA. (23.0 - 23.4 min).]
[NT:ORF_ID:o228#3; similar to PIR Accession Number] [LE:2012] [RE:2215]
[DI:direct]

| ORF Name | NT ID | AA ID | NT LN | AA LN | Score | P-value |
|---|---|---|---|---|---|---|
| 6929077_f3_408 | 413 | 7584 | 3981 | 1326 | 6657 | 0.0 |

Description gp:[GI:g2766693] [LN:AF038838] [AC:AF038838] [PN:proline dehydrogenase] [GN:putA]
[OR:Klebsiella aerogenes] [DB:genpept-bct2] [EC:1.5.99.8:1.5.1.12] [DE:Klebsiella
aerogenes proline dehydrogenase (putA) gene, completecds.] [NT:PutA;
pyrroline-5-carboxylate dehydrogenase] [LE:26] [RE:3964] [DI:direct]

| ORF Name | NT ID | AA ID | NT/LN | AA/LN | Score | P-value |
|---|---|---|---|---|---|---|
| 7234701_f1_60 | 414 | 7585 | 696 | 231 | 1036 | 1.4e-104 |

Description gp:[GI:g4324613] [LN:AF106566] [AC:AF106566] [PN:SlsA] [GN:slsA] [OR:Salmonella typhimurium] [DB:genpept-bct2] [DE:Salmonella typhimurium pathogenicity island SPI-3, completesequence.] [NT:similar to Escherichia coli OrfZ: SwissProt] [LE:11191] [RE:11871] [DI:direct]

| ORF Name | NT ID | AA ID | NT/LN | AA/LN | Score | P-value |
|---|---|---|---|---|---|---|
| 7316078_f2_226 | 415 | 7586 | 351 | 116 | 218 | 9.5e-18 |

Description gp:[GI:g2760957] [LN:AF039582] [AC:AF039582] [PN:putative integrase] [GN:int(p)] [OR:Enterobacter aerogenes] [DB:genpept-bct2] [DE:Enterobacter aerogenes putative integrase (int(p)) gene, partialcds; and EaeI methyltransferase alpha subunit (eaeIM-a), EaeImethyltransferase beta subunit (eaeIM-b), and EaeI restrictionendonuclease (eaeIR) genes, complete cds.] [NT:similar to phage P4 integrase SP:P39347] [LE:<1] [RE:1035] [DI:direct]

| ORF Name | NT ID | AA ID | NT/LN | AA/LN | Score | P-value |
|---|---|---|---|---|---|---|
| 859450_c1_509 | 416 | 7587 | 1110 | 369 | 1468 | 2.3e-150 |

Description sp:[LN:SFUA_SERMA] [AC:P21408] [GN:SFUA] [OR:Serratia marcescens] [DE:IRON(III)-BINDING PERIPLASMIC PROTEIN PRECURSOR] [SP:P21408] [DB:swissprot] >sp:[LN:QRSEUA] [AC:A35108] [PN:sfuA protein precursor] [GN:sfuA] [CL:sfuA protein] [OR:Serratia marcescens] [DB:pir1] >gp:[GI:g152860] [LN:SMASFUABC] [AC:M33815] [OR:Serratia marcescens] [SR:S.marcescens DNA, clone pSZ1] [DB:genpept-bct1] [DE:S.marcescens periplasmic-binding-protein-dependent iron transportprotein (sfuABC) genes, complete cds.] [NT:iron transport protein (sufA) precursor] [LE:168] [RE:1184] [DI:direct]

| ORF Name | NT ID | AA ID | NT/LN | AA/LN | Score | P-value |
|---|---|---|---|---|---|---|
| 9801556_f1_28 | 417 | 7588 | 1446 | 481 | 1857 | 1.4e-191 |

Description sp:[LN:F64849] [AC:F64849] [PN:probable permease b1065] [OR:Escherichia coli] [DB:pir2] >gp:[GI:d1036859:g4062645] [LN:D90743] [AC:D90743:AB001340] [PN:Hypothetical 44.7 kd protein in glnQ-ansR] [GN:yqjV] [OR:Escherichia coli] [SR:Escherichia coli(strain:K12) DNA, clone:Kohara clone #233] [DB:genpept-bct1] [DE:Escherichia coli genomic DNA. (24.1 - 24.5 min).] [NT:ORF_ID:o233#13; similar to SwissProt Accession] [LE:10484] [RE:11722] [DI:complement] >gp:[GI:g1787304] [LN:AE000207] [AC:AE000207:U00096] [PN:orf, hypothetical protein] [GN:yceL] [FN:orf; Unknown] [OR:Escherichia coli] [DB:genpept-bct2] [DE:Escherichia coli K-12 MG1655 section 97 of 400 of the completegenome.] [NT:f412; This 412 aa ORF is 23 pct identical (17 gaps)] [LE:7454] [RE:8692] [DI:complement]

| ORF Name | NT ID | AA ID | NT/LN | AA/LN | Score | P-value |
|---|---|---|---|---|---|---|
| 9870456_f2_199 | 418 | 7589 | 1059 | 352 | 1673 | 4.3e-172 |

Description sp:[LN:DEECOO] [AC:A25008:A27084:C64849] [PN:dihydroorotase,:carbamoylaspartic dehydrase] [GN:pyrC] [CL:dihydroorotase] [OR:Escherichia coli] [EC:3.5.2.3] [DB:pir1] [MP:23 min] >gp:[GI:d1036856:g1651523] [LN:D90743] [AC:D90743:AB001340] [PN:Dihydroorotase (EC 3.5.2.3).] [GN:pyrC] [OR:Escherichia coli] [SR:Escherichia coli(strain:K12) DNA, clone:Kohara clone #233] [DB:genpept-bct1] [DE:Escherichia coli genomic DNA. (24.1 - 24.5 min).] [NT:ORF_ID:o233#10; similar to PIR Accession Number] [LE:7927] [RE:8973] [DI:complement] >gp:[GI:g147473] [LN:ECOPYRCA] [AC:M16752] [GN:pyrC] [OR:Escherichia coli] [SR:E.coli (K-12 CLT9, strain MC4100) DNA, clone pBHM107] [DB:genpept-bct1] [DE:E.coli K-12 pyrC gene encoding dihydroorotase, complete cds.] [NT:dihydroorotase (EC 3.5.2.3)] [LE:467] [RE:1513] [DI:direct] >gp:[GI:g42607] [LN:ECPYRC] [AC:X04469:D00002:N00002] [PN:dihydroorotase] [GN:pyrC] [OR:Escherichia coli] [DB:genpept-bct1] [EC:3.5.2.3] [DE:E. coli pyrC gene for dihydroorotase.] [SP:P05020] [LE:881] [RE:1927] [DI:direct] >gp:[GI:g1787301] [LN:AE000207] [AC:AE000207:U00096] [PN:dihydro-orotase] [GN:pyrC] [FN:enzyme; Pyrimidine ribonucleotide biosynthesis] [OR:Escherichia coli] [DB:genpept-bct2] [EC:3.5.2.3] [DE:Escherichia coli K-12 MG1655 section 97 of 400 of the completegenome.] [NT:f348; 100 pct identical to PYRC_ECOLI SW: P05020] [LE:4897] [RE:5943] [DI:complement]

| ORF Name | NT ID | AA ID | NT/LN | AA/LN | Score | P-value |
|---|---|---|---|---|---|---|
| 10009443_c2_1687 | 419 | 7590 | 771 | 256 | 278 | 1.5e-23 |

Description sp:[LN:T05340] [AC:T05340] [PN:CTP synthase, F1C12.230:protein F1C12.230:protein F1C12.230] [CL:CTP synthase] [OR:Arabidopsis thaliana] [SR:, mouse-ear cress] [EC:6.3.4.2] [DB:pir2] [MP:4] >gp:[GI:g3046696] [LN:ATF1C12] [AC:AL022224] [PN:CTP synthase like protein] [GN:F1C12.230] [OR:Arabidopsis thaliana] [SR:thale cress] [DB:genpept-pln2] [EC:6.3.4.2] [DE:Arabidopsis thaliana DNA chromosome 4, BAC clone F1C12 (ESSAproject).] [NT:strong similarity to CTP synthase, Methanococcus] [LE:105128:105683:105880] [RE:105245:105762:105966] [DI:directJoin]

| ORF Name | NT ID | AA ID | NT/LN | AA/LN | Score | P-value |
|---|---|---|---|---|---|---|
| 10020885_f2_636 | 420 | 7591 | 255 | 84 | 304 | 5.1e-27 |

Description sp:[LN:YUR3_RHIME] [AC:P42878] [OR:Rhizobium meliloti] [DE:HYPOTHETICAL 8.9 KD PROTEIN IN UREA-UREB INTERGENIC REGION (ORF3)] [SP:P42878] [DB:swissprot] >sp:[LN:S42603] [AC:S42603] [PN:hypothetical protein 3] [OR:Rhizobium meliloti] [DB:pir2] >gp:[GI:g545798] [LN:S69145] [AC:S69145] [GN:orf3 3' of ureA] [OR:Sinorhizobium meliloti] [SR:Sinorhizobium meliloti AK631] [DB:genpept-bct1] [DE:ureA=UreA...ureC=UreC [Rhizobium meliloti, AK631, Genomic, 7 genes,4617 nt].] [NT:This sequence comes from Fig. 2.] [LE:679] [RE:933] [DI:direct]

| ORF Name | NT ID | AA ID | NT LN | AA LN | Score | P-value |
|---|---|---|---|---|---|---|
| 10260375_c1_1173 | 421 | 7592 | 600 | 199 | 849 | 9.0e-85 |

Description sp:[LN:YCFJ_ECOLI] [AC:P37796:P75951] [GN:YCFJ] [OR:Escherichia coli]
[DE:HYPOTHETICAL 18.9 KD PROTEIN IN NDH-MFD INTERGENIC REGION] [SP:P37796:P75951]
[DB:swissprot] >sp:[LN:C64855] [AC:C64855] [PN:ycfJ protein] [GN:ycfJ]
[OR:Escherichia coli] [DB:pir2] >gp:[GI:d1036911:g4062679] [LN:D90746]
[AC:D90746:AB001340] [PN:Hypothetical protein in ndh 3'region .] [GN:ycfJ]
[OR:Escherichia coli] [SR:Escherichia coli(strain:K12) DNA, clone:Kohara clone
237] [DB:genpept-bct1] [DE:Escherichia coli genomic DNA. (25.0 - 25.4 min).]
[NT:ORF_ID:o237#9; similar to SwissProt Accession] [LE:9540] [RE:10079]
[DI:direct] >gp:[GI:g1787353] [LN:AE000211] [AC:AE000211:U00096] [PN:orf,
hypothetical protein] [GN:ycfJ] [FN:orf; Unknown] [OR:Escherichia coli]
[DB:genpept-bct2] [DE:Escherichia coli K-12 MG1655 section 101 of 400 of the
completegenome.] [NT:o179; 100 pct identical to 63 aa fragment of] [LE:5911]
[RE:6450] [DI:direct]

| ORF Name | NT ID | AA ID | NT LN | AA LN | Score | P-value |
|---|---|---|---|---|---|---|
| 104762_c2_1620 | 422 | 7593 | 612 | 203 | 850 | 7.0e-85 |

Description sp:[LN:A57258] [AC:A57258] [PN:rha protein] [CL:phage P22 orf-201 protein]
[OR:phage phi-80] [DB:pir2] >gp:[GI:g1019108] [LN:P80A] [AC:L40418]
[FN:inhibitory for phage growth in E. coli IHF] [OR:Bacteriophage phi-80]
[DB:genpept-phg] [DE:Bacteriophage phi-80 gene, complete cds.] [NT:alternate
start at bp 59; ORF] [LE:175] [RE:729] [DI:direct]

| ORF Name | NT ID | AA ID | NT LN | AA LN | Score | P-value |
|---|---|---|---|---|---|---|
| 1050650_c2_1821 | 423 | 7594 | 927 | 308 | 1016 | 1.8e-102 |

Description sp:[LN:PGPB_ECOLI] [AC:P18201] [GN:PGPB] [OR:Escherichia coli] [EC:3.1.3.27]
[DE:PHOSPHATIDYLGLYCEROPHOSPHATASE B,] [SP:P18201] [DB:swissprot] >sp:[LN:PAECGB]
[AC:A30193:A64876] [PN:phosphatidylglycerophosphatase, B] [GN:pgpB]
[CL:phosphatidylglycerophosphatase B] [OR:Escherichia coli] [EC:3.1.3.27]
[DB:pir1] >gp:[GI:d1015548:g1742092] [LN:D90766] [AC:D90766:AB001340]
[PN:Phosphatidylglycerophosphatase B (EC 3.1.3.27).] [GN:pgpB] [OR:Escherichia
coli] [SR:Escherichia coli (strain:K12) DNA, clone_lib:Kohara lambda minise]
[DB:genpept-bct1] [DE:E.coli genomic DNA, Kohara clone #255(28.8-29.2 min.).]
[NT:ORF_ID:o255#3; similar to [SwissProt Accession] [LE:1595] [RE:2359]
[DI:direct] >gp:[GI:g450384] [LN:ECOPGPB] [AC:M23628]
[PN:phosphatidylglycerophosphate phosphatase B] [GN:pgpB] [OR:Escherichia coli]
[DB:genpept-bct1] [EC:3.1.3.27] [DE:E. coli phosphatidylglycerophosphate
phosphatase B (pgpB) gene,comnplete cds.] [LE:272] [RE:1036] [DI:direct]
>gp:[GI:g1787534] [LN:AE000226] [AC:AE000226:U00096] [PN:non-essential
phosphatidylglycerophosphate] [GN:pgpB] [FN:enzyme; Macromolecule synthesis,
modification:] [OR:Escherichia coli] [DB:genpept-bct2] [EC:3.1.3.27]
[DE:Escherichia coli K-12 MG1655 section 116 of 400 of the completegenome.]
[NT:o254; 100 pct identical to PGPB_ECOLI SW: P18201;] [LE:822] [RE:1586]
[DI:direct]

| ORF_Name | NT_ID | AA_ID | NT LN | AA LN | Score | P-value |
|---|---|---|---|---|---|---|
| 1051637_c2_1689 | 424 | 7595 | 825 | 274 | 948 | 2.9e-95 |

Description sp:[LN:YEAM_ECOLI] [AC:P76241] [GN:YEAM] [OR:Escherichia coli] [DE:HYPOTHETICAL TRANSCRIPTIONAL REGULATOR IN GAPA-RND INTERGENIC REGION] [SP:P76241] [DB:swissprot] >sp:[LN:F64939] [AC:F64939] [PN:hypothetical protein b1790] [OR:Escherichia coli] [DB:pir2] >gp:[GI:g1788091] [LN:AE000274] [AC:AE000274:U00096] [PN:putative ARAC-type regulatory protein] [GN:yeaM] [FN:putative regulator; Not classified] [OR:Escherichia coli] [DB:genpept-bct2] [DE:Escherichia coli K-12 MG1655 section 164 of 400 of the completegenome.] [NT:f273; This 273 aa ORF is 21 pct identical (7 gaps)] [LE:494] [RE:1315] [DI:complement]

| ORF_Name | NT_ID | AA_ID | NT LN | AA LN | Score | P-value |
|---|---|---|---|---|---|---|
| 10633290_c1_1188 | 425 | 7596 | 864 | 287 | 1176 | 2.0e-119 |

Description gp:[GI:d1036923:g4062689] [LN:D90747] [AC:D90747:AB001340] [PN:Heterocyst maturation protein (devA) homolog] [OR:Escherichia coli] [SR:Escherichia coli(strain:K12) DNA, clone:Kohara clone #238] [DB:genpept-bct1] [DE:Escherichia coli genomic DNA. (25.2 - 25.6 min).] [NT:ORF_ID:o238#6; similar to PIR Accession Number] [LE:8216] [RE:9007] [DI:direct]

| ORF_Name | NT_ID | AA_ID | NT LN | AA LN | Score | P-value |
|---|---|---|---|---|---|---|
| 10727218_f3_822 | 426 | 7597 | 912 | 303 | 448 | 2.8e-42 |

Description sp:[LN:DSDC_ECOLI] [AC:P46068:P77443] [GN:DSDC] [OR:Escherichia coli] [DE:D-SERINE DEAMINASE ACTIVATOR] [SP:P46068:P77443] [DB:swissprot] >sp:[LN:A65010] [AC:A65010] [PN:d-serine deaminase activator] [GN:dsdC] [CL:regulatory protein ampR] [OR:Escherichia coli] [DB:pir2] >gp:[GI:d1016952:g1799763] [LN:D90866] [AC:D90866:AB001340] [PN:D-SERINE DEAMINASE ACTIVATOR.] [GN:dsdC] [OR:Escherichia coli] [SR:Escherichia coli (strain:K12) DNA, clone_lib:Kohara lambda minise] [DB:genpept-bct1] [DE:E.coli genomic DNA, Kohara clone #411(53.2-53.6 min.).] [NT:similar to [SwissProt Accession Number P46068]] [LE:9703] [RE:10638] [DI:complement] >gp:[GI:d1016960:g1799772] [LN:D90867] [AC:D90867:AB001340] [PN:D-SERINE DEAMINASE ACTIVATOR.] [GN:dsdC] [OR:Escherichia coli] [SR:Escherichia coli (strain:K12) DNA, clone_lib:Kohara lambda minise] [DB:genpept-bct1] [DE:E.coli genomic DNA, Kohara clone #412(53.4-53.8 min.).] [NT:similar to [SwissProt Accession Number P46068]] [LE:462] [RE:1397] [DI:complement] >gp:[GI:g1788706] [LN:AE000324] [AC:AE000324:U00096] [PN:D-serine dehydratase (deaminase) transcriptional] [GN:dsdC] [FN:regulator; Degradation of small molecules:] [OR:Escherichia coli] [DB:genpept-bct2] [DE:Escherichia coli K-12 MG1655 section 214 of 400 of the completegenome.] [NT:f311; 99 pct identical to DSDC_ECOLI SW: P46068] [LE:6113] [RE:7048] [DI:complement]

| ORF Name | NT ID | AA ID | NT/LN | AA/LN | Score | P-value |
|---|---|---|---|---|---|---|
| 10835332_c2_1897 | 427 | 7598 | 1233 | 410 | 90 | 0.048 |

Description gp:[GI:e1347376:g3877772] [LN:CEF56H6] [AC:Z81553] [GN:F56H6.11]
[OR:Caenorhabditis elegans] [DB:genpept-inv1] [DE:Caenorhabditis elegans cosmid F56H6, complete sequence.] [LE:28107:28400:28710:28911]
[RE:28351:28664:28845:28997] [DI:directJoin]

| ORF Name | NT ID | AA ID | NT/LN | AA/LN | Score | P-value |
|---|---|---|---|---|---|---|
| 10979836_c3_2068 | 428 | 7599 | 1056 | 351 | 1594 | 1.0e-163 |

Description sp:[LN:SELD_ECOLI] [AC:P16456] [GN:SELD:FDHB] [OR:Escherichia coli] [EC:2.7.9.3]
[DE:(SELENIUM DONOR PROTEIN)] [SP:P16456] [DB:swissprot] >sp:[LN:JW0033]
[AC:JW0033:D64936] [PN:selenophosphate synthase] [GN:selD] [OR:Escherichia coli]
[DB:pir2] >gp:[GI:d1016278:g1742875] [LN:D90820] [AC:D90820:AB001340]
[PN:Selenide,water dikinase (EC 2.7.9.3)] [GN:selD, fdhB] [OR:Escherichia coli]
[SR:Escherichia coli (strain:K12) DNA, clone_lib:Kohara lambda minise]
[DB:genpept-bct1] [DE:E.coli genomic DNA, Kohara clone #329(39.7-40.0 min.).]
[NT:ORF_ID:o329#1; similar to [SwissProt Accession] [LE:3822] [RE:4865]
[DI:complement] >gp:[GI:g147806] [LN:ECOSELD] [AC:M30184] [PN:selenium metabolism protein] [GN:selD] [OR:Escherichia coli] [SR:Escherichia coli (strain MC4100)
(clone: pMN302) DNA] [DB:genpept-bct1] [DE:E.coli selenium metabolism protein (selD) gene, complete cds.] [LE:38] [RE:1081] [DI:direct] >gp:[GI:g1788062]
[LN:AE000271] [AC:AE000271:U00096] [PN:selenophosphate synthase, H(2)Se added to]
[GN:selD] [FN:enzyme; Aminoacyl tRNA synthetases, tRNA] [OR:Escherichia coli]
[DB:genpept-bct2] [DE:Escherichia coli K-12 MG1655 section 161 of 400 of the completegenome.] [NT:f347; 100 pct identical to SELD_ECOLI SW: P16456;] [LE:4742]
[RE:5785] [DI:complement]

| ORF Name | NT ID | AA ID | NT/LN | AA/LN | Score | P-value |
|---|---|---|---|---|---|---|
| 11883340_f1_245 | 429 | 7600 | 285 | 94 | 119 | 3.7e-06 |

Description gp:[GI:g5305335] [LN:AF071081] [AC:AF071081] [PN:proline-rich mucin homolog]
[OR:Mycobacterium tuberculosis] [DB:genpept-bct2] [DE:Mycobacterium tuberculosis proline-rich mucin homolog gene,complete cds.] [NT:74kD protein] [LE:1538]
[RE:3829] [DI:direct]

| ORF Name | NT ID | AA ID | NT/LN | AA/LN | Score | P-value |
|---|---|---|---|---|---|---|
| 1206455_c1_1535 | 430 | 7601 | 798 | 265 | 445 | 5.8e-42 |

Description gp:[GI:e1315844:g3425862] [LN:SCO07731] [AC:AJ007731] [PN:3-ketoacyl-ACP/CoA redutase] [GN:orfX] [OR:Streptomyces coelicolor] [DB:genpept-bct1]
[DE:Streptomyces coelicolor scbR gene, scbA gene, ORFs A,B,X & Z.] [LE:3795]
[RE:4529] [DI:complement]

| ORF_Name | NT ID | AA ID | NT/LN | AA/LN | Score | P-value |
|---|---|---|---|---|---|---|
| 12226430_f2_728 | 431 | 7602 | 1179 | 392 | 1741 | 2.7e-179 |

Description sp:[LN:POTA_ECOLI] [AC:P23858] [GN:POTA] [OR:Escherichia coli]
[DE:SPERMIDINE/PUTRESCINE TRANSPORT ATP-BINDING PROTEIN POTA] [SP:P23858]
[DB:swissprot] >sp:[LN:A40840] [AC:A40840:C64857] [PN:spermidine/putrescine
transport protein potA] [GN:potA] [CL:unassigned ATP-binding cassette
proteins:ATP-binding cassette homology] [OR:Escherichia coli] [DB:pir2]
>gp:[GI:d1036934:g1651555] [LN:D90748] [AC:D90748:AB001340]
[PN:Spermidine/putrescine transport protein A] [GN:potA] [OR:Escherichia coli]
[SR:Escherichia coli(strain:K12) DNA, clone:Kohara clone #239] [DB:genpept-bct1]
[DE:Escherichia coli genomic DNA. (25.6 - 25.9 min).] [NT:ORF_ID:o239#1; similar
to PIR Accession Number] [LE:692] [RE:1828] [DI:complement] >gp:[GI:g1787370]
[LN:AE000212] [AC:AE000212:U00096] [PN:ATP-binding component of
spermidine/putrescine] [GN:potA] [FN:transport; Transport of small molecules:
Amino] [OR:Escherichia coli] [DB:genpept-bct2] [DE:Escherichia coli K-12 MG1655
section 102 of 400 of the completegenome.] [NT:f378; 99 pct identical to
POTA_ECOLI SW: P23858] [LE:10460] [RE:11596] [DI:complement] >gp:[GI:g147326]
[LN:ECOPOTABCD] [AC:M64519] [PN:transport protein] [GN:potA] [OR:Escherichia
coli] [SR:E.coli (strain DR112) DNA, clone pPT104] [DB:genpept-bct2] [DE:E.coli
transport protein (potA, potB, potC and potD) genes,complete cds.] [LE:379]
[RE:1515] [DI:direct]

| ORF_Name | NT ID | AA ID | NT/LN | AA/LN | Score | P-value |
|---|---|---|---|---|---|---|
| 12301027_c2_1745 | 432 | 7603 | 1392 | 463 | 1736 | 9.1e-179 |

Description sp:[LN:ASTB_ECOLI] [AC:P76216] [GN:ASTB] [OR:Escherichia coli] [EC:3.-.-.-]
[DE:SUCCINYLARGININE DIHYDROLASE,] [SP:P76216] [DB:swissprot] >sp:[LN:A64934]
[AC:A64934] [PN:hypothetical protein b1745] [OR:Escherichia coli] [DB:pir2]
>gp:[GI:g1788041] [LN:AE000269] [AC:AE000269:U00096] [PN:orf, hypothetical
protein] [GN:b1745] [FN:orf; Unknown] [OR:Escherichia coli] [DB:genpept-bct2]
[DE:Escherichia coli K-12 MG1655 section 159 of 400 of the completegenome.]
[NT:f447] [LE:5690] [RE:7033] [DI:complement]

| ORF_Name | NT ID | AA ID | NT/LN | AA/LN | Score | P-value |
|---|---|---|---|---|---|---|
| 12360662_f1_225 | 433 | 7604 | 279 | 92 | 273 | 9.8e-24 |

Description sp:[LN:MSGA_SALTY] [AC:Q56031] [GN:MSGA] [OR:Salmonella typhimurium]
[DE:VIRULENCE PROTEIN MSGA] [SP:Q56031] [DB:swissprot] >gp:[GI:g1000114]
[LN:STU31849] [AC:U31849] [PN:MsgA] [GN:msgA] [FN:macrophage survival; virulence]
[OR:Salmonella typhimurium] [DB:genpept-bct1] [DE:Salmonella typhimurium pagD,
envE, msgA and envF genes, completecds.] [NT:MudJ insertion in msgA affects
survival within] [LE:1825] [RE:2064] [DI:direct]

| ORF_Name | NT ID | AA ID | NT LN | AA LN | Score | P-value |
|---|---|---|---|---|---|---|
| 12370755_f3_847 | 434 | 7605 | 1170 | 389 | 1639 | 1.7e-168 |

Description sp:[LN:SAPD_ECOLI] [AC:P36635] [GN:SAPD] [OR:Escherichia coli] [DE:PEPTIDE
TRANSPORT SYSTEM ATP-BINDING PROTEIN SAPD] [SP:P36635] [DB:swissprot]
>sp:[LN:F64877] [AC:F64877] [PN:peptide transport system ATP-binding protein
sapD] [GN:sapD] [CL:unassigned ATP-binding cassette proteins:ATP-binding cassette
homology] [OR:Escherichia coli] [DB:pir2] >gp:[GI:d1015560:g1742104] [LN:D90766]
[AC:D90766:AB001340] [PN:Peptide transport system ATP-binding protein] [GN:sapD]
[OR:Escherichia coli] [SR:Escherichia coli (strain:K12) DNA, clone_lib:Kohara
lambda minise] [DB:genpept-bct1] [DE:E.coli genomic DNA, Kohara clone
255(28.8-29.2 min.).] [NT:ORF_ID:o255#19; similar to [SwissProt Accession]
[LE:14904] [RE:15896] [DI:complement] >gp:[GI:d1015568:g1742113] [LN:D90767]
[AC:D90767:AB001340] [PN:Peptide transport system ATP-binding protein] [GN:sapD]
[OR:Escherichia coli] [SR:Escherichia coli (strain:K12) DNA, clone_lib:Kohara
lambda minise] [DB:genpept-bct1] [DE:E.coli genomic DNA, Kohara clone
256(29.0-29.4 min.).] [NT:ORF_ID:o255#19; similar to [SwissProt Accession]
[LE:8299] [RE:9291] [DI:complement] >gp:[GI:d1015577:g1742122] [LN:D90768]
[AC:D90768:AB001340] [PN:Peptide transport system ATP-binding protein] [GN:sapD]
[OR:Escherichia coli] [SR:Escherichia coli (strain:K12) DNA, clone_lib:Kohara
lambda minise] [DB:genpept-bct1] [DE:E.coli genomic DNA, Kohara clone
257(29.1-29.6 min.).] [NT:ORF_ID:o255#19; similar to [SwissProt Accession]
[LE:8] [RE:1000] [DI:complement] >gp:[GI:e236626:g1279403] [LN:ECSAPABCD]
[AC:X97282] [PN:SapD protein] [GN:sapD] [OR:Escherichia coli] [DB:genpept-bct1]
[DE:E.coli sapABCDF operon.] [SP:P36635] [LE:3716] [RE:4708] [DI:direct]
>gp:[GI:g1787548] [LN:AE000227] [AC:AE000227:U00096] [PN:putative ATP-binding
protein of peptide] [GN:sapD] [FN:putative transport; Not classified]
[OR:Escherichia coli] [DB:genpept-bct2] [DE:Escherichia coli K-12 MG1655 section
117 of 400 of the completegenome.] [NT:f330; 100 pct identical to 30 aa fragment]
[LE:3720] [RE:4712] [DI:complement]

| ORF Name | NT ID | AA ID | NT LN | AA LN | Score | P-value |
|---|---|---|---|---|---|---|
| 12535018_c2_1799 | 435 | 7606 | 909 | 302 | 525 | 1.9e-50 |

Description sp:[LN:GCVA_ECOLI] [AC:P32064] [GN:GCVA] [OR:Escherichia coli] [DE:ACTIVATOR)]
[SP:P32064] [DB:swissprot] >sp:[LN:I41065] [AC:I41065:I41229:D65063:S34371]
[PN:glycine cleavage system transcription activator] [GN:gcvA] [CL:regulatory
protein ampR] [OR:Escherichia coli] [DB:pir2] >gp:[GI:g312766] [LN:ECGCVA]
[AC:X73413] [PN:glycine cleavage activator protein] [GN:gcvA] [OR:Escherichia
coli] [DB:genpept-bct1] [DE:E.coli gene for glycine cleavage activator protein
and orf 2 and 3.] [SP:P32064] [LE:43] [RE:960] [DI:direct] >gp:[GI:g882703]
[LN:ECU29581] [AC:U29581] [GN:gcvA] [FN:regulatory protein for glycine cleavage]
[OR:Escherichia coli] [DB:genpept-bct1] [DE:Escherichia coli K-12 genome;
approximately 63 to 64 minutes.] [NT:CG Site No. 28676] [LE:23205] [RE:24122]
[DI:complement] >gp:[GI:g1789173] [LN:AE000364] [AC:AE000364:U00096] [PN:positive
regulator of gcv operon] [GN:gcvA] [FN:regulator; Central intermediary
metabolism:] [OR:Escherichia coli] [DB:genpept-bct2] [DE:Escherichia coli K-12
MG1655 section 254 of 400 of the completegenome.] [NT:f305; 100 pct identical to
GCVA_ECOLI SW: P32064;] [LE:7719] [RE:8636] [DI:complement] >gp:[GI:g523331]
[LN:ECOGCVA] [AC:U01030] [PN:GcvA] [FN:regulatory protein for glycine cleavage
enzyme] [OR:Escherichia coli] [DB:genpept-bct2] [DE:Escherichia coli K12 glycine
cleavage activator protein (gcvA)gene, complete cds.] [LE:304] [RE:1221]
[DI:direct]

| ORF Name | NT ID | AA ID | NT LN | AA LN | Score | P-value |
|---|---|---|---|---|---|---|
| 12536066_c1_1491 | 436 | 7607 | 1431 | 476 | 2270 | 2.4e-235 |

Description sp:[LN:YCJX_ECOLI] [AC:P76046:P77411] [GN:YCJX] [OR:Escherichia coli]
[DE:HYPOTHETICAL 52.6 KD PROTEIN IN OMPG-TYRR INTERGENIC REGION]
[SP:P76046:P77411] [DB:swissprot] >sp:[LN:D64881] [AC:D64881] [PN:ycjX protein]
[GN:ycjX] [OR:Escherichia coli] [DB:pir2] >gp:[GI:g1787581] [LN:AE000230]
[AC:AE000230:U00096] [PN:putative EC 2.1 enzymes] [GN:ycjX] [FN:putative enzyme;
Not classified] [OR:Escherichia coli] [DB:genpept-bct2] [DE:Escherichia coli K-12
MG1655 section 120 of 400 of the completegenome.] [NT:o465; This 465 aa ORF is 50
pct identical (6 gaps)] [LE:2279] [RE:3676] [DI:direct]

| ORF Name | NT ID | AA ID | NT LN | AA LN | Score | P-value |
|---|---|---|---|---|---|---|
| 12541666_f1_146 | 437 | 7608 | 246 | 81 | 121 | 1.0e-07 |

Description sp:[LN:YBIL_ECOLI] [AC:P75780] [GN:YBIL] [OR:Escherichia coli] [DE:PROBABLE
TONB-DEPENDENT RECEPTOR YBIL PRECURSOR] [SP:P75780] [DB:swissprot]
>sp:[LN:E64817] [AC:E64817] [PN:probable membrane protein b0805] [OR:Escherichia
coli] [DB:pir2] >gp:[GI:d1036457;g4062366] [LN:D90717] [AC:D90717:AB001340]
[PN:Fe(III)-pyochelin receptor fptA precursor] [GN:fptA] [OR:Escherichia coli]
[SR:Escherichia coli(strain:K12) DNA, clone:Kohara clone #204] [DB:genpept-bct1]
[DE:Escherichia coli genomic DNA. (17.9 - 18.2 min).] [NT:ORF_ID:o205#1; similar
to PIR Accession Number] [LE:10551] [RE:12833] [DI:complement]
>gp:[GI:d1036462;g4062371] [LN:D90718] [AC:D90718:AB001340] [PN:Fe(III)-pyochelin
receptor fptA precursor] [GN:fptA] [OR:Escherichia coli] [SR:Escherichia
coli(strain:K12) DNA, clone:Kohara clone #205] [DB:genpept-bct1] [DE:Escherichia
coli genomic DNA. (18.1 - 18.4 min).] [NT:ORF_ID:o205#1; similar to PIR Accession
Number] [LE:567] [RE:2849] [DI:complement] >gp:[GI:g1787024] [LN:AE000182]
[AC:AE000182:U00096] [PN:putative outer membrane receptor for iron] [GN:b0805]
[FN:putative membrane; Not classified] [OR:Escherichia coli] [DB:genpept-bct2]
[DE:Escherichia coli K-12 MG1655 section 72 of 400 of the completegenome.]
[NT:f760; This 760 aa ORF is 25 pct identical (75 gaps)] [LE:8516] [RE:10798]
[DI:complement]

| ORF Name | NT ID | AA ID | NT LN | AA LN | Score | P-value |
|---|---|---|---|---|---|---|
| 12677307_f1_185 | 438 | 7609 | 480 | 159 | 119 | 2.5e-06 |

Description gp:[GI:e1388148;g4455733] [LN:SC2G5] [AC:AL035478] [PN:putative transferase]
[GN:SC2G5.09] [OR:Streptomyces coelicolor] [DB:genpept-bct1] [DE:Streptomyces
coelicolor cosmid 2G5.] [NT:SC2G5.09, possible transferase, len: 566aa;]
[LE:7695] [RE:9395] [DI:direct]

| ORF_Name | NT ID | AA ID | NT LN | AA LN | Score | P-value |
|---|---|---|---|---|---|---|
| 12704781_c3_2035 | 439 | 7610 | 1365 | 454 | 1800 | 1.5e-185 |

Description sp:[LN:UMUC_ECOLI] [AC:P04152] [GN:UMUC] [OR:Escherichia coli] [DE:UMUC PROTEIN]
[SP:P04152] [DB:swissprot] >sp:[LN:ZWECC] [AC:E64864:A03550:B23157] [PN:umuC
protein] [GN:umuC] [CL:umuC protein] [OR:Escherichia coli] [DB:pir1] [MP:26 min]
>gp:[GI:d1037017:g1651581] [LN:D90752] [AC:D90752:AB001340] [PN:UmuC protein.]
[GN:umuC] [OR:Escherichia coli] [SR:Escherichia coli(strain:K12) DNA,
clone:Kohara clone #243] [DB:genpept-bct1] [DE:Escherichia coli genomic DNA.
(26.3 - 26.7 min).] [NT:ORF_ID:o244#4; similar to PIR Accession Number]
[LE:13077] [RE:14345] [DI:direct] >gp:[GI:d1037025:g1651587] [LN:D90753]
[AC:D90753:AB001340] [PN:UmuC protein.] [GN:umuC] [OR:Escherichia coli]
[SR:Escherichia coli(strain:K12) DNA, clone:Kohara clone #244] [DB:genpept-bct1]
[DE:Escherichia coli genomic DNA. (26.5 - 26.8 min).] [NT:ORF_ID:o244#4; similar
to PIR Accession Number] [LE:2932] [RE:4200] [DI:direct] >gp:[GI:g148129]
[LN:ECOUMUDC] [AC:M13387] [GN:umuC] [OR:Escherichia coli] [SR:Escherichia coli
DNA] [DB:genpept-bct1] [DE:E.coli umuDC operon encoding proteins functional in UV
mutagenesis,complete cds.] [LE:530] [RE:1798] [DI:direct] >gp:[GI:g1787432]
[LN:AE000216] [AC:AE000216:U00096] [PN:SOS mutagenesis and repair] [GN:umuC]
[FN:putative enzyme; DNA - replication, repair] [OR:Escherichia coli]
[DB:genpept-bct2] [DE:Escherichia coli K-12 MG1655 section 106 of 400 of the
completegenome.] [NT:o422; 99 pct identical to UMUC_ECOLI SW: P04152] [LE:10053]
[RE:11321] [DI:direct]

| ORF_Name | NT ID | AA ID | NT LN | AA LN | Score | P-value |
|---|---|---|---|---|---|---|
| 12915893_f1_87 | 440 | 7611 | 555 | 184 | 284 | 6.7e-25 |

Description gp:[GI:e1331942:g4106573] [LN:YP102KB] [AC:AL031866] [OR:Yersinia pestis]
[DB:genpept-bct1] [DE:Yersinia pestis 102 kbases unstable region: from 1 to
119443.] [NT:ORF 6, len=190 aa, similar to a 212 aa hypothetical] [LE:5698]
[RE:6270] [DI:complement]

| ORF_Name | NT ID | AA ID | NT LN | AA LN | Score | P-value |
|---|---|---|---|---|---|---|
| 12916531_c1_1523 | 441 | 7612 | 1314 | 437 | | |

Description

NO-HIT

| ORF_Name | NT ID | AA ID | NT LN | AA LN | Score | P-value |
|---|---|---|---|---|---|---|
| 12928461_c1_1266 | 442 | 7613 | 2265 | 754 | 340 | 8.8e-28 |

Description sp:[LN:T14652] [AC:T14652] [PN:protein J] [OR:Yersinia pestis] [DB:pir2]
>gp:[GI:g2996342] [LN:AF053947] [AC:AF053947] [PN:phage lambda host specific
protein J] [OR:Yersinia pestis] [DB:genpept-bct2] [DE:Yersinia pestis plasmid
pMT1, complete plasmid sequence.] [LE:6571] [RE:11049] [DI:complement]

| ORF_Name | NT_ID | AA_ID | NT LN | AA LN | Score | P-value |
|---|---|---|---|---|---|---|
| 12973281_f1_368 | 443 | 7614 | 267 | 88 | 119 | 1.3e-06 |

Description sp:[LN:T08134] [AC:T08134] [PN:oleosin-like protein] [OR:Brassica napus] [SR:, rape] [DB:pir2] >gp:[GI:e283598:g1769972] [LN:BNOLEOLP] [AC:Y08986] [PN:oleosin-like protein] [OR:Brassica napus] [SR:rape] [DB:genpept-pln1] [DE:B.napus gene encoding oleosin-like protein.] [LE:1907:2973:3278] [RE:2220:3209:3854] [DI:directJoin]

| ORF_Name | NT_ID | AA_ID | NT LN | AA LN | Score | P-value |
|---|---|---|---|---|---|---|
| 13016303_f3_803 | 444 | 7615 | 2742 | 913 | 864 | 1.0e-87 |

Description gp:[GI:g1354473] [LN:NCU53189] [AC:U53189] [PN:Os-1p] [GN:os-1] [OR:Neurospora crassa] [SR:Neurospora crassa strain=74-OR23-1A] [DB:genpept-pln2] [DE:Neurospora crassa osmotic-1 (os-1) gene, complete cds.] [LE:2157:3025:3941:4269] [RE:2958:3884:4207:5765] [DI:directJoin]

| ORF_Name | NT_ID | AA_ID | NT LN | AA LN | Score | P-value |
|---|---|---|---|---|---|---|
| 13020833_c2_1572 | 445 | 7616 | 909 | 302 | 1237 | 6.9e-126 |

Description sp:[LN:E64856] [AC:E64856] [PN:hypothetical protein b1120] [CL:conserved hypothetical protein b1120] [OR:Escherichia coli] [DB:pir2]
>gp:[GI:d1036926:g4062692] [LN:D90747] [AC:D90747:AB001340] [OR:Escherichia coli] [SR:Escherichia coli(strain:K12) DNA, clone:Kohara clone #238] [DB:genpept-bct1] [DE:Escherichia coli genomic DNA. (25.2 - 25.6 min.).] [NT:ORF_ID:o238#9] [LE:11207] [RE:12046] [DI:direct] >gp:[GI:g1787364] [LN:AE000212] [AC:AE000212:U00096] [PN:putative nicotinic acid] [GN:cobB] [FN:putative enzyme; Biosynthesis of cofactors,] [OR:Escherichia coli] [DB:genpept-bct2] [DE:Escherichia coli K-12 MG1655 section 102 of 400 of the completegenome.] [NT:o279; This 279 aa ORF is 31 pct identical (8 gaps)] [LE:5522] [RE:6361] [DI:direct]

| ORF_Name | NT_ID | AA_ID | NT LN | AA LN | Score | P-value |
|---|---|---|---|---|---|---|
| 13681550_c1_1297 | 446 | 7617 | 936 | 311 | 1166 | 2.3e-118 |

Description sp:[LN:DDG_ECOLI] [AC:P76522:P76949] [GN:DDG] [OR:Escherichia coli] [DE:DDG PROTEIN] [SP:P76522:P76949] [DB:swissprot] >gp:[GI:d1016976:g1799789] [LN:D90868] [AC:D90868:AB001340] [PN:HEAT SHOCK PROTEIN B.] [GN:htrB] [OR:Escherichia coli] [SR:Escherichia coli (strain:K12) DNA, clone_lib:Kohara lambda minise] [DB:genpept-bct1] [DE:E.coli genomic DNA, Kohara clone #414(53.8-54.2 min.).] [NT:similar to [SwissProt Accession Number P24187]] [LE:4122] [RE:5042] [DI:direct] >gp:[GI:g1872207] [LN:ECU49787] [AC:U49787] [PN:HtrB homolog] [OR:Escherichia coli] [DB:genpept-bct2] [DE:Escherichia coli HtrB homolog gene, complete cds.] [NT:Ddg] [LE:294] [RE:1214] [DI:direct]

| ORF Name | NT ID | AA ID | NT LN | AA LN | Score | P-value |
|---|---|---|---|---|---|---|
| 13720456_c3_2103 | 447 | 7618 | 393 | 130 | 502 | 5.3e-48 |

Description sp:[LN:PTCB_ECOLI] [AC:P17409] [GN:CELA] [OR:Escherichia coli] [EC:2.7.1.69]
[DE:(EC 2.7.1.69)] [SP:P17409] [DB:swissprot] >sp:[LN:S10870] [AC:S10870:B64933]
[PN:phosphotransferase system enzyme II,, cellobiose-specific factor IIB]
[GN:celA] [CL:phosphotransferase system enzyme II cellobiose-specific factor IIB]
[OR:Escherichia coli] [EC:2.7.1.69] [DB:pir2] >gp:[GI:d1016242:g1742835]
[LN:D90816] [AC:D90816:AB001340] [PN:CelA protein] [GN:celA] [OR:Escherichia
coli] [SR:Escherichia coli (strain:K12) DNA, clone_lib:Kohara lambda minise]
[DB:genpept-bct1] [DE:E.coli genomic DNA, Kohara clone #325(38.9-39.2 min.).]
[NT:ORF_ID:o326#7; similar to [PIR Accession Number] [LE:13888] [RE:14208]
[DI:complement] >gp:[GI:d1016250:g1742844] [LN:D90817] [AC:D90817:AB001340]
[PN:CelA protein] [GN:celA] [OR:Escherichia coli] [SR:Escherichia coli
(strain:K12) DNA, clone_lib:Kohara lambda minise] [DB:genpept-bct1] [DE:E.coli
genomic DNA, Kohara clone #326(39.1-39.4 min.).] [NT:ORF_ID:o326#7; similar to
[PIR Accession Number] [LE:6659] [RE:6979] [DI:complement]
>gp:[GI:d1016256:g1742851] [LN:D90818] [AC:D90818:AB001340] [PN:CelA protein]
[GN:celA] [OR:Escherichia coli] [SR:Escherichia coli (strain:K12) DNA,
clone_lib:Kohara lambda minise] [DB:genpept-bct1] [DE:E.coli genomic DNA, Kohara
clone #327(39.2-39.5 min.).] [NT:ORF_ID:o326#7; similar to [PIR Accession Number]
[LE:1027] [RE:1347] [DI:complement] >gp:[GI:g41097] [LN:ECCELOPE]
[AC:X52890:M64438:X53290] [OR:Escherichia coli] [DB:genpept-bct1] [DE:Escherichia
coli DNA for cel operon including celA, celB, celC,celD and celF genes.] [NT:celA
product, unknown] [SP:P17409] [LE:286] [RE:606] [DI:direct] >gp:[GI:g145478]
[LN:ECOCELA] [AC:M64438] [GN:celA] [OR:Escherichia coli] [SR:E.coli DNA]
[DB:genpept-bct1] [DE:E.coli cellobiose permease proteins celA, celB, celC,
cellobioseoperon repressor protein celD and cellobiose
phospho-B-glucosidaseprotein celF gene, complete cds.] [NT:putative] [LE:286]
[RE:606] [DI:direct] >gp:[GI:g1788034] [LN:AE000269] [AC:AE000269:U00096]
[PN:PEP-dependent phosphotransferase enzyme IV for] [GN:celA] [FN:enzyme;
Transport of small molecules:] [OR:Escherichia coli] [DB:genpept-bct2]
[EC:2.7.1.69] [DE:Escherichia coli K-12 MG1655 section 159 of 400 of the
completegenome.] [NT:f106; 100 pct identical to PTCB_ECOLI SW: P17409;] [LE:73]
[RE:393] [DI:complement]

| ORF Name | NT ID | AA ID | NT LN | AA LN | Score | P-value |
|---|---|---|---|---|---|---|
| 13869043_f1_316 | 448 | 7619 | 198 | 65 | 105 | 6.2e-06 |

Description sp:[LN:YEBW_ECOLI] [AC:P76275] [GN:YEBW] [OR:Escherichia coli] [DE:HYPOTHETICAL
7.3 KD PROTEIN IN PRC-HOLE INTERGENIC REGION] [SP:P76275] [DB:swissprot]

| ORF Name | NT ID | AA ID | NT LN | AA LN | Score | P-value |
|---|---|---|---|---|---|---|
| 1413877_c1_1475 | 449 | 7620 | 954 | 317 | 127 | 1.8e-05 |

Description sp:[LN:YFHA_BORPE] [AC:P33445] [OR:Bordetella pertussis] [DE:HYPOTHETICAL 33.8 KD PROTEIN IN PHAC 3'REGION (ORFA)] [SP:P33445] [DB:swissprot] >gp:[GI:g313841] [LN:BPFIMABC] [AC:X64876:S49543] [GN:orfA] [OR:Bordetella pertussis] [DB:genpept-bct1] [DE:B.pertussis fimbrial gene cluster fimA, fimB fimC and fimD genes.] [SP:P33445] [LE:7396] [RE:8358] [DI:direct]

| ORF Name | NT ID | AA ID | NT LN | AA LN | Score | P-value |
|---|---|---|---|---|---|---|
| 14156902_f1_125 | 450 | 7621 | 228 | 75 | 112 | 3.7e-06 |

Description sp:[LN:YAMP_RHOCA] [AC:P14172] [OR:Rhodobacter capsulatus] [SR:,Rhodopseudomonas capsulata] [DE:HYPOTHETICAL 28.2 KD PROTEIN IN AMPR 5'REGION] [SP:P14172] [DB:swissprot] >sp:[LN:S04647] [AC:S04647] [PN:hypothetical 28.2K protein] [CL:Rhodobacter capsulatus hypothetical 28.2K protein] [OR:Rhodobacter capsulatus] [DB:pir2] >gp:[GI:g45988] [LN:RCAMPR] [AC:X15791] [OR:Rhodobacter capsulatus] [DB:genpept-bct1] [DE:Rhodopseudomonas capsulata beta-lactamase and AmpR genes.] [NT:unidentified open reading frame (260 AA)] [SP:P14172] [LE:810] [RE:1592] [DI:direct]

| ORF Name | NT ID | AA ID | NT LN | AA LN | Score | P-value |
|---|---|---|---|---|---|---|
| 14299043_f2_618 | 451 | 7622 | 246 | 81 | | |

Description

NO-HIT

| ORF Name | NT ID | AA ID | NT LN | AA LN | Score | P-value |
|---|---|---|---|---|---|---|
| 14306501_f3_883 | 452 | 7623 | 735 | 244 | | |

Description

NO-HIT

| ORF Name | NT ID | AA ID | NT LN | AA LN | Score | P-value |
|---|---|---|---|---|---|---|
| 14337500_f2_738 | 453 | 7624 | 306 | 101 | 126 | 3.7e-08 |

Description sp:[LN:D72732] [AC:D72732] [PN:hypothetical protein APE0397] [GN:APE0397] [OR:Aeropyrum pernix] [DB:pir2] >gp:[GI:d1043138:g5104036] [LN:AP000059] [AC:AP000059] [PN:118aa long hypothetical protein] [GN:APE0397] [OR:Aeropyrum pernix] [SR:Aeropyrum pernix (strain:K1) DNA] [DB:genpept-bct1] [DE:Aeropyrum pernix genomic DNA, section 2/7.] [NT:motif=prokaryotic membrane lipoprotein lipid] [LE:72689] [RE:73045] [DI:direct]

| ORF Name | NT ID | AA ID | NT LN | AA LN | Score | P-value |
|---|---|---|---|---|---|---|
| 14507006_f2_602 | 454 | 7625 | 933 | 310 | 544 | 1.9e-52 |

Description sp:[LN:YHJC_ECOLI] [AC:P37641] [GN:YHJC] [OR:Escherichia coli] [DE:HYPOTHETICAL TRANSCRIPTIONAL REGULATOR IN TREF-KDGK INTERGENIC REGION] [SP:P37641] [DB:swissprot]

| ORF Name | NT ID | AA ID | NT LN | AA LN | Score | P-value |
|---|---|---|---|---|---|---|
| 14553416_f3_882 | 455 | 7626 | 552 | 183 | 106 | 0.0088 |

Description sp:[LN:T13030] [AC:T13030] [PN:microtubule binding protein D-CLIP-190] [OR:Drosophila melanogaster] [DB:pir2] >gp:[GI:g2773363] [LN:AF041382] [AC:AF041382] [PN:microtubule binding protein D-CLIP-190] [OR:Drosophila melanogaster] [SR:fruit fly] [DB:genpept-inv1] [DE:Drosophila melanogaster microtubule binding protein D-CLIP-190mRNA, complete cds.] [NT:CLIP-170 homolog] [LE:633] [RE:5705] [DI:direct]

| ORF Name | NT ID | AA ID | NT LN | AA LN | Score | P-value |
|---|---|---|---|---|---|---|
| 14557061_c2_1726 | 456 | 7627 | 651 | 216 | 897 | 7.4e-90 |

Description sp:[LN:F64935] [AC:F64935] [PN:hypothetical protein b1758] [CL:Sulfolobus solfataricus translation elongation factor aEF-1 beta] [OR:Escherichia coli] [DB:pir2] >gp:[GI:g1788055] [LN:AE000270] [AC:AE000270;U00096] [PN:putative cytochrome oxidase] [GN:b1758] [FN:putative enzyme; Not classified] [OR:Escherichia coli] [DB:genpept-bct2] [DE:Escherichia coli K-12 MG1655 section 160 of 400 of the completegenome.] [NT:f208; This 208 aa ORF is 25 pct identical (11 gaps)] [LE:8608] [RE:9234] [DI:complement]

| ORF Name | NT ID | AA ID | NT LN | AA LN | Score | P-value |
|---|---|---|---|---|---|---|
| 14570311_f3_839 | 457 | 7628 | 2364 | 787 | 141 | 1.7e-08 |

Description sp:[LN:AARP_PROST] [AC:P43463] [GN:AARP] [OR:Providencia stuartii] [DE:TRANSCRIPTIONAL ACTIVATOR AARP] [SP:P43463] [DB:swissprot] >gp:[GI:g623476] [LN:PROAARP] [AC:L38718] [PN:transcriptional activator] [GN:aarP] [OR:Providencia stuartii] [DB:genpept-bct1] [DE:Providencia stuartii (clone pSK.aarP) transcriptional activator(aarP) gene, complete cds.] [NT:member of the AraC/XylS family] [LE:352] [RE:759] [DI:direct]

232

| ORF_Name | NT ID | AA ID | NT LN | AA LN | Score | P-value |
|---|---|---|---|---|---|---|
| 14572167_f1_153 | 458 | 7629 | 402 | 133 | 589 | 3.2e-57 |

Description sp:[LN:YCIA_ECOLI] [AC:P04379] [GN:YCIA] [OR:Escherichia coli] [DE:(P14 PROTEIN)]
[SP:P04379] [DB:swissprot] >sp:[LN:A05224] [AC:A05224:H64872] [PN:yciA protein
precursor:14.2K protein] [GN:yciA] [OR:Escherichia coli] [DB:pir2] [MP:28 min]
>gp:[GI:d1015501:g1742042] [LN:D90763] [AC:D90763:AB001340] [GN:yciA]
[OR:Escherichia coli] [SR:Escherichia coli (strain:K12) DNA, clone_lib:Kohara
lambda minise] [DB:genpept-bct1] [DE:E.coli genomic DNA, Kohara clone
252(28.1-28.4 min.).] [NT:ORF_ID:o252#11; similar to [SwissProt Accession]
[LE:10169] [RE:10567] [DI:complement] >gp:[GI:g1787506] [LN:AE000223]
[AC:AE000223:U00096] [PN:orf, hypothetical protein] [GN:yciA] [FN:orf; Unknown]
[OR:Escherichia coli] [DB:genpept-bct2] [DE:Escherichia coli K-12 MG1655 section
113 of 400 of the completegenome.] [NT:f132; 100 pct identical to YCIA_ECOLI SW:
P04379] [LE:9022] [RE:9420] [DI:complement] >gp:[GI:g455187] [LN:ECOTONB]
[AC:K00431] [OR:Escherichia coli] [SR:E.coli K12 (strain MO), clone pRZ540]
[DB:genpept-bct2] [DE:E.coli tonB and P14 genes, complete cds.] [NT:P14 protein
(P14 gene; putative); putative] [LE:1096] [RE:1494] [DI:complement]
>gp:[GI:g902382] [LN:ECU24195] [AC:U24195] [GN:yciA] [OR:Escherichia coli]
[DB:genpept-bct2] [DE:Escherichia coli ECOR 1 (yciD) gene, partial cds, and
(yciC), (yciB), (yciA), membrane protein (tonB), (yciI), putative potassiumchannel
(kch), and cardiolipin synthase (cls) genes, complete cds.] [LE:2294] [RE:2692]
[DI:direct] >gp:[GI:g902391] [LN:ECU24196] [AC:U24196] [GN:yciA] [OR:Escherichia
coli] [DB:genpept-bct2] [DE:Escherichia coli ECOR 4 (yciD) gene, partial cds, and
(yciC), (yciB), (yciA), membrane protein (tonB), (yciI), putative potassiumchannel
(kch), and cardiolipin synthase (cls) genes, complete cds.] [LE:2294] [RE:2692]
[DI:direct] >gp:[GI:g902400] [LN:ECU24197] [AC:U24197] [GN:yciA] [OR:Escherichia
coli] [DB:genpept-bct2] [DE:Escherichia coli ECOR 16 (yciD) gene, partial cds,
and (yciC), (yciB), (yciA), membrane protein (tonB), (yciI), putative
potassiumchannel (kch), and cardiolipin synthase (cls) genes, complete cds.]
[LE:2294] [RE:2692] [DI:direct] >gp:[GI:g902409] [LN:ECU24198] [AC:U24198]
[GN:yciA] [OR:Escherichia coli] [DB:genpept-bct2] [DE:Escherichia coli ECOR 28
(yciD) gene, partial cds, and (yciC), (yciB), (yciA), membrane protein (tonB),
(yciI), putative potassiumchannel (kch), and cardiolipin synthase (cls) genes,
complete cds.] [LE:2294] [RE:2692] [DI:direct] >gp:[GI:g902418] [LN:ECU24199]
[AC:U24199] [GN:yciA] [OR:Escherichia coli] [DB:genpept-bct2] [DE:Escherichia
coli ECOR 31 (yciD) gene, partial cds, and (yciC), (yciB), (yciA), membrane
protein (tonB), (yciI), putative potassiumchannel (kch), and cardiolipin synthase
(cls) genes, complete cds.] [LE:2294] [RE:2692] [DI:direct] >gp:[GI:g902427]

| ORF Name | NT ID | AA ID | NT/LN | AA/LN | Score | P-value |
|---|---|---|---|---|---|---|
| 14578260_c3_2158 | 459 | 7630 | 1179 | 392 | 1486 | 2.8e-152 |

Description sp:[LN:SOHB_ECOLI] [AC:P24213:P77676] [GN:SOHB] [OR:Escherichia coli]
[EC:3.4.-.-] [DE:POSSIBLE PROTEASE SOHB,] [SP:P24213:P77676] [DB:swissprot]
>sp:[LN:C64875] [AC:C64875:A38115:B25786] [PN:probable serine proteinase, sohB]
[GN:sohB] [OR:Escherichia coli] [EC:3.4.-.-] [DB:pir2] [MP:28 min]
>gp:[GI:d1015525:g1742067] [LN:D90764] [AC:D90764:AB001340] [PN:Probable
microbial serine proteinase (EC) [GN:sohB] [OR:Escherichia coli] [SR:Escherichia
coli (strain:K12) DNA, clone_lib:Kohara lambda minise] [DB:genpept-bct1]
[DE:E.coli genomic DNA, Kohara clone #253(28.4-28.7 min.).] [NT:ORF_ID:o253#12;
similar to [PIR Accession Number] [LE:11952] [RE:13001] [DI:direct]
>gp:[GI:d1015540:g1742083] [LN:D90765] [AC:D90765:AB001340] [PN:Probable
microbial serine proteinase (EC) [GN:sohB] [OR:Escherichia coli] [SR:Escherichia
coli (strain:K12) DNA, clone_lib:Kohara lambda minise] [DB:genpept-bct1]
[DE:E.coli genomic DNA, Kohara clone #254(28.4-28.9 min.).] [NT:ORF_ID:o253#12;
similar to [PIR Accession Number] [LE:9458] [RE:10507] [DI:direct]
>gp:[GI:g1787527] [LN:AE000225] [AC:AE000225:U00096] [PN:putative protease]
[GN:sohB] [FN:putative enzyme; Not classified] [OR:Escherichia coli]
[DB:genpept-bct2] [EC:3.4.-.-] [DE:Escherichia coli K-12 MG1655 section 115 of
400 of the completegenome.] [NT:o349; 99 pct identical to SOHB_ECOLI SW: P24213;
CG] [LE:2616] [RE:3665] [DI:direct]

| ORF Name | NT ID | AA ID | NT/LN | AA/LN | Score | P-value |
|---|---|---|---|---|---|---|
| 14587826_c3_1983 | 460 | 7631 | 1725 | 574 | 1212 | 3.1e-123 |

Description gp:[GI:g5059249] [LN:AF147978] [AC:AF147978] [PN:putative terminase]
[OR:Bacteriophage D3] [DB:genpept-phg] [DE:Bacteriophage D3 putative terminase,
putative portal protein,putative ClpP protease, and major head protein genes,
complete cds;and unknown genes.] [NT:ORF1692; similar to the 50.9 kDa protein
product of] [LE:1145] [RE:2836] [DI:direct]

| ORF Name | NT ID | AA ID | NT/LN | AA/LN | Score | P-value |
|---|---|---|---|---|---|---|
| 14634692_f3_899 | 461 | 7632 | 1362 | 453 | 1912 | 2.0e-197 |

Description gp:[GI:g775159] [LN:ECU23494] [AC:U23494] [PN:anthranilate isomerase] [GN:trpC]
[OR:Escherichia coli] [DB:genpept-bct1] [DE:Escherichia coli ECOR 31 anthranilate
isomerase (trpC), tryptophansynthase beta subunit (trpB), tryptophan synthase
alpha subunit(trpA), (yciG), (yciF), and (yciE) genes, complete cds.] [LE:15]
[RE:1373] [DI:direct]

| ORF Name | NT ID | AA ID | NT/LN | AA/LN | Score | P-value |
|---|---|---|---|---|---|---|
| 14650307_f1_7 | 462 | 7633 | 417 | 138 | | |

Description

NO-HIT

| ORF Name | NT ID | AA ID | NT LN | AA LN | Score | P-value |
|---|---|---|---|---|---|---|
| 14651428_c2_1903 | 463 | 7634 | 1197 | 398 | 517 | 1.4e-49 |

Description sp:[LN:VINT_BPPH8] [AC:P06155] [GN:INT] [OR:Bacteriophage phi-80] [DE:INTEGRASE]
[SP:P06155] [DB:swissprot] >sp:[LN:RSBPI8] [AC:A24253] [PN:probable integrase]
[GN:int] [CL:phage phi-80 integrase] [OR:phage phi-80] [DB:pir1]

| ORF Name | NT ID | AA ID | NT LN | AA LN | Score | P-value |
|---|---|---|---|---|---|---|
| 14657077_c1_1489 | 464 | 7635 | 702 | 233 | 965 | 4.6e-97 |

Description sp:[LN:C64879] [AC:C64879:S17121:I60593] [PN:phage shock protein A] [GN:pspA]
[OR:Escherichia coli] [DB:pir2] >gp:[GI:d1015589:g1742134] [LN:D90768]
[AC:D90768:AB001340] [PN:Phage shock protein A] [GN:pspA] [OR:Escherichia coli]
[SR:Escherichia coli (strain:K12) DNA, clone_lib:Kohara lambda minise]
[DB:genpept-bct1] [DE:E.coli genomic DNA, Kohara clone #257(29.1-29.6 min.).]
[NT:ORF_ID:o257#13; similar to [PIR Accession Number] [LE:15449] [RE:16117]
[DI:direct] >gp:[GI:d1015597:g1742143] [LN:D90769] [AC:D90769:AB001340] [PN:Phage
shock protein A] [GN:pspA] [OR:Escherichia coli] [SR:Escherichia coli
(strain:K12) DNA, clone_lib:Kohara lambda minise] [DB:genpept-bct1] [DE:E.coli
genomic DNA, Kohara clone #258(29.5-29.8 min.).] [NT:ORF_ID:o257#13; similar to
[PIR Accession Number] [LE:1453] [RE:2121] [DI:direct] >gp:[GI:g2367118]
[LN:AE000228] [AC:AE000228:U00096] [PN:phage shock protein, inner membrane
protein] [GN:pspA] [FN:factor; Phage-related functions and prophages]
[OR:Escherichia coli] [DB:genpept-bct2] [DE:Escherichia coli K-12 MG1655 section
118 of 400 of the completegenome.] [NT:o222; 100 pct identical to PSPA_ECOLI SW:
P23853;] [LE:8744] [RE:9412] [DI:direct]

| ORF Name | NT ID | AA ID | NT LN | AA LN | Score | P-value |
|---|---|---|---|---|---|---|
| 14707062_c1_1246 | 465 | 7636 | 312 | 103 | | |

Description

NO-HIT

235

| ORF_Name | NT ID | AA ID | NT LN | AA LN | Score | P-value |
|---|---|---|---|---|---|---|
| 14742812_cl_1375 | 466 | 7637 | 354 | 117 | 500 | 8.6e-48 |

Description sp:[LN:OSME_ECOLI] [AC:P23933] [GN:OSME:ANR] [OR:Escherichia coli] [DE:GENE)]
[SP:P23933] [DB:swissprot] >sp:[LN:I57918] [AC:I57918:S16029:C64933]
[PN:osmotically inducible protein E precursor] [GN:osmE:arn] [OR:Escherichia
coli] [DB:pir2] >gp:[GI:d1016251:g1742845] [LN:D90817] [AC:D90817:AB001340]
[PN:OsmE protein] [GN:osmE, arn] [OR:Escherichia coli] [SR:Escherichia coli
(strain:K12) DNA, clone_lib:Kohara lambda minise] [DB:genpept-bct1] [DE:E.coli
genomic DNA, Kohara clone #326(39.1-39.4 min.).] [NT:ORF_ID:o326#8; similar to
[PIR Accession Number] [LE:7278] [RE:7616] [DI:complement]
>gp:[GI:d1016257:g1742852] [LN:D90818] [AC:D90818:AB001340] [PN:OsmE protein]
[GN:osmE, arn] [OR:Escherichia coli] [SR:Escherichia coli (strain:K12) DNA,
clone_lib:Kohara lambda minise] [DB:genpept-bct1] [DE:E.coli genomic DNA, Kohara
clone #327(39.2-39.5 min.).] [NT:ORF_ID:o326#8; similar to [PIR Accession Number]
[LE:1646] [RE:1984] [DI:complement] >gp:[GI:g40914] [LN:ECANRG] [AC:X60186]
[PN:activator of ntr-like gene] [GN:anr] [OR:Escherichia coli] [DB:genpept-bct1]
[DE:E.coli anr gene for activator of ntr-like gene.] [SP:P23933] [LE:85] [RE:423]
[DI:direct] >gp:[GI:g908847] [LN:ECOSMEG] [AC:X75957] [GN:osmE] [OR:Escherichia
coli] [DB:genpept-bct1] [DE:E.coli osmE gene.] [SP:P23933] [LE:284] [RE:622]
[DI:direct] >gp:[GI:g1788035] [LN:AE000269] [AC:AE000269:U00096] [PN:activator of
ntrL gene] [GN:osmE] [FN:regulator; Global regulatory functions] [OR:Escherichia
coli] [DB:genpept-bct2] [DE:Escherichia coli K-12 MG1655 section 159 of 400 of
the completegenome.] [NT:f112; 100 pct identical to OSME_ECOLI SW: P23933;]
[LE:692] [RE:1030] [DI:complement]

| ORF Name | NT ID | AA ID | NT LN | AA LN | Score | P-value |
|---|---|---|---|---|---|---|
| 14972158_c2_1753 | 467 | 7638 | 852 | 283 | 1203 | 2.8e-122 |

Description sp:[LN:CELD_ECOLI] [AC:P17410] [GN:CELD] [OR:Escherichia coli] [DE:CEL OPERON REPRESSOR] [SP:P17410] [DB:swissprot] >sp:[LN:S10873] [AC:S10873:G64932] [PN:regulatory protein celD:cel operon repressor] [GN:celD] [OR:Escherichia coli] [DB:pir2] >gp:[GI:d1016239:g1742832] [LN:D90816] [AC:D90816:AB001340] [PN:Regulatory protein CelD] [GN:celD] [OR:Escherichia coli] [SR:Escherichia coli (strain:K12) DNA, clone_lib:Kohara lambda minise] [DB:genpept-bct1] [DE:E.coli genomic DNA, Kohara clone #325(38.9-39.2 min.).] [NT:ORF_ID:o326#4; similar to [PIR Accession Number] [LE:11194] [RE:12036] [DI:complement] >gp:[GI:d1016247:g1742841] [LN:D90817] [AC:D90817:AB001340] [PN:Regulatory protein CelD] [GN:celD] [OR:Escherichia coli] [SR:Escherichia coli (strain:K12) DNA, clone_lib:Kohara lambda minise] [DB:genpept-bct1] [DE:E.coli genomic DNA, Kohara clone #326(39.1-39.4 min.).] [NT:ORF_ID:o326#4; similar to [PIR Accession Number] [LE:3965] [RE:4807] [DI:complement] >gp:[GI:g41100] [LN:ECCELOPE] [AC:X52890:M64438:X53290] [OR:Escherichia coli] [DB:genpept-bct1] [DE:Escherichia coli DNA for cel operon including celA, celB, celC,celD and celF genes.] [NT:celD product, repressor of the cel operon] [SP:P17410] [LE:2447] [RE:3289] [DI:direct] >gp:[GI:g145481] [LN:ECOCELA] [AC:M64438] [GN:celD] [OR:Escherichia coli] [SR:E.coli DNA] [DB:genpept-bct1] [DE:E.coli cellobiose permease proteins celA, celB, celC, cellobioseoperon repressor protein celD and cellobiose phospho-B-glucosidaseprotein celF gene, complete cds.] [NT:putative] [LE:2447] [RE:3289] [DI:direct] >gp:[GI:g1788030] [LN:AE000268] [AC:AE000268:U00096] [PN:negative transcriptional regulator of cel] [GN:celD] [FN:regulator; Degradation of small molecules:] [OR:Escherichia coli] [DB:genpept-bct2] [DE:Escherichia coli K-12 MG1655 section 158 of 400 of the completegenome.] [NT:f280; 100 pct identical to CELD_ECOLI SW: P17410;] [LE:8512] [RE:9354] [DI:complement]

| ORF Name | NT ID | AA ID | NT LN | AA LN | Score | P-value |
|---|---|---|---|---|---|---|
| 15664061_c2_1597 | 468 | 7639 | 1074 | 357 | 1185 | 2.2e-120 |

Description sp:[LN:IDH_ECOLI] [AC:P08200] [GN:ICD:ICDA:ICDE] [OR:Escherichia coli]
[EC:1.1.1.42] [DE:DECARBOXYLASE) (IDH) (NADP+-SPECIFIC ICDH) (IDP)] [SP:P08200]
[DB:swissprot] >sp:[LN:DCECIS] [AC:A28482:E64858] [PN:isocitrate dehydrogenase
(NADP+),:oxalosuccinate decarboxylase] [GN:icdA:icd:icdE] [CL:isocitrate
dehydrogenase (NADP)] [OR:Escherichia coli] [EC:1.1.1.42] [DB:pir1] [MP:25 min]
>gp:[GI:d1036944:g1651560] [LN:D90748] [AC:D90748:AB001340] [PN:Isocitrate
dehydrogenase (NADP) (EC 1.1.1.42)] [GN:icd] [OR:Escherichia coli]
[SR:Escherichia coli(strain:K12) DNA, clone:Kohara clone #239] [DB:genpept-bct1]
[DE:Escherichia coli genomic DNA. (25.6 - 25.9 min).] [NT:ORF_ID:o240#7; similar
to SwissProt Accession] [LE:11357] [RE:12607] [DI:direct]
>gp:[GI:d1036953:g1651566] [LN:D90749] [AC:D90749:AB001340] [PN:Isocitrate
dehydrogenase (NADP) (EC 1.1.1.42)] [GN:icd] [OR:Escherichia coli]
[SR:Escherichia coli(strain:K12) DNA, clone:Kohara clone #240] [DB:genpept-bct1]
[DE:Escherichia coli genomic DNA. (25.7 - 26.1 min).] [NT:ORF_ID:o240#7; similar
to SwissProt Accession] [LE:5674] [RE:6924] [DI:direct] >gp:[GI:g146432]
[LN:ECOICD] [AC:J02799] [OR:Escherichia coli] [SR:E.coli DNA, clone pTK512]
[DB:genpept-bct1] [DE:E.coli icd gene encoding isocitrate dehydrogenase, complete
cds.] [NT:isocitrate dehydrogenase (icd; EC 1.1.1.42)] [LE:291] [RE:1541]
[DI:direct] >gp:[GI:g1787381] [LN:AE000213] [AC:AE000213:U00096] [PN:isocitrate
dehydrogenase, specific for NADP+] [GN:icdA] [FN:enzyme; Energy metabolism,
carbon: TCA cycle] [OR:Escherichia coli] [DB:genpept-bct2] [EC:1.1.1.42]
[DE:Escherichia coli K-12 MG1655 section 103 of 400 of the completegenome.]
[NT:o416; 100 pct identical to IDH_ECOLI SW: P08200] [LE:9434] [RE:10684]
[DI:direct]

| ORF Name | NT ID | AA ID | NT LN | AA LN | Score | P-value |
|---|---|---|---|---|---|---|
| 156680_f3_1107 | 469 | 7640 | 483 | 160 | 184 | 2.6e-14 |

Description sp:[LN:T03008] [AC:T03008] [PN:probable regulatory protein] [OR:Salmonella
typhimurium] [DB:pir2] >gp:[GI:g3309514] [LN:STAF001386] [AC:AF001386]
[PN:unknown] [OR:Salmonella typhimurium] [DB:genpept-bct2] [DE:Salmonella
typhimurium sigma-E factor regulatory protein (rseA)gene, partial cds; sigma-E
factor regulatory protein (rseB),sigma-E factor regulatory protein (rseC),
truncated GTP-bindingprotein (lepA), complete cds; Gifsy-1 prophage left-end
portion:putative integrase (int), putative excisionase (xis),
andexodeoxyribonuclease VIII (recE) genes, complete cds; and unknowngenes.]
[NT:similar to DicA repressor protein] [LE:8859] [RE:9269] [DI:complement]

| ORF Name | NT ID | AA ID | NT/LN | AA/LN | Score | P-value |
|---|---|---|---|---|---|---|
| 15724165_c2_1576 | 470 | 7641 | 363 | 120 | 133 | 4.0e-08 |

Description sp:[LN:CSP_PLACB] [AC:P08672] [OR:Plasmodium cynomolgi] [SR:,strain Berok]
[DE:CIRCUMSPOROZOITE PROTEIN PRECURSOR (CS)] [SP:P08672] [DB:swissprot]
>gp:[GI:g160180] [LN:PFACSB] [AC:M15104] [OR:Plasmodium cynomolgi]
[SR:P.cynomolgi (strain Berok) blood stage DNA] [DB:genpept-inv1] [DE:P.cynomolgi
(strain Berok) circumsporozoite (CS) gene, completecds.] [NT:circumsporozoite
antigen] [LE:76] [RE:1212] [DI:direct]

| ORF Name | NT ID | AA ID | NT/LN | AA/LN | Score | P-value |
|---|---|---|---|---|---|---|
| 15741330_c3_1916 | 471 | 7642 | 480 | 159 | 456 | 4.0e-43 |

Description sp:[LN:YCFL_ECOLI] [AC:P75946] [GN:YCFL] [OR:Escherichia coli] [DE:HYPOTHETICAL
14.0 KD PROTEIN IN FHUE-NDH INTERGENIC REGION] [SP:P75946] [DB:swissprot]
>sp:[LN:E64854] [AC:E64854] [PN:ycfL protein precursor] [GN:ycfL] [OR:Escherichia
coli] [DB:pir2] >gp:[GI:d1036897;g4062668] [LN:D90745] [AC:D90745:AB001340]
[OR:Escherichia coli] [SR:Escherichia coli(strain:K12) DNA, clone:Kohara clone
236] [DB:genpept-bct1] [DE:Escherichia coli genomic DNA. (24.8 - 25.2 min).]
[NT:ORF_ID:o237#3] [LE:12889] [RE:13266] [DI:direct] >gp:[GI:d1036905;g4062674]
[LN:D90746] [AC:D90746:AB001340] [OR:Escherichia coli] [SR:Escherichia
coli(strain:K12) DNA, clone:Kohara clone #237] [DB:genpept-bct1] [DE:Escherichia
coli genomic DNA. (25.0 - 25.4 min).] [NT:ORF_ID:o237#3] [LE:4188] [RE:4565]
[DI:direct] >gp:[GI:g1787347] [LN:AE000211] [AC:AE000211:U00096] [PN:orf,
hypothetical protein] [GN:ycfL] [FN:orf; Unknown] [OR:Escherichia coli]
[DB:genpept-bct2] [DE:Escherichia coli K-12 MG1655 section 101 of 400 of the
completegenome.] [NT:o125] [LE:559] [RE:936] [DI:direct]

| ORF Name | NT ID | AA ID | NT/LN | AA/LN | Score | P-value |
|---|---|---|---|---|---|---|
| 15759707_f3_1108 | 472 | 7643 | 615 | 204 | 857 | 1.3e-85 |

Description sp:[LN:INTE_ECOLI] [AC:P75969] [GN:INTE] [OR:Escherichia coli] [DE:PROPHAGE
LAMBDA INTEGRASE (INT(LAMBDA)) (PROPHAGE E14 INTEGRASE)] [SP:P75969]
[DB:swissprot] >sp:[LN:A64859] [AC:A64859] [PN:integrase] [GN:intE] [CL:phage
lambda integrase] [OR:Escherichia coli] [DB:pir2] >gp:[GI:d1036955;g4062718]
[LN:D90749] [AC:D90749:AB001340] [PN:Integrase.] [GN:int] [OR:Escherichia coli]
[SR:Escherichia coli(strain:K12) DNA, clone:Kohara clone #240] [DB:genpept-bct1]
[DE:Escherichia coli genomic DNA. (25.7 - 26.1 min).] [NT:ORF_ID:o240#9; similar
to SwissProt Accession] [LE:10230] [RE:11357] [DI:complement] >gp:[GI:g1787386]
[LN:AE000214] [AC:AE000214:U00096] [PN:prophage e14 integrase] [GN:intE] [FN:IS,
phage, Tn; Phage-related functions and] [OR:Escherichia coli] [DB:genpept-bct2]
[DE:Escherichia coli K-12 MG1655 section 104 of 400 of the completegenome.]
[NT:f375; phage stats; This 375 aa ORF is 60 pct] [LE:3089] [RE:4216]
[DI:complement]

| ORF Name | NT ID | AA ID | NT LN | AA LN | Score | P-value |
|---|---|---|---|---|---|---|
| 157705_c1_1553 | 473 | 7644 | 819 | 272 | 404 | 1.3e-37 |

Description sp:[LN:B64911] [AC:B64911] [PN:hypothetical protein b1559] [OR:Escherichia coli]
[DB:pir2] >gp:[GI:g1787842] [LN:AE000253] [AC:AE000253:U00096] [PN:orf,
hypothetical protein] [GN:b1559] [FN:orf; Unknown] [OR:Escherichia coli]
[DB:genpept-bct2] [DE:Escherichia coli K-12 MG1655 section 143 of 400 of the
completegenome.] [NT:f260; This 260 aa ORF is 41 pct identical (14 gaps)]
[LE:241] [RE:1023] [DI:complement]

| ORF Name | NT ID | AA ID | NT LN | AA LN | Score | P-value |
|---|---|---|---|---|---|---|
| 15860093_f2_379 | 474 | 7645 | 861 | 286 | 1087 | 5.4e-110 |

Description sp:[LN:T15029] [AC:T15029] [PN:probable serine proteinase] [GN:Y1114]
[OR:Yersinia pestis] [DB:pir2] >gp:[GI:g5834734] [LN:YPPMT1] [AC:AL117211]
[PN:putative lipoprotein] [GN:YPMT1.49c] [OR:Yersinia pestis] [DB:genpept-bct1]
[DE:Yersinia pestis plasmid pPMT1.] [NT:YPMT1.49c, possible lipoprotein, len: 276
aa;] [LE:50146] [RE:50976] [DI:complement] >gp:[GI:g3883112] [LN:AF074611]
[AC:AF074611] [PN:putative serine protease] [GN:Y1114] [OR:Yersinia pestis]
[DB:genpept-bct2] [DE:Yersinia pestis plasmid pMT-1, complete plasmid sequence.]
[NT:o276; 29 pct identical (7 gaps) to 117 residues of] [LE:98281] [RE:99111]
[DI:direct]

| ORF Name | NT ID | AA ID | NT LN | AA LN | Score | P-value |
|---|---|---|---|---|---|---|
| 15863152_c1_1507 | 475 | 7646 | 1275 | 424 | 1216 | 1.2e-123 |

Description sp:[LN:OPDE_PSEAE] [AC:Q01602] [GN:OPDE] [OR:Pseudomonas aeruginosa]
[DE:TRANSCRIPTION REGULATORY PROTEIN OPDE] [SP:Q01602] [DB:swissprot]
>sp:[LN:S23860] [AC:S23860] [PN:chloramphenicol resistance protein homolog opdE]
[CL:Streptomyces lividans chloramphenicol resistance protein] [OR:Pseudomonas
aeruginosa] [DB:pir1] >gp:[GI:g45368] [LN:PAOPDEG] [AC:Z14064] [PN:OpdE]
[GN:opdE] [FN:Expression of OprD (imipenem-specific porin)] [OR:Pseudomonas
aeruginosa] [DB:genpept-bct1] [DE:P.aeruginosa opdE gene.] [NT:Interruption of
this gene with Tn501 leads to a] [SP:Q01602] [LE:963] [RE:2171] [DI:direct]

| ORF Name | NT ID | AA ID | NT LN | AA LN | Score | P-value |
|---|---|---|---|---|---|---|
| 16034666_f1_193 | 476 | 7647 | 1617 | 538 | | |

Description

NO-HIT

| ORF Name | NT ID | AA ID | NT/LN | AA/LN | Score | P-value |
|---|---|---|---|---|---|---|
| 16065963_f3_960 | 477 | 7648 | 573 | 190 | 774 | 8.0e-77 |

Description sp:[LN:YNJA_ECOLI] [AC:P76222] [GN:YNJA] [OR:Escherichia coli] [DE:HYPOTHETICAL 20.5 KD PROTEIN IN XTHA-GDHA INTERGENIC REGION] [SP:P76222] [DB:swissprot] >sp:[LN:A64935] [AC:A64935] [PN:hypothetical protein b1753] [OR:Escherichia coli] [DB:pir2] >gp:[GI:g1788050] [LN:AE000270] [AC:AE000270:U00096] [PN:orf, hypothetical protein] [GN:ynjA] [FN:orf; Unknown] [OR:Escherichia coli] [DB:genpept-bct2] [DE:Escherichia coli K-12 MG1655 section 160 of 400 of the completegenome.] [NT:o182; This 182 aa ORF is 20 pct identical (4 gaps)] [LE:3340] [RE:3888] [DI:direct]

| ORF Name | NT ID | AA ID | NT/LN | AA/LN | Score | P-value |
|---|---|---|---|---|---|---|
| 16109425_c1_1241 | 478 | 7649 | 957 | 318 | 425 | 7.7e-40 |

Description gp:[GI:g3249702] [LN:AF071201] [AC:AF071201] [PN:unknown] [OR:bacteriophage Felix 01] [DB:genpept-phg] [DE:Bacteriophage Felix 01 red gene, complete cds; and unknown genes.] [NT:ORF9; similar to head-tail connector of] [LE:5451] [RE:6779] [DI:direct]

| ORF Name | NT ID | AA ID | NT/LN | AA/LN | Score | P-value |
|---|---|---|---|---|---|---|
| 16147183_f2_627 | 479 | 7650 | 198 | 65 | | |

Description

NO-HIT

| ORF Name | NT ID | AA ID | NT/LN | AA/LN | Score | P-value |
|---|---|---|---|---|---|---|
| 16148543_f3_1125 | 480 | 7651 | 189 | 62 | | |

Description

NO-HIT

| ORF Name | NT ID | AA ID | NT/LN | AA/LN | Score | P-value |
|---|---|---|---|---|---|---|
| 16195305_f1_80 | 481 | 7652 | 219 | 72 | | |

Description

NO-HIT

| ORF Name | NT ID | AA ID | NT LN | AA LN | Score | P-value |
|---|---|---|---|---|---|---|
| 16302212_c2_1909 | 482 | 7653 | 1752 | 583 | 260 | 5.4e-19 |

Description sp:[LN:S59797] [AC:S59797] [PN:hypothetical protein YDR332w:hypothetical protein D9798.1] [CL:unassigned DEAD/H box helicases:DEAD/H box helicase homology] [OR:Saccharomyces cerevisiae] [DB:pir2] [MP:4R] >gp:[GI:g914990] [LN:YSCD9798] [AC:U32517:Z71256] [PN:Ydr332wp] [GN:YDR332W] [OR:Saccharomyces cerevisiae] [SR:baker's yeast] [DB:genpept-pln2] [DE:Saccharomyces cerevisiae chromosome IV cosmid 9798.] [NT:Similar to DEAD box family helicases] [LE:35629] [RE:37698] [DI:direct]

| ORF Name | NT ID | AA ID | NT LN | AA LN | Score | P-value |
|---|---|---|---|---|---|---|
| 16444717_f3_967 | 483 | 7654 | 1401 | 466 | 1898 | 6.2e-196 |

Description sp:[LN:E64935] [AC:E64935] [PN:hypothetical protein b1757] [OR:Escherichia coli] [DB:pir2] >gp:[GI:g1788054] [LN:AE000270] [AC:AE000270:U00096] [PN:putative thiosulfate sulfur transferase] [GN:b1757] [FN:putative enzyme; Central intermediary] [OR:Escherichia coli] [DB:genpept-bct2] [DE:Escherichia coli K-12 MG1655 section 160 of 400 of the completegenome.] [NT:o440; This 440 aa ORF is 27 pct identical (23 gaps)] [LE:7277] [RE:8599] [DI:direct]

| ORF Name | NT ID | AA ID | NT LN | AA LN | Score | P-value |
|---|---|---|---|---|---|---|
| 16532256_f2_438 | 484 | 7655 | 477 | 158 | 123 | 7.1e-07 |

Description gp:[GI:g2315991] [LN:RSU86454] [AC:U86454] [PN:FliK] [GN:flik] [OR:Rhodobacter sphaeroides] [DB:genpept-bct2] [DE:Rhodobacter sphaeroides hook length control protein FliK (fliK)gene, complete cds.] [NT:Flagellar Protein; hook length control protein;] [LE:16] [RE:1440] [DI:direct]

| ORF Name | NT ID | AA ID | NT LN | AA LN | Score | P-value |
|---|---|---|---|---|---|---|
| 16589533_cl_1206 | 485 | 7656 | 555 | 184 | 663 | 4.6e-65 |

Description sp:[LN:YAFM_ECOLI] [AC:Q47152] [GN:YAFM] [OR:Escherichia coli] [DE:HYPOTHETICAL
20.0 KD PROTEIN IN DINJ-FHIA INTERGENIC REGION] [SP:Q47152] [DB:swissprot]
>sp:[LN:E64747] [AC:E64747] [PN:yafM protein] [GN:yafM] [CL:hypothetical protein
HI0217] [OR:Escherichia coli] [DB:pir2] >gp:[GI:d1008171:g984584] [LN:ECODINJ]
[AC:D38582] [PN:YafM] [OR:Escherichia coli] [SR:Escherichia coli (sub_strain
W3110, strain K-12) (library: Kohara'] [DB:genpept-bct1] [DE:Escherichia coli
genes for 'YafH, YafI, YafJ, YafK, YafQ, DinJ,YafL, YafM, FhiA, MbhA, DinP, YafN,
YafO and YafP.] [NT:hypothetical] [LE:5279] [RE:5776] [DI:direct]
>gp:[GI:d1041666:g4902964] [LN:ECOTSF] [AC:D83536] [PN:Hypothetical protein
HI0217] [OR:Escherichia coli] [SR:Escherichia coli (strain:K12) DNA]
[DB:genpept-bct1] [DE:Escherichia coli genomic DNA. (4.1 - 6.1 min).]
[NT:ORF_ID:o127#6; similar to PIR Accession Number] [LE:57185] [RE:57682]
[DI:direct] >gp:[GI:g1552796] [LN:ECU70214] [AC:U70214] [GN:yafM] [OR:Escherichia
coli] [DB:genpept-bct1] [DE:Escherichia coli chromosome minutes 4-6.]
[NT:hypothetical] [LE:78712] [RE:79209] [DI:direct] >gp:[GI:g1786422]
[LN:AE000131] [AC:AE000131:U00096] [PN:orf, hypothetical protein] [GN:yafM]
[FN:orf; Unknown] [OR:Escherichia coli] [DB:genpept-bct2] [DE:Escherichia coli
K-12 MG1655 section 21 of 400 of the completegenome.] [NT:o165; 100 pct identical
to GB: ECODINJ_8] [LE:4226] [RE:4723] [DI:direct]

| ORF Name | NT ID | AA ID | NT LN | AA LN | Score | P-value |
|---|---|---|---|---|---|---|
| 16598541_cl_1234 | 486 | 7657 | 291 | 96 | 497 | 1.8e-47 |

Description sp:[LN:E64910] [AC:E64910] [PN:hypothetical protein b1554, phage protein-related]
[CL:phage T4 lysozyme:phage T4 lysozyme homology] [OR:Escherichia coli] [DB:pir2]
>gp:[GI:g1787836] [LN:AE000252] [AC:AE000252:U00096] [PN:putative lysozyme]
[GN:b1554] [FN:putative enzyme; Not classified] [OR:Escherichia coli]
[DB:genpept-bct2] [DE:Escherichia coli K-12 MG1655 section 142 of 400 of the
completegenome.] [NT:f177; This 177 aa ORF is 32 pct identical (15 gaps)]
[LE:7139] [RE:7672] [DI:complement]

| ORF Name | NT ID | AA ID | NT/LN | AA/LN | Score | P-value |
|---|---|---|---|---|---|---|
| 16602312_f1_322 | 487 | 7658 | 471 | 156 | 665 | 2.8e-65 |

Description sp:[LN:YMFB_ECOLI] [AC:P75965] [GN:YMFB] [OR:Escherichia coli] [DE:HYPOTHETICAL 17.4 KD PROTEIN IN TRMU-ICD INTERGENIC REGION] [SP:P75965] [DB:swissprot] >sp:[LN:C64858] [AC:C64858] [PN:probable dNTP pyrophohydrolase b1134] [CL:mutT domain homology] [OR:Escherichia coli] [DB:pir2] >gp:[GI:d1036942:g4062698] [LN:D90748] [AC:D90748:AB001340] [PN:Hypothetical protein YGL067w] [OR:Escherichia coli] [SR:Escherichia coli(strain:K12) DNA, clone:Kohara clone #239] [DB:genpept-bct1] [DE:Escherichia coli genomic DNA. (25.6 - 25.9 min).] [NT:ORF_ID:o240#5; similar to PIR Accession Number] [LE:10061] [RE:10522] [DI:complement] >gp:[GI:d1036951:g4062716] [LN:D90749] [AC:D90749:AB001340] [PN:Hypothetical protein YGL067w] [OR:Escherichia coli] [SR:Escherichia coli(strain:K12) DNA, clone:Kohara clone #240] [DB:genpept-bct1] [DE:Escherichia coli genomic DNA. (25.7 - 26.1 min).] [NT:ORF_ID:o240#5; similar to PIR Accession Number] [LE:4378] [RE:4839] [DI:complement] >gp:[GI:g1787379] [LN:AE000213] [AC:AE000213:U00096] [PN:putative phosphohydrolase] [GN:b1134] [FN:putative enzyme; Not classified] [OR:Escherichia coli] [DB:genpept-bct2] [DE:Escherichia coli K-12 MG1655 section 103 of 400 of the completegenome.] [NT:f153; This 153 aa ORF is 45 pct identical (3 gaps)] [LE:8138] [RE:8599] [DI:complement]

| ORF Name | NT ID | AA ID | NT/LN | AA/LN | Score | P-value |
|---|---|---|---|---|---|---|
| 16603375_f3_907 | 488 | 7659 | 951 | 316 | 239 | 3.9e-20 |

Description gp:[GI:g3293547] [LN:AF072709] [AC:AF072709] [PN:putative oxidoreductase] [OR:Streptomyces lividans] [DB:genpept-bct2] [DE:Streptomyces lividans amplifiable element AUD4: putativetranscriptional regulator, putative ferredoxin, putative cytochromeP450 oxidoreductase, and putative oxidoreductase genes, completecds; and unknown genes.] [NT:ORF9; similar to quinone oxidoreductase] [LE:6791] [RE:7732] [DI:direct]

| ORF Name | NT ID | AA ID | NT/LN | AA/LN | Score | P-value |
|---|---|---|---|---|---|---|
| 16688541_f1_186 | 489 | 7660 | 1551 | 516 | 1582 | 1.9e-162 |

Description sp:[LN:YNJC_ECOLI] [AC:P76224] [GN:YNJC] [OR:Escherichia coli] [DE:HYPOTHETICAL 56.2 KD PROTEIN IN XTHA-GDHA INTERGENIC REGION] [SP:P76224] [DB:swissprot]

| ORF Name | NT ID | AA ID | NT LN | AA LN | Score | P-value |
|---|---|---|---|---|---|---|
| 16689812_f2_731 | 490 | 7661 | 801 | 266 | 1237 | 6.9e-126 |

Description sp:[LN:POTC_ECOLI] [AC:P23859] [GN:POTC] [OR:Escherichia coli]
[DE:SPERMIDINE/PUTRESCINE TRANSPORT SYSTEM PERMEASE PROTEIN POTC] [SP:P23859]
[DB:swissprot] >sp:[LN:C40840] [AC:C40840:A64857] [PN:spermidine/putrescine
transport system permease potC] [GN:potC] [CL:spermidine/putrescine transport
system permease protein potI] [OR:Escherichia coli] [DB:pir2]
>gp:[GI:d1036930:g1651551] [LN:D90747] [AC:D90747:AB001340]
[PN:Spermidine/putrescine transport system permease] [GN:potC] [OR:Escherichia
coli] [SR:Escherichia coli(strain:K12) DNA, clone:Kohara clone #238]
[DB:genpept-bct1] [DE:Escherichia coli genomic DNA. (25.2 - 25.6 min).]
[NT:ORF_ID:o238#13; similar to SwissProt Accession] [LE:14513] [RE:15307]
[DI:complement] >gp:[GI:g1787368] [LN:AE000212] [AC:AE000212:U00096]
[PN:spermidine/putrescine transport system permease] [GN:potC] [FN:transport;
Transport of small molecules: Amino] [OR:Escherichia coli] [DB:genpept-bct2]
[DE:Escherichia coli K-12 MG1655 section 102 of 400 of the completegenome.]
[NT:f264; 100 pct identical to POTC_ECOLI SW: P23859] [LE:8828] [RE:9622]
[DI:complement] >gp:[GI:g147328] [LN:ECOPOTABCD] [AC:M64519] [PN:transport
protein] [GN:potC] [OR:Escherichia coli] [SR:E.coli (strain DR112) DNA, clone
pPT104] [DB:genpept-bct2] [DE:E.coli transport protein (potA, potB, potC and
potD) genes,complete cds.] [LE:2353] [RE:3147] [DI:direct]

| ORF Name | NT ID | AA ID | NT LN | AA LN | Score | P-value |
|---|---|---|---|---|---|---|
| 16798178_c3_2121 | 491 | 7662 | 681 | 226 | 905 | 1.0e-90 |

Description sp:[LN:OMPW_ECOLI] [AC:P21364:P97217:P97220] [GN:OMPW] [OR:Escherichia coli]
[DE:OUTER MEMBRANE PROTEIN W PRECURSOR] [SP:P21364:P97217:P97220] [DB:swissprot]
>sp:[LN:S07797] [AC:S07797:C64873] [PN:yciD protein precursor] [GN:yciD]
[OR:Escherichia coli] [DB:pir2] [MP:28 min] >gp:[GI:d1015504:g1742045]
[LN:D90763] [AC:D90763:AB001340] [PN:Outer membrane protein precursor.] [GN:yciD]
[OR:Escherichia coli] [SR:Escherichia coli (strain:K12) DNA, clone_lib:Kohara
lambda minise] [DB:genpept-bct1] [DE:E.coli genomic DNA, Kohara clone
252(28.1-28.4 min.).] [NT:ORF_ID:o252#14; similar to [SwissProt Accession]
[LE:12341] [RE:12979] [DI:direct] >gp:[GI:g43211] [LN:ECTRTOI] [AC:X13583]
[OR:Escherichia coli] [DB:genpept-bct1] [DE:E. coli DNA for intervening region
between trp operon and tonBgene.] [NT:ORF4 protein (AA 1-212)] [SP:P21364]
[LE:1433] [RE:2071] [DI:complement] >gp:[GI:g1787510] [LN:AE000224]
[AC:AE000224:U00096] [PN:putative outer membrane protein] [GN:yciD] [FN:putative
membrane; Not classified] [OR:Escherichia coli] [DB:genpept-bct2] [DE:Escherichia
coli K-12 MG1655 section 114 of 400 of the completegenome.] [NT:o212; 100 pct
identical to YCID_ECOLI SW: P21364] [LE:209] [RE:847] [DI:direct]

| ORF Name | NT ID | AA ID | NT LN | AA LN | Score | P-value |
|---|---|---|---|---|---|---|
| 16838531_c2_1755 | 492 | 7663 | 381 | 126 | 184 | 2.6e-14 |

Description sp:[LN:S42590] [AC:S42590] [PN:hypothetical 14.1K protein (celF region)] [CL:Escherichia coli hypothetical 14.1K protein (celF region)] [OR:Escherichia coli] [DB:pir2] >gp:[GI:g475895] [LN:ECCELKATE] [AC:X66725] [OR:Escherichia coli] [DB:genpept-bct1] [DE:E.coli DNA for connecting sequence between cel operon and KatE.] [NT:ORF 14.1] [LE:519] [RE:884] [DI:direct]

| ORF Name | NT ID | AA ID | NT LN | AA LN | Score | P-value |
|---|---|---|---|---|---|---|
| 16850768_c2_1613 | 493 | 7664 | 297 | 98 | | |

Description

NO-HIT

| ORF Name | NT ID | AA ID | NT LN | AA LN | Score | P-value |
|---|---|---|---|---|---|---|
| 16891942_c1_1244 | 494 | 7665 | 459 | 152 | | |

Description

NO-HIT

| ORF Name | NT ID | AA ID | NT LN | AA LN | Score | P-value |
|---|---|---|---|---|---|---|
| 16895803_f1_262 | 495 | 7666 | 576 | 191 | 402 | 2.1e-37 |

Description gp:[GI:d1042607:g5103196] [LN:AP000342] [AC:AP000342] [GN:ydjB] [OR:Plasmid R100] [SR:Plasmid R100 (specific_host:Shigella flexneri 2b strain 222] [DB:genpept-bct1] [DE:Plasmid R100 genomic DNA.] [LE:39673] [RE:40161] [DI:direct]

| ORF Name | NT ID | AA ID | NT/LN | AA/LN | Score | P-value |
|---|---|---|---|---|---|---|
| 16929160_f2_580 | 496 | 7667 | 1158 | 385 | 1603 | 1.1e-164 |

Description sp:[LN:ASG1_ECOLI] [AC:P18840] [GN:ANSA] [OR:Escherichia coli] [EC:3.5.1.1]
[DE:(L-ASNASE I)] [SP:P18840] [DB:swissprot] >sp:[LN:XDEC1] [AC:G64936:JU0047]
[PN:asparaginase, I] [GN:ansA] [CL:asparaginase] [OR:Escherichia coli]
[EC:3.5.1.1] [DB:pir1] [MP:39 min] >gp:[GI:d1016281:g1742878] [LN:D90820]
[AC:D90820:AB001340] [PN:L-asparaginase I (EC 3.5.1.1) (L-asparagine) [GN:ansA]
[OR:Escherichia coli] [SR:Escherichia coli (strain:K12) DNA, clone_lib:Kohara
lambda minise] [DB:genpept-bct1] [DE:E.coli genomic DNA, Kohara clone
329(39.7-40.0 min.).] [NT:ORF_ID:o329#4; similar to [SwissProt Accession]
[LE:7717] [RE:8733] [DI:direct] >gp:[GI:g1788065] [LN:AE000271]
[AC:AE000271:U00096] [PN:cytoplasmic L-asparaginase I] [GN:ansA] [FN:enzyme;
Degradation of small molecules: Amino] [OR:Escherichia coli] [DB:genpept-bct2]
[EC:3.5.1.1] [DE:Escherichia coli K-12 MG1655 section 161 of 400 of the
completegenome.] [NT:o338; 100 pct identical to ASG1_ECOLI SW: P18840;] [LE:8637]
[RE:9653] [DI:direct]

| ORF Name | NT ID | AA ID | NT/LN | AA/LN | Score | P-value |
|---|---|---|---|---|---|---|
| 16976660_f1_129 | 497 | 7668 | 1584 | 527 | 2275 | 7.0e-236 |

Description sp:[LN:TRPE_ECOLI] [AC:P00895:P78249] [GN:TRPE] [OR:Escherichia coli]
[EC:4.1.3.27] [DE:ANTHRANILATE SYNTHASE COMPONENT I,] [SP:P00895:P78249]
[DB:swissprot] >sp:[LN:NNEC1] [AC:C64874:D93746:A94643:I56371:A01115]
[PN:anthranilate synthase, component I] [GN:trpE] [CL:anthranilate synthase
component I] [OR:Escherichia coli] [EC:4.1.3.27] [DB:pir1] [MP:28 min]
>gp:[GI:d1015515:g1742057] [LN:D90764] [AC:D90764:AB001340] [PN:Anthranilate
synthase component I (EC) [GN:trpE] [OR:Escherichia coli] [SR:Escherichia coli
(strain:K12) DNA, clone_lib:Kohara lambda minise] [DB:genpept-bct1] [DE:E.coli
genomic DNA, Kohara clone #253(28.4-28.7 min.).] [NT:ORF_ID:o253#2; similar to
[SwissProt Accession] [LE:4004] [RE:5566] [DI:complement]
>gp:[GI:d1015530:g1742073] [LN:D90765] [AC:D90765:AB001340] [PN:Anthranilate
synthase component I (EC) [GN:trpE] [OR:Escherichia coli] [SR:Escherichia coli
(strain:K12) DNA, clone_lib:Kohara lambda minise] [DB:genpept-bct1] [DE:E.coli
genomic DNA, Kohara clone #254(28.4-28.9 min.).] [NT:ORF_ID:o253#2; similar to
[SwissProt Accession] [LE:1510] [RE:3072] [DI:complement] >gp:[GI:g1787518]
[LN:AE000224] [AC:AE000224:U00096] [PN:Anthranilate synthase component I]
[GN:trpE] [FN:enzyme; Amino acid biosynthesis: Tryptophan] [OR:Escherichia coli]
[DB:genpept-bct2] [EC:4.1.3.27] [DE:Escherichia coli K-12 MG1655 section 114 of
400 of the completegenome.] [NT:f520; 99 pct identical to TRPE_ECOLI SW: P00895;
CG] [LE:7573] [RE:9135] [DI:complement]

| ORF Name | NT ID | AA ID | NT/LN | AA/LN | Score | P-value |
|---|---|---|---|---|---|---|
| 16978451_f3_1014 | 498 | 7669 | 408 | 135 | | |

Description

NO-HIT

| ORF Name | NT ID | AA ID | NT LN | AA LN | Score | P-value |
|---|---|---|---|---|---|---|
| 17067791_c3_1955 | 499 | 7670 | 1128 | 375 | 238 | 7.8e-20 |

Description gp:[GI:e1310305:g3294250] [LN:SC7C7] [AC:AL031031] [PN:putative transcriptional regulator] [GN:SC7C7.17] [OR:Streptomyces coelicolor] [DB:genpept-bct1] [DE:Streptomyces coelicolor cosmid 7C7.] [NT:SC7C7.17, possible transcriptional regulatory] [LE:30760] [RE:31626] [DI:direct]

| ORF Name | NT ID | AA ID | NT LN | AA LN | Score | P-value |
|---|---|---|---|---|---|---|
| 17073783_f3_779 | 500 | 7671 | 213 | 70 | 55 | 0.0013 |

Description sp:[LN:H72077] [AC:H72077] [PN:ct006 hypothetical protein] [GN:CPn0442] [OR:Chlamydia pneumoniae] [DB:pir2] >gp:[GI:g4376725] [LN:AE001627] [AC:AE001627:AE001363] [PN:CT006 hypothetical protein] [GN:CPn0442] [OR:Chlamydophila pneumoniae] [DB:genpept-bct2] [DE:Chlamydia pneumoniae section 43 of 103 of the complete genome.] [LE:2559] [RE:3077] [DI:direct]

| ORF Name | NT ID | AA ID | NT LN | AA LN | Score | P-value |
|---|---|---|---|---|---|---|
| 18842_c3_1920 | 501 | 7672 | 684 | 227 | 924 | 1.0e-92 |

Description sp:[LN:YCFP_ECOLI] [AC:P75950] [GN:YCFP] [OR:Escherichia coli] [DE:HYPOTHETICAL 23.3 KD PROTEIN IN FHUE-NDH INTERGENIC REGION] [SP:P75950] [DB:swissprot] >sp:[LN:A64855] [AC:A64855] [PN:ycfP protein] [GN:ycfP] [OR:Escherichia coli] [DB:pir2] >gp:[GI:d1036901:g4062672] [LN:D90745] [AC:D90745:AB001340] [OR:Escherichia coli] [SR:Escherichia coli(strain:K12) DNA, clone:Kohara clone #236] [DB:genpept-bct1] [DE:Escherichia coli genomic DNA. (24.8 - 25.2 min).] [NT:ORF_ID:o237#7] [LE:15728] [RE:16327] [DI:direct] >gp:[GI:d1036909:g4062678] [LN:D90746] [AC:D90746:AB001340] [OR:Escherichia coli] [SR:Escherichia coli(strain:K12) DNA, clone:Kohara clone #237] [DB:genpept-bct1] [DE:Escherichia coli genomic DNA. (25.0 - 25.4 min).] [NT:ORF_ID:o237#7] [LE:7027] [RE:7626] [DI:direct] >gp:[GI:g1787351] [LN:AE000211] [AC:AE000211:U00096] [PN:orf, hypothetical protein] [GN:ycfP] [FN:orf; Unknown] [OR:Escherichia coli] [DB:genpept-bct2] [DE:Escherichia coli K-12 MG1655 section 101 of 400 of the completegenome.] [NT:o199; This 199 aa ORF is 26 pct identical (5 gaps)] [LE:3398] [RE:3997] [DI:direct]

| ORF Name | NT ID | AA ID | NT LN | AA LN | Score | P-value |
|---|---|---|---|---|---|---|
| 189527_f3_782 | 502 | 7673 | 204 | 67 | | |

Description

NO-HIT

| ORF Name | NT ID | AA ID | NT LN | AA LN | Score | P-value |
|---|---|---|---|---|---|---|
| 19609383_c3_2012 | 503 | 7674 | 927 | 308 | 461 | 1.2e-43 |

Description gp:[GI:g5852589] [LN:AF134978] [AC:AF134978] [PN:putative transcriptional regulator] [GN:stmR] [OR:Salmonella-typhimurium] [DB:genpept-bct2] [DE:Salmonella typhimurium putative transcriptional regulator (stmR)gene, complete cds.] [NT:StmR] [LE:1] [RE:879] [DI:direct]

| ORF Name | NT ID | AA ID | NT LN | AA LN | Score | P-value |
|---|---|---|---|---|---|---|
| 20422056_f1_357 | 504 | 7675 | 690 | 229 | 871 | 4.2e-87 |

Description sp:[LN:YCFS_ECOLI] [AC:P75954] [GN:YCFS] [OR:Escherichia coli] [DE:HYPOTHETICAL 34.6 KD PROTEIN IN NDH-MFD INTERGENIC REGION PRECURSOR] [SP:P75954] [DB:swissprot] >sp:[LN:F64855] [AC:F64855] [PN:ycfS protein precursor] [GN:ycfS] [CL:conserved hypothetical protein b0819] [OR:Escherichia coli] [DB:pir2] >gp:[GI:d1036914:g4062682] [LN:D90746] [AC:D90746:AB001340] [PN:Protein ErfK/SrfK precursor.] [GN:erfK] [OR:Escherichia coli] [SR:Escherichia coli(strain:K12) DNA, clone:Kohara clone #237] [DB:genpept-bct1] [DE:Escherichia coli genomic DNA. (25.0 - 25.4 min).] [NT:ORF_ID:o238#2; similar to SwissProt Accession] [LE:11353] [RE:12315] [DI:complement] >gp:[GI:d1036919:g4062686] [LN:D90747] [AC:D90747:AB001340] [PN:Protein ErfK/SrfK precursor.] [GN:erfK] [OR:Escherichia coli] [SR:Escherichia coli(strain:K12) DNA, clone:Kohara clone #238] [DB:genpept-bct1] [DE:Escherichia coli genomic DNA. (25.2 - 25.6 min).] [NT:ORF_ID:o238#2; similar to SwissProt Accession] [LE:1099] [RE:2061] [DI:complement] >gp:[GI:g1787356] [LN:AE000211] [AC:AE000211:U00096] [PN:orf, hypothetical protein] [GN:ycfS] [FN:orf; Unknown] [OR:Escherichia coli] [DB:genpept-bct2] [DE:Escherichia coli K-12 MG1655 section 101 of 400 of the completegenome.] [NT:f320; This 320 aa ORF is 48 pct identical (8 gaps)] [LE:7724] [RE:8686] [DI:complement]

| ORF Name | NT ID | AA ID | NT LN | AA LN | Score | P-value |
|---|---|---|---|---|---|---|
| 20438587_c1_1435 | 505 | 7676 | 1140 | 379 | 106 | 0.0050 |

Description gp:[GI:g532537] [LN:EFU09422] [AC:U09422] [GN:Int-Tn] [OR:Enterococcus faecalis] [DB:genpept-bct2] [DE:Enterococcus faecalis DS16 transposon Tn916, (tet(M)), (Xis-Tn),(Int-Tn) genes, ORFs 1-24, complete cds, complete sequence.] [NT:ORF4] [LE:16884] [RE:17858] [DI:direct]

| ORF Name | NT ID | AA ID | NT LN | AA LN | Score | P-value |
|---|---|---|---|---|---|---|
| 20507952_f1_311 | 506 | 7677 | 2070 | 689 | 109 | 0.030 |

Description gp:[GI:g5690407] [LN:AF163834] [AC:AF163834] [PN:developmental protein DG1091] [GN:DG1091] [OR:Dictyostelium discoideum] [DB:genpept-inv2] [DE:Dictyostelium discoideum developmental protein DG1091 (DG1091)gene, partial cds.] [LE:225:563:1143] [RE:449:1025:>3314] [DI:directJoin]

| ORF Name | NT ID | AA ID | NT/LN | AA/LN | Score | P-value |
|---|---|---|---|---|---|---|
| 20508306_f1_91 | 507 | 7678 | 1953 | 650 | 3052 | 0.0 |

Description sp:[LN:RNB_ECOLI] [AC:P30850:P78280] [GN:RNB] [OR:Escherichia coli] [EC:3.1.13.1]
[DE:EXORIBONUCLEASE II, (RIBONUCLEASE II) (RNASE II)] [SP:P30850:P78280]
[DB:swissprot] >sp:[LN:A64877] [AC:A64877:S78512:S32940:S28506]
[PN:exoribonuclease II,:ribonuclease II] [GN:rnb] [CL:exoribonuclease II]
[OR:Escherichia coli] [EC:3.1.13.1] [DB:pir2] >gp:[GI:d1015556:g1742100]
[LN:D90766] [AC:D90766:AB001340] [PN:Exoribonuclease II (EC 3.1.13.1)
(Ribonuclease) [GN:rnb] [OR:Escherichia coli] [SR:Escherichia coli (strain:K12)
DNA, clone_lib:Kohara lambda minise] [DB:genpept-bct1] [DE:E.coli genomic DNA,
Kohara clone #255(28.8-29.2 min.).] [NT:ORF_ID:o255#13; similar to [SwissProt
Accession] [LE:9247] [RE:11181] [DI:complement] >gp:[GI:d1015564:g1742109]
[LN:D90767] [AC:D90767:AB001340] [PN:Exoribonuclease II (EC 3.1.13.1)
(Ribonuclease) [GN:rnb] [OR:Escherichia coli] [SR:Escherichia coli (strain:K12)
DNA, clone_lib:Kohara lambda minise] [DB:genpept-bct1] [DE:E.coli genomic DNA,
Kohara clone #256(29.0-29.4 min.).] [NT:ORF_ID:o255#13; similar to [SwissProt
Accession] [LE:2642] [RE:4576] [DI:complement] >gp:[GI:g1787542] [LN:AE000226]
[AC:AE000226:U00096] [PN:RNase II, mRNA degradation] [GN:rnb] [FN:enzyme;
Degradation of RNA] [OR:Escherichia coli] [DB:genpept-bct2] [EC:3.1.13.1]
[DE:Escherichia coli K-12 MG1655 section 116 of 400 of the completegenome.]
[NT:f644; 99 pct identical to RNB_ECOLI SW: P30850; CG] [LE:8470] [RE:10404]
[DI:complement]

| ORF Name | NT ID | AA ID | NT/LN | AA/LN | Score | P-value |
|---|---|---|---|---|---|---|
| 20525451_f3_993 | 508 | 7679 | 1008 | 335 | 1652 | 7.3e-170 |

Description sp:[LN:DEECG3] [AC:A25209:C64938] [PN:glyceraldehyde-3-phosphate dehydrogenase,
A] [GN:gapA (gap)] [CL:glyceraldehyde-3-phosphate dehydrogenase] [OR:Escherichia
coli] [EC:1.2.1.12] [DB:pir1] [MP:39 min] >gp:[GI:d1016299:g1742897] [LN:D90821]
[AC:D90821:AB001340] [PN:Glyceraldehyde-3-phosphate dehydrogenase (EC) [GN:gap]
[OR:Escherichia coli] [SR:Escherichia coli (strain:K12) DNA, clone_lib:Kohara
lambda minise] [DB:genpept-bct1] [DE:E.coli genomic DNA, Kohara clone
330(39.9-40.3 min.).] [NT:ORF_ID:o330#6; similar to [PIR Accession Number]
[LE:10448] [RE:11443] [DI:direct] >gp:[GI:g41539] [LN:ECGAP] [AC:X02662]
[OR:Escherichia coli] [DB:genpept-bct1] [DE:E. coli gap gene for GAPDH
(glyceraldehyde-3-phosphatedehydrogenase).] [NT:put. GAPDH (aa 1-332)]
[SP:P06977] [LE:484] [RE:1479] [DI:direct] >gp:[GI:g1788079] [LN:AE000273]
[AC:AE000273:U00096] [PN:glyceraldehyde-3-phosphate dehydrogenase A] [GN:gapA]
[FN:enzyme; Energy metabolism, carbon: Glycolysis] [OR:Escherichia coli]
[DB:genpept-bct2] [EC:1.2.1.12] [DE:Escherichia coli K-12 MG1655 section 163 of
400 of the completegenome.] [NT:o331; 100 pct identical to G3P1_ECOLI SW:
P06977;] [LE:201] [RE:1196] [DI:direct]

| ORF Name | NT ID | AA ID | NT/LN | AA/LN | Score | P-value |
|---|---|---|---|---|---|---|
| 20744058_c2_1622 | 509 | 7680 | 435 | 144 | | |

Description

NO-HIT

| ORF Name | NT ID | AA ID | NT/LN | AA/LN | Score | P-value |
|---|---|---|---|---|---|---|
| 20877138_f2_705 | 510 | 7681 | 252 | 83 | | |

Description

NO-HIT

| ORF Name | NT ID | AA ID | NT/LN | AA/LN | Score | P-value |
|---|---|---|---|---|---|---|
| 212763_c1_1536 | 511 | 7682 | 1536 | 511 | 246 | 1.3e-27 |

Description sp:[LN:F72238] [AC:F72238] [PN:conserved hypothetical protein] [GN:TM1547] [OR:Thermotoga maritima] [DB:pir2] >gp:[GI:g4982115] [LN:AE001801] [AC:AE001801:AE000512] [PN:conserved hypothetical protein] [GN:TM1547] [OR:Thermotoga maritima] [DB:genpept-bct2] [DE:Thermotoga maritima section 113 of 136 of the complete genome.] [NT:similar to GB:Pyro_h percent identity: 58.04;] [LE:70] [RE:1482] [DI:direct]

| ORF Name | NT ID | AA ID | NT/LN | AA/LN | Score | P-value |
|---|---|---|---|---|---|---|
| 2128132_f3_809 | 512 | 7683 | 240 | 79 | | |

Description

NO-HIT

| ORF Name | NT ID | AA ID | NT/LN | AA/LN | Score | P-value |
|---|---|---|---|---|---|---|
| 2141451_f1_212 | 513 | 7684 | 552 | 183 | 493 | 4.8e-47 |

Description gp:[GI:e1172770:g2598550] [LN:LLAJ109] [AC:AJ000109] [PN:gluthatione peroxidase] [GN:gpo] [OR:Lactococcus lactis] [DB:genpept-bct1] [DE:Lactococcus lactis carB and gpo genes.] [LE:163] [RE:636] [DI:direct]

| ORF Name | NT ID | AA ID | NT LN | AA LN | Score | P-value |
|---|---|---|---|---|---|---|
| 21531258_f1_169 | 514 | 7685 | 1122 | 373 | 1287 | 3.5e-131 |

Description sp:[LN:NADE_ECOLI] [AC:P18843:P78235] [GN:NADE:EFG:NTRL] [OR:Escherichia coli]
[EC:6.3.5.1] [DE:PROTEIN)] [SP:P18843:P78235] [DB:swissprot] >sp:[LN:D64933]
[AC:D64933:A26928] [PN:NAD+ synthase (glutamine-hydrolyzing),:nitrogen-regulatory
protein] [GN:nadE] [CL:spore outgrowth factor B] [OR:Escherichia coli]
[EC:6.3.5.1] [DB:pir2] [MP:34-39 min] >gp:[GI:d1016252:g1742846] [LN:D90817]
[AC:D90817:AB001340] [PN:NH(3)-dependent NAD(+) synthetase (EC 6.3.5.1)]
[GN:nadE, efg, ntrL__] [OR:Escherichia coli] [SR:Escherichia coli (strain:K12)
DNA, clone_lib:Kohara lambda minise] [DB:genpept-bct1] [DE:E.coli genomic DNA,
Kohara clone #326(39.1-39.4 min.).] [NT:ORF_ID:o326#9; similar to [SwissProt
Accession] [LE:7818] [RE:8645] [DI:direct] >gp:[GI:d1016258:g1742853] [LN:D90818]
[AC:D90818:AB001340] [PN:NH(3)-dependent NAD(+) synthetase (EC 6.3.5.1)]
[GN:nadE, efg, ntrL__] [OR:Escherichia coli] [SR:Escherichia coli (strain:K12)
DNA, clone_lib:Kohara lambda minise] [DB:genpept-bct1] [DE:E.coli genomic DNA,
Kohara clone #327(39.2-39.5 min.).] [NT:ORF_ID:o326#9; similar to [SwissProt
Accession] [LE:2186] [RE:3013] [DI:direct] >gp:[GI:g1788036] [LN:AE000269]
[AC:AE000269:U00096] [PN:NAD synthetase, prefers NH3 over glutamine] [GN:nadE]
[FN:enzyme; Biosynthesis of cofactors, carriers:] [OR:Escherichia coli]
[DB:genpept-bct2] [EC:6.3.5.1] [DE:Escherichia coli K-12 MG1655 section 159 of
400 of the completegenome.] [NT:o275; residues 32-274 are 100 pct identical to]
[LE:1232] [RE:2059] [DI:direct]

| ORF Name | NT ID | AA ID | NT LN | AA LN | Score | P-value |
|---|---|---|---|---|---|---|
| 21539638_f1_81 | 515 | 7686 | 1677 | 558 | 2472 | 9.3e-257 |

Description sp:[LN:SAPA_SALTY] [AC:P36634] [GN:SAPA] [OR:Salmonella typhimurium] [DE:PEPTIDE
TRANSPORT PERIPLASMIC PROTEIN SAPA PRECURSOR] [SP:P36634] [DB:swissprot]
>sp:[LN:S39585] [AC:S39585] [PN:peptide transport periplasmic protein sapA
precursor] [GN:sapA] [CL:dipeptide transport protein] [OR:Salmonella typhimurium]
[DB:pir2] >gp:[GI:g414208] [LN:STSAP] [AC:X74212] [GN:sapA] [OR:Salmonella
typhimurium] [DB:genpept-bct1] [DE:S.typhimurium DNA sequence of antimicrobial
peptides-resistancelocus.] [SP:P36634] [LE:116] [RE:1765] [DI:direct]

| ORF Name | NT ID | AA ID | NT LN | AA LN | Score | P-value |
|---|---|---|---|---|---|---|
| 21641038_c3_2047 | 516 | 7687 | 339 | 112 | | |

Description

NO-HIT

| ORF_Name | NT ID | AA ID | NT LN | AA LN | Score | P-value |
|---|---|---|---|---|---|---|
| 21691967_c2_1899 | 517 | 7688 | 1260 | 419 | 295 | 4.2e-24 |

Description gp:[GI:g5921667] [LN:AF031418] [AC:AF031418] [PN:unknown] [OR:Pseudomonas putida] [DB:genpept-bct2] [DE:Pseudomonas putida FliK (fliK), FliL, FliM (fliM), FliN (fliN),FliO (fliO), FliP (fliP), FliQ (fliQ), FliR (fliR), and FlhB (flhB)genes, complete cds; and unknown gene.] [NT:ORF563] [LE:348] [RE:2039] [DI:direct]

| ORF_Name | NT ID | AA ID | NT LN | AA LN | Score | P-value |
|---|---|---|---|---|---|---|
| 21722836_f2_395 | 518 | 7689 | 1863 | 620 | 282 | 4.2e-35 |

Description sp:[LN:BCSA_ACEXY] [AC:P21877] [GN:BCSA] [OR:Acetobacter xylinum] [SR:,Acetobacter pasteurianus] [EC:2.4.1.12] [DE:CELLULOSE SYNTHASE CATALYTIC SUBUNIT [UDP-FORMING],] [SP:P21877] [DB:swissprot] >sp:[LN:C36963] [AC:S13732:S43049:C36963] [PN:cellulose synthase (UDP-forming), catalytic chain] [GN:bscA] [CL:bcsA protein] [OR:Acetobacter pasteurianus] [EC:2.4.1.12] [DB:pir2] >gp:[GI:g39287] [LN:AXCELSYN] [AC:X54676] [PN:cellulose synthase (UDP-forming)] [GN:acsA] [OR:Acetobacter xylinus] [DB:genpept-bct1] [EC:2.4.1.12] [DE:A. xylinum gene for cellulose biosynthesis.] [NT:catalytic subunit] [SP:P21877] [LE:636] [RE:2807] [DI:direct]

| ORF_Name | NT ID | AA ID | NT LN | AA LN | Score | P-value |
|---|---|---|---|---|---|---|
| 21739381_f2_527 | 519 | 7690 | 1455 | 484 | 2121 | 1.5e-219 |

Description sp:[LN:A64932] [AC:A64932] [PN:hypothetical protein b1729] [CL:Bacillus subtilis sodium-glutamate symporter homolog yhcL] [OR:Escherichia coli] [DB:pir2] >gp:[GI:d1016231:g1742823] [LN:D90815] [AC:D90815:AB001340] [PN:Proton/sodium-glutamate symport protein] [OR:Escherichia coli] [SR:Escherichia coli (strain:K12) DNA, clone_lib:Kohara lambda minise] [DB:genpept-bct1] [DE:E.coli genomic DNA, Kohara clone #324(38.8-39.1 min.).] [NT:ORF_ID:o324#9; similar to [SwissProt Accession] [LE:10464] [RE:11855] [DI:direct] >gp:[GI:d1016235:g1742828] [LN:D90816] [AC:D90816:AB001340] [PN:Proton/sodium-glutamate symport protein] [OR:Escherichia coli] [SR:Escherichia coli (strain:K12) DNA, clone_lib:Kohara lambda minise] [DB:genpept-bct1] [DE:E.coli genomic DNA, Kohara clone #325(38.9-39.2 min.).] [NT:ORF_ID:o324#9; similar to [SwissProt Accession] [LE:3523] [RE:4914] [DI:direct] >gp:[GI:g1788024] [LN:AE000268] [AC:AE000268:U00096] [PN:part of a kinase] [GN:b1729] [FN:putative enzyme; Not classified] [OR:Escherichia coli] [DB:genpept-bct2] [DE:Escherichia coli K-12 MG1655 section 158 of 400 of the completegenome.] [NT:o463; This 463 aa ORF is 55 pct identical (3 gaps)] [LE:841] [RE:2232] [DI:direct]

| ORF_Name | NT ID | AA ID | NT/LN | AA/LN | Score | P-value |
|---|---|---|---|---|---|---|
| 21985081_f2_754 | 520 | 7691 | 597 | 198 | 505 | 2.5e-48 |

Description sp:[LN:YCFS_ECOLI] [AC:P75954] [GN:YCFS] [OR:Escherichia coli] [DE:HYPOTHETICAL 34.6 KD PROTEIN IN NDH-MFD INTERGENIC REGION PRECURSOR] [SP:P75954] [DB:swissprot] >sp:[LN:F64855] [AC:F64855] [PN:ycfS protein precursor] [GN:ycfS] [CL:conserved hypothetical protein b0819] [OR:Escherichia coli] [DB:pir2] >gp:[GI:d1036914:g4062682] [LN:D90746] [AC:D90746:AB001340] [PN:Protein ErfK/SrfK precursor.] [GN:erfK] [OR:Escherichia coli] [SR:Escherichia coli(strain:K12) DNA, clone:Kohara clone #237] [DB:genpept-bct1] [DE:Escherichia coli genomic DNA. (25.0 - 25.4 min).] [NT:ORF_ID:o238#2; similar to SwissProt Accession] [LE:11353] [RE:12315] [DI:complement] >gp:[GI:d1036919:g4062686] [LN:D90747] [AC:D90747:AB001340] [PN:Protein ErfK/SrfK precursor.] [GN:erfK] [OR:Escherichia coli] [SR:Escherichia coli(strain:K12) DNA, clone:Kohara clone #238] [DB:genpept-bct1] [DE:Escherichia coli genomic DNA. (25.2 - 25.6 min).] [NT:ORF_ID:o238#2; similar to SwissProt Accession] [LE:1099] [RE:2061] [DI:complement] >gp:[GI:g1787356] [LN:AE000211] [AC:AE000211:U00096] [PN:orf, hypothetical protein] [GN:ycfS] [FN:orf; Unknown] [OR:Escherichia coli] [DB:genpept-bct2] [DE:Escherichia coli K-12 MG1655 section 101 of 400 of the completegenome.] [NT:f320; This 320 aa ORF is 48 pct identical (8 gaps)] [LE:7724] [RE:8686] [DI:complement]

| ORF_Name | NT ID | AA ID | NT/LN | AA/LN | Score | P-value |
|---|---|---|---|---|---|---|
| 22039591_f3_799 | 521 | 7692 | 1665 | 554 | | |

Description

NO-HIT

| ORF_Name | NT ID | AA ID | NT/LN | AA/LN | Score | P-value |
|---|---|---|---|---|---|---|
| 22050327_f1_10 | 522 | 7693 | 627 | 208 | | |

Description

NO-HIT

| ORF_Name | NT ID | AA ID | NT/LN | AA/LN | Score | P-value |
|---|---|---|---|---|---|---|
| 22063552_f1_13 | 523 | 7694 | 591 | 196 | 613 | 9.2e-60 |

Description gp:[GI:g5924062] [LN:AF158699] [AC:AF158699:U41162] [PN:unknown] [OR:Burkholderia cepacia] [DB:genpept-bct2] [DE:Burkholderia cepacia D-serine deaminase (dsd), marR homolog, andmajor facilitator superfamily transporter homolog (ORFD) genes,complete cds; and unknown gene.] [NT:ORFE; similar to Pyrococcus furiosus intracellular] [LE:1981] [RE:2574] [DI:direct]

| ORF Name | NT ID | AA ID | NT LN | AA LN | Score | P-value |
|---|---|---|---|---|---|---|
| 22085408_f1_135 | 524 | 7695 | 198 | 65 | | |

Description

NO-HIT

| ORF Name | NT ID | AA ID | NT LN | AA LN | Score | P-value |
|---|---|---|---|---|---|---|
| 22128562_f2_388 | 525 | 7696 | 306 | 101 | | |

Description

NO-HIT

| ORF Name | NT ID | AA ID | NT LN | AA LN | Score | P-value |
|---|---|---|---|---|---|---|
| 22286086_c1_1231 | 526 | 7697 | 1065 | 354 | 908 | 5.0e-91 |

Description gp:[GI:d1015980:g1742555] [LN:D90798] [AC:D90798:AB001340] [OR:Escherichia coli]
[SR:Escherichia coli (strain:K12) DNA, clone_lib:Kohara lambda minise]
[DB:genpept-bct1] [DE:E.coli genomic DNA, Kohara clone #307(35.1-35.5 min.).]
[NT:ORF_ID:o308#16; similar to [SwissProt Accession] [LE:15249] [RE:16298]
[DI:complement] >gp:[GI:d1015990:g1742566] [LN:D90799] [AC:D90799:AB001340]
[OR:Escherichia coli] [SR:Escherichia coli (strain:K12) DNA, clone_lib:Kohara
lambda minise] [DB:genpept-bct1] [DE:E.coli genomic DNA, Kohara clone
308(35.3-35.7 min.).] [NT:ORF_ID:o308#16; similar to [SwissProt Accession]
[LE:5222] [RE:6271] [DI:complement] >gp:[GI:d1016012:g1742589] [LN:D90800]
[AC:D90800:AB001340] [OR:Escherichia coli] [SR:Escherichia coli (strain:K12) DNA,
clone_lib:Kohara lambda minise] [DB:genpept-bct1] [DE:E.coli genomic DNA, Kohara
clone #309(35.4-35.7 min.).] [NT:ORF_ID:o308#16; similar to [SwissProt Accession]
[LE:1998] [RE:3047] [DI:complement]

| ORF Name | NT ID | AA ID | NT LN | AA LN | Score | P-value |
|---|---|---|---|---|---|---|
| 22455312_f1_315 | 527 | 7698 | 249 | 82 | 79 | 0.0062 |

Description sp:[LN:H72579] [AC:H72579] [PN:hypothetical protein APE1920] [GN:APE1920]
[OR:Aeropyrum pernix] [DB:pir2] >gp:[GI:d1044711:g5105612] [LN:AP000062]
[AC:AP000062] [PN:167aa long hypothetical protein] [GN:APE1920] [OR:Aeropyrum
pernix] [SR:Aeropyrum pernix (strain:K1) DNA] [DB:genpept-bct1] [DE:Aeropyrum
pernix genomic DNA, section 5/7.] [NT:motif=prokaryotic membrane lipoprotein
lipid] [LE:229934] [RE:230437] [DI:direct]

255

| ORF Name | NT ID | AA ID | NT LN | AA LN | Score | P-value |
|---|---|---|---|---|---|---|
| 22706957_f2_599 | 528 | 7699 | 1266 | 421 | 538 | 8.1e-52 |

Description gp:[GI:e1536959:g5738822] [LN:SCJ11] [AC:AL109949] [PN:putative integral membrane transport protein] [GN:SCJ11.08c] [OR:Streptomyces coelicolor A3(2)] [DB:genpept-bct1] [DE:Streptomyces coelicolor cosmid J11.] [NT:SCJ11.08c, possible integral membrane transport] [LE:4976] [RE:6199] [DI:complement]

| ORF Name | NT ID | AA ID | NT LN | AA LN | Score | P-value |
|---|---|---|---|---|---|---|
| 22737632_f1_204 | 529 | 7700 | 1359 | 452 | 428 | 3.1e-43 |

Description sp:[LN:CHI1_BACCI] [AC:P20533] [GN:CHIA1] [OR:Bacillus circulans] [EC:3.2.1.14] [DE:CHITINASE A1 PRECURSOR,] [SP:P20533] [DB:swissprot] >sp:[LN:A38368] [AC:A38368] [PN:chitinase, precursor] [CL:fibronectin type III repeat homology] [OR:Bacillus circulans] [EC:3.2.1.14] [DB:pir2] >gp:[GI:g142688] [LN:BACCHIA3] [AC:M57601:J05599] [PN:chitinase A1] [GN:chiA] [OR:Bacillus circulans] [SR:Bacillus circulans (strain WL-12) DNA] [DB:genpept-bct1] [EC:3.2.1.14] [DE:B.circulans chitinase A1 (chiA) gene, complete cds.] [LE:242] [RE:2341] [DI:direct]

| ORF Name | NT ID | AA ID | NT LN | AA LN | Score | P-value |
|---|---|---|---|---|---|---|
| 22783412_f1_37 | 530 | 7701 | 2511 | 836 | 281 | 1.3e-28 |

Description gp:[GI:g5359712] [LN:AF126472] [AC:AF126472] [PN:mannosidase] [OR:Cellulomonas fimi] [DB:genpept-bct2] [DE:Cellulomonas fimi mannosidase gene, complete cds.] [LE:1] [RE:2529] [DI:direct]

| ORF Name | NT ID | AA ID | NT LN | AA LN | Score | P-value |
|---|---|---|---|---|---|---|
| 22910263_c3_1967 | 531 | 7702 | 183 | 60 | | |

Description

NO-HIT

| ORF Name | NT ID | AA ID | NT/LN | AA/LN | Score | P-value |
|---|---|---|---|---|---|---|
| 22931566_c2_1863 | 532 | 7703 | 234 | 77 | 295 | 4.6e-26 |

Description sp:[LN:PSPD_ECOLI] [AC:P23856] [GN:PSPD] [OR:Escherichia coli] [DE:PHAGE SHOCK
PROTEIN D] [SP:P23856] [DB:swissprot] >sp:[LN:S17124] [AC:S17124:I84051:F64879]
[PN:phage shock protein D] [GN:pspD] [OR:Escherichia coli] [DB:pir2]
>gp:[GI:d1015592:g1742137] [LN:D90768] [AC:D90768:AB001340] [PN:Phage shock
protein D] [GN:pspD] [OR:Escherichia coli] [SR:Escherichia coli (strain:K12) DNA,
clone_lib:Kohara lambda minise] [DB:genpept-bct1] [DE:E.coli genomic DNA, Kohara
clone #257(29.1-29.6 min.).] [NT:ORF_ID:o257#16; similar to [PIR Accession
Number] [LE:16763] [RE:16984] [DI:direct] >gp:[GI:d1015600:g1742146] [LN:D90769]
[AC:D90769:AB001340] [PN:Phage shock protein D] [GN:pspD] [OR:Escherichia coli]
[SR:Escherichia coli (strain:K12) DNA, clone_lib:Kohara lambda minise]
[DB:genpept-bct1] [DE:E.coli genomic DNA, Kohara clone #258(29.5-29.8 min.).]
[NT:ORF_ID:o257#16; similar to [PIR Accession Number] [LE:2767] [RE:2988]
[DI:direct] >gp:[GI:g42542] [LN:ECPSP] [AC:X57560] [PN:pspD protein] [GN:pspD]
[OR:Escherichia coli] [DB:genpept-bct1] [DE:E.coli stress-induced psp operon
DNA.] [SP:P23856] [LE:1812] [RE:2033] [DI:direct] >gp:[GI:g1787565] [LN:AE000228]
[AC:AE000228:U00096] [PN:phage shock protein] [GN:pspD] [FN:IS, phage, Tn;
Phage-related functions and] [OR:Escherichia coli] [DB:genpept-bct1]
[DE:Escherichia coli K-12 MG1655 section 118 of 400 of the completegenome.]
[NT:o73; 100 pct identical to PSPD_ECOLI SW: P23856] [LE:10058] [RE:10279]
[DI:direct]

| ORF Name | NT ID | AA ID | NT/LN | AA/LN | Score | P-value |
|---|---|---|---|---|---|---|
| 22941551_f2_608 | 533 | 7704 | 567 | 188 | 674 | 3.1e-66 |

Description sp:[LN:YEAL_ECOLI] [AC:P76240:O07965:O07967] [GN:YEAL] [OR:Escherichia coli]
[DE:HYPOTHETICAL 15.3 KD PROTEIN IN GAPA-RND INTERGENIC REGION]
[SP:P76240:O07965:O07967] [DB:swissprot] >sp:[LN:E64939] [AC:E64939]
[PN:hypothetical protein b1789] [CL:hypothetical protein ytwI] [OR:Escherichia
coli] [DB:pir2] >gp:[GI:d1016312:g1736415] [LN:D90822] [AC:D90822:AB001340]
[OR:Escherichia coli] [SR:Escherichia coli (strain:K12) DNA, clone_lib:Kohara
lambda minise] [DB:genpept-bct1] [DE:E.coli genomic DNA, Kohara clone
331(40.1-40.4 min.).] [NT:ORF_ID:o331#5; similar to [SwissProt Accession]
[LE:11499] [RE:11945] [DI:direct] >gp:[GI:d1016314:g1736418] [LN:D90823]
[AC:D90823:AB001340] [OR:Escherichia coli] [SR:Escherichia coli (strain:K12) DNA,
clone_lib:Kohara lambda minise] [DB:genpept-bct1] [DE:E.coli genomic DNA, Kohara
clone #332(40.4-40.7 min.).] [NT:ORF_ID:o331#5; similar to [SwissProt Accession]
[LE:548] [RE:994] [DI:direct] >gp:[GI:g1788090] [LN:AE000274]
[AC:AE000274:U00096] [PN:orf, hypothetical protein] [GN:yeaL] [FN:orf; Unknown]
[OR:Escherichia coli] [DB:genpept-bct2] [DE:Escherichia coli K-12 MG1655 section
164 of 400 of the completegenome.] [NT:o148; This 148 aa ORF is 53 pct identical
(1 gap)] [LE:91] [RE:537] [DI:direct]

| ORF Name | NT ID | AA ID | NT LN | AA LN | Score | P-value |
|---|---|---|---|---|---|---|
| 23443751_c2_1559 | 534 | 7705 | 1344 | 447 | 2110 | 2.1e-218 |

Description sp:[LN:DEECR] [AC:A00461:B64855] [PN:NADH dehydrogenase,] [GN:ndh] [CL:NADH dehydrogenase] [OR:Escherichia coli] [EC:1.6.99.3] [DB:pir1] [MP:22 min] >gp:[GI:d1036910:g1651546] [LN:D90746] [AC:D90746:AB001340] [PN:NADH dehydrogenase (EC 1.6.99.3)] [GN:ndh] [OR:Escherichia coli] [SR:Escherichia coli(strain:K12) DNA, clone:Kohara clone #237] [DB:genpept-bct1] [DE:Escherichia coli genomic DNA. (25.0 - 25.4 min).] [NT:ORF_ID:o237#8; similar to PIR Accession Number] [LE:8026] [RE:9330] [DI:direct] >gp:[GI:g581140] [LN:ECNDHX] [AC:V00306:J01653] [PN:NADH dehydrogenase] [GN:ndh] [OR:Escherichia coli] [DB:genpept-bct1] [DE:E. coli gene ndh coding for respiratory NADH dehydrogenase (acomponent of the electron transport chain). This enzyme catalysesthe transfer of electrons from NADH to the respiratory chain andthus links the major catabolic and energy-producing pathways of thecell.] [SP:P00393] [LE:354] [RE:1658] [DI:direct] >gp:[GI:g1787352] [LN:AE000211] [AC:AE000211:U00096] [PN:respiratory NADH dehydrogenase] [GN:ndh] [FN:enzyme; Energy metabolism, carbon: Aerobic] [OR:Escherichia coli] [DB:genpept-bct2] [EC:1.6.99.3] [DE:Escherichia coli K-12 MG1655 section 101 of 400 of the completegenome.] [NT:o434; 99 pct identical to DHNA_ECOLI SW: P00393 but] [LE:4397] [RE:5701] [DI:direct]

| ORF Name | NT ID | AA ID | NT LN | AA LN | Score | P-value |
|---|---|---|---|---|---|---|
| 23470393_c2_1838 | 535 | 7706 | 1461 | 486 | 786 | 4.3e-78 |

Description sp:[LN:E70081] [AC:E70081] [PN:purine-cytosine permease homolog yxlA] [GN:yxlA] [OR:Bacillus subtilis] [DB:pir2] >gp:[GI:e1186370:g2636406] [LN:BSUB0020] [AC:Z99123:AL009126] [GN:yxlA] [FN:unknown] [OR:Bacillus subtilis] [DB:genpept-bct1] [DE:Bacillus subtilis complete genome (section 20 of 21): from 3798401to 4010550.] [NT:similar to purine-cytosine permease] [LE:171452] [RE:172825] [DI:direct] >gp:[GI:d1012399:g1783255] [LN:D83026] [AC:D83026:D45911] [GN:yxlA] [OR:Bacillus subtilis] [SR:Bacillus subtilis (strain:BGSC 1A1) DNA] [DB:genpept-bct1] [DE:Bacillus subtilis genome sequence covering lic-cel region.] [NT:homologous to purine-cytosine permease] [LE:51640] [RE:53013] [DI:complement]

| ORF Name | NT ID | AA ID | NT LN | AA LN | Score | P-value |
|---|---|---|---|---|---|---|
| 23492843_f3_1086 | 536 | 7707 | 195 | 64 | | |

Description

NO-HIT

| ORF Name | NT ID | AA ID | NT/LN | AA/LN | Score | P-value |
|---|---|---|---|---|---|---|
| 2353427_c1_1240 | 537 | 7708 | 1242 | 413 | 462 | 9.2e-44 |

Description gp:[GI:g5059250] [LN:AF147978] [AC:AF147978] [PN:putative portal protein]
[OR:Bacteriophage D3] [DB:genpept-phg] [DE:Bacteriophage D3 putative terminase,
putative portal protein,putative ClpP protease, and major head protein genes,
complete cds;and unknown genes.] [NT:ORF1305; similar to the portal protein of]
[LE:2990] [RE:4294] [DI:direct]

| ORF Name | NT ID | AA ID | NT/LN | AA/LN | Score | P-value |
|---|---|---|---|---|---|---|
| 2360952_f3_1042 | 538 | 7709 | 714 | 237 | 609 | 2.4e-59 |

Description gp:[GI:d1042608:g5103197] [LN:AP000342] [AC:AP000342] [GN:yeaA] [OR:Plasmid R100]
[SR:Plasmid R100 (specific_host:Shigella flexneri 2b strain 222]
[DB:genpept-bct1] [DE:Plasmid R100 genomic DNA.] [NT:43% identical (4 gaps) to
216 residues of 226 aa] [LE:40169] [RE:40855] [DI:direct] >gp:[GI:g5738087]
[LN:AF162223] [AC:AF162223] [PN:JemC] [GN:jemC] [OR:Shigella flexneri]
[DB:genpept-bct2] [DE:Shigella flexneri transposon Tn10 IS10-left transposase,
JemA(jemA), JemB (jemB), JemC (jemC), TetR (tetR), TetA (tetA), TetC(tetC), TetD
(tetD), and IS10-right transposase genes, completecds.] [NT:similar to cadmium-,
arsenic-, arsenate-, and] [LE:4038] [RE:4724] [DI:direct]

| ORF Name | NT ID | AA ID | NT/LN | AA/LN | Score | P-value |
|---|---|---|---|---|---|---|
| 23631562_f3_942 | 539 | 7710 | 183 | 60 | | |

Description

NO-HIT

| ORF Name | NT ID | AA ID | NT/LN | AA/LN | Score | P-value |
|---|---|---|---|---|---|---|
| 23847526_c1_1237 | 540 | 7711 | 393 | 130 | 169 | 1.0e-12 |

Description sp:[LN:T13559] [AC:T13559] [PN:hypothetical protein 19] [OR:Bacillus phage
phi-105] [DB:pir2] >gp:[GI:d1037663:g4126656] [LN:AB016282] [AC:AB016282]
[OR:bacteriophage phi-105] [SR:bacteriophage phi-105 DNA] [DB:genpept-phg]
[DE:Bacteriophage phi-105 DNA, complete sequence.] [NT:ORF19] [LE:38622]
[RE:38996] [DI:direct] >gp:[GI:g532220] [LN:PH5ORFHTR] [AC:L35561] [PN:holin]
[OR:bacteriophage phi-105] [SR:Bacteriophage phi-105 DNA] [DB:genpept-phg]
[DE:Bacteriophage phi-105 ORFs 1-3.] [NT:ORF2; potential dual start motif;
putative] [LE:796] [RE:1170] [DI:direct]

| ORF Name | NT ID | AA ID | NT/LN | AA/LN | Score | P-value |
|---|---|---|---|---|---|---|
| 24022061_f1_319 | 541 | 7712 | 588 | 195 | 827 | 1.9e-82 |

Description sp:[LN:INTE_ECOLI] [AC:P75969] [GN:INTE] [OR:Escherichia coli] [DE:PROPHAGE
LAMBDA INTEGRASE (INT(LAMBDA)) (PROPHAGE E14 INTEGRASE)] [SP:P75969]
[DB:swissprot] >sp:[LN:A64859] [AC:A64859] [PN:integrase] [GN:intE] [CL:phage
lambda integrase] [OR:Escherichia coli] [DB:pir2] >gp:[GI:d1036955:g4062718]
[LN:D90749] [AC:D90749:AB001340] [PN:Integrase.] [GN:int] [OR:Escherichia coli]
[SR:Escherichia coli(strain:K12) DNA, clone:Kohara clone #240] [DB:genpept-bct1]
[DE:Escherichia coli genomic DNA. (25.7 - 26.1 min).] [NT:ORF_ID:o240#9; similar
to SwissProt Accession] [LE:10230] [RE:11357] [DI:complement] >gp:[GI:g1787386]
[LN:AE000214] [AC:AE000214:U00096] [PN:prophage e14 integrase] [GN:intE] [FN:IS,
phage, Tn; Phage-related functions and] [OR:Escherichia coli] [DB:genpept-bct2]
[DE:Escherichia coli K-12 MG1655 section 104 of 400 of the completegenome.]
[NT:f375; phage stats; This 375 aa ORF is 60 pct] [LE:3089] [RE:4216]
[DI:complement]

| ORF Name | NT ID | AA ID | NT/LN | AA/LN | Score | P-value |
|---|---|---|---|---|---|---|
| 24023432_c1_1485 | 542 | 7713 | 189 | 62 | | |

Description

NO-HIT

| ORF Name | NT ID | AA ID | NT/LN | AA/LN | Score | P-value |
|---|---|---|---|---|---|---|
| 24042832_f2_611 | 543 | 7714 | 1239 | 412 | 1525 | 2.1e-156 |

Description sp:[LN:YEAN_ECOLI] [AC:P76242:O07966:O07968] [GN:YEAN] [OR:Escherichia coli]
[DE:HYPOTHETICAL 41.2 KD PROTEIN IN GAPA-RND INTERGENIC REGION]
[SP:P76242:O07966:O07968] [DB:swissprot] >sp:[LN:G64939] [AC:G64939]
[PN:hypothetical protein b1791] [CL:cynX protein] [OR:Escherichia coli] [DB:pir1]
>gp:[GI:d1016313:g1736416] [LN:D90822] [AC:D90822:AB001340] [PN:Cyanate transport
protein CynX.] [OR:Escherichia coli] [SR:Escherichia coli (strain:K12) DNA,
clone_lib:Kohara lambda minise] [DB:genpept-bct1] [DE:E.coli genomic DNA, Kohara
clone #331(40.1-40.4 min.).] [NT:ORF_ID:o331#7; similar to [SwissProt Accession]
[LE:12820] [RE:14001] [DI:direct] >gp:[GI:d1016315:g1736419] [LN:D90823]
[AC:D90823:AB001340] [PN:Cyanate transport protein CynX.] [OR:Escherichia coli]
[SR:Escherichia coli (strain:K12) DNA, clone_lib:Kohara lambda minise]
[DB:genpept-bct1] [DE:E.coli genomic DNA, Kohara clone #332(40.4-40.7 min.).]
[NT:ORF_ID:o331#7; similar to [SwissProt Accession] [LE:1869] [RE:3050]
[DI:direct] >gp:[GI:g1788092] [LN:AE000274] [AC:AE000274:U00096] [PN:putative
amino acid/amine transport protein] [GN:yeaN] [FN:putative transport; Not
classified] [OR:Escherichia coli] [DB:genpept-bct2] [DE:Escherichia coli K-12
MG1655 section 164 of 400 of the completegenome.] [NT:o393; This 393 aa ORF is 42
pct identical (7 gaps)] [LE:1412] [RE:2593] [DI:direct]

| ORF Name | NT ID | AA ID | NT/LN | AA/LN | Score | P-value |
|---|---|---|---|---|---|---|
| 24255025_f2_452 | 544 | 7715 | 843 | 280 | 646 | 2.9e-63 |

Description sp:[LN:YCIW_ECOLI] [AC:P76035] [GN:YCIW] [OR:Escherichia coli] [DE:HYPOTHETICAL
45.1 KD PROTEIN IN RNB-FABI INTERGENIC REGION] [SP:P76035] [DB:swissprot]
>sp:[LN:B64877] [AC:B64877] [PN:probable membrane protein yciW] [GN:yciW]
[OR:Escherichia coli] [DB:pir2] >gp:[GI:g1787544] [LN:AE000227]
[AC:AE000227:U00096] [PN:putative oxidoreductase] [GN:yciW] [FN:putative enzyme;
Not classified] [OR:Escherichia coli] [DB:genpept-bct2] [DE:Escherichia coli K-12
MG1655 section 117 of 400 of the completegenome.] [NT:f401; This 401 aa ORF is 25
pct identical (7 gaps)] [LE:64] [RE:1269] [DI:complement]

| ORF Name | NT ID | AA ID | NT/LN | AA/LN | Score | P-value |
|---|---|---|---|---|---|---|
| 24266926_f3_816 | 545 | 7716 | 531 | 176 | 711 | 3.8e-70 |

Description sp:[LN:JC5504] [AC:JC5504:G64881:PC4166] [PN:thioredoxin
peroxidase,:scavengase:scavengase p20:thiol peroxidase p20] [GN:tpx]
[CL:thioredoxin peroxidase] [OR:Escherichia coli] [EC:1.11.1.-] [DB:pir2]
>gp:[GI:g1787584] [LN:AE000230] [AC:AE000230:U00096] [PN:thiol peroxidase]
[GN:tpx] [FN:enzyme; Detoxification] [OR:Escherichia coli]
[EC:1.11.1-] [DE:Escherichia coli K-12 MG1655 section 120 of 400 of the
completegenome.] [NT:f168; 99 pct identical to GB: ECU33213_1] [LE:6467]
[RE:6973] [DI:complement] >gp:[GI:g1931625] [LN:ECU93212] [AC:U93212]
[PN:scavengase p20] [OR:Escherichia coli] [DB:genpept-bct2] [DE:Escherichia coli
scavengase p20 gene, complete cds.] [NT:thiol peroxidase] [LE:1] [RE:507]
[DI:direct]

| ORF Name | NT ID | AA ID | NT/LN | AA/LN | Score | P-value |
|---|---|---|---|---|---|---|
| 24397511_f2_483 | 546 | 7717 | 597 | 198 | | |

Description

NO-HIT

| ORF Name | NT ID | AA ID | NT/LN | AA/LN | Score | P-value |
|---|---|---|---|---|---|---|
| 24401036_f1_289 | 547 | 7718 | 183 | 60 | | |

Description

NO-HIT

| ORF Name | NT ID | AA ID | NT LN | AA LN | Score | P-value |
|---|---|---|---|---|---|---|
| 24414587_c1_1278 | 548 | 7719 | 918 | 305 | 362 | 3.6e-33 |

Description gp:[GI:g3172412] [LN:AF064550] [AC:AF064550] [PN:unknown] [OR:Clostridium pasteurianum] [DB:genpept-bct2] [DE:Clostridium pasteurianum putative pyruvate-ferredoxinoxidoreductase (pfo2) gene, partial cds; CotF (cotf) gene, completecds; and unknown gene.] [NT:putative; similar to Bacillus subtilis cotJC] [LE:2540] [RE:3217] [DI:direct]

| ORF Name | NT ID | AA ID | NT LN | AA LN | Score | P-value |
|---|---|---|---|---|---|---|
| 24425751_c2_1869 | 549 | 7720 | 1608 | 535 | 2279 | 2.6e-236 |

Description sp:[LN:TYRR_ECOLI] [AC:P07604] [GN:TYRR] [OR:Escherichia coli] [DE:TRANSCRIPTIONAL REGULATORY PROTEIN TYRR] [SP:P07604] [DB:swissprot] >sp:[LN:RGECAY] [AC:A47086:A24209:F64881] [PN:transcription regulator tyrR] [GN:tyrR] [CL:nif-specific regulatory protein:RNA polymerase sigma factor interaction domain homology] [OR:Escherichia coli] [DB:pir1] [MP:29 min] >gp:[GI:d1015621:g1742168] [LN:D90770] [AC:D90770:AB001340] [PN:Regulatory protein TyrR] [GN:tyrR] [OR:Escherichia coli] [SR:Escherichia coli (strain:K12) DNA, clone_lib:Kohara lambda minise] [DB:genpept-bct1] [DE:E.coli genomic DNA, Kohara clone #259(29.6-30.0 min.).] [NT:ORF_ID:o260#6; similar to [PIR Accession Number] [LE:13300] [RE:14841] [DI:direct] >gp:[GI:d1015632:g1742180] [LN:D90771] [AC:D90771:AB001340] [PN:Regulatory protein TyrR] [GN:tyrR] [OR:Escherichia coli] [SR:Escherichia coli (strain:K12) DNA, clone_lib:Kohara lambda minise] [DB:genpept-bct1] [DE:E.coli genomic DNA, Kohara clone #260(29.8-30.2 min.).] [NT:ORF_ID:o260#6; similar to [PIR Accession Number] [LE:5193] [RE:6734] [DI:direct] >gp:[GI:g148092] [LN:ECOTYRR] [AC:M12114] [OR:Escherichia coli] [SR:E.coli K12, clone pMU360] [DB:genpept-bct1] [DE:E.coli K12 tyrR regulatory gene encoding TyrR protein, completecds.] [NT:TyrR protein] [LE:318] [RE:1859] [DI:direct] >gp:[GI:g1787583] [LN:AE000230] [AC:AE000230:U00096] [PN:transcriptional regulation of aroF, aroG, tyrA] [GN:tyrR] [FN:regulator; Transport of small molecules: Amino] [OR:Escherichia coli] [DB:genpept-bct2] [DE:Escherichia coli K-12 MG1655 section 120 of 400 of the completegenome.] [NT:o513; 100 pct identical to TYRR_ECOLI SW: P07604;] [LE:4882] [RE:6423] [DI:direct]

| ORF Name | NT ID | AA ID | NT LN | AA LN | Score | P-value |
|---|---|---|---|---|---|---|
| 24495437_c3_1985 | 550 | 7721 | 1302 | 433 | 119 | 0.00037 |

Description sp:[LN:COAT_BPHK7] [AC:P49861] [GN:5] [OR:Bacteriophage HK97] [DE:MAJOR CAPSID PROTEIN PRECURSOR (GP5) (HEAD PROTEIN)] [SP:P49861] [DB:swissprot] >sp:[LN:S54392] [AC:S54392:S54373] [PN:major capsid protein gp5] [GN:5] [OR:phage HK97] [DB:pir2] >gp:[GI:g609312] [LN:BHU18319] [AC:U18319] [PN:major capsid protein gp5] [GN:5] [OR:Bacteriophage HK97] [DB:genpept-phg] [DE:Bacteriophage HK97 portal protein gp3 (3) gene, putative proheadprotease gp4 (4) gene, and major capsid protein gp5 (5) gene,complete cds.] [NT:major prohead protein; additional processing of gp5] [LE:2131] [RE:3288] [DI:direct]

| ORF Name | NT ID | AA ID | NT/LN | AA/LN | Score | P-value |
|---|---|---|---|---|---|---|
| 24495682_f1_84 | 551 | 7722 | 828 | 275 | 1269 | 2.8e-129 |

Description sp:[LN:SAPF_SALTY] [AC:P36638] [GN:SAPF] [OR:Salmonella typhimurium] [DE:PEPTIDE TRANSPORT SYSTEM ATP-BINDING PROTEIN SAPF] [SP:P36638] [DB:swissprot] >sp:[LN:S39589] [AC:S39589] [PN:peptide transport system ATP-binding protein sapF] [GN:sapF] [CL:unassigned ATP-binding cassette proteins:ATP-binding cassette homology] [OR:Salmonella typhimurium] [DB:pir2] >gp:[GI:g414212] [LN:STSAP] [AC:X74212] [GN:sapF] [OR:Salmonella typhimurium] [DB:genpept-bct1] [DE:S.typhimurium DNA sequence of antimicrobial peptides-resistancelocus.] [SP:P36638] [LE:4598] [RE:5404] [DI:direct]

| ORF Name | NT ID | AA ID | NT/LN | AA/LN | Score | P-value |
|---|---|---|---|---|---|---|
| 24495840_c1_1504 | 552 | 7723 | 651 | 216 | 988 | 2.0e-101 |

Description sp:[LN:MPPA_ECOLI] [AC:P77348] [GN:MPPA] [OR:Escherichia coli] [DE:PERIPLASMIC MUREIN PEPTIDE-BINDING PROTEIN PRECURSOR] [SP:P77348] [DB:swissprot] >gp:[GI:g2935635] [LN:ECU88242] [AC:U88242] [PN:periplasmic murein peptide binding protein] [GN:mppA] [FN:essential for the uptake of the murein peptide] [OR:Escherichia coli] [DB:genpept-bct2] [DE:Escherichia coli periplasmic murein peptide binding proteinprecursor (mppA) gene, complete cds.] [NT:transport into the cytoplasm from MppA requires] [LE:149] [RE:1762] [DI:direct]

| ORF Name | NT ID | AA ID | NT/LN | AA/LN | Score | P-value |
|---|---|---|---|---|---|---|
| 24644088_f3_1147 | 553 | 7724 | 3465 | 1154 | 5449 | 0.0 |

Description sp:[LN:MFD_ECOLI] [AC:P30958:P77592] [GN:MFD] [OR:Escherichia coli] [DE:TRANSCRIPTION-REPAIR COUPLING FACTOR (TRCF)] [SP:P30958:P77592] [DB:swissprot] >sp:[LN:G64855] [AC:G64855:A46215] [PN:transcription/repair-coupling protein:mutation frequency decline protein] [GN:mfd:trcF] [CL:transcription-repair coupling protein:DEAD/H box helicase homology] [OR:Escherichia coli] [DB:pir1] >gp:[GI:d1036915:g1651547] [LN:D90746] [AC:D90746:AB001340] [PN:Transcription-repair coupling protein mfd] [GN:mfd] [OR:Escherichia coli] [SR:Escherichia coli(strain:K12) DNA, clone:Kohara clone #237] [DB:genpept-bct1] [DE:Escherichia coli genomic DNA. (25.0 - 25.4 min).] [NT:ORF_ID:o238#3; similar to PIR Accession Number] [LE:12459] [RE:15905] [DI:complement] >gp:[GI:d1036920:g1651549] [LN:D90747] [AC:D90747:AB001340] [PN:Transcription-repair coupling protein mfd] [GN:mfd] [OR:Escherichia coli] [SR:Escherichia coli(strain:K12) DNA, clone:Kohara clone #238] [DB:genpept-bct1] [DE:Escherichia coli genomic DNA. (25.2 - 25.6 min).] [NT:ORF_ID:o238#3; similar to PIR Accession Number] [LE:2205] [RE:5651] [DI:complement] >gp:[GI:g1787357] [LN:AE000211] [AC:AE000211:U00096] [PN:transcription-repair coupling factor; mutation] [GN:mfd] [FN:factor; DNA - replication, repair,] [OR:Escherichia coli] [DB:genpept-bct2] [DE:Escherichia coli K-12 MG1655 section 101 of 400 of the completegenome.] [NT:f1148; 99 pct identical to MFD_ECOLI SW: P30958] [LE:8830] [RE:12276] [DI:complement]

| ORF Name | NT ID | AA ID | NT/LN | AA/LN | Score | P-value |
|---|---|---|---|---|---|---|
| 24644805_c2_1615 | 554 | 7725 | 210 | 69 | 84 | 0.0010 |

Description gp:[GI:g2564084] [LN:BNU45242] [AC:U45242] [PN:orf QD1] [FN:unknown]
[OR:Bacteriophage N15] [DB:genpept-phg] [DE:Bacteriophage immB region, N15
primase (repA) gene, partial cds;and repressor protein (cB), repressor protein
(cro), antiterminator(Q), orf QD1 and dnq genes, complete cds.] [NT:putative]
[LE:1886] [RE:2314] [DI:direct]

| ORF Name | NT ID | AA ID | NT/LN | AA/LN | Score | P-value |
|---|---|---|---|---|---|---|
| 24663592_f2_628 | 555 | 7726 | 195 | 64 | 63 | 0.025 |

Description sp:[LN:LEP3_ERWCH] [AC:P31711] [GN:OUTO] [OR:Erwinia chrysanthemi] [EC:3.4.99.-]
[DE:(PECTIC ENZYMES SECRETION PROTEIN OUTO)] [SP:P31711] [DB:swissprot]
>sp:[LN:C47755] [AC:C47755] [PN:pectic enzyme secretion protein OutO] [CL:type IV
prepilin peptidase] [OR:Erwinia chrysanthemi] [DB:pir1] >gp:[GI:g148444]
[LN:ERWOUTCM] [AC:L02214] [PN:secretory component] [GN:outO] [OR:Erwinia
chrysanthemi] [SR:Erwinia chrysanthemi (strain AC4150) DNA] [DB:genpept-bct1]
[DE:Erwinia chrysanthemi secretory component (outC-outM) genes,complete cds.]
[NT:putative] [LE:11472] [RE:12323] [DI:direct]

| ORF Name | NT ID | AA ID | NT/LN | AA/LN | Score | P-value |
|---|---|---|---|---|---|---|
| 24667178_c3_2161 | 556 | 7727 | 2610 | 869 | 4237 | 0.0 |

Description sp:[LN:TOP1_ECOLI] [AC:P06612] [GN:TOPA:SUPX] [OR:Escherichia coli] [EC:5.99.1.2]
[DE:(UNTWISTING ENZYME) (SWIVELASE)] [SP:P06612] [DB:swissprot] >sp:[LN:ISECTP]
[AC:E64875:A25786:C26695] [PN:DNA topoisomerase:nicking-closing
enzyme:omega-protein:relaxing enzyme:swivelase:type I DNA
topoisomerase:untwisting enzyme] [GN:topA:supX] [CL:bacterial type I DNA
topoisomerase] [OR:Escherichia coli] [EC:5.99.1.2] [DB:pir1] [MP:28 min]
>gp:[GI:d1015527:g1742069] [LN:D90764] [AC:D90764:AB001340] [PN:DNA topoisomerase
I (EC 5.99.1.2) (w-protein)] [GN:topA, supX] [OR:Escherichia coli]
[SR:Escherichia coli (strain:K12) DNA, clone_lib:Kohara lambda minise]
[DB:genpept-bct1] [DE:E.coli genomic DNA, Kohara clone #253(28.4-28.7 min.).]
[NT:ORF_ID:o253#14; similar to [SwissProt Accession] [LE:13668] [RE:16265]
[DI:direct] >gp:[GI:d1015542:g1742085] [LN:D90765] [AC:D90765:AB001340] [PN:DNA
topoisomerase I (EC 5.99.1.2) (w-protein)] [GN:topA, supX] [OR:Escherichia coli]
[SR:Escherichia coli (strain:K12) DNA, clone_lib:Kohara lambda minise]
[DB:genpept-bct1] [DE:E.coli genomic DNA, Kohara clone #254(28.4-28.9 min.).]
[NT:ORF_ID:o253#14; similar to [SwissProt Accession] [LE:11174] [RE:13771]
[DI:direct] >gp:[GI:g415338] [LN:ECTOPA] [AC:X04475:X12873] [OR:Escherichia coli]
[DB:genpept-bct1] [DE:E. coli topA gene for DNA topoisomerase I.] [NT:put. DNA
topoisomerase I (AA 1-864)] [SP:P06612] [LE:1318] [RE:3915] [DI:direct]
>gp:[GI:g1787529] [LN:AE000225] [AC:AE000225:U00096] [PN:DNA topoisomerase type
I, omega protein] [GN:topA] [FN:enzyme; DNA - replication, repair,]
[OR:Escherichia coli] [DB:genpept-bct2] [EC:5.99.1.2] [DE:Escherichia coli K-12
MG1655 section 115 of 400 of the completegenome.] [NT:o865; 100 pct identical to
TOP1_ECOLI SW: P06612;] [LE:4332] [RE:6929] [DI:direct]

| ORF Name | NT ID | AA ID | NT/LN | AA/LN | Score | P-value |
|---|---|---|---|---|---|---|
| 24713331_f2_396 | 557 | 7728 | 363 | 120 | 120 | 1.8e-06 |

Description gp:[GI:g3044086] [LN:AF055904] [AC:AF055904] [PN:unknown] [OR:Myxococcus xanthus]
[DB:genpept-bct2] [DE:Myxococcus xanthus acetylornithine deacetylase (argE)
gene,complete cds; and unknown gene.] [NT:ORF2; no developmental phenotype]
[LE:10] [RE:1638] [DI:complement]

| ORF Name | NT ID | AA ID | NT/LN | AA/LN | Score | P-value |
|---|---|---|---|---|---|---|
| 24734412_c2_1907 | 558 | 7729 | 222 | 73 | | |

Description

NO-HIT

| ORF Name | NT ID | AA ID | NT/LN | AA/LN | Score | P-value |
|---|---|---|---|---|---|---|
| 24735030_f3_956 | 559 | 7730 | 984 | 327 | 1305 | 4.3e-133 |

Description sp:[LN:EX3_ECOLI] [AC:P09030] [GN:XTHA:XTH] [OR:Escherichia coli] [EC:3.1.11.2]
[DE:ENDONUCLEASE VI)] [SP:P09030] [DB:swissprot] >sp:[LN:NCECX3]
[AC:E64934:A31839:S03102] [PN:exodeoxyribonuclease III,:E. coli exonuclease III]
[GN:xthA:xth] [CL:exodeoxyribonuclease III] [OR:Escherichia coli] [EC:3.1.11.2]
[DB:pir1] [MP:38 min] >gp:[GI:d1016263:g1742858] [LN:D90818] [AC:D90818:AB001340]
[PN:Exodeoxyribonuclease III (EC 3.1.11.2)] [GN:xthA, xth] [OR:Escherichia coli]
[SR:Escherichia coli (strain:K12) DNA, clone_lib:Kohara lambda minise]
[DB:genpept-bct1] [DE:E.coli genomic DNA, Kohara clone #327(39.2-39.5 min.).]
[NT:ORF_ID:o327#6; similar to [PIR Accession Number] [LE:12156] [RE:12962]
[DI:direct] >gp:[GI:d1016267:g1742863] [LN:D90819] [AC:D90819:AB001340]
[PN:Exodeoxyribonuclease III (EC 3.1.11.2)] [GN:xthA, xth] [OR:Escherichia coli]
[SR:Escherichia coli (strain:K12) DNA, clone_lib:Kohara lambda minise]
[DB:genpept-bct1] [DE:E.coli genomic DNA, Kohara clone #328(39.4-39.8 min.).]
[NT:ORF_ID:o327#6; similar to [PIR Accession Number] [LE:3943] [RE:4749]
[DI:direct] >gp:[GI:g43312] [LN:ECXTHA] [AC:X13002] [PN:exonuclease III]
[OR:Escherichia coli] [DB:genpept-bct1] [DE:E. coli xthA gene for exonuclease
III.] [SP:P09030] [LE:189] [RE:995] [DI:direct] >gp:[GI:g1788046] [LN:AE000270]
[AC:AE000270:U00096] [PN:exonuclease III] [GN:xthA] [FN:enzyme; Degradation of
DNA] [OR:Escherichia coli] [DB:genpept-bct2] [EC:3.1.11.2] [DE:Escherichia coli
K-12 MG1655 section 160 of 400 of the completegenome.] [NT:o268; 99 pct identical
to EX3_ECOLI SW: P09030; CG] [LE:253] [RE:1059] [DI:direct]

| ORF_Name | NT_ID | AA_ID | NT LN | AA LN | Score | P-value |
|---|---|---|---|---|---|---|
| 24739455_c3_2021 | 560 | 7731 | 660 | 219 | 807 | 2.5e-80 |

Description sp:[LN:YEAS_ECOLI] [AC:P76249:007971:007969] [GN:YEAS] [OR:Escherichia coli]
[DE:HYPOTHETICAL 23.2 KD PROTEIN IN GAPA-RND INTERGENIC REGION]
[SP:P76249:007971:007969] [DB:swissprot] >sp:[LN:F64940] [AC:F64940]
[PN:hypothetical protein b1798] [CL:hypothetical protein b1798] [OR:Escherichia
coli] [DB:pir2] >gp:[GI:d1016317:g1736421] [LN:D90823] [AC:D90823:AB001340]
[OR:Escherichia coli] [SR:Escherichia coli (strain:K12) DNA, clone_lib:Kohara
lambda minise] [DB:genpept-bct1] [DE:E.coli genomic DNA, Kohara clone
332(40.4-40.7 min.).] [NT:ORF_ID:o332#6; similar to [SwissProt Accession]
[LE:6317] [RE:6955] [DI:complement] >gp:[GI:d1016326:g1736431] [LN:D90824]
[AC:D90824:AB001340] [OR:Escherichia coli] [SR:Escherichia coli (strain:K12) DNA,
clone_lib:Kohara lambda minise] [DB:genpept-bct1] [DE:E.coli genomic DNA, Kohara
clone #333(40.5-40.8 min.).] [NT:ORF_ID:o332#6; similar to [SwissProt Accession]
[LE:1787] [RE:2425] [DI:complement] >gp:[GI:g1788099] [LN:AE000274]
[AC:AE000274:U00096] [PN:orf, hypothetical protein] [GN:yeaS] [FN:orf; Unknown]
[OR:Escherichia coli] [DB:genpept-bct2] [DE:Escherichia coli K-12 MG1655 section
164 of 400 of the completegenome.] [NT:f212; This 212 aa ORF is 50 pct identical
(4 gaps)] [LE:5860] [RE:6498] [DI:complement]

| ORF_Name | NT_ID | AA_ID | NT LN | AA LN | Score | P-value |
|---|---|---|---|---|---|---|
| 24806577_c3_2100 | 561 | 7732 | 486 | 161 | 636 | 3.3e-62 |

Description sp:[LN:SPY_ECOLI] [AC:P77754] [GN:SPY] [OR:Escherichia coli] [DE:SPHEROPLAST
PROTEIN Y PRECURSOR] [SP:P77754] [DB:swissprot] >sp:[LN:G64933] [AC:G64933]
[PN:hypothetical protein b1743] [OR:Escherichia coli] [DB:pir2]
>gp:[GI:d1016254:g1742848] [LN:D90817] [AC:D90817:AB001340] [GN:yiiO]
[OR:Escherichia coli] [SR:Escherichia coli (strain:K12) DNA, clone_lib:Kohara
lambda minise] [DB:genpept-bct1] [DE:E.coli genomic DNA, Kohara clone
326(39.1-39.4 min.).] [NT:ORF_ID:o326#12; similar to [SwissProt Accession]
[LE:10500] [RE:10985] [DI:complement] >gp:[GI:d1016260:g1742855] [LN:D90818]
[AC:D90818:AB001340] [GN:yiiO] [OR:Escherichia coli] [SR:Escherichia coli
(strain:K12) DNA, clone_lib:Kohara lambda minise] [DB:genpept-bct1] [DE:E.coli
genomic DNA, Kohara clone #327(39.2-39.5 min.).] [NT:ORF_ID:o326#12; similar to
[SwissProt Accession] [LE:4868] [RE:5353] [DI:complement]
>gp:[GI:e264781:g1655583] [LN:ECSPYGENE] [AC:Y07714] [PN:spheroplast protein y]
[GN:spy] [OR:Escherichia coli] [DB:genpept-bct1] [DE:E.coli spy gene.]
[SP:P77754] [LE:1032] [RE:1517] [DI:direct] >gp:[GI:g1788039] [LN:AE000269]
[AC:AE000269:U00096] [PN:periplasmic protein related to spheroblast] [GN:spy]
[FN:phenotype; Not classified] [OR:Escherichia coli] [DB:genpept-bct2]
[DE:Escherichia coli K-12 MG1655 section 159 of 400 of the completegenome.]
[NT:f161; This 161 aa ORF is 29 pct identical (6 gaps)] [LE:3914] [RE:4399]
[DI:complement]

| ORF Name | NT ID | AA ID | NT/LN | AA/LN | Score | P-value |
|---|---|---|---|---|---|---|
| 24822306_c3_2160 | 562 | 7733 | 219 | 72 | | |

Description

NO-HIT

| ORF Name | NT ID | AA ID | NT/LN | AA/LN | Score | P-value |
|---|---|---|---|---|---|---|
| 24849181_c3_1992 | 563 | 7734 | 2439 | 812 | 187 | 1.3e-10 |

Description gp:[GI:g603857] [LN:LMSAP2GN] [AC:Z46970] [PN:secreted acid phosphatase 2 (SAP2)] [GN:lmsap2] [OR:Leishmania mexicana] [DB:genpept-invl] [DE:L.mexicana lmsap2 gene for secreted acid phosphatase 2 (SAP2).] [LE:74] [RE:2740] [DI:direct]

| ORF Name | NT ID | AA ID | NT/LN | AA/LN | Score | P-value |
|---|---|---|---|---|---|---|
| 24853590_c2_1661 | 564 | 7735 | 183 | 60 | 216 | 6.3e-17 |

Description gp:[GI:e293295:g2208964] [LN:PACIOAB] [AC:Y10528] [PN:cyanide insensitive terminal oxidase] [GN:cioA] [OR:Pseudomonas aeruginosa] [DB:genpept-bct1] [DE:P.aeruginosa cioA and cioB genes.] [LE:276] [RE:1742] [DI:direct]

| ORF Name | NT ID | AA ID | NT/LN | AA/LN | Score | P-value |
|---|---|---|---|---|---|---|
| 24881537_f1_82 | 565 | 7736 | 906 | 301 | 1414 | 1.2e-144 |

Description sp:[LN:SAPC_SALTY] [AC:P36669] [GN:SAPC] [OR:Salmonella typhimurium] [DE:PEPTIDE TRANSPORT SYSTEM PERMEASE PROTEIN SAPC] [SP:P36669] [DB:swissprot]
>sp:[LN:S39587] [AC:S39587] [PN:peptide transport system permease sapC] [GN:sapC] [CL:oligopeptide permease protein oppB] [OR:Salmonella typhimurium] [DB:pir2]
>gp:[GI:g414210] [LN:STSAP] [AC:X74212] [GN:sapC] [OR:Salmonella typhimurium] [DB:genpept-bct1] [DE:S.typhimurium DNA sequence of antimicrobial peptides-resistancelocus.] [SP:P36669] [LE:2714] [RE:3604] [DI:direct]

| ORF Name | NT ID | AA ID | NT/LN | AA/LN | Score | P-value |
|---|---|---|---|---|---|---|
| 25400425_c1_1331 | 566 | 7737 | 1275 | 424 | | |

Description

NO-HIT

| ORF Name | NT ID | AA ID | NT/LN | AA/LN | Score | P-value |
|---|---|---|---|---|---|---|
| 25401012_f3_924 | 567 | 7738 | 288 | 95 | | |

Description

NO-HIT

267

| ORF_Name | NT ID | AA ID | NT/LN | AA/LN | Score | P-value |
|---|---|---|---|---|---|---|
| 25480052_c1_1499 | 568 | 7739 | 1188 | 395 | 1100 | 2.3e-111 |

Description sp:[LN:ABRB_ECOLI] [AC:P75747] [GN:ABRB] [OR:Escherichia coli] [DE:ABRB PROTEIN] [SP:P75747] [DB:swissprot] >sp:[LN:B64807] [AC:B64807] [PN:abrB protein] [GN:abrB] [OR:Escherichia coli] [DB:pir2] >gp:[GI:d1036365:g4062311] [LN:D90710] [AC:D90710:AB001340] [OR:Escherichia coli] [SR:Escherichia coli(strain:K12) DNA, clone:Kohara clone #175] [DB:genpept-bct1] [DE:Escherichia coli genomic DNA. (15.9 - 16.3 min).] [NT:ORF_ID:o175#10] [LE:9447] [RE:10538] [DI:complement] >gp:[GI:g1786933] [LN:AE000174] [AC:AE000174:U00096] [PN:putative transport protein] [GN:abrB] [FN:putative transport; Not classified] [OR:Escherichia coli] [DB:genpept-bct2] [DE:Escherichia coli K-12 MG1655 section 64 of 400 of the completegenome.] [NT:f363; This 363 aa ORF is 20 pct identical (11 gaps)] [LE:12592] [RE:13683] [DI:complement]

| ORF_Name | NT ID | AA ID | NT/LN | AA/LN | Score | P-value |
|---|---|---|---|---|---|---|
| 25507790_f2_716 | 569 | 7740 | 309 | 102 | 337 | 1.6e-30 |

Description sp:[LN:B64859] [AC:B64859] [PN:probable excisionase] [OR:Escherichia coli] [DB:pir2] >gp:[GI:d1036956:g4062719] [LN:D90749] [AC:D90749:AB001340] [PN:Excisionase.] [GN:xis] [OR:Escherichia coli] [SR:Escherichia coli(strain:K12) DNA, clone:Kohara clone #240] [DB:genpept-bct1] [DE:Escherichia coli genomic DNA. (25.7 - 26.1 min).] [NT:ORF_ID:o240#10; similar to SwissProt Accession] [LE:11338] [RE:11583] [DI:complement] >gp:[GI:g1787387] [LN:AE000214] [AC:AE000214:U00096] [PN:orf, hypothetical protein] [GN:b1141] [FN:orf; Unknown] [OR:Escherichia coli] [DB:genpept-bct2] [DE:Escherichia coli K-12 MG1655 section 104 of 400 of the completegenome.] [NT:f81; phage stats; This 81 aa ORF is 36 pct] [LE:4197] [RE:4442] [DI:complement]

| ORF_Name | NT ID | AA ID | NT/LN | AA/LN | Score | P-value |
|---|---|---|---|---|---|---|
| 25522687_c1_1245 | 570 | 7741 | 477 | 158 | 104 | 7.9e-06 |

Description sp:[LN:T13521] [AC:T13521] [PN:hypothetical protein 32] [OR:Bacillus phage phi-105] [DB:pir2] >gp:[GI:d1037625:g4126618] [LN:AB016282] [AC:AB016282] [OR:bacteriophage phi-105] [SR:bacteriophage phi-105 DNA] [DB:genpept-phg] [DE:Bacteriophage phi-105 DNA, complete sequence.] [NT:ORF32] [LE:7157] [RE:7540] [DI:direct]

| ORF_Name | NT ID | AA ID | NT/LN | AA/LN | Score | P-value |
|---|---|---|---|---|---|---|
| 25524180_c2_1640 | 571 | 7742 | 723 | 240 | 1158 | 1.6e-117 |

Description sp:[LN:T13105] [AC:T13105] [PN:minor tail protein gp19] [OR:phage N15] [DB:pir2] >gp:[GI:g3192702] [LN:AF064539] [AC:AF064539] [PN:gp19] [GN:gene 19] [OR:Bacteriophage N15] [DB:genpept-phg] [DE:Bacteriophage N15, complete genome.] [NT:minor tail protein] [LE:13981] [RE:14712] [DI:direct]

| ORF_Name | NT_ID | AA_ID | NT/LN | AA/LN | Score | P-value |
|---|---|---|---|---|---|---|
| 25558212_f2_381 | 572 | 7743 | 213 | 70 | | |

Description

NO-HIT

| ORF_Name | NT_ID | AA_ID | NT/LN | AA/LN | Score | P-value |
|---|---|---|---|---|---|---|
| 25675250_f1_258 | 573 | 7744 | 1272 | 423 | 1699 | 7.6e-175 |

Description sp:[LN:YBDR_ECOLI] [AC:P77316] [GN:YBDR] [OR:Escherichia coli] [DE:INTERGENIC REGION] [SP:P77316] [DB:swissprot] >sp:[LN:F64794] [AC:F64794] [PN:probable alcohol dehydrogenase, ybdR] [GN:ybdR] [CL:alcohol dehydrogenase:long-chain alcohol dehydrogenase homology] [OR:Escherichia coli] [EC:1.1.1.1] [DB:pir1] >gp:[GI:d1036224;g4062224] [LN:D90701] [AC:D90701:AB001340] [PN:Glutathione-dependent formaldehyde dehydrogenase] [GN:fadH] [OR:Escherichia coli] [SR:Escherichia coli(strain:K12) DNA, clone:Kohara clone #166] [DB:genpept-bct1] [DE:Escherichia coli genomic DNA. (13.6 - 14.0 min).] [NT:ORF_ID:o167#4; similar to SwissProt Accession] [LE:11845] [RE:13083] [DI:direct] >gp:[GI:d1036233;g4062230] [LN:D90702] [AC:D90702:AB001340] [PN:Glutathione-dependent formaldehyde dehydrogenase] [GN:fadH] [OR:Escherichia coli] [SR:Escherichia coli(strain:K12) DNA, clone:Kohara clone #167] [DB:genpept-bct1] [DE:Escherichia coli genomic DNA. (13.7 - 14.1 min).] [NT:ORF_ID:o167#4; similar to SwissProt Accession] [LE:4029] [RE:5267] [DI:direct] >gp:[GI:g1778526] [LN:ECU82598] [AC:U82598] [PN:FadH homolog] [OR:Escherichia coli] [DB:genpept-bct1] [DE:Escherichia coli genomic sequence of minutes 9 to 12.] [NT:similar to E. coli FadH] [LE:82718] [RE:83956] [DI:direct] >gp:[GI:g1786825] [LN:AE000166] [AC:AE000166:U00096] [PN:putative oxidoreductase] [GN:ybdR] [FN:putative enzyme; Not classified] [OR:Escherichia coli] [DB:genpept-bct2] [DE:Escherichia coli K-12 MG1655 section 56 of 400 of the completegenome.] [NT:o412; This 412 aa ORF is 47 pct identical (8 gaps)] [LE:5476] [RE:6714] [DI:direct]

| ORF_Name | NT_ID | AA_ID | NT/LN | AA/LN | Score | P-value |
|---|---|---|---|---|---|---|
| 25676577_f3_1115 | 574 | 7745 | 1167 | 388 | 1843 | 4.2e-190 |

Description sp:[LN:TRMU_ECOLI] [AC:P25745:P75964] [GN:TRMU:ASUE] [OR:Escherichia coli] [EC:2.1.1.61] [DE:(EC 2.1.1.61)] [SP:P25745:P75964] [DB:swissprot] >sp:[LN:B64858] [AC:B64858:S19210] [PN:probable ATPase ycfB] [GN:ycfB] [CL:probable membrane protein YDL033c] [OR:Escherichia coli] [DB:pir2] >gp:[GI:g1787378] [LN:AE000213] [AC:AE000213:U00096] [PN:orf, hypothetical protein] [GN:ycfB] [FN:orf; Unknown] [OR:Escherichia coli] [DB:genpept-bct2] [DE:Escherichia coli K-12 MG1655 section 103 of 400 of the completegenome.] [NT:f383; 100 pct identical to fragment YCFB_ECOLI] [LE:6978] [RE:8129] [DI:complement]

| ORF Name | NT ID | AA ID | NT LN | AA LN | Score | P-value |
|---|---|---|---|---|---|---|
| 25680317_c1_1367 | 575 | 7746 | 1104 | 367 | 1453 | 8.9e-149 |

Description sp:[LN:ASTA_ECOLI] [AC:P76218] [GN:ASTA] [OR:Escherichia coli] [EC:2.3.1.109]
[DE:ARGININE N-SUCCINYLTRANSFERASE, (AOST)] [SP:P76218] [DB:swissprot]
>sp:[LN:C64934] [AC:C64934] [PN:hypothetical protein b1747] [OR:Escherichia coli]
[DB:pir2] >gp:[GI:g1788043] [LN:AE000269] [AC:AE000269;U00096] [PN:orf,
hypothetical protein] [GN:b1747] [FN:orf; Unknown] [OR:Escherichia coli]
[DB:genpept-bct2] [DE:Escherichia coli K-12 MG1655 section 159 of 400 of the
completegenome.] [NT:f344; 26 pct identical (5 gaps) to 90 residues] [LE:8505]
[RE:9539] [DI:complement]

| ORF Name | NT ID | AA ID | NT LN | AA LN | Score | P-value |
|---|---|---|---|---|---|---|
| 257188_c3_2080 | 576 | 7747 | 495 | 164 | 139 | 1.6e-09 |

Description sp:[LN:G72510] [AC:G72510] [PN:hypothetical protein APE2061] [GN:APE2061]
[OR:Aeropyrum pernix] [DB:pir2] >gp:[GI:d1044857;g5105759] [LN:AP000063]
[AC:AP000063] [PN:114aa long hypothetical protein] [GN:APE2061] [OR:Aeropyrum
pernix] [SR:Aeropyrum pernix (strain:K1) DNA] [DB:genpept-bct1] [DE:Aeropyrum
pernix genomic DNA, section 6/7.] [NT:similar to OWL:AP00000656 percent
identity:52.747] [LE:58153] [RE:58497] [DI:direct]

| ORF Name | NT ID | AA ID | NT LN | AA LN | Score | P-value |
|---|---|---|---|---|---|---|
| 25820377_c2_1791 | 577 | 7748 | 1209 | 402 | | |

Description

NO-HIT

| ORF Name | NT ID | AA ID | NT LN | AA LN | Score | P-value |
|---|---|---|---|---|---|---|
| 25893767_c3_1961 | 578 | 7749 | 231 | 76 | 335 | 2.6e-30 |

Description gp:[GI:g2618942] [LN:AF017620] [AC:AF017620] [PN:isocitrate dehydrogenase]
[GN:icd] [OR:Citrobacter koseri] [DB:genpept-bct2] [DE:Citrobacter diversus CIT42
isocitrate dehydrogenase (icd) gene,partial cds.] [LE:<1] [RE:>1164] [DI:direct]

| ORF Name | NT ID | AA ID | NT/LN | AA/LN | Score | P-value |
|---|---|---|---|---|---|---|
| 25908405_c1_1202 | 579 | 7750 | 246 | 81 | 145 | 3.6e-10 |

Description sp:[LN:A71007] [AC:A71007] [PN:hypothetical protein PH1351] [GN:PH1351]
[OR:Pyrococcus horikoshii] [DB:pir2] >gp:[GI:d1031400:g3257774] [LN:AP000006]
[AC:AP000006:AB005215:AB009510:AB009511:AB009512:AB009513:AB009514] [PN:101aa
long hypothetical protein] [GN:PH1351] [OR:Pyrococcus horikoshii] [SR:Pyrococcus
horikoshii (strain:OT3) DNA, clone:Pyrococcus horikoshi] [DB:genpept-bct1]
[DE:Pyrococcus horikoshii OT3 genomic DNA, 1166001-1485000 nt. position(6/7).]
[LE:50986] [RE:51291] [DI:direct]

| ORF Name | NT ID | AA ID | NT/LN | AA/LN | Score | P-value |
|---|---|---|---|---|---|---|
| 25978375_c1_1547 | 580 | 7751 | 237 | 78 | 72 | 0.019 |

Description sp:[LN:RCRO_BPP22] [AC:P09964:Q38659] [GN:CRO] [OR:Bacteriophage P22]
[DE:REGULATORY PROTEIN CRO] [SP:P09964:Q38659] [DB:swissprot] >sp:[LN:RGBP22]
[AC:A25867] [PN:regulatory protein cro] [GN:cro] [CL:phage P22 regulatory protein
cro] [OR:phage P22] [DB:pir1] >gp:[GI:e264368:g1143410] [LN:BPES18GEN]
[AC:X87420] [GN:cro] [OR:Salmonella typhimurium] [DB:genpept-bct1]
[DE:Bacteriophage ES18 genes 24, c2, cro, c1, 18, and oL and oRoperators.]
[LE:1634] [RE:1819] [DI:direct] >gp:[GI:g215272] [LN:P22CROA] [AC:M12584]
[OR:Bacteriophage P22] [SR:Bacteriophage P22 DNA from E.coli] [DB:genpept-phg]
[DE:Bacteriophage P22 cro and c1 genes, complete cds.] [NT:cro peptide] [LE:87]
[RE:272] [DI:direct]

| ORF Name | NT ID | AA ID | NT/LN | AA/LN | Score | P-value |
|---|---|---|---|---|---|---|
| 26025687_c3_1990 | 581 | 7752 | 903 | 300 | | |

Description

NO-HIT

| ORF Name | NT ID | AA ID | NT/LN | AA/LN | Score | P-value |
|---|---|---|---|---|---|---|
| 26064063_f2_412 | 582 | 7753 | 408 | 135 | 162 | 5.7e-12 |

Description gp:[GI:e1341376:g3861425] [LN:SC1E6] [AC:AL033505] [PN:hypothetical protein
SC1E6.02c] [GN:SC1E6.02c] [OR:Streptomyces coelicolor] [DB:genpept-bct1]
[DE:Streptomyces coelicolor cosmid 1E6.] [NT:SC1E6.02c, unknown, len: 115 aa]
[LE:1884] [RE:2231] [DI:complement]

| ORF Name | NT ID | AA ID | NT/LN | AA/LN | Score | P-value |
|---|---|---|---|---|---|---|
| 2611083_f1_263 | 583 | 7754 | 267 | 88 | | |

Description

NO-HIT

| ORF Name | NT ID | AA ID | NT LN | AA LN | Score | P-value |
|---|---|---|---|---|---|---|
| 2619032_c1_1252 | 584 | 7755 | 759 | 252 | 986 | 2.7e-99 |

Description sp:[LN:T13104] [AC:T13104] [PN:minor tail protein L homolog:protein gp18]
[CL:phage lambda minor tail protein L] [OR:phage N15] [DB:pir2] >gp:[GI:g3192701]
[LN:AF064539] [AC:AF064539] [PN:gp18] [GN:gene 18] [OR:Bacteriophage N15]
[DB:genpept-phg] [DE:Bacteriophage N15, complete genome.] [NT:minor tail protein]
[LE:13224] [RE:13979] [DI:direct]

| ORF Name | NT ID | AA ID | NT LN | AA LN | Score | P-value |
|---|---|---|---|---|---|---|
| 26301891_c1_1418 | 585 | 7756 | 459 | 152 | 132 | 2.2e-08 |

Description sp:[LN:D34768] [AC:D34768] [PN:ORF4 protein] [OR:Orf virus] [DB:pir2]
>gp:[GI:g332566] [LN:ORFPRTPS] [AC:M30023:J04371:M37623] [OR:orf virus] [SR:Orf
virus (strain NZ2) DNA] [DB:genpept-vrl] [DE:Orf virus homologue of retroviral
pseudoprotease gene, completecds.] [NT:ORF4] [LE:1248] [RE:2042] [DI:complement]

| ORF Name | NT ID | AA ID | NT LN | AA LN | Score | P-value |
|---|---|---|---|---|---|---|
| 26306512_c1_1274 | 586 | 7757 | 189 | 62 | 281 | 1.4e-24 |

Description sp:[LN:F64873] [AC:F64873:S07794] [PN:yciG protein] [GN:yciG] [OR:Escherichia
coli] [DB:pir2] [MP:28 min] >gp:[GI:g1787513] [LN:AE000224] [AC:AE000224:U00096]
[PN:orf, hypothetical protein] [GN:yciG] [FN:orf; Unknown] [OR:Escherichia coli]
[DB:genpept-bct2] [DE:Escherichia coli K-12 MG1655 section 114 of 400 of the
completegenome.] [NT:f78; 100 pct identical to YCIG_ECOLI SW: P21361 but]
[LE:2045] [RE:2281] [DI:complement]

| ORF Name | NT ID | AA ID | NT LN | AA LN | Score | P-value |
|---|---|---|---|---|---|---|
| 26346036_c3_2154 | 587 | 7758 | 219 | 72 | | |

Description

NO-HIT

| ORF Name | NT ID | AA ID | NT LN | AA LN | Score | P-value |
|---|---|---|---|---|---|---|
| 26353385_c1_1409 | 588 | 7759 | 462 | 153 | 133 | 6.7e-09 |

Description gp:[GI:g5763938] [LN:SCF34] [AC:AL109974] [PN:putative MarR-family
transcriptional regulator] [GN:SCF34.06] [OR:Streptomyces coelicolor A3(2)]
[DB:genpept-bct1] [DE:Streptomyces coelicolor cosmid F34.] [NT:SCF34.06, possible
MarR-family transcriptional] [LE:4039] [RE:4545] [DI:direct]

| ORF Name | NT ID | AA ID | NT/LN | AA/LN | Score | P-value |
|---|---|---|---|---|---|---|
| 26353417_c1_1254 | 589 | 7760 | 597 | 198 | 747 | 5.8e-74 |

Description sp:[LN:T13106] [AC:T13106] [PN:minor tail protein gp20] [OR:phage N15] [DB:pir2]
>gp:[GI:g3192703] [LN:AF064539] [AC:AF064539] [PN:gp20] [GN:gene 20]
[OR:Bacteriophage N15] [DB:genpept-phg] [DE:Bacteriophage N15, complete genome.]
[NT:minor tail protein] [LE:14712] [RE:15290] [DI:direct]

| ORF Name | NT ID | AA ID | NT/LN | AA/LN | Score | P-value |
|---|---|---|---|---|---|---|
| 26375452_c2_1669 | 590 | 7761 | 687 | 228 | 157 | 3.6e-10 |

Description sp:[LN:YHJH_ECOLI] [AC:P37646] [GN:YHJH] [OR:Escherichia coli] [DE:HYPOTHETICAL
29.6 KD PROTEIN IN TREF-KDGK INTERGENIC REGION] [SP:P37646] [DB:swissprot]

| ORF Name | NT ID | AA ID | NT/LN | AA/LN | Score | P-value |
|---|---|---|---|---|---|---|
| 26426886_c1_1412 | 591 | 7762 | 1281 | 426 | 1235 | 1.1e-125 |

Description sp:[LN:TUD4_AGRVI] [AC:Q44472] [GN:TTUD] [OR:Agrobacterium vitis] [EC:1.1.1.81]
[DE:PUTATIVE HYDROXYPYRUVATE REDUCTASE,] [SP:Q44472] [DB:swissprot]
>gp:[GI:g805293] [LN:AVU25634] [AC:U25634] [GN:ttuD] [OR:Agrobacterium vitis]
[SR:Plasmid pTrAB4] [DB:genpept-bct1] [DE:Agrobacterium vitis plasmid pTrAB4
putative LysR-type protein(ttuA), putative tartrate transport protein (ttuB),
putativetartrate dehydrogenase (ttuC), putative hydroxypyruvate reductase(ttuD)
and putative pyruvate kinase (ttuE) genes, complete cds.] [NT:putative
hydroxypyruvate reductase; inducible by] [LE:3809] [RE:5125] [DI:direct]

| ORF Name | NT ID | AA ID | NT LN | AA LN | Score | P-value |
|---|---|---|---|---|---|---|
| 26444092_c1_1170 | 592 | 7763 | 1041 | 346 | 1548 | 7.6e-159 |

Description sp:[LN:YCFO_ECOLI] [AC:P75949] [GN:YCFO] [OR:Escherichia coli] [DE:HYPOTHETICAL 37.6 KD PROTEIN IN FHUE-NDH INTERGENIC REGION] [SP:P75949] [DB:swissprot] >sp:[LN:H64854] [AC:H64854] [PN:probable glucosidase, ycfO] [GN:ycfO] [OR:Escherichia coli] [EC:3.2.1.-] [DB:pir2] >gp:[GI:d1036900:g4062671] [LN:D90745] [AC:D90745:AB001340] [PN:Hypothetical protein HI0959] [OR:Escherichia coli] [SR:Escherichia coli(strain:K12) DNA, clone:Kohara clone #236] [DB:genpept-bct1] [DE:Escherichia coli genomic DNA. (24.8 - 25.2 min).] [NT:ORF_ID:o237#6; similar to PIR Accession Number] [LE:14737] [RE:15762] [DI:direct] >gp:[GI:d1036908:g4062677] [LN:D90746] [AC:D90746:AB001340] [PN:Hypothetical protein HI0959] [OR:Escherichia coli] [SR:Escherichia coli(strain:K12) DNA, clone:Kohara clone #237] [DB:genpept-bct1] [DE:Escherichia coli genomic DNA. (25.0 - 25.4 min).] [NT:ORF_ID:o237#6; similar to PIR Accession Number] [LE:6036] [RE:7061] [DI:direct] >gp:[GI:g1787350] [LN:AE000211] [AC:AE000211:U00096] [PN:orf, hypothetical protein] [GN:ycfO] [FN:orf; Unknown] [OR:Escherichia coli] [DB:genpept-bct2] [DE:Escherichia coli K-12 MG1655 section 101 of 400 of the completegenome.] [NT:o341; This 341 aa ORF is 52 pct identical (8 gaps)] [LE:2407] [RE:3432] [DI:direct]

| ORF Name | NT ID | AA ID | NT LN | AA LN | Score | P-value |
|---|---|---|---|---|---|---|
| 26579711_f1_101 | 593 | 7764 | 621 | 206 | 958 | 2.5e-96 |

Description sp:[LN:GCH2_ECOLI] [AC:P25523:P78147] [GN:RIBA] [OR:Escherichia coli] [EC:3.5.4.25] [DE:GTP CYCLOHYDROLASE II,] [SP:P25523:P78147] [DB:swissprot] >sp:[LN:A40654] [AC:A40654:S22376:H64875:S25160] [PN:GTP cyclohydrolase II,] [GN:ribA] [CL:Escherichia coli cyclohydrolase II:cyclohydrolase homology] [OR:Escherichia coli] [EC:3.5.4.25] [DB:pir1] >gp:[GI:d1015547:g1742091] [LN:D90766] [AC:D90766:AB001340] [PN:GTP cyclohydrolase II (EC 3.5.4.25)] [GN:ribA] [OR:Escherichia coli] [SR:Escherichia coli (strain:K12) DNA, clone_lib:Kohara lambda minise] [DB:genpept-bct1] [DE:E.coli genomic DNA, Kohara clone #255(28.8-29.2 min).] [NT:ORF_ID:o255#2; similar to [PIR Accession Number] [LE:835] [RE:1425] [DI:complement] >gp:[GI:g42738] [LN:ECRIBA] [AC:X67876] [PN:GTP cyclohydrolase II] [GN:ribA] [OR:Escherichia coli] [DB:genpept-bct1] [DE:E.coli ribA gene for GTP cyclohydrolase II.] [SP:P25523] [LE:768] [RE:1358] [DI:direct] >gp:[GI:g1787533] [LN:AE000226] [AC:AE000226:U00096] [PN:GTP cyclohydrolase II] [GN:ribA] [FN:enzyme; Biosynthesis of cofactors, carriers;] [OR:Escherichia coli] [DB:genpept-bct2] [EC:3.5.4.25] [DE:Escherichia coli K-12 MG1655 section 116 of 400 of the completegenome.] [NT:f196; 100 pct identical GCH2_ECOLI SW: P25523; CG] [LE:62] [RE:652] [DI:complement]

| ORF Name | NT ID | AA ID | NT LN | AA LN | Score | P-value |
|---|---|---|---|---|---|---|
| 26584643_f1_233 | 594 | 7765 | 543 | 180 | 321 | 8.0e-29 |

Description sp:[LN:F69744] [AC:F69744] [PN:hypothetical protein ybbK] [GN:ybbK] [OR:Bacillus subtilis] [DB:pir2] >gp:[GI:d1020265:g1256140] [LN:AB002150] [AC:AB002150:D84214] [PN:YbbK] [OR:Bacillus subtilis] [SR:Bacillus subtilis (strain:168) DNA] [DB:genpept-bct1] [DE:Bacillus subtilis DNA for FeuB, FeuA, YbbB, YbbC, YbbD, YbzA, YbbE,YbbF, YbbH, YbbI, YbbJ, YbbK, YbbL, YbbM, YbbP, complete cds.] [LE:12225] [RE:12680] [DI:complement] >gp:[GI:e1182105:g2632439] [LN:BSUB0001] [AC:Z99104:AL009126] [GN:ybbK] [FN:unknown] [OR:Bacillus subtilis] [DB:genpept-bct1] [DE:Bacillus subtilis complete genome (section 1 of 21): from 1 to213080.] [LE:193567] [RE:194022] [DI:complement]

| ORF Name | NT ID | AA ID | NT LN | AA LN | Score | P-value |
|---|---|---|---|---|---|---|
| 26695416_c1_1490 | 595 | 7766 | 438 | 145 | 444 | 7.4e-42 |

Description sp:[LN:PSPC_ECOLI] [AC:P23855] [GN:PSPC] [OR:Escherichia coli] [DE:PHAGE SHOCK PROTEIN C] [SP:P23855] [DB:swissprot] >sp:[LN:S17123] [AC:S17123:I84050:E64879] [PN:phage shock protein C] [GN:pspC] [OR:Escherichia coli] [DB:pir2] >gp:[GI:d1015591:g1742136] [LN:D90768] [AC:D90768:AB001340] [PN:Phage shock protein C] [GN:pspC] [OR:Escherichia coli] [SR:Escherichia coli (strain:K12) DNA, clone_lib:Kohara lambda minise] [DB:genpept-bct1] [DE:E.coli genomic DNA, Kohara clone #257(29.1-29.6 min.).] [NT:ORF_ID:o257#15; similar to [PIR Accession Number] [LE:16395] [RE:16754] [DI:direct] >gp:[GI:d1015599:g1742145] [LN:D90769] [AC:D90769:AB001340] [PN:Phage shock protein C] [GN:pspC] [OR:Escherichia coli] [SR:Escherichia coli (strain:K12) DNA, clone_lib:Kohara lambda minise] [DB:genpept-bct1] [DE:E.coli genomic DNA, Kohara clone #258(29.5-29.8 min.).] [NT:ORF_ID:o257#15; similar to [PIR Accession Number] [LE:2399] [RE:2758] [DI:direct] >gp:[GI:g42541] [LN:ECPSP] [AC:X57560] [PN:pspC protein] [GN:pspC] [OR:Escherichia coli] [DB:genpept-bct1] [DE:E.coli stress-induced psp operon DNA.] [SP:P23855] [LE:1444] [RE:1803] [DI:direct] >gp:[GI:g1787564] [LN:AE000228] [AC:AE000228:U00096] [PN:phage shock protein: activates phage] [GN:pspC] [FN:factor; Phage-related functions and prophages] [OR:Escherichia coli] [DB:genpept-bct2] [DE:Escherichia coli K-12 MG1655 section 118 of 400 of the completegenome.] [NT:o119; 100 pct identical to PSPC_ECOLI SW: P23855;] [LE:9690] [RE:10049] [DI:direct]

| ORF Name | NT ID | AA ID | NT LN | AA LN | Score | P-value |
|---|---|---|---|---|---|---|
| 26695937_c1_1318 | 596 | 7767 | 927 | 308 | 269 | 2.6e-23 |

Description sp:[LN:MAUR_PARDE] [AC:P52685] [GN:MAUR] [OR:Paracoccus denitrificans] [DE:MAU OPERON TRANSCRIPTIONAL ACTIVATOR] [SP:P52685] [DB:swissprot] >sp:[LN:S51047] [AC:S51047] [PN:mauR protein] [GN:mauR] [OR:Paracoccus denitrificans] [DB:pir2] >gp:[GI:g558803] [LN:PDU12464] [AC:U12464] [PN:LysR-type transcriptional activator] [GN:mauR] [OR:Paracoccus denitrificans] [DB:genpept-bct1] [DE:Paracoccus denitrificans (ORF1) gene, partial cds, and LysR-typetranscriptional activator (mauR), (mauF), and methylaminedehydrogenase large subunit (mauB) genes, complete cds.] [LE:854] [RE:1705] [DI:complement]

| ORF Name | NT ID | AA ID | NT LN | AA LN | Score | P-value |
|---|---|---|---|---|---|---|
| 26758400_c1_1282 | 597 | 7768 | 651 | 216 | | |

Description

NO-HIT

| ORF Name | NT ID | AA ID | NT LN | AA LN | Score | P-value |
|---|---|---|---|---|---|---|
| 26776390_f3_1015 | 598 | 7769 | 516 | 171 | 631 | 1.1e-61 |

Description sp:[LN:YEAK_ECOLI] [AC:P76238] [GN:YEAK] [OR:Escherichia coli] [DE:HYPOTHETICAL
17.9 KD PROTEIN IN GAPA-RND INTERGENIC REGION] [SP:P76238] [DB:swissprot]
>sp:[LN:C64939] [AC:C64939] [PN:hypothetical protein b1787] [CL:Escherichia coli
hypothetical protein b1787] [OR:Escherichia coli] [DB:pir2] >gp:[GI:g1788087]
[LN:AE000273] [AC:AE000273:U00096] [PN:orf, hypothetical protein] [GN:yeaK]
[FN:orf; Unknown] [OR:Escherichia coli] [DB:genpept-bct2] [DE:Escherichia coli
K-12 MG1655 section 163 of 400 of the completegenome.] [NT:o167] [LE:11004]
[RE:11507] [DI:direct]

| ORF Name | NT ID | AA ID | NT LN | AA LN | Score | P-value |
|---|---|---|---|---|---|---|
| 26818917_f3_777 | 599 | 7770 | 243 | 80 | | |

Description

NO-HIT

| ORF Name | NT ID | AA ID | NT LN | AA LN | Score | P-value |
|---|---|---|---|---|---|---|
| 26850662_f1_340 | 600 | 7771 | 1065 | 354 | 1731 | 3.1e-178 |

Description sp:[LN:POTD_ECOLI] [AC:P23861] [GN:POTD] [OR:Escherichia coli]
[DE:SPERMIDINE/PUTRESCINE-BINDING PERIPLASMIC PROTEIN PRECURSOR (SPBP)]
[SP:P23861] [DB:swissprot] >sp:[LN:D40840] [AC:D40840:H64856]
[PN:spermidine/putrescine-binding protein precursor:spermidine/putrescine
transport protein D] [GN:potD] [OR:Escherichia coli] [DB:pir2]
>gp:[GI:d1036929:g1651550] [LN:D90747] [AC:D90747:AB001340]
[PN:Spermidine/putrescine transport protein D] [GN:potD] [OR:Escherichia coli]
[SR:Escherichia coli(strain:K12) DNA, clone:Kohara clone #238] [DB:genpept-bct1]
[DE:Escherichia coli genomic DNA. (25.2 - 25.6 min).] [NT:ORF_ID:o238#12; similar
to PIR Accession Number] [LE:13470] [RE:14516] [DI:complement] >gp:[GI:g1787367]
[LN:AE000212] [AC:AE000212:U00096] [PN:spermidine/putrescine periplasmic
transport] [GN:potD] [FN:transport; Transport of small molecules: Amino]
[OR:Escherichia coli] [DB:genpept-bct2] [DE:Escherichia coli K-12 MG1655 section
102 of 400 of the completegenome.] [NT:f348; 100 pct identical to POTD_ECOLI SW:
P23861] [LE:7785] [RE:8831] [DI:complement] >gp:[GI:g147329] [LN:ECOPOTABCD]
[AC:M64519] [PN:transport protein] [GN:potD] [OR:Escherichia coli] [SR:E.coli
(strain DR112) DNA, clone pPT104] [DB:genpept-bct2] [DE:E.coli transport protein
(potA, potB, potC and potD) genes,complete cds.] [LE:3144] [RE:4190] [DI:direct]

| ORF Name | NT ID | AA ID | NT/LN | AA/LN | Score | P-value |
|---|---|---|---|---|---|---|
| 270402_f2_526 | 601 | 7772 | 615 | 204 | 909 | 3.9e-91 |

Description sp:[LN:H64931] [AC:H64931] [PN:probable membrane protein b1728] [OR:Escherichia coli] [DB:pir2] >gp:[GI:g1788023] [LN:AE000268] [AC:AE000268:U00096] [PN:orf, hypothetical protein] [GN:b1728] [FN:orf; Unknown] [OR:Escherichia coli] [DB:genpept-bct2] [DE:Escherichia coli K-12 MG1655 section 158 of 400 of the completegenome.] [NT:o200; This 200 aa ORF is 32 pct identical (15 gaps)] [LE:106] [RE:708] [DI:direct]

| ORF Name | NT ID | AA ID | NT/LN | AA/LN | Score | P-value |
|---|---|---|---|---|---|---|
| 273577_c2_1874 | 602 | 7773 | 834 | 277 | | |

Description

NO-HIT

| ORF Name | NT ID | AA ID | NT/LN | AA/LN | Score | P-value |
|---|---|---|---|---|---|---|
| 285933_f1_182 | 603 | 7774 | 765 | 254 | 775 | 6.2e-77 |

Description sp:[LN:YDJZ_ECOLI] [AC:P76221] [GN:YDJZ] [OR:Escherichia coli] [DE:HYPOTHETICAL 26.2 KD PROTEIN IN XTHA-GDHA INTERGENIC REGION] [SP:P76221] [DB:swissprot] >sp:[LN:H64934] [AC:H64934] [PN:hypothetical protein b1752] [OR:Escherichia coli] [DB:pir2] >gp:[GI:g1788049] [LN:AE000270] [AC:AE000270:U00096] [PN:orf, hypothetical protein] [GN:ydjZ] [FN:orf; Unknown] [OR:Escherichia coli] [DB:genpept-bct2] [DE:Escherichia coli K-12 MG1655 section 160 of 400 of the completegenome.] [NT:o235; This 235 aa ORF is 29 pct identical (10 gaps)] [LE:2633] [RE:3340] [DI:direct]

| ORF Name | NT ID | AA ID | NT/LN | AA/LN | Score | P-value |
|---|---|---|---|---|---|---|
| 2869201_f2_378 | 604 | 7775 | 222 | 73 | 81 | 0.0022 |

Description sp:[LN:S74607] [AC:S74607] [PN:hypothetical protein slr1100] [CL:Synechocystis hypothetical protein slr1100] [OR:Synechocystis sp.] [SR:PCC 6803, , PCC 6803] [SR:PCC 6803, ] [DB:pir2] >gp:[GI:d1017492:g1651832] [LN:D90900] [AC:D90900:AB001339] [PN:hypothetical protein] [DB:genpept-bct1] [DE:Synechocystis sp. PCC6803 complete genome, 2/27, 133860-271599.] [NT:ORF_ID:slr1100] [LE:62752] [RE:63132] [DI:direct]

| ORF_Name | NT_ID | AA_ID | NT LN | AA LN | Score | P-value |
|---|---|---|---|---|---|---|
| 29329666_c3_1949 | 605 | 7776 | 1293 | 430 | 1963 | 8.0e-203 |

Description sp:[LN:PEPT_ECOLI] [AC:P29745:P77794] [GN:PEPT] [OR:Escherichia coli]
[EC:3.4.11.-] [DE:PEPTIDASE T, (AMINOTRIPEPTIDASE) (TRIPEPTIDASE)]
[SP:P29745:P77794] [DB:swissprot] >sp:[LN:D64857] [AC:D64857]
[PN:aminotripeptidase,:peptidase T] [GN:pepT] [OR:Escherichia coli] [EC:3.4.11.-]
[DB:pir2] >gp:[GI:d1036935:g1651556] [LN:D90748] [AC:D90748:AB001340]
[PN:Peptidase T (EC 3.4.11.-) (aminotripeptidase)] [GN:pepT] [OR:Escherichia
coli] [SR:Escherichia coli(strain:K12) DNA, clone:Kohara clone #239]
[DB:genpept-bct1] [DE:Escherichia coli genomic DNA. (25.6 - 25.9 min).]
[NT:ORF_ID:o239#2; similar to SwissProt Accession] [LE:2078] [RE:3304]
[DI:direct] >gp:[GI:g1787372] [LN:AE000213] [AC:AE000213:U00096] [PN:putative
peptidase T] [GN:pepT] [FN:putative enzyme; Not classified] [OR:Escherichia coli]
[DB:genpept-bct2] [EC:3.4.11.-] [DE:Escherichia coli K-12 MG1655 section 103 of
400 of the completegenome.] [NT:o408; 100 pct identical to 42 aa fragment]
[LE:155] [RE:1381] [DI:direct]

| ORF_Name | NT_ID | AA_ID | NT LN | AA LN | Score | P-value |
|---|---|---|---|---|---|---|
| 29423378_c1_1180 | 606 | 7777 | 309 | 102 | 358 | 9.6e-33 |

Description sp:[LN:YCFR_ECOLI] [AC:P75953] [GN:YCFR] [OR:Escherichia coli] [DE:HYPOTHETICAL
8.8 KD PROTEIN IN NDH-MFD INTERGENIC REGION PRECURSOR] [SP:P75953] [DB:swissprot]
>sp:[LN:E64855] [AC:E64855] [PN:ycfR protein precursor] [GN:ycfR] [CL:conserved
hypothetical protein b3238] [OR:Escherichia coli] [DB:pir2]
>gp:[GI:d1036913:g4062681] [LN:D90746] [AC:D90746:AB001340] [PN:Hypothetical 8.6
kd protein in dinG/rarB] [OR:Escherichia coli] [SR:Escherichia coli(strain:K12)
DNA, clone:Kohara clone #237] [DB:genpept-bct1] [DE:Escherichia coli genomic DNA.
(25.0 - 25.4 min).] [NT:ORF_ID:o238#1; similar to SwissProt Accession] [LE:11014]
[RE:11271] [DI:direct] >gp:[GI:d1036918:g4062685] [LN:D90747]
[AC:D90747:AB001340] [PN:Hypothetical 8.6 kd protein in dinG/rarB]
[OR:Escherichia coli] [SR:Escherichia coli(strain:K12) DNA, clone:Kohara clone
238] [DB:genpept-bct1] [DE:Escherichia coli genomic DNA. (25.2 - 25.6 min).]
[NT:ORF_ID:o238#1; similar to SwissProt Accession] [LE:760] [RE:1017] [DI:direct]
>gp:[GI:g1787355] [LN:AE000211] [AC:AE000211:U00096] [PN:orf, hypothetical
protein] [GN:ycfR] [FN:orf; Unknown] [OR:Escherichia coli] [DB:genpept-bct2]
[DE:Escherichia coli K-12 MG1655 section 101 of 400 of the completegenome.]
[NT:o85; This 85 aa ORF is 47 pct identical (1 gap)] [LE:7385] [RE:7642]
[DI:direct]

| ORF_Name | NT_ID | AA_ID | NT LN | AA LN | Score | P-value |
|---|---|---|---|---|---|---|
| 29490675_c2_1617 | 607 | 7778 | 666 | 221 | | |

Description

NO-HIT

| ORF Name | NT ID | AA ID | NT LN | AA LN | Score | P-value |
|---|---|---|---|---|---|---|
| 2949186_c2_1766 | 608 | 7779 | 549 | 182 | 696 | 1.5e-68 |

Description sp:[LN:YNIB_ECOLI] [AC:P76208] [GN:YNIB] [OR:Escherichia coli] [DE:HYPOTHETICAL
20.4 KD PROTEIN IN PFKB-CEDA INTERGENIC REGION] [SP:P76208] [DB:swissprot]
>sp:[LN:F64931] [AC:F64931] [PN:probable membrane protein b1726] [OR:Escherichia
coli] [DB:pir2] >gp:[GI:g1788020] [LN:AE000267] [AC:AE000267:U00096] [PN:orf,
hypothetical protein] [GN:b1726] [FN:orf; Unknown] [OR:Escherichia coli]
[DB:genpept-bct2] [DE:Escherichia coli K-12 MG1655 section 157 of 400 of the
completegenome.] [NT:f178; This 178 aa ORF is 30 pct identical (13 gaps)]
[LE:8680] [RE:9216] [DI:complement]

| ORF Name | NT ID | AA ID | NT LN | AA LN | Score | P-value |
|---|---|---|---|---|---|---|
| 29495907_f3_877 | 609 | 7780 | 606 | 201 | 912 | 1.9e-91 |

Description sp:[LN:BTUR_ECOLI] [AC:P13040] [GN:BTUR:COBA] [OR:Escherichia coli] [EC:2.5.1.17]
[DE:ADENOSYLTRANSFERASE)] [SP:P13040] [DB:swissprot] >sp:[LN:A64875]
[AC:A64875:A32232] [PN:cob(I)alamin adenosyltransferase,] [GN:btuR:cobA]
[OR:Escherichia coli] [EC:2.5.1.17] [DB:pir2] >gp:[GI:d1015523:g1742065]
[LN:D90764] [AC:D90764:AB001340] [PN:Cob(I)alamin adenosyltransferase (EC
2.5.1.17)] [GN:btuR, cobA] [OR:Escherichia coli] [SR:Escherichia coli
(strain:K12) DNA, clone_lib:Kohara lambda minise] [DB:genpept-bct1] [DE:E.coli
genomic DNA, Kohara clone #253(28.4-28.7 min.).] [NT:ORF_ID:o253#10; similar to
[SwissProt Accession] [LE:10387] [RE:10977] [DI:complement]
>gp:[GI:d1015538:g1742081] [LN:D90765] [AC:D90765:AB001340] [PN:Cob(I)alamin
adenosyltransferase (EC 2.5.1.17)] [GN:btuR, cobA] [OR:Escherichia coli]
[SR:Escherichia coli (strain:K12) DNA, clone_lib:Kohara lambda minise]
[DB:genpept-bct1] [DE:E.coli genomic DNA, Kohara clone #254(28.4-28.9 min.).]
[NT:ORF_ID:o253#10; similar to [SwissProt Accession] [LE:7893] [RE:8483]
[DI:complement] >gp:[GI:g145448] [LN:ECOBTUR] [AC:M21528] [OR:Escherichia coli]
[SR:E.coli (K12) DNA] [DB:genpept-bct1] [DE:E.coli btuR gene encoding protein
BtuR, complete cds.] [NT:btuR protein] [LE:102] [RE:692] [DI:direct]
>gp:[GI:g1787525] [LN:AE000225] [AC:AE000225:U00096] [PN:cob(I)alamin
adenolsyltransferase] [GN:btuR] [FN:enzyme; Biosynthesis of cofactors, carriers:]
[OR:Escherichia coli] [DB:genpept-bct2] [EC:2.5.1.17] [DE:Escherichia coli K-12
MG1655 section 115 of 400 of the completegenome.] [NT:f196; 100 pct identical to
BTUR_ECOLI SW: P13040;] [LE:1051] [RE:1641] [DI:complement]

| ORF_Name | NT ID | AA ID | NT/LN | AA/LN | Score | P-value |
|---|---|---|---|---|---|---|
| 29556509_c2_1554 | 610 | 7781 | 1257 | 418 | 2007 | 1.7e-207 |

Description sp:[LN:PTGB_ECOLI] [AC:P05053] [GN:PTSG:GLCA:UMG] [OR:Escherichia coli]
[EC:2.7.1.69] [DE:(EC 2.7.1.69) (EII-GLC)] [SP:P05053] [DB:swissprot]
>sp:[LN:WQEC2G] [AC:A25336:B64854] [PN:phosphotransferase system enzyme II,,
glucose-specific, factor II:glucose-permease, factor II:phosphotransferase system
enzyme II-Glc:protein-N(pi)-phosphohistidine-glucose phosphotransferase, factor
II] [GN:ptsG:glcA:umg] [CL:phosphotransferase system glucose-specific enzyme II,
factor II:phosphotransferase system glucose-specific enzyme II, factor II
homology] [OR:Escherichia coli] [EC:2.7.1.69] [DB:pir1] [MP:24 min]
>gp:[GI:d1036894:g1651541] [LN:D90745] [AC:D90745:AB001340] [PN:PTS system,
glucose-specific IIBC component] [GN:glcA] [OR:Escherichia coli] [SR:Escherichia
coli(strain:K12) DNA, clone:Kohara clone #236] [DB:genpept-bct1] [DE:Escherichia
coli genomic DNA. (24.8 - 25.2 min).] [NT:ORF_ID:o236#10; similar to SwissProt
Accession] [LE:8511] [RE:9944] [DI:direct] >gp:[GI:g147393] [LN:ECOPTSG]
[AC:J02618] [GN:ptsG] [OR:Escherichia coli] [SR:E.coli DNA strain ptsG4]
[DB:genpept-bct1] [DE:E. coli ptsG gene encoding glucose-specific enzyme II
ofphosphotransferase system.] [NT:glucose-specific enzyme II of
phosphotransferase] [LE:39] [RE:1472] [DI:direct] >gp:[GI:g1787343] [LN:AE000210]
[AC:AE000210:U00096] [PN:PTS system, glucose-specific IIBC component] [GN:ptsG]
[FN:transport; Transport of small molecules:] [OR:Escherichia coli]
[DB:genpept-bct2] [EC:2.7.1.69] [DE:Escherichia coli K-12 MG1655 section 100 of
400 of the completegenome.] [NT:o477; 100 pct identical to PTGB_ECOLI SW: P05053]
[LE:9174] [RE:10607] [DI:direct]

| ORF_Name | NT ID | AA ID | NT/LN | AA/LN | Score | P-value |
|---|---|---|---|---|---|---|
| 29703505_c2_1684 | 611 | 7782 | 357 | 118 | 285 | 5.2e-25 |

Description sp:[LN:YOAF_ECOLI] [AC:P76244] [GN:YOAF] [OR:Escherichia coli] [DE:HYPOTHETICAL
8.9 KD PROTEIN IN GAPA-RND INTERGENIC REGION] [SP:P76244] [DB:swissprot]
>sp:[LN:A64940] [AC:A64940] [PN:hypothetical protein b1793] [OR:Escherichia coli]
[DB:pir2] >gp:[GI:g1788094] [LN:AE000274] [AC:AE000274:U00096] [PN:orf,
hypothetical protein] [GN:yoaF] [FN:orf; Unknown] [OR:Escherichia coli]
[DB:genpept-bct2] [DE:Escherichia coli K-12 MG1655 section 164 of 400 of the
completegenome.] [NT:f84; This 84 aa ORF is 30 pct identical (6 gaps)] [LE:3017]
[RE:3271] [DI:complement]

| ORF_Name | NT ID | AA ID | NT/LN | AA/LN | Score | P-value |
|---|---|---|---|---|---|---|
| 29713175_c3_2212 | 612 | 7783 | 1107 | 368 | 1538 | 8.7e-158 |

Description sp:[LN:D64882] [AC:D64882] [PN:periplasmic oligopeptide-binding protein precursor] [CL:dipeptide transport protein] [OR:Escherichia coli] [DB:pir2] >gp:[GI:d1015638;g1742186] [LN:D90771] [AC:D90771:AB001340] [PN:Periplasmic oligopeptide-binding protein] [OR:Escherichia coli] [SR:Escherichia coli (strain:K12) DNA, clone_lib:Kohara lambda minise] [DB:genpept-bct1] [DE:E.coli genomic DNA, Kohara clone #260(29.8-30.2 min.).] [NT:ORF_ID:o260#13; similar to [SwissProt Accession] [LE:11679] [RE:13313] [DI:direct] >gp:[GI:d1015648;g1742197] [LN:D90772] [AC:D90772:AB001340] [PN:Periplasmic oligopeptide-binding protein] [OR:Escherichia coli] [SR:Escherichia coli (strain:K12) DNA, clone_lib:Kohara lambda minise] [DB:genpept-bct1] [DE:E.coli genomic DNA, Kohara clone #261(30.0-30.3 min.).] [NT:ORF_ID:o260#13; similar to [SwissProt Accession] [LE:1744] [RE:3378] [DI:direct] >gp:[GI:g1787590] [LN:AE000231] [AC:AE000231:U00096] [PN:putative transport periplasmic protein] [GN:b1329] [FN:putative transport; Not classified] [OR:Escherichia coli] [DB:genpept-bct2] [DE:Escherichia coli K-12 MG1655 section 121 of 400 of the completegenome.] [NT:o544; This 544 aa ORF is 48 pct identical (4 gaps)] [LE:1308] [RE:2942] [DI:direct]

| ORF_Name | NT ID | AA ID | NT/LN | AA/LN | Score | P-value |
|---|---|---|---|---|---|---|
| 29723881_c3_1980 | 613 | 7784 | 204 | 67 | | |

Description

NO-HIT

| ORF_Name | NT ID | AA ID | NT/LN | AA/LN | Score | P-value |
|---|---|---|---|---|---|---|
| 29818806_f2_626 | 614 | 7785 | 1560 | 519 | 475 | 3.9e-45 |

Description gp:[GI:g1515465] [LN:RRU65510] [AC:U65510:U43789:M90421:S41762:U20508] [PN:unknown] [OR:Rhodospirillum rubrum] [DB:genpept-bct2] [DE:Rhodospirillum rubrum CO-induced hydrogenase operon (cooM, cooK,cooL, cooX, cooU, cooH) genes, iron sulfur protein (cooF) gene,carbon monoxide dehydrogenase (cooS) gene, carbon monoxidedehydrogenase accessory proteins (cooC, cooT, cooJ) genes, putativetranscriptional activator (cooA) gene, nicotinate-nucleotidepyrophosphorylase (nadC) gene, complete cds, L-aspartate oxidase(nadB) gene, and alkyl hydroperoxide reductase (ahpC) gene, partialcds.] [NT:hypothetical ORF similar to YpuE of] [LE:433] [RE:1824] [DI:complement]

281

| ORF Name | NT ID | AA ID | NT LN | AA LN | Score | P-value |
|---|---|---|---|---|---|---|
| 29850436_c3_1972 | 615 | 7786 | 279 | 92 | 220 | 4.0e-18 |

Description sp:[LN:T03015] [AC:T03015] [PN:hypothetical protein 13] [OR:Salmonella typhimurium] [DB:pir2] >gp:[GI:g3294487] [LN:STAF001386] [AC:AF001386] [PN:unknown] [OR:Salmonella typhimurium] [DB:genpept-bct2] [DE:Salmonella typhimurium sigma-E factor regulatory protein (rseA)gene, partial cds; sigma-E factor regulatory protein (rseB),sigma-E factor regulatory protein (rseC), truncated GTP-bindingprotein (lepA), complete cds; Gifsy-1 prophage left-end portion:putative integrase (int), putative excisionase (xis), andexodeoxyribonuclease VIII (recE) genes, complete cds; and unknowngenes.] [NT:ORF-13; similar to Escherichia coli dinI gene] [LE:13114] [RE:>13311] [DI:direct]

| ORF Name | NT ID | AA ID | NT LN | AA LN | Score | P-value |
|---|---|---|---|---|---|---|
| 29882943_c3_2095 | 616 | 7787 | 1491 | 496 | 2043 | 2.7e-211 |

Description gp:[GI:d1016261:g1742856] [LN:D90818] [AC:D90818:AB001340] [PN:Succinate semialdehyde dehydrogenase (EC) [OR:Escherichia coli] [SR:Escherichia coli (strain:K12) DNA, clone_lib:Kohara lambda minise] [DB:genpept-bct1] [DE:E.coli genomic DNA, Kohara clone #327(39.2-39.5 min.).] [NT:ORF_ID:o327#3; similar to [SwissProt Accession] [LE:7984] [RE:9519] [DI:complement]

| ORF Name | NT ID | AA ID | NT LN | AA LN | Score | P-value |
|---|---|---|---|---|---|---|
| 29978541_c3_1975 | 617 | 7788 | 408 | 135 | 339 | 9.9e-31 |

Description sp:[LN:G64910] [AC:G64910] [PN:lysis protein S.b1556] [OR:Escherichia coli] [DB:pir2] >gp:[GI:d1015976:g1742551] [LN:D90798] [AC:D90798:AB001340] [PN:Lysis protein S.] [OR:Escherichia coli] [SR:Escherichia coli (strain:K12) DNA, clone_lib:Kohara lambda minise] [DB:genpept-bct1] [DE:E.coli genomic DNA, Kohara clone #307(35.1-35.5 min.).] [NT:ORF_ID:o308#12; similar to [SwissProt Accession] [LE:12364] [RE:12654] [DI:complement] >gp:[GI:d1015986:g1742562] [LN:D90799] [AC:D90799:AB001340] [PN:Lysis protein S.] [OR:Escherichia coli] [SR:Escherichia coli (strain:K12) DNA, clone_lib:Kohara lambda minise] [DB:genpept-bct1] [DE:E.coli genomic DNA, Kohara clone #308(35.3-35.7 min.).] [NT:ORF_ID:o308#12; similar to [SwissProt Accession] [LE:2337] [RE:2627] [DI:complement] >gp:[GI:g1787838] [LN:AE000252] [AC:AE000252:U00096] [PN:orf, hypothetical protein] [GN:b1556] [FN:orf; Unknown] [OR:Escherichia coli] [DB:genpept-bct2] [DE:Escherichia coli K-12 MG1655 section 142 of 400 of the completegenome.] [NT:f96; 83 pct identical to 71 amino acids] [LE:7985] [RE:8275] [DI:complement]

| ORF Name | NT ID | AA ID | NT LN | AA LN | Score | P-value |
|---|---|---|---|---|---|---|
| 30133561_f3_1116 | 618 | 7789 | 654 | 217 | 973 | 6.5e-98 |

Description sp:[LN:YCFC_ECOLI] [AC:P25746] [GN:YCFC] [OR:Escherichia coli] [DE:HYPOTHETICAL
22.9 KD PROTEIN IN PURB-ICDA INTERGENIC REGION (ORF-23)] [SP:P25746]
[DB:swissprot] >sp:[LN:S19211] [AC:S19211:A64858] [PN:ycfC protein] [GN:ycfC]
[OR:Escherichia coli] [DB:pir2] >gp:[GI:d1036940:g4062696] [LN:D90748]
[AC:D90748:AB001340] [PN:Hypothetical protein 23.] [GN:ycfC] [OR:Escherichia
coli] [SR:Escherichia coli(strain:K12) DNA, clone:Kohara clone #239]
[DB:genpept-bct1] [DE:Escherichia coli genomic DNA. (25.6 - 25.9 min).]
[NT:ORF_ID:o240#3; similar to PIR Accession Number] [LE:8224] [RE:8865]
[DI:complement] >gp:[GI:d1036949:g4062714] [LN:D90749] [AC:D90749:AB001340]
[PN:Hypothetical protein 23.] [GN:ycfC] [OR:Escherichia coli] [SR:Escherichia
coli(strain:K12) DNA, clone:Kohara clone #240] [DB:genpept-bct1] [DE:Escherichia
coli genomic DNA. (25.7 - 26.1 min).] [NT:ORF_ID:o240#3; similar to PIR Accession
Number] [LE:2541] [RE:3182] [DI:complement] >gp:[GI:g581207] [LN:ECPURB]
[AC:X59307] [GN:ORF-23] [OR:Escherichia coli] [DB:genpept-bct1] [DE:E.coli
ORF-15, ORF-23, purB and phoP (5'end) genes.] [SP:P25746] [LE:731] [RE:1372]
[DI:direct] >gp:[GI:g1787377] [LN:AE000213] [AC:AE000213:U00096] [PN:orf,
hypothetical protein] [GN:ycfC] [FN:orf; Unknown] [OR:Escherichia coli]
[DB:genpept-bct2] [DE:Escherichia coli K-12 MG1655 section 103 of 400 of the
completegenome.] [NT:f213; 99 pct identical to YCFC_ECOLI SW: P25746] [LE:6301]
[RE:6942] [DI:complement]

| ORF Name | NT ID | AA ID | NT LN | AA LN | Score | P-value |
|---|---|---|---|---|---|---|
| 30158450_c1_1496 | 619 | 7790 | 1404 | 467 | 1156 | 2.6e-117 |

Description sp:[LN:CELF_BACSU] [AC:P46320] [GN:CELF:CELD:LICH] [OR:Bacillus subtilis]
[EC:3.2.1.86] [DE:PROBABLE 6-PHOSPHO-BETA-GLUCOSIDASE,] [SP:P46320]
[DB:swissprot] >sp:[LN:S57762] [AC:S57762:G69651] [PN:6-phospho-beta-glucosidase
licH] [GN:licH] [OR:Bacillus subtilis] [DB:pir2] >gp:[GI:g895751] [LN:BSCELABCD]
[AC:Z49992] [PN:putative 6-phospho-beta-glucosidase] [GN:celD] [OR:Bacillus
subtilis] [DB:genpept-bct1] [DE:B.subtilis celA, celB, celC, celD and ywaA
genes.] [SP:P46320] [LE:4270] [RE:5598] [DI:direct] >gp:[GI:e1186355:g2636391]
[LN:BSUB0020] [AC:Z99123:AL009126] [PN:6-phospho-beta-glucosidase] [GN:licH]
[FN:lichenan degradation products utilization] [OR:Bacillus subtilis]
[DB:genpept-bct1] [EC:3.2.1.86] [DE:Bacillus subtilis complete genome (section 20
of 21): from 3798401to 4010550.] [NT:alternate gene name: celD, celF] [SP:P46320]
[LE:158910] [RE:160238] [DI:complement]

| ORF Name | NT ID | AA ID | NT/LN | AA/LN | Score | P-value |
|---|---|---|---|---|---|---|
| 30277181_c1_1314 | 620 | 7791 | 765 | 254 | 616 | 4.4e-60 |

Description sp:[LN:F69868] [AC:F69868] [PN:glucose 1-dehydrogenase homolog ykvO] [GN:ykvO]
[CL:ribitol dehydrogenase:short-chain alcohol dehydrogenase homology]
[OR:Bacillus subtilis] [DB:pir2] >gp:[GI:e1184967:g2633748] [LN:BSUB0008]
[AC:Z99111:AL009126] [GN:ykvO] [FN:unknown] [OR:Bacillus subtilis]
[DB:genpept-bct1] [DE:Bacillus subtilis complete genome (section 8 of 21): from
1394791to 1603020.] [NT:similar to glucose 1-dehydrogenase] [LE:47548] [RE:48294]
[DI:direct]

| ORF Name | NT ID | AA ID | NT/LN | AA/LN | Score | P-value |
|---|---|---|---|---|---|---|
| 30353755_c1_1203 | 621 | 7792 | 222 | 73 | 121 | 1.3e-07 |

Description sp:[LN:E72756] [AC:E72756] [PN:hypothetical protein APE0042] [GN:APE0042]
[OR:Aeropyrum pernix] [DB:pir2] >gp:[GI:d1042727:g5103430] [LN:AP000058]
[AC:AP000058] [PN:110aa long hypothetical protein] [GN:APE0042] [OR:Aeropyrum
pernix] [SR:Aeropyrum pernix (strain:K1) DNA] [DB:genpept-bct1] [DE:Aeropyrum
pernix genomic DNA, section 1/7.] [NT:similar to OWL:AP000006197 percent
identity:37.705] [LE:25576] [RE:25908] [DI:complement]

| ORF Name | NT ID | AA ID | NT/LN | AA/LN | Score | P-value |
|---|---|---|---|---|---|---|
| 30359662_c2_1801 | 622 | 7793 | 552 | 183 | | |

Description

NO-HIT

| ORF Name | NT ID | AA ID | NT LN | AA LN | Score | P-value |
|---|---|---|---|---|---|---|
| 30489091_c2_1555 | 623 | 7794 | 429 | 142 | 563 | 1.8e-54 |

Description sp:[LN:YCFF_ECOLI] [AC:P36950:P75945] [GN:YCFF] [OR:Escherichia coli]
[DE:HYPOTHETICAL 13.2 KD PROTEIN HIT-LIKE PROTEIN IN FHUE 5'REGION]
[SP:P36950:P75945] [DB:swissprot] >sp:[LN:JC5685] [AC:JC5685:PC4410:D64854]
[PN:histidine triad-like protein ycfF:P1,P4 bis(5'-adenosyl)
tetraphosphate-binding histidine triad protein, 14K] [GN:ycfF] [CL:protein kinase
C inhibitor:histidine triad homology] [OR:Escherichia coli] [DB:pir2] [MP:16 min]
>gp:[GI:d1036896:g4062667] [LN:D90745] [AC:D90745:AB001340] [PN:Hypothetical
protein HI0961] [OR:Escherichia coli] [SR:Escherichia coli(strain:K12) DNA,
clone:Kohara clone #236] [DB:genpept-bct1] [DE:Escherichia coli genomic DNA.
(24.8 - 25.2 min).] [NT:ORF_ID:o237#2; similar to PIR Accession Number]
[LE:12527] [RE:12886] [DI:direct] >gp:[GI:d1036904:g4062673] [LN:D90746]
[AC:D90746:AB001340] [PN:Hypothetical protein HI0961] [OR:Escherichia coli]
[SR:Escherichia coli(strain:K12) DNA, clone:Kohara clone #237] [DB:genpept-bct1]
[DE:Escherichia coli genomic DNA. (25.0 - 25.4 min).] [NT:ORF_ID:o237#2; similar
to PIR Accession Number] [LE:3826] [RE:4185] [DI:direct] >gp:[GI:g1787346]
[LN:AE000211] [AC:AE000211:U00096] [PN:orf, hypothetical protein] [GN:ycfF]
[FN:orf; Unknown] [OR:Escherichia coli] [DB:genpept-bct2] [DE:Escherichia coli
K-12 MG1655 section 101 of 400 of the completegenome.] [NT:o119; This 119 aa ORF
is 74 pct identical (0 gaps)] [LE:197] [RE:556] [DI:direct]

| ORF Name | NT ID | AA ID | NT LN | AA LN | Score | P-value |
|---|---|---|---|---|---|---|
| 30598778_f2_515 | 624 | 7795 | 726 | 241 | 903 | 1.7e-90 |

Description sp:[LN:YBIX_ECOLI] [AC:P75779] [GN:YBIX] [OR:Escherichia coli] [DE:HYPOTHETICAL
26.9 KD PROTEIN IN DING-GLNQ INTERGENIC REGION] [SP:P75779] [DB:swissprot]
>sp:[LN:D64817] [AC:D64817] [PN:ybiX protein] [GN:ybiX] [OR:Escherichia coli]
[DB:pir2] >gp:[GI:d1036456:g4062365] [LN:D90717] [AC:D90717:AB001340]
[OR:Escherichia coli] [SR:Escherichia coli(strain:K12) DNA, clone:Kohara clone
204] [DB:genpept-bct1] [DE:Escherichia coli genomic DNA. (17.9 - 18.2 min).]
[NT:ORF_ID:o204#10] [LE:9832] [RE:10545] [DI:complement] >gp:[GI:g1787023]
[LN:AE000182] [AC:AE000182:U00096] [PN:putative enzyme] [GN:ybiX] [FN:putative
enzyme; Not classified] [OR:Escherichia coli] [DB:genpept-bct2] [DE:Escherichia
coli K-12 MG1655 section 72 of 400 of the completegenome.] [NT:f237; This 237 aa
ORF is 26 pct identical (4 gaps)] [LE:7797] [RE:8510] [DI:complement]

| ORF Name | NT ID | AA ID | NT LN | AA LN | Score | P-value |
|---|---|---|---|---|---|---|
| 30714592_f2_609 | 625 | 7796 | 372 | 123 | 137 | 5.9e-09 |

Description gp:[GI:g5832876] [LN:CEY50E8A] [AC:AL117200] [GN:Y50E8A.g] [OR:Caenorhabditis
elegans] [DB:genpept-inv1] [DE:Caenorhabditis elegans cosmid Y50E8A, complete
sequence.] [NT:predicted using Genefinder; preliminary prediction]
[LE:16593:19237:20708] [RE:19113:20275:20895] [DI:complementJoin]

| ORF Name | NT ID | AA ID | NT/LN | AA/LN | Score | P-value |
|---|---|---|---|---|---|---|
| 30755382_f2_435 | 626 | 7797 | 327 | 108 | 84 | 3.0e-05 |

Description sp:[LN:G72471] [AC:G72471] [PN:hypothetical protein APE2416] [GN:APE2416]
[OR:Aeropyrum pernix] [DB:pir2] >gp:[GI:d1045217:g5106120] [LN:AP000064]
[AC:AP000064] [PN:200aa long hypothetical protein] [GN:APE2416] [OR:Aeropyrum
pernix] [SR:Aeropyrum pernix (strain:K1) DNA] [DB:genpept-bct1] [DE:Aeropyrum
pernix genomic DNA, section 7/7.] [LE:107570] [RE:108172] [DI:complement]

| ORF Name | NT ID | AA ID | NT/LN | AA/LN | Score | P-value |
|---|---|---|---|---|---|---|
| 31268881_f3_1113 | 627 | 7798 | 198 | 65 | | |

Description

NO-HIT

| ORF Name | NT ID | AA ID | NT/LN | AA/LN | Score | P-value |
|---|---|---|---|---|---|---|
| 31275455_f2_546 | 628 | 7799 | 198 | 65 | 121 | 1.8e-07 |

Description sp:[LN:T10737] [AC:T10737] [PN:extensin-like cell wall protein:proline-rich cell
wall protein:proline-rich cell wall protein] [OR:Gossypium barbadense] [SR:,
sea-island cotton] [DB:pir2] >gp:[GI:g451544] [LN:GBU04267] [AC:U04267]
[PN:proline-rich cell wall protein] [OR:Gossypium barbadense] [SR:sea-island
cotton] [DB:genpept-pln1] [DE:Gossypium barbadense Sea Island proline-rich cell
wall protein genecomplete cds.] [LE:321:1464] [RE:881:1547] [DI:directJoin]

| ORF Name | NT ID | AA ID | NT/LN | AA/LN | Score | P-value |
|---|---|---|---|---|---|---|
| 31291450_f2_524 | 629 | 7800 | 711 | 236 | 861 | 4.8e-86 |

Description sp:[LN:YNIC_ECOLI] [AC:P77247] [GN:YNIC] [OR:Escherichia coli] [DE:HYPOTHETICAL
24.3 KD PROTEIN IN PFKB-CEDA INTERGENIC REGION] [SP:P77247] [DB:swissprot]
>sp:[LN:G64931] [AC:G64931] [PN:yniC protein] [GN:yniC] [CL:hypothetical protein
b2690] [OR:Escherichia coli] [DB:pir2] >gp:[GI:d1016230:g1742822] [LN:D90815]
[AC:D90815:AB001340] [PN:Phosphoglycolate phosphatase (EC 3.1.3.18).]
[OR:Escherichia coli] [SR:Escherichia coli (strain:K12) DNA, clone_lib:Kohara
lambda minise] [DB:genpept-bct1] [DE:E.coli genomic DNA, Kohara clone
324(38.8-39.1 min.).] [NT:ORF_ID:o324#7; similar to [SwissProt Accession]
[LE:8910] [RE:9578] [DI:direct] >gp:[GI:d1016234:g1742827] [LN:D90816]
[AC:D90816:AB001340] [PN:Phosphoglycolate phosphatase (EC 3.1.3.18).]
[OR:Escherichia coli] [SR:Escherichia coli (strain:K12) DNA, clone_lib:Kohara
lambda minise] [DB:genpept-bct1] [DE:E.coli genomic DNA, Kohara clone
325(38.9-39.2 min.).] [NT:ORF_ID:o324#7; similar to [SwissProt Accession]
[LE:1969] [RE:2637] [DI:direct] >gp:[GI:g1788021] [LN:AE000267]
[AC:AE000267:U00096] [PN:putative phosphatase] [GN:yniC] [FN:putative enzyme; Not
classified] [OR:Escherichia coli] [DB:genpept-bct2] [DE:Escherichia coli K-12
MG1655 section 157 of 400 of the completegenome.] [NT:o222; This 222 aa ORF is 31
pct identical (15 gaps)] [LE:9363] [RE:10031] [DI:direct]

| ORF Name | NT ID | AA ID | NT/LN | AA/LN | Score | P-value |
|---|---|---|---|---|---|---|
| 31300041_f3_845 | 630 | 7801 | 1017 | 338 | 1512 | 5.0e-155 |

Description sp:[LN:SAPB_SALTY] [AC:P36668] [GN:SAPB] [OR:Salmonella typhimurium] [DE:PEPTIDE TRANSPORT SYSTEM PERMEASE PROTEIN SAPB] [SP:P36668] [DB:swissprot] >sp:[LN:S39586] [AC:S39586] [PN:peptide transport system permease protein sapB] [GN:sapB] [CL:transmembrane protein dppB] [OR:Salmonella typhimurium] [DB:pir2] >gp:[GI:g414209] [LN:STSAP] [AC:X74212] [GN:sapB] [OR:Salmonella typhimurium] [DB:genpept-bct1] [DE:S.typhimurium DNA sequence of antimicrobial peptides-resistancelocus.] [SP:P36668] [LE:1762] [RE:2727] [DI:direct]

| ORF Name | NT ID | AA ID | NT/LN | AA/LN | Score | P-value |
|---|---|---|---|---|---|---|
| 31375188_f1_156 | 631 | 7802 | 927 | 308 | 971 | 1.1e-97 |

Description sp:[LN:KDUD_ECOLI] [AC:P37769] [GN:KDUD] [OR:Escherichia coli] [EC:1.1.1.125] [DE:DEOXYGLUCONATE OXIDOREDUCTASE)] [SP:P37769] [DB:swissprot] >sp:[LN:C65067] [AC:C65067] [PN:2-deoxy-D-gluconate 3-dehydrogenase,] [GN:kduD] [CL:ribitol dehydrogenase:short-chain alcohol dehydrogenase homology] [OR:Escherichia coli] [EC:1.1.1.125] [DB:pir2] >gp:[GI:g882735] [LN:ECU29581] [AC:U29581] [OR:Escherichia coli] [DB:genpept-bct1] [DE:Escherichia coli K-12 genome; approximately 63 to 64 minutes.] [NT:ORF_f253] [LE:64052] [RE:64813] [DI:complement] >gp:[GI:g1789208] [LN:AE000368] [AC:AE000368:U00096] [PN:2-deoxy-D-gluconate 3-dehydrogenase] [GN:kduD] [FN:enzyme; Central intermediary metabolism: Pool,] [OR:Escherichia coli] [DB:genpept-bct2] [EC:1.1.1.125] [DE:Escherichia coli K-12 MG1655 section 258 of 400 of the completegenome.] [NT:f253; 100 pct identical to KDUD_ECOLI SW: P37769] [LE:1828] [RE:2589] [DI:complement]

| ORF Name | NT ID | AA ID | NT/LN | AA/LN | Score | P-value |
|---|---|---|---|---|---|---|
| 31484791_f3_892 | 632 | 7803 | 975 | 324 | 187 | 1.0e-12 |

Description sp:[LN:YOAV_BACSU] [AC:O34416] [GN:YOAV] [OR:Bacillus subtilis] [DE:HYPOTHETICAL 33.0 KD PROTEIN IN PELB-PENP INTERGENIC REGION] [SP:O34416] [DB:swissprot] >sp:[LN:G69897] [AC:G69897] [PN:conserved hypothetical protein yoaV] [GN:yoaV] [OR:Bacillus subtilis] [DB:pir2] >gp:[GI:e1185349:g2634270] [LN:BSUB0011] [AC:Z99114:AL009126] [GN:yoaV] [FN:unknown] [OR:Bacillus subtilis] [DB:genpept-bct1] [DE:Bacillus subtilis complete genome (section 11 of 21): from 2000171to 2207900.] [NT:similar to hypothetical proteins] [LE:45013] [RE:45891] [DI:direct] >gp:[GI:g2619001] [LN:AF027868] [AC:AF027868] [PN:YoaV] [GN:yoaV] [OR:Bacillus subtilis] [DB:genpept-bct2] [DE:Bacillus subtilis chromosome region between terC and odhAB.] [NT:similar to E.coli YijE hypothetical protein (312] [LE:25922] [RE:26800] [DI:direct]

| ORF Name | NT ID | AA ID | NT LN | AA LN | Score | P-value |
|---|---|---|---|---|---|---|
| 3156381_c1_1455 | 633 | 7804 | 1176 | 391 | 1752 | 1.8e-180 |

Description sp:[LN:YCIM_ECOLI] [AC:P45576:P76836] [GN:YCIM] [OR:Escherichia coli]
[DE:HYPOTHETICAL 44.5 KD PROTEIN IN PGPB-PYRF INTERGENIC REGION PRECURSOR]
[SP:P45576:P76836] [DB:swissprot] >sp:[LN:C64876] [AC:C64876] [PN:yciM protein
precursor] [GN:yciM] [CL:hypothetical protein HI1223:tetratricopeptide repeat
homology] [OR:Escherichia coli] [DB:pir2] >gp:[GI:d1015550:g1742094] [LN:D90766]
[AC:D90766:AB001340] [GN:yciM] [OR:Escherichia coli [SR:Escherichia coli
(strain:K12) DNA, clone_lib:Kohara lambda minise] [DB:genpept-bct1] [DE:E.coli
genomic DNA, Kohara clone #255(28.8-29.2 min.).] [NT:ORF_ID:o255#5; similar to
[SwissProt Accession] [LE:2823] [RE:3992] [DI:direct] >gp:[GI:g2367116]
[LN:AE000226] [AC:AE000226:U00096] [PN:yciM] [OR:Escherichia coli] [DB:genpept-bct2]
[FN:putative factor; Not classified] [OR:Escherichia coli] [DB:genpept-bct2]
[DE:Escherichia coli K-12 MG1655 section 116 of 400 of the completegenome.]
[NT:o389; 98 pct identical to 82 aa fragment] [LE:2050] [RE:3219] [DI:direct]

| ORF Name | NT ID | AA ID | NT LN | AA LN | Score | P-value |
|---|---|---|---|---|---|---|
| 31660191_f1_29 | 634 | 7805 | 1446 | 481 | | |

Description

NO-HIT

| ORF Name | NT ID | AA ID | NT LN | AA LN | Score | P-value |
|---|---|---|---|---|---|---|
| 31734378_f3_1020 | 635 | 7806 | 1179 | 392 | 925 | 7.9e-93 |

Description gp:[GI:d1016316:g1736420] [LN:D90823] [AC:D90823:AB001340] [OR:Escherichia coli]
[SR:Escherichia coli (strain:K12) DNA, clone_lib:Kohara lambda minise]
[DB:genpept-bct1] [DE:E.coli genomic DNA, Kohara clone #332(40.4-40.7 min.).]
[NT:ORF_ID:o332#1; similar to [SwissProt Accession] [LE:3911] [RE:4936]
[DI:direct]

| ORF Name | NT ID | AA ID | NT LN | AA LN | Score | P-value |
|---|---|---|---|---|---|---|
| 31766530_f2_613 | 636 | 7807 | 732 | 243 | 430 | 2.3e-40 |

Description sp:[LN:YEAO_ECOLI] [AC:P76243] [GN:YEAO] [OR:Escherichia coli] [DE:HYPOTHETICAL
14.2 KD PROTEIN IN GAPA-RND INTERGENIC REGION] [SP:P76243] [DB:swissprot]
>sp:[LN:H64939] [AC:H64939] [PN:hypothetical protein b1792] [OR:Escherichia coli]
[DB:pir2] >gp:[GI:g1788093] [LN:AE000274] [AC:AE000274:U00096] [PN:orf,
hypothetical protein] [GN:yeaO] [FN:orf; Unknown] [OR:Escherichia coli]
[DB:genpept-bct2] [DE:Escherichia coli K-12 MG1655 section 164 of 400 of the
completegenome.] [NT:o122; This 122 aa ORF is 34 pct identical (5 gaps)]
[LE:2627] [RE:2995] [DI:direct]

| ORF Name | NT ID | AA ID | NT LN | AA LN | Score | P-value |
|---|---|---|---|---|---|---|
| 31803555_f1_122 | 637 | 7808 | 213 | 70 | | |

Description

NO-HIT

| ORF Name | NT ID | AA ID | NT LN | AA LN | Score | P-value |
|---|---|---|---|---|---|---|
| 31845918_f2_661 | 638 | 7809 | 204 | 67 | | |

Description

NO-HIT

| ORF Name | NT ID | AA ID | NT LN | AA LN | Score | P-value |
|---|---|---|---|---|---|---|
| 31853576_f3_966 | 639 | 7810 | 1044 | 347 | 680 | 7.3e-67 |

Description gp:[GI:d1016270:g1742866] [LN:D90819] [AC:D90819:AB001340] [PN:Inner membrane protein MalK] [OR:Escherichia coli] [SR:Escherichia coli (strain:K12) DNA, clone_lib:Kohara lambda minise] [DB:genpept-bct1] [DE:E.coli genomic DNA, Kohara clone #328(39.4-39.8 min.).] [NT:ORF_ID:o328#8; similar to [PIR Accession Number] [LE:10176] [RE:10916] [DI:direct]

| ORF Name | NT ID | AA ID | NT LN | AA LN | Score | P-value |
|---|---|---|---|---|---|---|
| 31878915_c1_1196 | 640 | 7811 | 1209 | 402 | | |

Description

NO-HIT

| ORF Name | NT ID | AA ID | NT LN | AA LN | Score | P-value |
|---|---|---|---|---|---|---|
| 31894831_c1_1298 | 641 | 7812 | 369 | 122 | 246 | 7.1e-21 |

Description sp:[LN:YNAJ_ECOLI] [AC:P76050] [GN:YNAJ] [OR:Escherichia coli] [DE:HYPOTHETICAL 9.3 KD PROTEIN IN TPX-FNR INTERGENIC REGION] [SP:P76050] [DB:swissprot] >sp:[LN:G64882] [AC:G64882] [PN:membrane protein ynaJ precursor:conserved hypothetical protein b1332] [OR:Escherichia coli] [DB:pir2] >gp:[GI:g1787593] [LN:AE000231] [AC:AE000231:U00096] [PN:orf, hypothetical protein] [GN:ynaJ] [FN:orf; Unknown] [OR:Escherichia coli] [DB:genpept-bct2] [DE:Escherichia coli K-12 MG1655 section 121 of 400 of the completegenome.] [NT:o85; This 85 aa ORF is 32 pct identical (0 gaps)] [LE:5467] [RE:5724] [DI:direct]

| ORF Name | NT ID | AA ID | NT LN | AA LN | Score | P-value |
|---|---|---|---|---|---|---|
| 31914537_c2_1629 | 642 | 7813 | 342 | 113 | | |

Description

NO-HIT

| ORF Name | NT ID | AA ID | NT LN | AA LN | Score | P-value |
|---|---|---|---|---|---|---|
| 32109388_f3_1123 | 643 | 7814 | 1200 | 399 | 1799 | 1.9e-185 |

Description sp:[LN:E64857] [AC:E64857:D41966] [PN:ycfD protein] [GN:ycfD] [OR:Escherichia coli] [DB:pir2] >gp:[GI:g1787373] [LN:AE000213] [AC:AE000213:U00096] [PN:orf, hypothetical protein] [GN:ycfD] [FN:orf; Unknown] [OR:Escherichia coli] [DB:genpept-bct2] [DE:Escherichia coli K-12 MG1655 section 103 of 400 of the completegenome.] [NT:f376; 100 pct identical to fragment YCFD_ECOLI] [LE:1430] [RE:2560] [DI:complement]

| ORF Name | NT ID | AA ID | NT LN | AA LN | Score | P-value |
|---|---|---|---|---|---|---|
| 32220931_c2_1607 | 644 | 7815 | 462 | 153 | | |

Description

NO-HIT

| ORF Name | NT ID | AA ID | NT LN | AA LN | Score | P-value |
|---|---|---|---|---|---|---|
| 32244061_c1_1381 | 645 | 7816 | 762 | 253 | 977 | 2.5e-98 |

Description sp:[LN:YDJC_ECOLI] [AC:P37794:P77435] [GN:YDJC] [OR:Escherichia coli] [DE:HYPOTHETICAL 27.8 KD PROTEIN IN CELF-KATE INTERGENIC REGION] [SP:P37794:P77435] [DB:swissprot] >sp:[LN:E64932] [AC:E64932] [PN:ydjC protein] [GN:ydjC] [CL:cellobiose phosphotransferase system celC] [OR:Escherichia coli] [DB:pir2] >gp:[GI:d1016237:g1742830] [LN:D90816] [AC:D90816:AB001340] [GN:ydjC] [OR:Escherichia coli] [SR:Escherichia coli (strain:K12) DNA, clone_lib:Kohara lambda minise] [DB:genpept-bct1] [DE:E.coli genomic DNA, Kohara clone #325(38.9-39.2 min.).] [NT:ORF_ID:o326#2; similar to [SwissProt Accession] [LE:8975] [RE:9724] [DI:complement] >gp:[GI:d1016245:g1742839] [LN:D90817] [AC:D90817:AB001340] [GN:ydjC] [OR:Escherichia coli] [SR:Escherichia coli (strain:K12) DNA, clone_lib:Kohara lambda minise] [DB:genpept-bct1] [DE:E.coli genomic DNA, Kohara clone #326(39.1-39.4 min.).] [NT:ORF_ID:o326#2; similar to [SwissProt Accession] [LE:1746] [RE:2495] [DI:complement] >gp:[GI:g1788028] [LN:AE000268] [AC:AE000268:U00096] [PN:orf, hypothetical protein] [GN:ydjC] [FN:orf; Unknown] [OR:Escherichia coli] [DB:genpept-bct2] [DE:Escherichia coli K-12 MG1655 section 158 of 400 of the completegenome.] [NT:f249; 87 pct identical to YDJC_ECOLI SW: P37794;] [LE:6293] [RE:7042] [DI:complement]

| ORF_Name | NT_ID | AA_ID | NT/LN | AA/LN | Score | P-value |
|---|---|---|---|---|---|---|
| 32287663_c3_2053 | 646 | 7817 | 801 | 266 | 1122 | 1.1e-113 |

Description sp:[LN:YEAF_ECOLI] [AC:P77486:O07962] [GN:YEAF] [OR:Escherichia coli]
[DE:HYPOTHETICAL 27.8 KD PROTEIN IN GAPA-RND INTERGENIC REGION PRECURSOR]
[SP:P77486:O07962] [DB:swissprot] >sp:[LN:F64938] [AC:F64938] [PN:hypothetical
protein b1782] [CL:hypothetical protein b1782] [OR:Escherichia coli] [DB:pir2]
>gp:[GI:d1016302;g1742900] [LN:D90821] [AC:D90821:AB001340] [PN:Outer membrane
protein precursor.] [OR:Escherichia coli] [SR:Escherichia coli (strain:K12) DNA,
clone_lib:Kohara lambda minise] [DB:genpept-bct1] [DE:E.coli genomic DNA, Kohara
clone #330(39.9-40.3 min.).] [NT:ORF_ID:o330#9; similar to [SwissProt Accession]
[LE:13403] [RE:14149] [DI:complement] >gp:[GI:d1016307;g1736410] [LN:D90822]
[AC:D90822:AB001340] [PN:Outer membrane protein precursor.] [OR:Escherichia coli]
[SR:Escherichia coli (strain:K12) DNA, clone_lib:Kohara lambda minise]
[DB:genpept-bct1] [DE:E.coli genomic DNA, Kohara clone #331(40.1-40.4 min.).]
[NT:ORF_ID:o330#9; similar to [SwissProt Accession] [LE:2873] [RE:3619]
[DI:complement] >gp:[GI:g1788082] [LN:AE000273] [AC:AE000273:U00096] [PN:orf,
hypothetical protein] [GN:yeaF] [FN:orf; Unknown] [OR:Escherichia coli]
[DB:genpept-bct2] [DE:Escherichia coli K-12 MG1655 section 163 of 400 of the
completegenome.] [NT:f248; This 248 aa ORF is 40 pct identical (6 gaps)]
[LE:3156] [RE:3902] [DI:complement]

| ORF_Name | NT_ID | AA_ID | NT/LN | AA/LN | Score | P-value |
|---|---|---|---|---|---|---|
| 32291080_c1_1459 | 647 | 7818 | 1209 | 402 | | |

Description

NO-HIT

| ORF_Name | NT_ID | AA_ID | NT/LN | AA/LN | Score | P-value |
|---|---|---|---|---|---|---|
| 32313556_f1_90 | 648 | 7819 | 717 | 238 | 345 | 2.3e-31 |

Description sp:[LN:YCIW_ECOLI] [AC:P76035] [GN:YCIW] [OR:Escherichia coli] [DE:HYPOTHETICAL
45.1 KD PROTEIN IN RNB-FABI INTERGENIC REGION] [SP:P76035] [DB:swissprot]
>sp:[LN:B64877] [AC:B64877] [PN:probable membrane protein yciW] [GN:yciW]
[OR:Escherichia coli] [DB:pir2] >gp:[GI:g1787544] [LN:AE000227]
[AC:AE000227:U00096] [PN:putative oxidoreductase] [GN:yciW] [FN:putative enzyme;
Not classified] [OR:Escherichia coli] [DB:genpept-bct2] [DE:Escherichia coli K-12
MG1655 section 117 of 400 of the completegenome.] [NT:f401; This 401 aa ORF is 25
pct identical (7 gaps)] [LE:64] [RE:1269] [DI:complement]

| ORF Name | NT ID | AA ID | NT LN | AA LN | Score | P-value |
|---|---|---|---|---|---|---|
| 3234662_c2_1758 | 649 | 7820 | 381 | 126 | 371 | 4.0e-34 |

Description sp:[LN:CEDA_ECOLI] [AC:P76211] [GN:CEDA] [OR:Escherichia coli] [DE:CELL DIVISION ACTIVATOR CEDA] [SP:P76211] [DB:swissprot] >sp:[LN:C64932] [AC:C64932] [PN:hypothetical protein b1731] [OR:Escherichia coli] [DB:pir2] >gp:[GI:g1788026] [LN:AE000268] [AC:AE000268:U00096] [PN:orf, hypothetical protein] [GN:b1731] [FN:orf; Unknown] [OR:Escherichia coli] [DB:genpept-bct2] [DE:Escherichia coli K-12 MG1655 section 158 of 400 of the completegenome.] [NT:f87; This 87 aa ORF is 24 pct identical (3 gaps)] [LE:3328] [RE:3591] [DI:complement]

| ORF Name | NT ID | AA ID | NT LN | AA LN | Score | P-value |
|---|---|---|---|---|---|---|
| 3241717_c2_1637 | 650 | 7821 | 351 | 116 | 217 | 8.4e-18 |

Description gp:[GI:d1047004:g5725178] [LN:AB030825] [AC:AB030825] [GN:MF2] [OR:Pseudomonas aeruginosa] [SR:Pseudomonas aeruginosa (strain:PAO1) DNA] [DB:genpept-bct1] [DE:Pseudomonas aeruginosa genomic DNA, partial sequence, strain:PAO1.] [NT:PRF32; similar to M gene of lambda and gene17 of] [LE:22854] [RE:23195] [DI:direct]

| ORF Name | NT ID | AA ID | NT LN | AA LN | Score | P-value |
|---|---|---|---|---|---|---|
| 32459633_f3_1114 | 651 | 7822 | 657 | 218 | 954 | 6.7e-96 |

Description sp:[LN:YMFC_ECOLI] [AC:P75966] [GN:YMFC] [OR:Escherichia coli] [DE:HYPOTHETICAL 24.9 KD PROTEIN IN TRMU-ICDA INTERGENIC REGION] [SP:P75966] [DB:swissprot] >gp:[GI:d1036943:g4062699] [LN:D90748] [AC:D90748:AB001340] [PN:Hypothetical protein HI0694] [OR:Escherichia coli] [SR:Escherichia coli(strain:K12) DNA, clone:Kohara clone #239] [DB:genpept-bct1] [DE:Escherichia coli genomic DNA. (25.6 - 25.9 min).] [NT:ORF_ID:o240#6; similar to PIR Accession Number] [LE:10532] [RE:11185] [DI:complement] >gp:[GI:d1036952:g4062717] [LN:D90749] [AC:D90749:AB001340] [PN:Hypothetical protein HI0694] [OR:Escherichia coli] [SR:Escherichia coli(strain:K12) DNA, clone:Kohara clone #240] [DB:genpept-bct1] [DE:Escherichia coli genomic DNA. (25.7 - 26.1 min).] [NT:ORF_ID:o240#6; similar to PIR Accession Number] [LE:4849] [RE:5502] [DI:complement]

| ORF Name | NT ID | AA ID | NT LN | AA LN | Score | P-value |
|---|---|---|---|---|---|---|
| 32463330_c1_1215 | 652 | 7823 | 411 | 136 | 572 | 2.0e-55 |

Description sp:[LN:IDH_ECOLI] [AC:P08200] [GN:ICD:ICDA:ICDE] [OR:Escherichia coli]
[EC:1.1.1.42] [DE:DECARBOXYLASE) (IDH) (NADP+-SPECIFIC ICDH) (IDP)] [SP:P08200]
[DB:swissprot] >sp:[LN:DCECIS] [AC:A28482:E64858] [PN:isocitrate dehydrogenase
(NADP+),:oxalosuccinate decarboxylase] [GN:icdA:icd:icdE] [CL:isocitrate
dehydrogenase (NADP)] [OR:Escherichia coli] [EC:1.1.1.42] [DB:pir1] [MP:25 min]
>gp:[GI:d1036944:g1651560] [LN:D90748] [AC:D90748:AB001340] [PN:Isocitrate
dehydrogenase (NADP) (EC 1.1.1.42)] [GN:icd] [OR:Escherichia coli]
[SR:Escherichia coli(strain:K12) DNA, clone:Kohara clone #239] [DB:genpept-bct1]
[DE:Escherichia coli genomic DNA. (25.6 - 25.9 min).] [NT:ORF_ID:o240#7; similar
to SwissProt Accession] [LE:11357] [RE:12607] [DI:direct]
>gp:[GI:d1036953:g1651566] [LN:D90749] [AC:D90749:AB001340] [PN:Isocitrate
dehydrogenase (NADP) (EC 1.1.1.42)] [GN:icd] [OR:Escherichia coli]
[SR:Escherichia coli(strain:K12) DNA, clone:Kohara clone #240] [DB:genpept-bct1]
[DE:Escherichia coli genomic DNA. (25.7 - 26.1 min).] [NT:ORF_ID:o240#7; similar
to SwissProt Accession] [LE:5674] [RE:6924] [DI:direct] >gp:[GI:g146432]
[LN:ECOICD] [AC:J02799] [OR:Escherichia coli] [SR:E.coli DNA, clone pTK512]
[DB:genpept-bct1] [DE:E.coli icd gene encoding isocitrate dehydrogenase, complete
cds.] [NT:isocitrate dehydrogenase (icd; EC 1.1.1.42)] [LE:291] [RE:1541]
[DI:direct] >gp:[GI:g1787381] [LN:AE000213] [AC:AE000213:U00096] [PN:isocitrate
dehydrogenase, specific for NADP+] [GN:icdA] [FN:enzyme; Energy metabolism,
carbon: TCA cycle] [OR:Escherichia coli] [DB:genpept-bct2] [EC:1.1.1.42]
[DE:Escherichia coli K-12 MG1655 section 103 of 400 of the completegenome.]
[NT:o416; 100 pct identical to IDH_ECOLI SW: P08200] [LE:9434] [RE:10684]
[DI:direct]

| ORF Name | NT ID | AA ID | NT LN | AA LN | Score | P-value |
|---|---|---|---|---|---|---|
| 32510300_c2_1872 | 653 | 7824 | 1044 | 347 | 1354 | 2.8e-138 |

Description sp:[LN:YCJG_ECOLI] [AC:P51981:P51982:P76048:P77345] [GN:YCJG] [OR:Escherichia
coli] [DE:HYPOTHETICAL 34.7 KD PROTEIN IN TPX-FNR INTERGENIC REGION]
[SP:P51981:P51982:P76048:P77345] [DB:swissprot] >gp:[GI:d1015623:g1742170]
[LN:D90770] [AC:D90770:AB001340] [GN:ycjG] [OR:Escherichia coli] [SR:Escherichia
coli (strain:K12) DNA, clone_lib:Kohara lambda minise] [DB:genpept-bct1]
[DE:E.coli genomic DNA, Kohara clone #259(29.6-30.0 min.).] [NT:ORF_ID:o260#8;
similar to [SwissProt Accession] [LE:15510] [RE:16475] [DI:direct]
>gp:[GI:d1015634:g1742182] [LN:D90771] [AC:D90771:AB001340] [GN:ycjG]
[OR:Escherichia coli] [SR:Escherichia coli (strain:K12) DNA, clone_lib:Kohara
lambda minise] [DB:genpept-bct1] [DE:E.coli genomic DNA, Kohara clone
260(29.8-30.2 min.).] [NT:ORF_ID:o260#8; similar to [SwissProt Accession]
[LE:7403] [RE:8368] [DI:direct]

| ORF Name | NT ID | AA ID | NT/LN | AA/LN | Score | P-value |
|---|---|---|---|---|---|---|
| 32660828_f3_909 | 654 | 7825 | 783 | 260 | 206 | 1.2e-16 |

Description sp:[LN:CSGA_MYXXA] [AC:P21158] [GN:CSGA:SPOC] [OR:Myxococcus xanthus]
[DE:C-FACTOR (C SIGNAL)] [SP:P21158] [DB:swissprot] >sp:[LN:T10125]
[AC:T10125:A34687:S36091] [PN:developmental protein C-factor:csgA protein]
[GN:csgA] [CL:short-chain alcohol dehydrogenase homology] [OR:Myxococcus xanthus]
[DB:pir2] >gp:[GI:g150084] [LN:MXADK162] [AC:M29288] [GN:csgA] [OR:Myxococcus
xanthus] [SR:M.xanthus (DK 1622) DNA] [DB:genpept-bct1] [DE:M.xanthus csg locus
encoding csgA and fprA protein genes.] [LE:592] [RE:1092] [DI:direct]

| ORF Name | NT ID | AA ID | NT/LN | AA/LN | Score | P-value |
|---|---|---|---|---|---|---|
| 32666641_f3_1136 | 655 | 7826 | 204 | 67 | | |

Description

NO-HIT

| ORF Name | NT ID | AA ID | NT/LN | AA/LN | Score | P-value |
|---|---|---|---|---|---|---|
| 3304680_f2_623 | 656 | 7827 | 1821 | 606 | 545 | 1.5e-52 |

Description sp:[LN:S76977] [AC:S76977] [PN:pleD-4 protein:protein slr0302:protein slr0302]
[GN:pleD-4] [OR:Synechocystis sp.] [SR:PCC 6803, , PCC 6803] [SR:PCC 6803, ]
[DB:pir2] >gp:[GI:d1011320:g1001789] [LN:SYCSLRG] [AC:D64005:AB001339] [PN:PleD
gene product] [GN:pleD] [OR:Synechocystis sp.] [SR:Synechocystis sp.
(strain:PCC6803) DNA] [DB:genpept-bct1] [DE:Synechocystis sp. PCC6803 complete
genome, 24/27, 3002966-3138603.] [NT:ORF_ID:slr0302] [LE:11424] [RE:13730]
[DI:direct]

| ORF Name | NT ID | AA ID | NT/LN | AA/LN | Score | P-value |
|---|---|---|---|---|---|---|
| 33250015_c1_1330 | 657 | 7828 | 468 | 155 | 675 | 2.5e-66 |

Description sp:[LN:YEAA_ECOLI] [AC:P39903:P76232] [GN:YEAA] [OR:Escherichia coli]
[DE:HYPOTHETICAL 15.5 KD PROTEIN IN ANSA-GAPA INTERGENIC REGION]
[SP:P39903:P76232] [DB:swissprot] >sp:[LN:B64938] [AC:B64938] [PN:hypothetical
protein b1778] [DB:pir1] [CL:hypthetical protein YCL033c] [OR:Escherichia coli] [DB:pir1]
>gp:[GI:g1788077] [LN:AE000272] [AC:AE000272:U00096] [PN:orf, hypothetical
protein] [GN:yeaA] [FN:orf; Unknown] [OR:Escherichia coli] [DB:genpept-bct2]
[DE:Escherichia coli K-12 MG1655 section 162 of 400 of the completegenome.]
[NT:f137; This 137 aa ORF is 56 pct identical (4 gaps)] [LE:9472] [RE:9885]
[DI:complement]

| ORF Name | NT ID | AA ID | NT LN | AA LN | Score | P-value |
|---|---|---|---|---|---|---|
| 33288285_f3_886 | 658 | 7829 | 279 | 92 | | |

Description

NO-HIT

| ORF Name | NT ID | AA ID | NT LN | AA LN | Score | P-value |
|---|---|---|---|---|---|---|
| 33360302_f3_881 | 659 | 7830 | 363 | 120 | 95 | 7.1e-05 |

Description sp:[LN:FUR3_BACSU] [AC:P71086] [GN:YGAG] [OR:Bacillus subtilis] [DE:FERRIC UPTAKE
REGULATION PROTEIN HOMOLOG 3] [SP:P71086] [DB:swissprot] >sp:[LN:B69816]
[AC:B69816] [PN:transcription regulator Fur family homolog ygaG] [GN:ygaG]
[CL:ferric uptake regulator] [OR:Bacillus subtilis] [DB:pir2]
>gp:[GI:e1182862:g2633196] [LN:BSUB0005] [AC:Z99108:AL009126] [GN:ygaG]
[FN:unknown] [OR:Bacillus subtilis] [DB:genpept-bct1] [DE:Bacillus subtilis
complete genome (section 5 of 21): from 802821 to1011250.] [NT:similar to
transcriptional regulator (Fur family)] [SP:P71086] [LE:141173] [RE:141610]
[DI:direct] >gp:[GI:e281583:g1673396] [LN:BSZ82044] [AC:Z82044] [PN:hypothetical
16.4 kd protein] [GN:ygaG] [OR:Bacillus subtilis] [DB:genpept-bct1]
[DE:B.subtilis 25 kb genomic DNA segment (from sspE to katA).] [NT:homology to
ferric uptake regulation protein] [SP:P71086] [LE:8023] [RE:8460] [DI:direct]

| ORF Name | NT ID | AA ID | NT LN | AA LN | Score | P-value |
|---|---|---|---|---|---|---|
| 33367818_c2_1625 | 660 | 7831 | 192 | 63 | 126 | 3.7e-08 |

Description sp:[LN:YMFR_ECOLI] [AC:P75979] [GN:YMFR] [OR:Escherichia coli] [DE:HYPOTHETICAL
6.4 KD PROTEIN IN INTE-PIN INTERGENIC REGION] [SP:P75979] [DB:swissprot]
>sp:[LN:C64860] [AC:C64860] [PN:hypothetical protein b1150] [OR:Escherichia coli]
[DB:pir2] >gp:[GI:d1036962:g4062725] [LN:D90749] [AC:D90749:AB001340]
[OR:Escherichia coli] [SR:Escherichia coli(strain:K12) DNA, clone:Kohara clone
240] [DB:genpept-bct1] [DE:Escherichia coli genomic DNA. (25.7 - 26.1 min).]
[NT:ORF_ID:o241#6] [LE:16100] [RE:16282] [DI:direct] >gp:[GI:d1036974:g4062736]
[LN:D90750] [AC:D90750:AB001340] [OR:Escherichia coli] [SR:Escherichia
coli(strain:K12) DNA, clone:Kohara clone #241] [DB:genpept-bct1] [DE:Escherichia
coli genomic DNA. (26.0 - 26.3 min).] [NT:ORF_ID:o241#6] [LE:3747] [RE:3929]
[DI:direct] >gp:[GI:g1787396] [LN:AE000214] [AC:AE000214:U00096] [PN:orf,
hypothetical protein] [GN:ymfR] [FN:orf; Unknown] [OR:Escherichia coli]
[DB:genpept-bct2] [DE:Escherichia coli K-12 MG1655 section 104 of 400 of the
completegenome.] [NT:o60; This 60 aa ORF is 36 pct identical (3 gaps)] [LE:8959]
[RE:9141] [DI:direct]

| ORF_Name | NT_ID | AA_ID | NT LN | AA LN | Score | P-value |
|---|---|---|---|---|---|---|
| 33400280_f1_93 | 661 | 7832 | 252 | 83 | 310 | 1.2e-27 |

Description sp:[LN:OSMB_ECOLI] [AC:P17873] [GN:OSMB] [OR:Escherichia coli] [DE:OSMOTICALLY
INDUCIBLE LIPOPROTEIN B PRECURSOR] [SP:P17873] [DB:swissprot] >sp:[LN:LPECOB]
[AC:A32255;F64876] [PN:lipoprotein B precursor, osmotically inducible] [GN:osmB]
[CL:osmotically inducible lipoprotein omsB] [OR:Escherichia coli] [DB:pir1]
[MP:28 min] >gp:[GI:d1015553;g1742097] [LN:D90766] [AC:D90766;AB001340]
[PN:Lipoprotein osmB precursor, osmotically] [GN:osmB] [OR:Escherichia coli]
[SR:Escherichia coli (strain:K12) DNA, clone_lib:Kohara lambda minise]
[DB:genpept-bct1] [DE:E.coli genomic DNA, Kohara clone #255(28.8-29.2 min.).]
[NT:ORF_ID:o255#8; similar to [PIR Accession Number] [LE:5375] [RE:5593]
[DI:complement] >gp:[GI:g147040] [LN:ECOOSMB] [AC:M22859] [GN:osmB]
[OR:Escherichia coli] [SR:E.coli (strain K12; MPh2) DNA, clones pTZ[18U,19U]]
[DB:genpept-bct1] [DE:E.coli osmB gene encoding OsmB protein, complete cds.]
[LE:304] [RE:522] [DI:direct] >gp:[GI:g1787539] [LN:AE000226]
[AC:AE000226;U00096] [PN:osmotically inducible lipoprotein] [GN:osmB]
[FN:putative membrane; Osmotic adaptation] [OR:Escherichia coli]
[DB:genpept-bct2] [DE:Escherichia coli K-12 MG1655 section 116 of 400 of the
completegenome.] [NT:f72; 100 pct identical to OSMB_ECOLI SW: P17873; CG]
[LE:4602] [RE:4820] [DI:complement]

| ORF_Name | NT_ID | AA_ID | NT LN | AA LN | Score | P-value |
|---|---|---|---|---|---|---|
| 33455378_c3_2062 | 662 | 7833 | 1425 | 474 | | |

Description

NO-HIT

| ORF_Name | NT_ID | AA_ID | NT LN | AA LN | Score | P-value |
|---|---|---|---|---|---|---|
| 33484781_c3_2063 | 663 | 7834 | 1272 | 423 | 771 | 1.7e-76 |

Description sp:[LN:YDJA_ECOLI] [AC:P24250] [GN:YDJA] [OR:Escherichia coli] [DE:HYPOTHETICAL
20.1 KD PROTEIN IN SELD-SPPA INTERGENIC REGION (ORF183)] [SP:P24250]
[DB:swissprot] >sp:[LN:A40360] [AC:A40360;E64936] [PN:hypothetical protein, 20K
(selD-sppA intergenic region)] [GN:ydjA] [OR:Escherichia coli] [DB:pir2]
>gp:[GI:d1016279;g1742876] [LN:D90820] [AC:D90820;AB001340] [GN:ydjA]
[OR:Escherichia coli] [SR:Escherichia coli (strain:K12) DNA, clone_lib:Kohara
lambda minise] [DB:genpept-bct1] [DE:E.coli genomic DNA, Kohara clone
329(39.7-40.0 min.).] [NT:ORF_ID:o329#2; similar to [PIR Accession Number]
[LE:4982] [RE:5533] [DI:complement] >gp:[GI:g147021] [LN:ECOORF183] [AC:M68961]
[OR:Escherichia coli] [SR:Escherichia coli DNA] [DB:genpept-bct1] [DE:Escherichia
coli ORF183 gene, complete cds and selD gene, 5' end.] [NT:ORF183] [LE:106]
[RE:657] [DI:direct] >gp:[GI:g1788063] [LN:AE000271] [AC:AE000271;U00096]
[PN:orf, hypothetical protein] [GN:ydjA] [FN:orf; Unknown] [OR:Escherichia coli]
[DB:genpept-bct2] [DE:Escherichia coli K-12 MG1655 section 161 of 400 of the
completegenome.] [NT:f183; 100 pct identical to YDJA_ECOLI SW: P24250;] [LE:5902]
[RE:6453] [DI:complement]

| ORF Name | NT ID | AA ID | NT LN | AA LN | Score | P-value |
|---|---|---|---|---|---|---|
| 33600787_f1_78 | 664 | 7835 | 507 | 168 | 287 | 3.2e-25 |

Description gp:[GI:e1420188:g4539255] [LN:SPBC2A9] [AC:AL049495] [PN:hypothetical protein]
[GN:SPBC2A9.02] [OR:Schizosaccharomyces pombe] [SR:fission yeast]
[DB:genpept-pln1] [DE:S.pombe chromosome I cosmid c2A9_3p.] [NT:SPBC2A9.02,
len:295, SIMILARITY:Saccharomyces] [LE:2272] [RE:3159] [DI:direct]

| ORF Name | NT ID | AA ID | NT LN | AA LN | Score | P-value |
|---|---|---|---|---|---|---|
| 33679182_c3_2083 | 665 | 7836 | 1476 | 491 | 292 | 1.4e-22 |

Description sp:[LN:S27923] [AC:S27923] [PN:gene LF3 protein] [OR:human herpesvirus
4:Epstein-Barr virus] [DB:pir2] >gp:[GI:g330421] [LN:HS4RAJI] [AC:M35547]
[OR:Human herpesvirus 4] [SR:Epstein-Barr virus (strain Raji) DNA]
[DB:genpept-vrl] [DE:Epstein-Barr virus Raji strain, sequences spanning the large
B95-8deletion.] [NT:LF3 gene product] [LE:851] [RE:3625] [DI:complement]

| ORF Name | NT ID | AA ID | NT LN | AA LN | Score | P-value |
|---|---|---|---|---|---|---|
| 33692692_f3_995 | 666 | 7837 | 438 | 145 | 112 | 1.8e-08 |

Description sp:[LN:EXLP_TOBAC] [AC:Q03211] [OR:Nicotiana tabacum] [SR:,Common tobacco]
[DE:PISTIL-SPECIFIC EXTENSIN-LIKE PROTEIN PRECURSOR (PELP)] [SP:Q03211]
[DB:swissprot] >sp:[LN:JQ1696] [AC:JQ1696:S24621] [PN:pistil extensin-like
protein precursor (clone pMG15)] [OR:Nicotiana tabacum] [SR:, common tobacco]
[DB:pir2] >gp:[GI:g19929] [LN:NTPMG15] [AC:Z14019:S48638] [PN:pistil extensin
like protein] [FN:unknown] [OR:Nicotiana tabacum] [SR:common tobacco]
[DB:genpept-pln1] [DE:N.tabacum mRNA for pistil extensin like protein.]
[SP:Q03211] [LE:11] [RE:1291] [DI:direct]

| ORF Name | NT ID | AA ID | NT LN | AA LN | Score | P-value |
|---|---|---|---|---|---|---|
| 33705191_f2_501 | 667 | 7838 | 222 | 73 | 104 | 7.9e-06 |

Description sp:[LN:D71162] [AC:D71162] [PN:hypothetical protein PH0497] [GN:PH0497]
[CL:Pyrococcus horikoshii hypothetical protein PH0497] [OR:Pyrococcus horikoshii]
[DB:pir2] >gp:[GI:d1030528:g3256902] [LN:AP000002]
[AC:AP000002:AB009475:AB009476:AB009477:AB009478:AB009479:AB009480] [PN:126aa
long hypothetical protein] [GN:PH0497] [OR:Pyrococcus horikoshii] [SR:Pyrococcus
horikoshii (strain:OT3) DNA] [DB:genpept-bct1] [DE:Pyrococcus horikoshii OT3
genomic DNA, 287001-544000 nt. position(2/7).] [LE:162558] [RE:162938]
[DI:direct]

| ORF Name | NT ID | AA ID | NT/LN | AA/LN | Score | P-value |
|---|---|---|---|---|---|---|
| 33713882_c1_1226 | 668 | 7839 | 609 | 202 | 172 | 4.9e-13 |

Description sp:[LN:RPC2_BPPH8] [AC:P14820] [GN:CII] [OR:Bacteriophage phi-80] [DE:REGULATORY PROTEIN CII] [SP:P14820] [DB:swissprot] >sp:[LN:S04830] [AC:S04830] [PN:regulatory protein cII] [GN:cII] [OR:phage phi-80] [DB:pir2] >gp:[GI:g579068] [LN:BP80ER] [AC:X13065:M37383] [OR:Bacteriophage phi-80] [DB:genpept-phg] [DE:Bacteriophage phi80 early region.] [NT:cII gene (AA 1 - 132)] [SP:P14820] [LE:3750] [RE:4148] [DI:direct]

| ORF Name | NT ID | AA ID | NT/LN | AA/LN | Score | P-value |
|---|---|---|---|---|---|---|
| 33723437_c3_2048 | 669 | 7840 | 612 | 203 | | |

Description

NO-HIT

| ORF Name | NT ID | AA ID | NT/LN | AA/LN | Score | P-value |
|---|---|---|---|---|---|---|
| 33725662_f3_1041 | 670 | 7841 | 516 | 171 | 284 | 6.7e-25 |

Description gp:[GI:d1042606:g5103195] [LN:AP000342] [AC:AP000342] [GN:ydjA] [OR:Plasmid R100] [SR:Plasmid R100 (specific_host:Shigella flexneri 2b strain 222] [DB:genpept-bct1] [DE:Plasmid R100 genomic DNA.] [NT:24% identical (1 gap) to 102 residues of 114 aa] [LE:39462] [RE:39782] [DI:direct] >gp:[GI:g5738086] [LN:AF162223] [AC:AF162223] [PN:JemB] [GN:jemB] [OR:Shigella flexneri] [DB:genpept-bct2] [DE:Shigella flexneri transposon Tn10 IS10-left transposase, JemA(jemA), JemB (jemB), JemC (jemC), TetR (tetR), TetA (tetA), TetC(tetC), TetD (tetD), and IS10-right transposase genes, completecds.] [NT:similar to a Bacillus subtilits hypothetical] [LE:3331] [RE:3651] [DI:direct]

| ORF Name | NT ID | AA ID | NT/LN | AA/LN | Score | P-value |
|---|---|---|---|---|---|---|
| 33756391_c3_2162 | 671 | 7842 | 1182 | 393 | 1653 | 5.7e-170 |

Description sp:[LN:CYSB_KLEAE] [AC:P45600] [GN:CYSB] [OR:Klebsiella aerogenes] [DE:CYS REGULON TRANSCRIPTIONAL ACTIVATOR] [SP:P45600] [DB:swissprot] >sp:[LN:S43835] [AC:S43835] [PN:regulatory protein cysB] [GN:cysB] [CL:regulatory protein lysR] [OR:Klebsiella sp.] [SR:ATCC 15380, , ATCC 15380] [SR:ATCC 15380, ] [DB:pir2]

| ORF Name | NT ID | AA ID | NT LN | AA LN | Score | P-value |
|---|---|---|---|---|---|---|
| 33782031_f2_457 | 672 | 7843 | 771 | 256 | 915 | 9.1e-92 |

Description sp:[LN:YCIT_ECOLI] [AC:P76034] [GN:YCIT] [OR:Escherichia coli] [DE:HYPOTHETICAL TRANSCRIPTIONAL REGULATOR IN OSMB-RNB INTERGENIC REGION] [SP:P76034] [DB:swissprot] >sp:[LN:G64876] [AC:G64876] [PN:hypothetical protein b1284] [CL:regulatory protein gutR] [OR:Escherichia coli] [DB:pir2] >gp:[GI:g1787540] [LN:AE000226] [AC:AE000226:U00096] [PN:putative DEOR-type transcriptional regulator] [GN:b1284] [FN:putative regulator; Not classified] [OR:Escherichia coli] [DB:genpept-bct2] [DE:Escherichia coli K-12 MG1655 section 116 of 400 of the completegenome.] [NT:f249; This 249 aa ORF is 32 pct identical (8 gaps)] [LE:5089] [RE:5838] [DI:complement]

| ORF Name | NT ID | AA ID | NT LN | AA LN | Score | P-value |
|---|---|---|---|---|---|---|
| 33796956_f2_584 | 673 | 7844 | 369 | 122 | 594 | 9.4e-58 |

Description sp:[LN:B64770] [AC:B64770:JQ0698:S12303] [PN:yajD protein] [GN:yajD] [OR:Escherichia coli] [DB:pir2] >gp:[GI:g1773094] [LN:ECU82664] [AC:U82664] [PN:hypothetical 12.6kd protein] [GN:yajD] [OR:Escherichia coli] [DB:genpept-bct1] [DE:Escherichia coli minutes 9 to 11 genomic sequence.] [LE:10055] [RE:10402] [DI:direct] >gp:[GI:g1786611] [LN:AE000147] [AC:AE000147:U00096] [PN:orf, hypothetical protein] [GN:yajD] [OR:Escherichia coli] [DB:genpept-bct2] [DE:Escherichia coli K-12 MG1655 section 37 of 400 of the completegenome.] [NT:o115; 100 pct identical to 108 residues of] [LE:8198] [RE:8545] [DI:direct]

| ORF Name | NT ID | AA ID | NT LN | AA LN | Score | P-value |
|---|---|---|---|---|---|---|
| 33830090_f3_1099 | 674 | 7845 | 240 | 79 | | |

Description

NO-HIT

| ORF Name | NT ID | AA ID | NT LN | AA LN | Score | P-value |
|---|---|---|---|---|---|---|
| 33836463_c3_1994 | 675 | 7846 | 183 | 60 | 251 | 4.7e-21 |

Description sp:[LN:IDH_ECOLI] [AC:P08200] [GN:ICD:ICDA:ICDE] [OR:Escherichia coli]
[EC:1.1.1.42] [DE:DECARBOXYLASE) (IDH) (NADP+-SPECIFIC ICDH) (IDP)] [SP:P08200]
[DB:swissprot] >sp:[LN:DCECIS] [AC:A28482:E64858] [PN:isocitrate dehydrogenase
(NADP+),:oxalosuccinate decarboxylase] [GN:icdA:icd:icdE] [CL:isocitrate
dehydrogenase (NADP)] [OR:Escherichia coli] [EC:1.1.1.42] [DB:pir1] [MP:25 min]
>gp:[GI:d1036944:g1651560] [LN:D90748] [AC:D90748:AB001340] [PN:Isocitrate
dehydrogenase (NADP) (EC 1.1.1.42)] [GN:icd] [OR:Escherichia coli]
[SR:Escherichia coli(strain:K12) DNA, clone:Kohara clone #239] [DB:genpept-bct1]
[DE:Escherichia coli genomic DNA. (25.6 - 25.9 min).] [NT:ORF_ID:o240#7; similar
to SwissProt Accession] [LE:11357] [RE:12607] [DI:direct]
>gp:[GI:d1036953:g1651566] [LN:D90749] [AC:D90749:AB001340] [PN:Isocitrate
dehydrogenase (NADP) (EC 1.1.1.42)] [GN:icd] [OR:Escherichia coli]
[SR:Escherichia coli(strain:K12) DNA, clone:Kohara clone #240] [DB:genpept-bct1]
[DE:Escherichia coli genomic DNA. (25.7 - 26.1 min).] [NT:ORF_ID:o240#7; similar
to SwissProt Accession] [LE:5674] [RE:6924] [DI:direct] >gp:[GI:g146432]
[LN:ECOICD] [AC:J02799] [OR:Escherichia coli] [SR:E.coli DNA, clone pTK512]
[DB:genpept-bct1] [DE:E.coli icd gene encoding isocitrate dehydrogenase, complete
cds.] [NT:isocitrate dehydrogenase (icd; EC 1.1.1.42)] [LE:291] [RE:1541]
[DI:direct] >gp:[GI:g1787381] [LN:AE000213] [AC:AE000213:U00096] [PN:isocitrate
dehydrogenase, specific for NADP+] [GN:icdA] [FN:enzyme; Energy metabolism,
carbon: TCA cycle] [OR:Escherichia coli] [DB:genpept-bct2] [EC:1.1.1.42]
[DE:Escherichia coli K-12 MG1655 section 103 of 400 of the completegenome.]
[NT:o416; 100 pct identical to IDH_ECOLI SW: P08200] [LE:9434] [RE:10684]
[DI:direct]

| ORF Name | NT ID | AA ID | NT LN | AA LN | Score | P-value |
|---|---|---|---|---|---|---|
| 3384591_c1_1271 | 676 | 7847 | 201 | 66 | | |

Description

NO-HIT

| ORF Name | NT ID | AA ID | NT LN | AA LN | Score | P-value |
|---|---|---|---|---|---|---|
| 33855431_c2_1573 | 677 | 7848 | 414 | 137 | | |

Description

NO-HIT

300

| ORF Name | NT ID | AA ID | NT/LN | AA/LN | Score | P-value |
|---|---|---|---|---|---|---|
| 33866680_f2_514 | 678 | 7849 | 1770 | 589 | 2428 | 4.3e-252 |

Description sp:[LN:YBIL_ECOLI] [AC:P75780] [GN:YBIL] [OR:Escherichia coli] [DE:PROBABLE TONB-DEPENDENT RECEPTOR YBIL PRECURSOR] [SP:P75780] [DB:swissprot] >sp:[LN:E64817] [AC:E64817] [PN:probable membrane protein b0805] [OR:Escherichia coli] [DB:pir2] >gp:[GI:d1036457;g4062366] [LN:D90717] [AC:D90717:AB001340] [PN:Fe(III)-pyochelin receptor fptA precursor] [GN:fptA] [OR:Escherichia coli] [SR:Escherichia coli(strain:K12) DNA, clone:Kohara clone #204] [DB:genpept-bct1] [DE:Escherichia coli genomic DNA. (17.9 - 18.2 min).] [NT:ORF_ID:o205#1; similar to PIR Accession Number] [LE:10551] [RE:12833] [DI:complement] >gp:[GI:d1036462;g4062371] [LN:D90718] [AC:D90718:AB001340] [PN:Fe(III)-pyochelin receptor fptA precursor] [GN:fptA] [OR:Escherichia coli] [SR:Escherichia coli(strain:K12) DNA, clone:Kohara clone #205] [DB:genpept-bct1] [DE:Escherichia coli genomic DNA. (18.1 - 18.4 min).] [NT:ORF_ID:o205#1; similar to PIR Accession Number] [LE:567] [RE:2849] [DI:complement] >gp:[GI:g1787024] [LN:AE000182] [AC:AE000182:U00096] [PN:putative outer membrane receptor for iron] [GN:b0805] [FN:putative membrane; Not classified] [OR:Escherichia coli] [DB:genpept-bct2] [DE:Escherichia coli K-12 MG1655 section 72 of 400 of the completegenome.] [NT:f760; This 760 aa ORF is 25 pct identical (75 gaps)] [LE:8516] [RE:10798] [DI:complement]

| ORF Name | NT ID | AA ID | NT/LN | AA/LN | Score | P-value |
|---|---|---|---|---|---|---|
| 33877312_c2_1911 | 679 | 7850 | 489 | 162 | | |

Description

NO-HIT

| ORF Name | NT ID | AA ID | NT/LN | AA/LN | Score | P-value |
|---|---|---|---|---|---|---|
| 33880202_c3_1986 | 680 | 7851 | 3366 | 1121 | 261 | 3.4e-23 |

Description gp:[GI:d1047003;g5725177] [LN:AB030825] [AC:AB030825] [GN:HF2] [OR:Pseudomonas aeruginosa] [SR:Pseudomonas aeruginosa (strain:PAO1) DNA] [DB:genpept-bct1] [DE:Pseudomonas aeruginosa genomic DNA, partial sequence, strain:PAO1.] [NT:PRF31; similar to H gene of lambda and gene16 of] [LE:21026] [RE:22861] [DI:direct]

| ORF Name | NT ID | AA ID | NT LN | AA LN | Score | P-value |
|---|---|---|---|---|---|---|
| 3398450_c3_1973 | 681 | 7852 | 498 | 165 | 168 | 1.3e-12 |

Description sp:[LN:LEXA_ECOLI] [AC:P03033] [GN:LEXA:EXRA:SPR:TSL:UMUA] [OR:Escherichia coli]
[EC:3.4.21.88] [DE:LEXA REPRESSOR,] [SP:P03033] [DB:swissprot] >sp:[LN:ILEC]
[AC:A90808:A93734:S11945:B65212:A03569] [PN:lexA repressor] [GN:lexA] [CL:lexA
repressor] [OR:Escherichia coli] [DB:pir1] [MP:92 min] >gp:[GI:g146608]
[LN:ECOLEXA] [AC:J01643:V00299:V00300] [OR:Escherichia coli] [SR:Escherichia coli
DNA] [DB:genpept-bct1] [DE:E.coli lexA gene coding for SOS function regulatory
protein.] [NT:SOS function regulatory protein (lexA)] [LE:102] [RE:710]
[DI:direct] >gp:[GI:g1790476] [LN:AE000477] [AC:AE000477:U00096] [PN:regulator
for SOS(lexA) regulon] [GN:lexA] [FN:regulator; Global regulatory functions]
[OR:Escherichia coli] [DB:genpept-bct2] [DE:Escherichia coli K-12 MG1655 section
367 of 400 of the completegenome.] [NT:o202b; CG Site No. 558] [LE:9210]
[RE:9818] [DI:direct] >gp:[GI:g396378] [LN:ECOUW89] [AC:U00006] [GN:lexA]
[FN:regulatory gene for SOS regulon] [OR:Escherichia coli] [SR:Escherichia coli
(sub_strain MG1655, strain K-12) (library: lambda] [DB:genpept-bct2] [DE:E. coli
chromosomal region from 89.2 to 92.8 minutes.] [NT:CG Site No. 558] [LE:122357]
[RE:122965] [DI:direct]

| ORF Name | NT ID | AA ID | NT LN | AA LN | Score | P-value |
|---|---|---|---|---|---|---|
| 33988133_f3_880 | 682 | 7853 | 285 | 94 | | |

Description

NO-HIT

| ORF Name | NT ID | AA ID | NT LN | AA LN | Score | P-value |
|---|---|---|---|---|---|---|
| 34164561_f1_359 | 683 | 7854 | 2226 | 741 | 2818 | 2.0e-293 |

Description gp:[GI:g5532466] [LN:AF141323] [AC:AF141323] [PN:IutA] [GN:iutA] [OR:Shigella
flexneri] [DB:genpept-bct2] [DE:Shigella flexneri SHI-2 pathogenicity island,
complete sequence.] [LE:20096] [RE:22294] [DI:direct]

| ORF Name | NT ID | AA ID | NT/LN | AA/LN | Score | P-value |
|---|---|---|---|---|---|---|
| 34177086_f1_111 | 684 | 7855 | 825 | 274 | 1111 | 1.5e-112 |

Description sp:[LN:YCIK_ECOLI] [AC:P31808:P77516] [GN:YCIK] [OR:Escherichia coli]
[EC:1.-.-.-] [DE:(EC 1.-.-.-)] [SP:P31808:P77516] [DB:swissprot] >sp:[LN:B64875]
[AC:B64875] [PN:probable dehydrogenase, yciK] [GN:yciK] [CL:short-chain alcohol
dehydrogenase homology] [OR:Escherichia coli] [EC:1.1.1.-] [DB:pir2]
>gp:[GI:d1015524:g1742066] [LN:D90764] [AC:D90764:AB001340] [PN:Internalin B]
[GN:yciK] [OR:Escherichia coli] [SR:Escherichia coli (strain:K12) DNA,
clone_lib:Kohara lambda minise] [DB:genpept-bct1] [DE:E.coli genomic DNA, Kohara
clone #253(28.4-28.7 min.).] [NT:ORF_ID:o253#11; similar to [PIR Accession
Number] [LE:10974] [RE:11732] [DI:complement] >gp:[GI:d1015539:g1742082]
[LN:D90765] [AC:D90765:AB001340] [PN:Internalin B] [GN:yciK] [OR:Escherichia
coli] [SR:Escherichia coli (strain:K12) DNA, clone_lib:Kohara lambda minise]
[DB:genpept-bct1] [DE:E.coli genomic DNA, Kohara clone #254(28.4-28.9 min.).]
[NT:ORF_ID:o253#11; similar to [PIR Accession Number] [LE:8480] [RE:9238]
[DI:complement] >gp:[GI:g1787526] [LN:AE000225] [AC:AE000225:U00096] [PN:putative
oxidoreductase] [GN:yciK] [FN:putative enzyme; Not classified] [OR:Escherichia
coli] [DB:genpept-bct2] [DE:Escherichia coli K-12 MG1655 section 115 of 400 of
the completegenome.] [NT:f252; 98 pct identical to YCIK_ECOLI SW: P31808]
[LE:1638] [RE:2396] [DI:complement]

| ORF Name | NT ID | AA ID | NT/LN | AA/LN | Score | P-value |
|---|---|---|---|---|---|---|
| 34179677_c2_1691 | 685 | 7856 | 1242 | 413 | 300 | 1.3e-26 |

Description gp:[GI:g5006985] [LN:AF146532] [AC:AF146532] [PN:putative Heptosyl transferase]
[OR:Klebsiella pneumoniae] [DB:genpept-bct2] [DE:Klebsiella pneumoniae waa gene
cluster.] [NT:similar to a segment of heptosyl I transferases] [LE:5373]
[RE:6413] [DI:complement]

| ORF Name | NT ID | AA ID | NT/LN | AA/LN | Score | P-value |
|---|---|---|---|---|---|---|
| 34188261_f2_498 | 686 | 7857 | 837 | 278 | 1357 | 1.3e-138 |

Description sp:[LN:TRPA_KLEAE] [AC:P00930] [GN:TRPA] [OR:Klebsiella aerogenes] [EC:4.2.1.20]
[DE:TRYPTOPHAN SYNTHASE ALPHA CHAIN,] [SP:P00930] [DB:swissprot] >gp:[GI:g43784]
[LN:KATRPA] [AC:V00630] [OR:Klebsiella aerogenes] [DB:genpept-bct1] [DE:K.
aerogenes trpA gene encoding tryptophan synthetase (alphapolypeptide).]
[NT:reading frame trpA] [SP:P00930] [LE:60] [RE:869] [DI:direct] >gp:[GI:g149328]
[LN:KPNTRPA] [AC:J01738] [OR:Klebsiella aerogenes] [SR:klebsiella aerogenes]
[DB:genpept-bct1] [DE:klebsiella aerogenes tryptophan operon trpa gene.]
[NT:trpa] [LE:60] [RE:869] [DI:direct]

| ORF Name | NT ID | AA ID | NT/LN | AA/LN | Score | P-value |
|---|---|---|---|---|---|---|
| 34196081_f1_9 | 687 | 7858 | 441 | 146 | | |

Description

NO-HIT

| ORF Name | NT ID | AA ID | NT/LN | AA/LN | Score | P-value |
|---|---|---|---|---|---|---|
| 34414093_c3_1942 | 688 | 7859 | 1731 | 576 | 135 | 1.5e-07 |

Description gp:[GI:e1512354:g5441780] [LN:SCI30A] [AC:AL096811] [PN:putative aldehyde dehydrogenase] [GN:SCI30A.27c] [OR:Streptomyces coelicolor A3(2)] [DB:genpept-bct1] [DE:Streptomyces coelicolor cosmid I30A.] [NT:SCI30A.27c, probable aldehyde dehydrogenase, len:] [LE:26139] [RE:27527] [DI:complement]

| ORF Name | NT ID | AA ID | NT/LN | AA/LN | Score | P-value |
|---|---|---|---|---|---|---|
| 34416632_c3_2199 | 689 | 7860 | 1068 | 355 | 1540 | 5.4e-158 |

Description sp:[LN:YCJF_ECOLI] [AC:P45525:P77177] [GN:YCJF] [OR:Escherichia coli] [DE:HYPOTHETICAL 39.4 KD PROTEIN IN PSPE-TYRR INTERGENIC REGION] [SP:P45525:P77177] [DB:swissprot] >sp:[LN:E64881] [AC:E64881] [PN:membrane protein ycjF] [GN:ycjF] [CL:hypothetical protein HI0043] [OR:Escherichia coli] [DB:pir2] >gp:[GI:d1015619:g1742166] [LN:D90770] [AC:D90770:AB001340] [OR:Escherichia coli] [SR:Escherichia coli (strain:K12) DNA, clone_lib:Kohara lambda minise] [DB:genpept-bct1] [DE:E.coli genomic DNA, Kohara clone #259(29.6-30.0 min.).] [NT:ORF_ID:o260#4; similar to [SwissProt Accession] [LE:12091] [RE:13152] [DI:direct] >gp:[GI:d1015630:g1742178] [LN:D90771] [AC:D90771:AB001340] [OR:Escherichia coli] [SR:Escherichia coli (strain:K12) DNA, clone_lib:Kohara lambda minise] [DB:genpept-bct1] [DE:E.coli genomic DNA, Kohara clone #260(29.8-30.2 min.).] [NT:ORF_ID:o260#4; similar to [SwissProt Accession] [LE:3984] [RE:5045] [DI:direct] >gp:[GI:g1787582] [LN:AE000230] [AC:AE000230:U00096] [PN:orf, hypothetical protein] [GN:ycjF] [FN:orf; Unknown] [OR:Escherichia coli] [DB:genpept-bct2] [DE:Escherichia coli K-12 MG1655 section 120 of 400 of the completegenome.] [NT:o353; 100 pct identical to 52 aa of 102 aa] [LE:3673] [RE:4734] [DI:direct]

| ORF Name | NT ID | AA ID | NT/LN | AA/LN | Score | P-value |
|---|---|---|---|---|---|---|
| 34474041_c3_1979 | 690 | 7861 | 369 | 122 | 271 | 1.6e-23 |

Description sp:[LN:T13142] [AC:T13142] [PN:protein gp55] [OR:phage N15] [DB:pir2] >gp:[GI:g3192739] [LN:AF064539] [AC:AF064539] [PN:gp55] [GN:gene 55] [OR:Bacteriophage N15] [DB:genpept-phg] [DE:Bacteriophage N15, complete genome.] [LE:43448] [RE:43993] [DI:direct]

| ORF_Name | NT ID | AA ID | NT/LN | AA/LN | Score | P-value |
|---|---|---|---|---|---|---|
| 34474180_c3_2129 | 691 | 7862 | 354 | 117 | 90 | 0.0030 |

Description sp:[LN:YQEB_ECOLI] [AC:Q46808] [GN:YQEB] [OR:Escherichia coli] [DE:HYPOTHETICAL
57.7 KD PROTEIN IN KDUI-LYSS INTERGENIC REGION] [SP:Q46808] [DB:swissprot]
>sp:[LN:C65071] [AC:C65071] [PN:hypothetical protein b2875] [OR:Escherichia coli]
[DB:pir2] >gp:[GI:g887825] [LN:ECU28375] [AC:U28375] [OR:Escherichia coli]
[DB:genpept-bct1] [DE:Escherichia coli K-12 genome; approximately 64 to 65
minutes.] [NT:ORF_f541] [LE:22429] [RE:24054] [DI:complement] >gp:[GI:g1789240]
[LN:AE000371] [AC:AE000371:U00096] [PN:putative synthases] [GN:b2875]
[FN:putative enzyme; Not classified] [OR:Escherichia coli] [DB:genpept-bct2]
[DE:Escherichia coli K-12 MG1655 section 261 of 400 of the completegenome.]
[NT:f541; This 541 aa ORF is 28 pct identical (7 gaps)] [LE:141] [RE:1766]
[DI:complement]

| ORF_Name | NT ID | AA ID | NT/LN | AA/LN | Score | P-value |
|---|---|---|---|---|---|---|
| 34494791_c2_1557 | 692 | 7863 | 804 | 267 | 825 | 3.1e-82 |

Description sp:[LN:YCFN_ECOLI] [AC:P75948] [GN:YCFN] [OR:Escherichia coli] [DE:HYPOTHETICAL
32.4 KD PROTEIN IN FHUE-NDH INTERGENIC REGION] [SP:P75948] [DB:swissprot]
>sp:[LN:G64854] [AC:G64854] [PN:ycfN protein] [GN:ycfN] [OR:Escherichia coli]
[DB:pir2] >gp:[GI:d1036899:g4062670] [LN:D90745] [AC:D90745:AB001340]
[OR:Escherichia coli] [SR:Escherichia coli(strain:K12) DNA, clone:Kohara clone
236] [DB:genpept-bct1] [DE:Escherichia coli genomic DNA. (24.8 - 25.2 min).]
[NT:ORF_ID:o237#5] [LE:13902] [RE:14726] [DI:direct] >gp:[GI:d1036907:g4062676]
[LN:D90746] [AC:D90746:AB001340] [OR:Escherichia coli] [SR:Escherichia
coli(strain:K12) DNA, clone:Kohara clone #237] [DB:genpept-bct1] [DE:Escherichia
coli genomic DNA. (25.0 - 25.4 min).] [NT:ORF_ID:o237#5] [LE:5201] [RE:6025]
[DI:direct] >gp:[GI:g1787349] [LN:AE000211] [AC:AE000211:U00096] [PN:putative
beta-glucosidase (EC 3.2.1.21)] [GN:ycfN] [FN:putative enzyme; Not classified]
[OR:Escherichia coli] [DB:genpept-bct2] [DE:Escherichia coli K-12 MG1655 section
101 of 400 of the completegenome.] [NT:o274; This 274 aa ORF is 32 pct identical
(1 gap)] [LE:1572] [RE:2396] [DI:direct]

| ORF Name | NT ID | AA ID | NT LN | AA LN | Score | P-value |
|---|---|---|---|---|---|---|
| 34506965_f3_1128 | 693 | 7864 | 960 | 319 | 1329 | 1.2e-135 |

Description sp:[LN:POTB_ECOLI] [AC:P23860] [GN:POTB] [OR:Escherichia coli]
[DE:SPERMIDINE/PUTRESCINE TRANSPORT SYSTEM PERMEASE PROTEIN POTB] [SP:P23860]
[DB:swissprot] >sp:[LN:B40840] [AC:B40840:B64857] [PN:spermidine/putrescine
transport system permease potB] [GN:potB] [CL:spermidine/putrescine transport
system permease protein potH] [OR:Escherichia coli] [DB:pir2]
>gp:[GI:d1036931:g1651552] [LN:D90747] [AC:D90747:AB001340]
[PN:Spermidine/putrescine transport system permease] [GN:potB] [OR:Escherichia
coli] [SR:Escherichia coli(strain:K12) DNA, clone:Kohara clone #238]
[DB:genpept-bct1] [DE:Escherichia coli genomic DNA. (25.2 - 25.6 min).]
[NT:ORF_ID:o238#14; similar to SwissProt Accession] [LE:15304] [RE:16131]
[DI:complement] >gp:[GI:g1787369] [LN:AE000212] [AC:AE000212:U00096]
[PN:spermidine/putrescine transport system permease] [GN:potB] [FN:transport;
Transport of small molecules: Amino] [OR:Escherichia coli] [DB:genpept-bct2]
[DE:Escherichia coli K-12 MG1655 section 102 of 400 of the completegenome.]
[NT:f275; 99 pct identical to POTB_ECOLI SW: P23860] [LE:9619] [RE:10446]
[DI:complement] >gp:[GI:g147327] [LN:ECOPOTABCD] [AC:M64519] [PN:transport
protein] [GN:potB] [OR:Escherichia coli] [SR:E.coli (strain DR112) DNA, clone
pPT104] [DB:genpept-bct2] [DE:E.coli transport protein (potA, potB, potC and
potD) genes,complete cds.] [LE:1529] [RE:2356] [DI:direct]

| ORF Name | NT ID | AA ID | NT LN | AA LN | Score | P-value |
|---|---|---|---|---|---|---|
| 34547262_c2_1598 | 694 | 7865 | 222 | 73 | | |

Description

NO-HIT

| ORF Name | NT ID | AA ID | NT LN | AA LN | Score | P-value |
|---|---|---|---|---|---|---|
| 34557331_f3_918 | 695 | 7866 | 825 | 274 | 971 | 1.1e-97 |

Description sp:[LN:B64873] [AC:B64873:S07798] [PN:probable membrane protein yciC] [GN:yciC]
[CL:yciC protein] [OR:Escherichia coli] [DB:pir2] [MP:28 min]
>gp:[GI:d1015503:g1742044] [LN:D90763] [AC:D90763:AB001340] [GN:yciC]
[OR:Escherichia coli] [SR:Escherichia coli (strain:K12) DNA, clone_lib:Kohara
lambda minise] [DB:genpept-bct1] [DE:E.coli genomic DNA, Kohara clone
252(28.1-28.4 min.).] [NT:ORF_ID:o252#13; similar to [SwissProt Accession]
[LE:11241] [RE:11984] [DI:complement] >gp:[GI:g1787508] [LN:AE000223]
[AC:AE000223:U00096] [PN:orf, hypothetical protein] [GN:yciC] [FN:orf; Unknown]
[OR:Escherichia coli] [DB:genpept-bct2] [DE:Escherichia coli K-12 MG1655 section
113 of 400 of the completegenome.] [NT:f247; 93 pct identical to YCIC_ECOLI SW:
P21365;] [LE:10094] [RE:10837] [DI:complement]

| ORF_Name | NT_ID | AA_ID | NT LN | AA LN | Score | P-value |
|---|---|---|---|---|---|---|
| 34558537_f1_242 | 696 | 7867 | 1350 | 449 | 358 | 9.6e-33 |

Description sp:[LN:B72425] [AC:B72425] [PN:conserved hypothetical protein] [GN:TM0037]
[OR:Thermotoga maritima] [DB:pir2] >gp:[GI:g4980522] [LN:AE001691]
[AC:AE001691:AE000512] [PN:conserved hypothetical protein] [GN:TM0037]
[OR:Thermotoga maritima] [DB:genpept-bct2] [DE:Thermotoga maritima section 3 of
136 of the complete genome.] [NT:similar to PID:558266 percent identity: 57.38;]
[LE:4622] [RE:5872] [DI:direct]

| ORF_Name | NT_ID | AA_ID | NT LN | AA LN | Score | P-value |
|---|---|---|---|---|---|---|
| 34609412_f3_776 | 697 | 7868 | 693 | 230 | 352 | 4.2e-32 |

Description sp:[LN:RPC1_BPHK0] [AC:P18680] [GN:CI-HTT] [OR:Bacteriophage HK022] [DE:26 KD
REPRESSOR PROTEIN (REGULATORY PROTEIN CI)] [SP:P18680] [DB:swissprot]
>gp:[GI:g435310] [LN:STHK022N] [AC:X16093] [OR:Bacteriophage HK022]
[DB:genpept-phg] [DE:Lambdoid Phage HK022 nun gene and immunity region.] [NT:cI
gene product (AA 1-208)] [SP:P18680] [LE:2300] [RE:3007] [DI:complement]

| ORF_Name | NT_ID | AA_ID | NT LN | AA LN | Score | P-value |
|---|---|---|---|---|---|---|
| 34646066_f2_410 | 698 | 7869 | 897 | 298 | 524 | 2.5e-50 |

Description sp:[LN:YCJZ_ECOLI] [AC:P77333:P76841] [GN:YCJZ] [OR:Escherichia coli]
[DE:HYPOTHETICAL TRANSCRIPTIONAL REGULATOR IN TPX-FNR INTERGENIC REGION]
[SP:P77333:P76841] [DB:swissprot] >sp:[LN:C64882] [AC:C64882] [PN:probable
transcription regulator ycjZ] [GN:ycjZ] [CL:hypothetical protein b1328]
[OR:Escherichia coli] [DB:pir2] >gp:[GI:d1015637:g1742185] [LN:D90771]
[AC:D90771:AB001340] [PN:Xanthosine operon regulatory protein.] [OR:Escherichia
coli] [SR:Escherichia coli (strain:K12) DNA, clone_lib:Kohara lambda minise]
[DB:genpept-bct1] [DE:E.coli genomic DNA, Kohara clone #260(29.8-30.2 min.).]
[NT:ORF_ID:o260#12; similar to [SwissProt Accession] [LE:10464] [RE:11363]
[DI:direct] >gp:[GI:d1015647:g1742196] [LN:D90772] [AC:D90772:AB001340]
[PN:Xanthosine operon regulatory protein.] [OR:Escherichia coli] [SR:Escherichia
coli (strain:K12) DNA, clone_lib:Kohara lambda minise] [DB:genpept-bct1]
[DE:E.coli genomic DNA, Kohara clone #261(30.0-30.3 min.).] [NT:ORF_ID:o260#12;
similar to [SwissProt Accession] [LE:529] [RE:1428] [DI:direct] >gp:[GI:g1787589]
[LN:AE000231] [AC:AE000231:U00096] [PN:putative transcriptional regulator
LYSR-type] [GN:ycjZ] [FN:putative regulator; Not classified] [OR:Escherichia
coli] [DB:genpept-bct2] [DE:Escherichia coli K-12 MG1655 section 121 of 400 of
the completegenome.] [NT:o299; This 299 aa ORF is 47 pct identical (0 gaps)]
[LE:93] [RE:992] [DI:direct]

| ORF Name | NT ID | AA ID | NT LN | AA LN | Score | P-value |
|---|---|---|---|---|---|---|
| 34667311_c1_1508 | 699 | 7870 | 888 | 295 | 690 | 6.3e-68 |

Description sp:[LN:A72308] [AC:A72308] [PN:oxidoreductase, aldo/keto reductase family] [GN:TM1009] [CL:aldehyde reductase] [OR:Thermotoga maritima] [DB:pir2] >gp:[GI:g4981536] [LN:AE001762] [AC:AE001762:AE000512] [PN:oxidoreductase, aldo/keto reductase family] [GN:TM1009] [OR:Thermotoga maritima] [DB:genpept-bct2] [DE:Thermotoga maritima section 74 of 136 of the complete genome.] [NT:similar to GB:AL009126 percent identity: 69.23;] [LE:8972] [RE:9832] [DI:direct]

| ORF Name | NT ID | AA ID | NT LN | AA LN | Score | P-value |
|---|---|---|---|---|---|---|
| 35158555_f1_141 | 700 | 7871 | 927 | 308 | 674 | 3.1e-66 |

Description sp:[LN:TUA4_AGRVI] [AC:P52669] [GN:TTUA] [OR:Agrobacterium vitis] [DE:PROBABLE TARTRATE UTILIZATION TRANSCRIPTIONAL REGULATOR] [SP:P52669] [DB:swissprot] >gp:[GI:g805290] [LN:AVU25634] [AC:U25634] [GN:ttuA] [OR:Agrobacterium vitis] [SR:Plasmid pTrAB4] [DB:genpept-bct1] [DE:Agrobacterium vitis plasmid pTrAB4 putative LysR-type protein(ttuA), putative tartrate transport protein (ttuB), putativetartrate dehydrogenase (ttuC), putative hydroxypyruvate reductase(ttuD) and putative pyruvate kinase (ttuE) genes, complete cds.] [NT:putative LysR-type regulatory protein; transcribed] [LE:405] [RE:1319] [DI:complement]

| ORF Name | NT ID | AA ID | NT LN | AA LN | Score | P-value |
|---|---|---|---|---|---|---|
| 35158587_f1_162 | 701 | 7872 | 2313 | 770 | 3306 | 0.0 |

Description sp:[LN:CATE_ECOLI] [AC:P21179:P78066:P76906:P78168] [GN:KATE] [OR:Escherichia coli] [EC:1.11.1.6] [DE:CATALASE HPII, (HYDROXYPEROXIDASE II)] [SP:P21179:P78066:P76906:P78168] [DB:swissprot] >sp:[LN:A39129] [AC:A39129:D64932] [GN:katE] [PN:catalase, HPII] [EC:1.11.1.6] [DB:pir2] [MP:37.8 min] >gp:[GI:d1016236:g1742829] [LN:D90816] [AC:D90816:AB001340] [PN:Catalase (EC 1.11.1.6) HPII] [GN:katE] [OR:Escherichia coli] [SR:Escherichia coli (strain:K12) DNA, clone_lib:Kohara lambda minise] [DB:genpept-bct1] [DE:E.coli genomic DNA, Kohara clone #325(38.9-39.2 min.).] [NT:ORF_ID:o325-326#1; similar to [PIR Accession Number] [LE:6456] [RE:8717] [DI:direct] >gp:[GI:g146533] [LN:ECOKATE] [AC:M55161] [PN:catalase HPII] [GN:katE] [OR:Escherichia coli] [SR:E.coli K12 DNA] [DB:genpept-bct1] [DE:E.coli catalase HPII (katE) gene, complete cds.] [LE:821] [RE:3082] [DI:direct]

| ORF Name | NT ID | AA ID | NT LN | AA LN | Score | P-value |
|---|---|---|---|---|---|---|
| 35208288_f1_19 | 702 | 7873 | 960 | 319 | 511 | 5.9e-49 |

Description sp:[LN:YHJC_ECOLI] [AC:P37641] [GN:YHJC] [OR:Escherichia coli] [DE:HYPOTHETICAL
TRANSCRIPTIONAL REGULATOR IN TREF-KDGK INTERGENIC REGION] [SP:P37641]
[DB:swissprot]

| ORF Name | NT ID | AA ID | NT LN | AA LN | Score | P-value |
|---|---|---|---|---|---|---|
| 35312568_f1_152 | 703 | 7874 | 2280 | 759 | 2574 | 1.4e-267 |

Description gp:[GI:g6006729] [LN:AF135597] [AC:AF135597] [PN:siderophore receptor IroN]
[GN:iroN] [OR:Escherichia coli] [DB:genpept-bct2] [DE:Escherichia coli
siderophore receptor IroN (iroN) gene, partialcds.] [LE:321] [RE:>2495]
[DI:direct]

| ORF Name | NT ID | AA ID | NT LN | AA LN | Score | P-value |
|---|---|---|---|---|---|---|
| 35338142_f3_857 | 704 | 7875 | 384 | 127 | | |

Description

NO-HIT

| ORF Name | NT ID | AA ID | NT LN | AA LN | Score | P-value |
|---|---|---|---|---|---|---|
| 35437808_c2_1815 | 705 | 7876 | 186 | 61 | | |

Description

NO-HIT

| ORF Name | NT ID | AA ID | NT LN | AA LN | Score | P-value |
|---|---|---|---|---|---|---|
| 35629757_c3_1940 | 706 | 7877 | 357 | 118 | 86 | 9.2e-06 |

Description sp:[LN:F70642] [AC:F70642] [PN:probable ribosomal protein S3 rpsC] [GN:rpsC]
[CL:Escherichia coli ribosomal protein S3] [OR:Mycobacterium tuberculosis]
[DB:pir2] >gp:[GI:e293287:g1806175] [LN:MTCY210] [AC:Z84395:AL123456] [PN:rpsC]
[GN:rpsC] [OR:Mycobacterium tuberculosis] [DB:genpept-bct1] [DE:Mycobacterium
tuberculosis H37Rv complete genome; segment 34/162.] [NT:Rv0707, (MTCY210.26),
len: 274 aa, rpsC, almost] [LE:19580] [RE:20404] [DI:direct]

| ORF Name | NT ID | AA ID | NT LN | AA LN | Score | P-value |
|---|---|---|---|---|---|---|
| 35675632_f2_398 | 707 | 7878 | 1416 | 471 | | |

Description

NO-HIT

| ORF_Name | NT_ID | AA_ID | NT LN | AA LN | Score | P-value |
|---|---|---|---|---|---|---|
| 35807042_f3_898 | 708 | 7879 | 1653 | 550 | 2582 | 2.0e-268 |

Description sp:[LN:NNEC2] [AC:B64874:A93746:A93168:I56374:A01125] [PN:anthranilate synthase, component II] [GN:trpG-trpD] [CL:trpG-trpD bifunctional enzyme:trpD homology:trpG homology] [OR:Escherichia coli] [EC:4.1.3.27] [DB:pir1] [MP:28 min] >gp:[GI:d1015514:g1742056] [LN:D90764] [AC:D90764:AB001340] [PN:Anthranilate synthase (EC 4.1.3.27) component] [GN:trpD] [OR:Escherichia coli] [SR:Escherichia coli (strain:K12) DNA, clone_lib:Kohara lambda minise] [DB:genpept-bct1] [DE:E.coli genomic DNA, Kohara clone #253(28.4-28.7 min.).] [NT:ORF_ID:o253#1; similar to [PIR Accession Number] [LE:2409] [RE:4004] [DI:complement] >gp:[GI:g1787517] [LN:AE000224] [AC:AE000224:U00096] [PN:anthranilate synthase component II, glutamine] [GN:trpD] [FN:enzyme; Amino acid biosynthesis: Tryptophan] [OR:Escherichia coli] [DB:genpept-bct2] [EC:4.1.3.27:2.4.2.18] [DE:Escherichia coli K-12 MG1655 section 114 of 400 of the completegenome.] [NT:f531; 99 pct identical to TRPG_ECOLI SW: P00904; CG] [LE:5978] [RE:7573] [DI:complement]

| ORF_Name | NT_ID | AA_ID | NT LN | AA LN | Score | P-value |
|---|---|---|---|---|---|---|
| 35807132_f3_873 | 709 | 7880 | 282 | 93 | 341 | 6.1e-31 |

Description sp:[LN:YCIN_ECOLI] [AC:P46132:P77447] [GN:YCIN] [OR:Escherichia coli] [DE:HYPOTHETICAL 9.4 KD PROTEIN IN SOHB-TOPA INTERGENIC REGION] [SP:P46132:P77447] [DB:swissprot] >sp:[LN:D64875] [AC:D64875] [PN:yciN protein] [GN:yciN] [OR:Escherichia coli] [DB:pir2] >gp:[GI:d1015526:g1742068] [LN:D90764] [AC:D90764:AB001340] [GN:yciN] [OR:Escherichia coli] [SR:Escherichia coli (strain:K12) DNA, clone_lib:Kohara lambda minise] [DB:genpept-bct1] [DE:E.coli genomic DNA, Kohara clone #253(28.4-28.7 min.).] [NT:ORF_ID:o253#13; similar to [SwissProt Accession] [LE:13037] [RE:13288] [DI:complement] >gp:[GI:d1015541:g1742084] [LN:D90765] [AC:D90765:AB001340] [GN:yciN] [OR:Escherichia coli] [SR:Escherichia coli (strain:K12) DNA, clone_lib:Kohara lambda minise] [DB:genpept-bct1] [DE:E.coli genomic DNA, Kohara clone #254(28.4-28.9 min.).] [NT:ORF_ID:o253#13; similar to [SwissProt Accession] [LE:10543] [RE:10794] [DI:complement] >gp:[GI:g1787528] [LN:AE000225] [AC:AE000225:U00096] [PN:orf, hypothetical protein] [GN:yciN] [FN:orf; Unknown] [OR:Escherichia coli] [DB:genpept-bct2] [DE:Escherichia coli K-12 MG1655 section 115 of 400 of the completegenome.] [NT:f83; 100 pct identical to 42 aa of YCIN_ECOLI] [LE:3701] [RE:3952] [DI:complement]

| ORF Name | NT ID | AA ID | NT LN | AA LN | Score | P-value |
|---|---|---|---|---|---|---|
| 35835050_c2_1591 | 710 | 7881 | 765 | 254 | 152 | 9.2e-11 |

Description sp:[LN:E69770] [AC:E69770] [PN:hypothetical protein ydbB] [GN:ydbB] [OR:Bacillus subtilis] [DB:pir2] >gp:[GI:d1020031;g1881251] [LN:AB001488] [AC:AB001488] [GN:ydbB] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:FUNCTION UNKNOWN.] [LE:28066] [RE:28407] [DI:direct] >gp:[GI:e1182407;g2632741] [LN:BSUB0003] [AC:Z99106:AL009126] [GN:ydbB] [FN:unknown] [OR:Bacillus subtilis] [DB:genpept-bct1] [DE:Bacillus subtilis complete genome (section 3 of 21): from 402751 to611850.] [LE:91810] [RE:92151] [DI:direct]

| ORF Name | NT ID | AA ID | NT LN | AA LN | Score | P-value |
|---|---|---|---|---|---|---|
| 36021058_c2_1825 | 711 | 7882 | 441 | 146 | 511 | 5.9e-49 |

Description sp:[LN:Q3ECPF] [AC:E64876:B28440] [PN:probable translation initiation factor yciH] [GN:yciH] [CL:pyrF operon conserved hypothetical 11.4K protein] [OR:Escherichia coli] [DB:pir1] [MP:28 min] >gp:[GI:g1787538] [LN:AE000226] [AC:AE000226:U00096] [PN:orf, hypothetical protein] [GN:yciH] [FN:orf; Unknown] [OR:Escherichia coli] [DB:genpept-bct2] [DE:Escherichia coli K-12 MG1655 section 116 of 400 of the completegenome.] [NT:o109; 100 pct identical to YCIH_ECOLI SW:] [LE:4147] [RE:4476] [DI:direct]

| ORF Name | NT ID | AA ID | NT LN | AA LN | Score | P-value |
|---|---|---|---|---|---|---|
| 36023966_c2_1736 | 712 | 7883 | 411 | 136 | 114 | 3.4e-06 |

Description sp:[LN:YFHA_BORPE] [AC:P33445] [OR:Bordetella pertussis] [DE:HYPOTHETICAL 33.8 KD PROTEIN IN FHAC 3'REGION (ORFA)] [SP:P33445] [DB:swissprot] >gp:[GI:g313841] [LN:BPFIMABC] [AC:X64876:S49543] [GN:orfA] [OR:Bordetella pertussis] [DB:genpept-bct1] [DE:B.pertussis fimbrial gene cluster fimA, fimB fimC and fimD genes.] [SP:P33445] [LE:7396] [RE:8358] [DI:direct]

| ORF Name | NT ID | AA ID | NT LN | AA LN | Score | P-value |
|---|---|---|---|---|---|---|
| 36037932_f2_540 | 713 | 7884 | 882 | 293 | 1137 | 2.7e-115 |

Description sp:[LN:E64933] [AC:E64933] [PN:hypothetical protein b1741] [OR:Escherichia coli] [DB:pir2] >gp:[GI:g1788037] [LN:AE000269] [AC:AE000269:U00096] [PN:putative excinuclease subunit] [GN:b1741] [FN:putative enzyme; Not classified] [OR:Escherichia coli] [DB:genpept-bct2] [DE:Escherichia coli K-12 MG1655 section 159 of 400 of the completegenome.] [NT:o295] [LE:2289] [RE:3176] [DI:direct]

| ORF_Name | NT ID | AA ID | NT/LN | AA/LN | Score | P-value |
|---|---|---|---|---|---|---|
| 36038306_f1_318 | 714 | 7885 | 2202 | 733 | 815 | 3.8e-93 |

Description sp:[LN:T03004] [AC:T03004] [PN:exodeoxyribonuclease VIII homolog] [OR:Salmonella typhimurium] [DB:pir2] >gp:[GI:g3294473] [LN:STAF001386] [AC:AF001386] [PN:exodeoxyribonuclease VIII] [GN:recE] [OR:Salmonella typhimurium] [DB:genpept-bct2] [DE:Salmonella typhimurium sigma-E factor regulatory protein (rseA)gene, partial cds; sigma-E factor regulatory protein (rseB), sigma-E factor regulatory protein (rseC), truncated GTP-bindingprotein (lepA), complete cds; Gifsy-1 prophage left-end portion:putative integrase (int), putative excisionase (xis), andexodeoxyribonuclease VIII (recE) genes, complete cds; and unknowngenes.] [NT:RecE; similar to Escherichia coli rac prophage recE] [LE:4972] [RE:7899] [DI:complement]

| ORF_Name | NT ID | AA ID | NT/LN | AA/LN | Score | P-value |
|---|---|---|---|---|---|---|
| 36049040_f2_592 | 715 | 7886 | 1305 | 434 | 2055 | 1.4e-212 |

Description sp:[LN:YEAH_ECOLI] [AC:P76235:O07964] [GN:YEAH] [OR:Escherichia coli] [DE:HYPOTHETICAL 49.4 KD PROTEIN IN GAPA-RND INTERGENIC REGION] [SP:P76235:O07964] [DB:swissprot] >sp:[LN:H64938] [AC:H64938] [PN:hypothetical protein b1784] [OR:Escherichia coli] [DB:pir2] >gp:[GI:d1016309:g1736412] [LN:D90822] [AC:D90822:AB001340] [GN:yzdC] [OR:Escherichia coli] [SR:Escherichia coli (strain:K12) DNA, clone_lib:Kohara lambda minise] [DB:genpept-bct1] [DE:E.coli genomic DNA, Kohara clone #331(40.1-40.4 min.).] [NT:ORF_ID:o331#1; similar to [SwissProt Accession] [LE:6102] [RE:7385] [DI:direct] >gp:[GI:g1788084] [LN:AE000273] [AC:AE000273:U00096] [PN:orf, hypothetical protein] [GN:yeaH] [FN:orf; Unknown] [OR:Escherichia coli] [DB:genpept-bct2] [DE:Escherichia coli K-12 MG1655 section 163 of 400 of the completegenome.] [NT:o427; This 427 aa ORF is 28 pct identical (43 gaps)] [LE:6385] [RE:7668] [DI:direct]

| ORF_Name | NT ID | AA ID | NT LN | AA LN | Score | P-value |
|---|---|---|---|---|---|---|
| 36050802_f2_723 | 716 | 7887 | 1527 | 508 | 2067 | 7.7e-214 |

Description sp:[LN:PHOQ_ECOLI] [AC:P23837] [GN:PHOQ] [OR:Escherichia coli] [EC:2.7.3.-]
[DE:SENSOR PROTEIN PHOQ,] [SP:P23837] [DB:swissprot] >sp:[LN:B41966]
[AC:B41966:B41965:F64857:JU0380] [PN:sensor kinase phoQ,:sensor protein phoQ]
[GN:phoQ] [CL:envZ protein:sensor histidine kinase homology] [OR:Escherichia
coli] [EC:2.7.3.-] [DB:pir1] [MP:25 min] >gp:[GI:d1036937:g1651557] [LN:D90748]
[AC:D90748:AB001340] [PN:Virulence membrane protein phoQ.] [GN:phoQ]
[OR:Escherichia coli] [SR:Escherichia coli(strain:K12) DNA, clone:Kohara clone
239] [DB:genpept-bct1] [DE:Escherichia coli genomic DNA. (25.6 - 25.9 min).]
[NT:ORF_ID:o239#4; similar to PIR Accession Number] [LE:4550] [RE:6010]
[DI:complement] >gp:[GI:d1015097:g216609] [LN:ECOPHOPQ] [AC:D90393] [PN:PhoQ
protein] [GN:phoQ] [OR:Escherichia coli] [SR:E.coli (strain K12) DNA]
[DB:genpept-bct1] [DE:E.coli phoP and phoQ genes, complete cds.] [NT:sensor
protein] [LE:1722] [RE:3182] [DI:direct] >gp:[GI:g1787374] [LN:AE000213]
[AC:AE000213:U00096] [PN:sensor protein PhoQ] [GN:phoQ] [FN:enzyme; Global
regulatory functions] [OR:Escherichia coli] [DB:genpept-bct2] [EC:2.7.3.-]
[DE:Escherichia coli K-12 MG1655 section 103 of 400 of the completegenome.]
[NT:f486; 99 pct identical to PHOQ_ECOLI SW: P23837] [LE:2627] [RE:4087]
[DI:complement]

| ORF_Name | NT ID | AA ID | NT LN | AA LN | Score | P-value |
|---|---|---|---|---|---|---|
| 36051441_f1_48 | 717 | 7888 | 726 | 241 | 1035 | 1.8e-104 |

Description sp:[LN:YCJI_ECOLI] [AC:P51983:P77675] [GN:YCJI] [OR:Escherichia coli]
[DE:HYPOTHETICAL 28.8 KD PROTEIN IN TPX-FNR ITERGENIC REGION] [SP:P51983:P77675]
[DB:swissprot] >sp:[LN:A64882] [AC:A64882] [PN:ycjI protein] [GN:ycjI]
[OR:Escherichia coli] [DB:pir2] >gp:[GI:d1015624:g1742171] [LN:D90770]
[AC:D90770:AB001340] [GN:ycjI] [OR:Escherichia coli] [SR:Escherichia coli
(strain:K12) DNA, clone_lib:Kohara lambda minise] [DB:genpept-bct1] [DE:E.coli
genomic DNA, Kohara clone #259(29.6-30.0 min.).] [NT:ORF_ID:o260#9; similar to
[SwissProt Accession] [LE:16450] [RE:17238] [DI:complement]
>gp:[GI:d1015635:g1742183] [LN:D90771] [AC:D90771:AB001340] [GN:ycjI]
[OR:Escherichia coli] [SR:Escherichia coli (strain:K12) DNA, clone_lib:Kohara
lambda minise] [DB:genpept-bct1] [DE:E.coli genomic DNA, Kohara clone
260(29.8-30.2 min.).] [NT:ORF_ID:o260#9; similar to [SwissProt Accession]
[LE:8343] [RE:9131] [DI:complement] >gp:[GI:g1787586] [LN:AE000230]
[AC:AE000230:U00096] [PN:putative carboxypeptidase] [GN:ycjI] [FN:putative
enzyme; Not classified] [OR:Escherichia coli] [DB:genpept-bct2] [DE:Escherichia
coli K-12 MG1655 section 120 of 400 of the completegenome.] [NT:f262; This 262 aa
ORF is 40 pct identical (6 gaps)] [LE:8032] [RE:8820] [DI:complement]

| ORF Name | NT ID | AA ID | NT LN | AA LN | Score | P-value |
|---|---|---|---|---|---|---|
| 36053252_c3_2187 | 718 | 7889 | 873 | 290 | 462 | 9.2e-44 |

Description gp:[GI:g5881864] [LN:SC5G9] [AC:AL117385] [PN:hypothetical protein] [GN:SC5G9.16]
[OR:Streptomyces coelicolor A3(2)] [DB:genpept-bct1] [DE:Streptomyces coelicolor
cosmid 5G9.] [NT:SC5G9.16, possible DNA-binding protein, len: 295] [LE:17934]
[RE:18821] [DI:direct]

| ORF Name | NT ID | AA ID | NT LN | AA LN | Score | P-value |
|---|---|---|---|---|---|---|
| 36069515_c1_1427 | 719 | 7890 | 882 | 293 | 1193 | 3.2e-121 |

Description sp:[LN:YCIV_ECOLI] [AC:P77766] [GN:YCIV] [OR:Escherichia coli] [DE:HYPOTHETICAL
32.6 KD PROTEIN IN TRPL-BTUR INTERGENIC REGION] [SP:P77766] [DB:swissprot]
>sp:[LN:E64874] [AC:E64874] [PN:probable metal-dependent phosphoesterase yciV]
[GN:yciV] [CL:hypothetical protein HI1400] [OR:Escherichia coli] [DB:pir2]
>gp:[GI:d1015516:g1742058] [LN:D90764] [AC:D90764:AB001340] [OR:Escherichia coli]
[SR:Escherichia coli (strain:K12) DNA, clone_lib:Kohara lambda minise]
[DB:genpept-bct1] [DE:E.coli genomic DNA, Kohara clone #253(28.4-28.7 min.).]
[NT:ORF_ID:o253#3; similar to [SwissProt Accession] [LE:5840] [RE:6721]
[DI:direct] >gp:[GI:d1015531:g1742074] [LN:D90765] [AC:D90765:AB001340]
[OR:Escherichia coli] [SR:Escherichia coli (strain:K12) DNA, clone_lib:Kohara
lambda minise] [DB:genpept-bct1] [DE:E.coli genomic DNA, Kohara clone
254(28.4-28.9 min.).] [NT:ORF_ID:o253#3; similar to [SwissProt Accession]
[LE:3346] [RE:4227] [DI:direct] >gp:[GI:g1787520] [LN:AE000224]
[AC:AE000224:U00096] [PN:putative enzymes] [GN:yciV] [FN:putative enzyme; Not
classified] [OR:Escherichia coli] [DB:genpept-bct2] [DE:Escherichia coli K-12
MG1655 section 114 of 400 of the completegenome.] [NT:o293; This 293 aa ORF is 50
pct identical (3 gaps)] [LE:9409] [RE:10290] [DI:direct]

| ORF Name | NT ID | AA ID | NT LN | AA LN | Score | P-value |
|---|---|---|---|---|---|---|
| 36069758_f3_965 | 720 | 7891 | 423 | 140 | 142 | 2.7e-09 |

Description sp:[LN:A61183] [AC:A61183:S27643] [PN:hypothetical protein (sdsB region)]
[OR:Pseudomonas sp.] [DB:pir2]

| ORF Name | NT ID | AA ID | NT LN | AA LN | Score | P-value |
|---|---|---|---|---|---|---|
| 36135312_f1_210 | 721 | 7892 | 1956 | 651 | 3305 | 0.0 |

Description sp:[LN:YEAG_ECOLI] [AC:P77391:O07963] [GN:YEAG] [OR:Escherichia coli]
[DE:HYPOTHETICAL 74.5 KD PROTEIN IN GAPA-RND INTERGENIC REGION]
[SP:P77391:O07963] [DB:swissprot] >sp:[LN:G64938] [AC:G64938] [PN:hypothetical
protein b1783] [OR:Escherichia coli] [DB:pir2] >gp:[GI:d1016303:g1742901]
[LN:D90821] [AC:D90821:AB001340] [PN:PrkA protein.] [OR:Escherichia coli]
[SR:Escherichia coli (strain:K12) DNA, clone_lib:Kohara lambda minise]
[DB:genpept-bct1] [DE:E.coli genomic DNA, Kohara clone #330(39.9-40.3 min.).]
[NT:ORF_ID:o330#10; similar to [SwissProt Accession] [LE:14585] [RE:16519]
[DI:direct] >gp:[GI:d1016308:g1736411] [LN:D90822] [AC:D90822:AB001340] [PN:PrkA
protein.] [OR:Escherichia coli] [SR:Escherichia coli (strain:K12) DNA,
clone_lib:Kohara lambda minise] [DB:genpept-bct1] [DE:E.coli genomic DNA, Kohara
clone #331(40.1-40.4 min.).] [NT:ORF_ID:o330#10; similar to [SwissProt Accession]
[LE:4055] [RE:5989] [DI:direct] >gp:[GI:g1788083] [LN:AE000273]
[AC:AE000273:U00096] [PN:orf, hypothetical protein] [GN:yeaG] [FN:orf; Unknown]
[OR:Escherichia coli] [DB:genpept-bct2] [DE:Escherichia coli K-12 MG1655 section
163 of 400 of the completegenome.] [NT:o644; This 644 aa ORF is 35 pct identical
(34 gaps)] [LE:4338] [RE:6272] [DI:direct]

| ORF Name | NT ID | AA ID | NT LN | AA LN | Score | P-value |
|---|---|---|---|---|---|---|
| 36226513_c3_2163 | 722 | 7893 | 2688 | 895 | 4119 | 0.0 |

Description gp:[GI:d1015544:g1742087] [LN:D90765] [AC:D90765:AB001340] [PN:Aconitate
hydratase (EC 4.2.1.3)] [GN:acnA] [OR:Escherichia coli] [SR:Escherichia coli
(strain:K12) DNA, clone_lib:Kohara lambda minise] [DB:genpept-bct1] [DE:E.coli
genomic DNA, Kohara clone #254(28.4-28.9 min.).] [NT:ORF_ID:o254-5#1; similar to
[PIR Accession Number] [LE:15957] [RE:18632] [DI:direct] >gp:[GI:g40896]
[LN:ECACN] [AC:X60293] [PN:aconitate hydratase] [GN:acn] [OR:Escherichia coli]
[DB:genpept-bct1] [EC:4.2.1.3] [DE:E.coli acn, cysB and ribA genes.] [SP:P25516]
[LE:1234] [RE:3909] [DI:direct]

| ORF Name | NT ID | AA ID | NT LN | AA LN | Score | P-value |
|---|---|---|---|---|---|---|
| 36354551_c2_1785 | 723 | 7894 | 1227 | 408 | 1585 | 9.1e-163 |

Description sp:[LN:TTC1_AGRVI] [AC:Q44471] [GN:TTUC] [OR:Agrobacterium vitis] [EC:1.1.1.93]
[DE:PROBABLE TARTRATE DEHYDROGENASE TTUC, (TDH)] [SP:Q44471] [DB:swissprot]
>gp:[GI:g805292] [LN:AVU25634] [AC:U25634] [GN:ttuC] [OR:Agrobacterium vitis]
[SR:Plasmid pTrAB4] [DB:genpept-bct1] [DE:Agrobacterium vitis plasmid pTrAB4
putative LysR-type protein(ttuA), putative tartrate transport protein (ttuB),
putativetartrate dehydrogenase (ttuC), putative hydroxypyruvate reductase(ttuD)
and putative pyruvate kinase (ttuE) genes, complete cds.] [NT:putative tartrate
dehydrogenase; already] [LE:2766] [RE:3860] [DI:direct] >gp:[GI:g2305216]
[LN:AF010262] [AC:AF010262] [PN:tartrate dehydrogenase] [GN:ttuC]
[OR:Agrobacterium vitis] [DB:genpept-bct2] [DE:Agrobacterium vitis plasmid pTi
tartrate dehydrogenase (ttuC) gene,complete cds.] [LE:171] [RE:1265] [DI:direct]

| ORF_Name | NT ID | AA ID | NT/LN | AA/LN | Score | P-value |
|---|---|---|---|---|---|---|
| 36368933_f1_121 | 724 | 7895 | 1383 | 460 | 86 | 0.0066 |

Description sp:[LN:JAA092] [AC:A03336] [PN:chorion class A protein pc292 precursor]
[CL:chorion class A protein pc292] [OR:Antheraea polyphemus] [SR:, polyphemus moth] [DB:pir1]

| ORF_Name | NT ID | AA ID | NT/LN | AA/LN | Score | P-value |
|---|---|---|---|---|---|---|
| 36428880_c1_1328 | 725 | 7896 | 975 | 324 | 997 | 1.9e-100 |

Description sp:[LN:E64938] [AC:E64938] [PN:probable aldehyde reductase, b1781] [CL:aldehyde reductase] [OR:Escherichia coli] [EC:1.1.1.-] [DB:pir1]
>gp:[GI:d1016306;g1736409] [LN:D90822] [AC:D90822:AB001340] [PN:Morphine 6-dehydrogenase (EC 1.1.1.218)] [OR:Escherichia coli] [SR:Escherichia coli (strain:K12) DNA, clone_lib:Kohara lambda minise] [DB:genpept-bct1] [DE:E.coli genomic DNA, Kohara clone #331(40.1-40.4 min.).] [NT:ORF_ID:o330#8; similar to [SwissProt Accession] [LE:1929] [RE:2783] [DI:complement] >gp:[GI:g1788081] [LN:AE000273] [AC:AE000273:U00096] [PN:putative an aldehyde reductase] [GN:b1781] [FN:putative enzyme; Not classified] [OR:Escherichia coli] [DB:genpept-bct2] [DE:Escherichia coli K-12 MG1655 section 163 of 400 of the completegenome.] [NT:f284; residues 72-114 are 46 pct identical to] [LE:2212] [RE:3066] [DI:complement]

| ORF_Name | NT ID | AA ID | NT/LN | AA/LN | Score | P-value |
|---|---|---|---|---|---|---|
| 36430431_f3_919 | 726 | 7897 | 588 | 195 | 877 | 9.7e-88 |

Description gp:[GI:g902453] [LN:ECU24203] [AC:U24203] [GN:yciB] [OR:Escherichia coli]
[DB:genpept-bct2] [DE:Escherichia coli ECOR 52 (yciD) gene, partial cds, and (yciC), (yciB), (yciA), membrane protein (tonB), (yciI), putative potassiumchannel (kch), and cardiolipin synthase (cls) genes, complete cds.] [LE:1650] [RE:2189] [DI:direct]

| ORF_Name | NT ID | AA ID | NT/LN | AA/LN | Score | P-value |
|---|---|---|---|---|---|---|
| 3912776_c2_1740 | 727 | 7898 | 1272 | 423 | 1746 | 8.0e-180 |

Description gp:[GI:g1916298] [LN:ECU90416] [AC:U90416]
[PN:N-(alpha)-acetylornithine-(delta)-] [GN:cstC] [OR:Escherichia coli]
[DB:genpept-bct1] [DE:Escherichia coli
N-(alpha)-acetylornithine-(delta)-aminotransferase(cstC) gene, complete cds.]
[NT:CstC; similar to ArgD] [LE:418] [RE:1638] [DI:direct]

| ORF Name | NT ID | AA ID | NT LN | AA LN | Score | P-value |
|---|---|---|---|---|---|---|
| 3944218_c3_1917 | 728 | 7899 | 660 | 219 | 861 | 4.8e-86 |

Description gp:[GI:d1036898:g4062669] [LN:D90745] [AC:D90745:AB001340]
[PN:Fibronectin-binding protein B] [OR:Escherichia coli] [SR:Escherichia
coli(strain:K12) DNA, clone:Kohara clone #236] [DB:genpept-bct1] [DE:Escherichia
coli genomic DNA. (24.8 - 25.2 min).] [NT:ORF_ID:o237#4; similar to PIR Accession
Number] [LE:13277] [RE:13921] [DI:direct] >gp:[GI:d1036906:g4062675] [LN:D90746]
[AC:D90746:AB001340] [PN:Fibronectin-binding protein B] [OR:Escherichia coli]
[SR:Escherichia coli(strain:K12) DNA, clone:Kohara clone #237] [DB:genpept-bct1]
[DE:Escherichia coli genomic DNA. (25.0 - 25.4 min).] [NT:ORF_ID:o237#4; similar
to PIR Accession Number] [LE:4576] [RE:5220] [DI:direct]

| ORF Name | NT ID | AA ID | NT LN | AA LN | Score | P-value |
|---|---|---|---|---|---|---|
| 3954838_c3_2155 | 729 | 7900 | 594 | 197 | 378 | 7.3e-35 |

Description gp:[GI:g1545990] [LN:YEU58366] [AC:U58366] [PN:resolvase] [GN:tnpR] [OR:Yersinia
enterocolitica] [DB:genpept-bct1] [DE:Yersinia enterocolitica Tn2502 transposon
defective transposase(tnpA), resolvase (tnpR), arsenate reductase (arsC),
transmembraneprotein of arsenite pump (arsB), arsenite inducible repressor(arsR),
and ArsH (arsH) genes, complete cds.] [NT:TnpR] [LE:1046] [RE:1627] [DI:direct]
>gp:[GI:g4324380] [LN:AF102990]
[AC:AF102990:AF054978:AF054979:AF054980:AF054981:AF080156:Z69926:L0 6216]
[PN:resolvase TnpR] [GN:tnpR] [OR:Yersinia enterocolitica] [DB:genpept-bct2]
[DE:Yersinia enterocolitica plasmid pYVe227, complete sequence.] [LE:60004]
[RE:60585] [DI:direct]

| ORF Name | NT ID | AA ID | NT LN | AA LN | Score | P-value |
|---|---|---|---|---|---|---|
| 3994050_c3_2018 | 730 | 7901 | 1071 | 356 | 1268 | 3.6e-129 |

Description sp:[LN:ASPG_ERWCH] [AC:P06608] [GN:ASN] [OR:Erwinia chrysanthemi] [EC:3.5.1.1]
[DE:(L-ASNASE)] [SP:P06608] [DB:swissprot] >sp:[LN:A26054] [AC:A26054:S03681]
[PN:asparaginase, precursor] [CL:asparaginase] [OR:Erwinia chrysanthemi]
[EC:3.5.1.1] [DB:pir1] >gp:[GI:e1372002:g4185897] [LN:ECSK] [AC:X14777:M14741]
[PN:L-asparaginase] [OR:Erwinia chrysanthemi] [DB:genpept-bct1] [EC:3.5.1.1]
[DE:Erwinia chrysanthemi genes encoding L-asparaginase and shikimatekinase.]
[LE:345] [RE:1391] [DI:direct] >gp:[GI:g490255] [LN:A14577] [AC:A14577]
[PN:L-asparginase] [OR:Erwinia chrysanthemi] [DB:genpept-pat] [DE:asparginase
gene cloned in pUC9.] [SP:P06608] [LE:661] [RE:1707] [DI:direct]

| ORF Name | NT ID | AA ID | NT LN | AA LN | Score | P-value |
|---|---|---|---|---|---|---|
| 4035966_c3_2194 | 731 | 7902 | 1437 | 478 | 420 | 2.6e-39 |

Description gp:[GI:g3170571] [LN:AF058302] [AC:AF058302] [PN:putative antibiotic antiporter] [GN:frnF] [OR:Streptomyces roseofulvus] [DB:genpept-bct2] [DE:Streptomyces roseofulvus frenolicin biosynthetic gene cluster,complete sequence.] [NT:FrnF; actVA-ORF1 homolog] [LE:8271] [RE:9824] [DI:direct]

| ORF Name | NT ID | AA ID | NT LN | AA LN | Score | P-value |
|---|---|---|---|---|---|---|
| 4088293_c1_1243 | 732 | 7903 | 300 | 99 | | |

Description

NO-HIT

| ORF Name | NT ID | AA ID | NT LN | AA LN | Score | P-value |
|---|---|---|---|---|---|---|
| 4100380_f2_482 | 733 | 7904 | 294 | 97 | | |

Description

NO-HIT

| ORF Name | NT ID | AA ID | NT LN | AA LN | Score | P-value |
|---|---|---|---|---|---|---|
| 4117968_f1_117 | 734 | 7905 | 219 | 72 | | |

Description

NO-HIT

| ORF Name | NT ID | AA ID | NT LN | AA LN | Score | P-value |
|---|---|---|---|---|---|---|
| 412628_f1_5 | 735 | 7906 | 225 | 74 | | |

Description

NO-HIT

| ORF Name | NT ID | AA ID | NT LN | AA LN | Score | P-value |
|---|---|---|---|---|---|---|
| 4144066_c1_1233 | 736 | 7907 | 294 | 97 | 335 | 2.6e-30 |

Description sp:[LN:T13141] [AC:T13141] [PN:lysozyme homolog:protein gp54] [CL:phage T4 lysozyme:phage T4 lysozyme homology] [OR:phage N15] [DB:pir2] >gp:[GI:g3192716] [LN:AF064539] [AC:AF064539] [PN:gp54] [GN:gene 54] [OR:Bacteriophage N15] [DB:genpept-phg] [DE:Bacteriophage N15, complete genome.] [NT:lysozyme homolog] [LE:42915] [RE:43451] [DI:direct]

| ORF_Name | NT_ID | AA_ID | NT/LN | AA/LN | Score | P-value |
|---|---|---|---|---|---|---|
| 4164818_f2_581 | 737 | 7908 | 651 | 216 | 929 | 3.0e-93 |

Description sp:[LN:PNCA_ECOLI] [AC:P21369:P76229:P76910] [GN:PNCA:NAM] [OR:Escherichia coli]
[EC:3.5.1.-:3.5.1.19] [DE:(PZASE); NICOTINAMIDASE, (NICOTINE DEAMIDASE)]]
[SP:P21369:P76229:P76910] [DB:swissprot] >gp:[GI:d1016282:g1742879] [LN:D90820]
[AC:D90820:AB001340] [GN:ydjB] [OR:Escherichia coli] [SR:Escherichia coli
(strain:K12) DNA, clone_lib:Kohara lambda minise] [DB:genpept-bct1] [DE:E.coli
genomic DNA, Kohara clone #329(39.7-40.0 min.).] [NT:ORF_ID:o329#5; similar to
[PIR Accession Number] [LE:8744] [RE:9385] [DI:direct] >gp:[GI:g145280]
[LN:ECOANSORA] [AC:M26934] [OR:Escherichia coli] [SR:E.coli K-12 DNA]
[DB:genpept-bct1] [DE:E.coli ansA-ORF1 gene pair, complete cds.] [NT:ORF1]
[LE:1140] [RE:1781] [DI:direct]

| ORF_Name | NT_ID | AA_ID | NT/LN | AA/LN | Score | P-value |
|---|---|---|---|---|---|---|
| 4166711_c2_1564 | 738 | 7909 | 1299 | 432 | 78 | 0.043 |

Description sp:[LN:HSP2_HUMAN] [AC:P04554] [GN:PRM2] [OR:Homo sapiens] [SR:,Human]
[DE:PROTEINS HPS1, HPS2, HPI2, AND HPI1)] [SP:P04554] [DB:swissprot]
>sp:[LN:HSHUP2]
[AC:B38515:I38871:A02661:A25395:B25395:S10801:S17219;S02056:A29222: S33299]
[PN:sperm histone P2 precursor:proprotamine:protamine 2 (P2):protamine 3 (P3)]
[GN:PRM2] [CL:sperm histone] [OR:Homo sapiens] [SR:, man] [DB:pir1]
[MP:16p13.3-16p13.3] >gp:[GI:g886877] [LN:HSPRMTNP2] [AC:Z46940] [PN:protamine 2]
[GN:PRM2] [OR:Homo sapiens] [SR:human] [DB:genpept-pri1] [DE:H.sapiens PRM1 gene,
PRM2 gene and TNP2 gene.] [SP:P04554] [LE:6275:6709] [RE:6545:6746]
[DI:directJoin] >gp:[GI:g190456] [LN:HUMPROT2] [AC:M60332] [PN:proatamine 2]
[GN:PRM2] [OR:Homo sapiens] [SR:Human DNA] [DB:genpept-pri1] [DE:Human protamine
2 gene, complete cds.] [LE:904:1338] [RE:1174:1375] [DI:directJoin]
>gp:[GI:g642460] [LN:HSU15422] [AC:U15422] [PN:protamine 2] [GN:PRM2] [FN:DNA
binding protein] [OR:Homo sapiens] [SR:human] [DB:genpept-pri3] [DE:Human
protamine 1 (PRM1), protamine 2 (PRM2) and transition protein2 (TNP2) genes,
complete cds.] [LE:19893:20326] [RE:20163:20363] [DI:directJoin]

| ORF_Name | NT_ID | AA_ID | NT/LN | AA/LN | Score | P-value |
|---|---|---|---|---|---|---|
| 417150_c1_1432 | 739 | 7910 | 246 | 81 | | |

Description

NO-HIT

| ORF Name | NT ID | AA ID | NT LN | AA LN | Score | P-value |
|---|---|---|---|---|---|---|
| 4180463_c2_1797 | 740 | 7911 | 630 | 209 | 1031 | 4.6e-104 |

Description sp:[LN:F64874] [AC:F64874] [PN:probable translation factor yciO] [GN:yciO]
[CL:hypothetical protein HI1198] [OR:Escherichia coli] [DB:pir2]
>gp:[GI:d1015517:g1742059] [LN:D90764] [AC:D90764:AB001340] [GN:yciO]
[OR:Escherichia coli] [SR:Escherichia coli (strain:K12) DNA, clone_lib:Kohara
lambda minise] [DB:genpept-bct1] [DE:E.coli genomic DNA, Kohara clone
253(28.4-28.7 min.).] [NT:ORF_ID:o253#4; similar to [SwissProt Accession]
[LE:6682] [RE:7338] [DI:direct] >gp:[GI:d1015532:g1742075] [LN:D90765]
[AC:D90765:AB001340] [GN:yciO] [OR:Escherichia coli] [SR:Escherichia coli
(strain:K12) DNA, clone_lib:Kohara lambda minise] [DB:genpept-bct1] [DE:E.coli
genomic DNA, Kohara clone #254(28.4-28.9 min.).] [NT:ORF_ID:o253#4; similar to
[SwissProt Accession] [LE:4188] [RE:4844] [DI:direct] >gp:[GI:g1787521]
[LN:AE000224] [AC:AE000224:U00096] [PN:orf, hypothetical protein] [GN:yciO]
[FN:orf; Unknown] [OR:Escherichia coli] [DB:genpept-bct2] [DE:Escherichia coli
K-12 MG1655 section 114 of 400 of the completegenome.] [NT:o218; 100 pct
identical to YCIO_ECOLI SW:] [LE:10251] [RE:10907] [DI:direct]

| ORF Name | NT ID | AA ID | NT LN | AA LN | Score | P-value |
|---|---|---|---|---|---|---|
| 429701_c2_1662 | 741 | 7912 | 1236 | 411 | 1553 | 2.3e-159 |

Description gp:[GI:e293295:g2208964] [LN:PACIOAB] [AC:Y10528] [PN:cyanide insensitive
terminal oxidase] [GN:cioA] [OR:Pseudomonas aeruginosa] [DB:genpept-bct1]
[DE:P.aeruginosa cioA and cioB genes.] [LE:276] [RE:1742] [DI:direct]

| ORF Name | NT ID | AA ID | NT LN | AA LN | Score | P-value |
|---|---|---|---|---|---|---|
| 4300407_c2_1589 | 742 | 7913 | 192 | 63 | | |

Description

NO-HIT

| ORF Name | NT ID | AA ID | NT LN | AA LN | Score | P-value |
|---|---|---|---|---|---|---|
| 4302343_c3_1969 | 743 | 7914 | 1029 | 342 | 226 | 9.8e-19 |

Description sp:[LN:RMECI] [AC:S56589:B28484:D65251:A25124] [PN:replication termination factor dnaT:primosomal protein i] [GN:dnaT] [CL:primosomal protein i] [OR:Escherichia coli] [DB:pir1] [MP:99 min] >gp:[GI:g145790] [LN:ECODNATC] [AC:J04030:J02785:M13005] [OR:Escherichia coli] [SR:E.coli (strain K12 C600) DNA [1]; clone pJK137 [2]] [DB:genpept-bct1] [DE:E.coli dna operon encoding normal and stable DNA replicationproteins P-14, dnaT, dnaC and P-18, complete cds.] [NT:prepriming protein I] [LE:523] [RE:1062] [DI:direct] >gp:[GI:g537205] [LN:ECOUW93] [AC:U14003] [GN:dnaT] [FN:DNA biosynthesis; primasomal protein i] [OR:Escherichia coli] [DB:genpept-bct1] [DE:Escherichia coli K-12 chromosomal region from 92.8 to 00.1 minutes.] [NT:CG Site No. 839] [LE:291810] [RE:292349] [DI:complement] >gp:[GI:g1790824] [LN:AE000507] [AC:AE000507:U00096] [PN:DNA biosynthesis; primosomal protein i] [GN:dnaT] [FN:factor; DNA - replication, repair,] [OR:Escherichia coli] [DB:genpept-bct2] [DE:Escherichia coli K-12 MG1655 section 397 of 400 of the completegenome.] [NT:f179; 99 pct identical amino acid sequence and] [LE:3927] [RE:4466] [DI:complement]

| ORF Name | NT ID | AA ID | NT LN | AA LN | Score | P-value |
|---|---|---|---|---|---|---|
| 4322260_f3_910 | 744 | 7915 | 576 | 191 | 650 | 1.1e-63 |

Description sp:[LN:YBIL_ECOLI] [AC:P75780] [GN:YBIL] [OR:Escherichia coli] [DE:PROBABLE TONB-DEPENDENT RECEPTOR YBIL PRECURSOR] [SP:P75780] [DB:swissprot] >sp:[LN:E64817] [AC:E64817] [PN:probable membrane protein b0805] [OR:Escherichia coli] [DB:pir2] >gp:[GI:d1036457:g4062366] [LN:D90717] [AC:D90717:AB001340] [PN:Fe(III)-pyochelin receptor fptA precursor] [GN:fptA] [OR:Escherichia coli] [SR:Escherichia coli(strain:K12) DNA, clone:Kohara clone #204] [DB:genpept-bct1] [DE:Escherichia coli genomic DNA. (17.9 - 18.2 min).] [NT:ORF_ID:o205#1; similar to PIR Accession Number] [LE:10551] [RE:12833] [DI:complement] >gp:[GI:d1036462:g4062371] [LN:D90718] [AC:D90718:AB001340] [PN:Fe(III)-pyochelin receptor fptA precursor] [GN:fptA] [OR:Escherichia coli] [SR:Escherichia coli(strain:K12) DNA, clone:Kohara clone #205] [DB:genpept-bct1] [DE:Escherichia coli genomic DNA. (18.1 - 18.4 min).] [NT:ORF_ID:o205#1; similar to PIR Accession Number] [LE:567] [RE:2849] [DI:complement] >gp:[GI:g1787024] [LN:AE000182] [AC:AE000182:U00096] [PN:putative outer membrane receptor for iron] [GN:b0805] [FN:putative membrane; Not classified] [OR:Escherichia coli] [DB:genpept-bct2] [DE:Escherichia coli K-12 MG1655 section 72 of 400 of the completegenome.] [NT:f760; This 760 aa ORF is 25 pct identical (75 gaps)] [LE:8516] [RE:10798] [DI:complement]

| ORF Name | NT ID | AA ID | NT LN | AA LN | Score | P-value |
|---|---|---|---|---|---|---|
| 4347125_c3_1935 | 745 | 7916 | 960 | 319 | 1326 | 2.6e-135 |

Description sp:[LN:YCFX_ECOLI] [AC:P75959] [GN:YCFX] [OR:Escherichia coli] [DE:HYPOTHETICAL 33.0 KD PROTEIN IN MFD-COBB INTERGENIC REGION] [SP:P75959] [DB:swissprot] >sp:[LN:D64856] [AC:D64856] [PN:ycfX protein] [GN:ycfX] [CL:conserved hypothetical protein HI0182:glucose kinase homology] [OR:Escherichia coli] [DB:pir2] >gp:[GI:d1036925:g4062691] [LN:D90747] [AC:D90747:AB001340] [PN:Hypothetical protein HI0182] [OR:Escherichia coli] [SR:Escherichia coli(strain:K12) DNA, clone:Kohara clone #238] [DB:genpept-bct1] [DE:Escherichia coli genomic DNA. (25.2 - 25.6 min).] [NT:ORF_ID:o238#8; similar to PIR Accession Number] [LE:10280] [RE:11191] [DI:direct] >gp:[GI:g1787363] [LN:AE000212] [AC:AE000212:U00096] [PN:putative NAGC-like transcriptional regulator] [GN:ycfX] [FN:putative regulator; Not classified] [OR:Escherichia coli] [DB:genpept-bct2] [DE:Escherichia coli K-12 MG1655 section 102 of 400 of the completegenome.] [NT:o303; This 303 aa ORF is 50 pct identical (1 gap)] [LE:4595] [RE:5506] [DI:direct]

| ORF Name | NT ID | AA ID | NT LN | AA LN | Score | P-value |
|---|---|---|---|---|---|---|
| 4352255_c3_1981 | 746 | 7917 | 330 | 109 | | |

Description

NO-HIT

| ORF Name | NT ID | AA ID | NT LN | AA LN | Score | P-value |
|---|---|---|---|---|---|---|
| 4353268_c3_2167 | 747 | 7918 | 747 | 248 | 1062 | 2.4e-107 |

Description sp:[LN:DCOP_ECOLI] [AC:P08244] [GN:PYRF] [OR:Escherichia coli] [EC:4.1.1.23] [DE:DECARBOXYLASE)] [SP:P08244] [DB:swissprot] >sp:[LN:DCECOP] [AC:A28440:D64876] [PN:orotidine-5'-phosphate decarboxylase,:OMP decarboxylase:orotidine-5'-phosphate carboxy-lyase] [GN:pyrF:purF] [CL:orotidine-5'-phosphate decarboxylase:orotidine-5'-phosphate decarboxylase homology] [OR:Escherichia coli] [EC:4.1.1.23] [DB:pir1] [MP:28 min] >gp:[GI:d1015551:g1742095] [LN:D90766] [AC:D90766:AB001340] [PN:Orotidine 5'-phosphate decarboxylase (EC] [GN:pyrF] [OR:Escherichia coli (strain:K12) DNA, clone_lib:Kohara lambda minise] [DB:genpept-bct1] [DE:E.coli genomic DNA, Kohara clone #255(28.8-29.2 min.).] [NT:ORF_ID:o255#6; similar to [SwissProt Accession] [LE:4186] [RE:4923] [DI:direct] >gp:[GI:g147475] [LN:ECOPYRF] [AC:J02768] [GN:pyrF] [OR:Escherichia coli] [SR:E.coli K12 (CLT43) DNA, clone pDK26] [DB:genpept-bct1] [DE:E.coli pyrF operon encoding orotidine 5'-monophosphate (OMP)decarboxylase.] [NT:orotidine 5' monophosphate (OMP) decarboxylase] [LE:320] [RE:1057] [DI:direct] >gp:[GI:g1787537] [LN:AE000226] [AC:AE000226:U00096] [PN:orotidine-5'-phosphate decarboxylase] [GN:pyrF] [FN:enzyme; Pyrimidine ribonucleotide biosynthesis] [OR:Escherichia coli] [DB:genpept-bct2] [EC:4.1.1.23] [DE:Escherichia coli K-12 MG1655 section 116 of 400 of the completegenome.] [NT:o245; 100 pct identical to DCOP_ECOLI SW: P08244;] [LE:3413] [RE:4150] [DI:direct]

| ORF Name | NT ID | AA ID | NT/LN | AA/LN | Score | P-value |
|---|---|---|---|---|---|---|
| 4422317_c1_1454 | 748 | 7919 | 408 | 135 | 408 | 4.8e-38 |

Description sp:[LN:YCIS_ECOLI] [AC:P77614] [GN:YCIS] [OR:Escherichia coli] [DE:HYPOTHETICAL
11.4 KD PROTEIN IN PGPB-PYRF INTERGENIC REGION] [SP:P77614] [DB:swissprot]
>sp:[LN:B64876] [AC:B64876] [PN:probable membrane protein yciS] [GN:yciS]
[CL:hypothetical protein HI1222] [OR:Escherichia coli] [DB:pir2]
>gp:[GI:d1015549:g1742093] [LN:D90766] [AC:D90766:AB001340] [OR:Escherichia coli]
[SR:Escherichia coli (strain:K12) DNA, clone_lib:Kohara lambda minise]
[DB:genpept-bct1] [DE:E.coli genomic DNA, Kohara clone #255(28.8-29.2 min.).]
[NT:ORF_ID:o255#4; similar to [SwissProt Accession] [LE:2508] [RE:2816]
[DI:direct] >gp:[GI:g1787535] [LN:AE000226] [AC:AE000226:U00096] [PN:orf,
hypothetical protein] [GN:yciS] [FN:orf; Unknown] [OR:Escherichia coli]
[DB:genpept-bct2] [DE:Escherichia coli K-12 MG1655 section 116 of 400 of the
completegenome.] [NT:o102; This 102 aa ORF is 35 pct identical (0 gaps)]
[LE:1735] [RE:2043] [DI:direct]

| ORF Name | NT ID | AA ID | NT/LN | AA/LN | Score | P-value |
|---|---|---|---|---|---|---|
| 4457061_c3_2133 | 749 | 7920 | 1341 | 446 | 1717 | 9.4e-177 |

Description sp:[LN:TUB3_AGRVI] [AC:P70786] [GN:TTUB] [OR:Agrobacterium vitis] [DE:PUTATIVE
TARTRATE TRANSPORTER] [SP:P70786] [DB:swissprot] >gp:[GI:g984367] [LN:AVU32375]
[AC:U32375] [GN:ttuB] [OR:Agrobacterium vitis] [SR:plasmid pTrAB3]
[DB:genpept-bct2] [DE:Agrobacterium vitis plasmid pTrAB3 tartrate utilization
generegion, including LysR-like regulator (ttuA), membrane protein(ttuB),
tartrate dehydrogenase (ttuC and ttuC'), enzyme degradingprimary tartrate
degradation product (ttuD) and pyruvate kinase(ttuE) genes, complete cds.]
[NT:membrane protein] [LE:1579] [RE:2928] [DI:direct]

| ORF Name | NT ID | AA ID | NT/LN | AA/LN | Score | P-value |
|---|---|---|---|---|---|---|
| 4460002_f1_358 | 750 | 7921 | 744 | 247 | 876 | 1.2e-87 |

Description sp:[LN:D64855] [AC:D64855] [PN:probable transcription regulator ycfQ] [GN:ycfQ]
[OR:Escherichia coli] [DB:pir2] >gp:[GI:d1036912:g4062680] [LN:D90746]
[AC:D90746:AB001340] [PN:SocA3 protein] [GN:socA3] [OR:Escherichia coli]
[SR:Escherichia coli(strain:K12) DNA, clone:Kohara clone #237] [DB:genpept-bct1]
[DE:Escherichia coli genomic DNA. (25.0 - 25.4 min).] [NT:ORF_ID:o237#10; similar
to PIR Accession Number] [LE:10141] [RE:10851] [DI:complement] >gp:[GI:g1787354]
[LN:AE000211] [AC:AE000211:U00096] [PN:orf, hypothetical protein] [GN:ycfQ]
[FN:orf; Unknown] [OR:Escherichia coli] [DB:genpept-bct2] [DE:Escherichia coli
K-12 MG1655 section 101 of 400 of the completegenome.] [NT:f236; This 236 aa ORF
is 28 pct identical (12 gaps)] [LE:6512] [RE:7222] [DI:complement]

| ORF Name | NT ID | AA ID | NT LN | AA LN | Score | P-value |
|---|---|---|---|---|---|---|
| 4475443_c2_1862 | 751 | 7922 | 234 | 77 | 319 | 1.3e-28 |

Description sp:[LN:PSPB_ECOLI] [AC:P23854] [GN:PSPB] [OR:Escherichia coli] [DE:PHAGE SHOCK
PROTEIN B] [SP:P23854] [DB:swissprot] >sp:[LN:S17122] [AC:S17122:I84049:D64879]
[PN:phage shock protein B] [GN:pspB] [OR:Escherichia coli] [DB:pir2]
>gp:[GI:d1015590:g1742135] [LN:D90768] [AC:D90768:AB001340] [PN:Phage shock
protein B] [GN:pspB] [OR:Escherichia coli] [SR:Escherichia coli (strain:K12) DNA,
clone_lib:Kohara lambda minise] [DB:genpept-bct1] [DE:E.coli genomic DNA, Kohara
clone #257(29.1-29.6 min.).] [NT:ORF_ID:o257#14; similar to [PIR Accession
Number] [LE:16171] [RE:16395] [DI:direct] >gp:[GI:d1015598:g1742144] [LN:D90769]
[AC:D90769:AB001340] [PN:Phage shock protein B] [GN:pspB] [OR:Escherichia coli]
[SR:Escherichia coli (strain:K12) DNA, clone_lib:Kohara lambda minise]
[DB:genpept-bct1] [DE:E.coli genomic DNA, Kohara clone #258(29.5-29.8 min.).]
[NT:ORF_ID:o257#14; similar to [PIR Accession Number] [LE:2175] [RE:2399]
[DI:direct] >gp:[GI:g42540] [LN:ECPSP] [AC:X57560] [PN:pspB protein] [GN:pspB]
[OR:Escherichia coli] [DB:genpept-bct1] [DE:E.coli stress-induced psp operon
DNA.] [SP:P23854] [LE:1220] [RE:1444] [DI:direct] >gp:[GI:g1787563] [LN:AE000228]
[AC:AE000228:U00096] [PN:phage shock protein] [GN:pspB] [FN:IS, phage, Tn;
Phage-related functions and] [OR:Escherichia coli] [DB:genpept-bct2]
[DE:Escherichia coli K-12 MG1655 section 118 of 400 of the completegenome.]
[NT:o74; 100 pct identical to PSPB_ECOLI SW: P23854; CG] [LE:9466] [RE:9690]
[DI:direct]

| ORF Name | NT ID | AA ID | NT LN | AA LN | Score | P-value |
|---|---|---|---|---|---|---|
| 4507943_f2_579 | 752 | 7923 | 1863 | 620 | 2688 | 1.2e-279 |

Description sp:[LN:PRECT4]
[AC:F64936:A24813:I59590:I81186:I81187:I81194:I81189;I81193:I81207:
I81208:I81190:I81188] [PN:proteinase IV,] [GN:sppA] [CL:proteinase IV]
[OR:Escherichia coli] [EC:3.4.-.-] [DB:pir1] >gp:[GI:d1016280:g1742877]
[LN:D90820] [AC:D90820:AB001340] [PN:Proteinase IV (EC 3.4.-.-)] [GN:sppA]
[OR:Escherichia coli] [SR:Escherichia coli (strain:K12) DNA, clone_lib:Kohara
lambda minise] [DB:genpept-bct1] [DE:E.coli genomic DNA, Kohara clone
329(39.7-40.0 min.).] [NT:ORF_ID:o329#3; similar to [PIR Accession Number]
[LE:5694] [RE:7550] [DI:direct] >gp:[GI:g1788064] [LN:AE000271]
[AC:AE000271:U00096] [PN:protease IV, a signal peptide peptidase] [GN:sppA]
[FN:enzyme; Degradation of proteins, peptides,] [OR:Escherichia coli]
[DB:genpept-bct2] [EC:3.4.-.-] [DE:Escherichia coli K-12 MG1655 section 161 of
400 of the completegenome.] [NT:o618; 99 pct identical to SPPA_ECOLI SW: P08395;
CG] [LE:6614] [RE:8470] [DI:direct]

| ORF Name | NT ID | AA ID | NT/LN | AA/LN | Score | P-value |
|---|---|---|---|---|---|---|
| 4550908_c2_1854 | 753 | 7924 | 1224 | 407 | 765 | 7.2e-76 |

Description sp:[LN:HIPO_CAMJE] [AC:P45493] [GN:HIPO] [OR:Campylobacter jejuni] [EC:3.5.1.32] [DE:(HIPPURICASE)] [SP:P45493] [DB:swissprot] >sp:[LN:I40762] [AC:I40762:S47321] [PN:hippurate hydrolase,] [GN:hipO] [CL:hippurate hydrolase] [OR:Campylobacter jejuni] [EC:3.5.1.32] [DB:pir2] >gp:[GI:g535810] [LN:CJHIPPURC] [AC:Z36940] [PN:hippuricase] [GN:hipO] [FN:N-benzoylglycine amidohydrolase] [OR:Campylobacter jejuni] [DB:genpept-bct1] [EC:3.5.1.32] [DE:C.jejuni hipO gene for hippuricase.] [SP:P45493] [LE:1341] [RE:2492] [DI:direct]

| ORF Name | NT ID | AA ID | NT/LN | AA/LN | Score | P-value |
|---|---|---|---|---|---|---|
| 4554818_c1_1281 | 754 | 7925 | 1023 | 340 | 1194 | 2.5e-121 |

Description gp:[GI:e293136:g2208965] [LN:PACIOAB] [AC:Y10528] [PN:cyanide insensitive terminal oxidase] [GN:cioB] [OR:Pseudomonas aeruginosa] [DB:genpept-bct1] [DE:P.aeruginosa cioA and cioB genes.] [LE:1746] [RE:2753] [DI:direct]

| ORF Name | NT ID | AA ID | NT LN | AA LN | Score | P-value |
|---|---|---|---|---|---|---|
| 4726068_f3_900 | 755 | 7926 | 1203 | 400 | 1954 | 7.2e-202 |

Description sp:[LN:TSECB] [AC:H64873:C93746:A92276:A92091:A92101:A01155] [PN:tryptophan
synthase, beta chain] [GN:trpB] [CL:tryptophan synthase beta chain:tryptophan
synthase beta chain homology] [OR:Escherichia coli] [EC:4.2.1.20] [DB:pir1]
[MP:28 min] >gp:[GI:g147958] [LN:ECOTGP]
[AC:J01714:M12471:M12472:M24865:M25264:M25593:M59208] [PN:tryptophan synthase
beta subunit] [GN:trpB] [OR:Escherichia coli] [SR:Escherichia coli RNA and DNA]
[DB:genpept-bct1] [DE:Escherichia coli tryptophan operon (trpABCDE) genes,
complete.] [LE:5014] [RE:6207] [DI:direct] >gp:[GI:e1387356:g4377530] [LN:ECTRPB]
[AC:V00365] [GN:trpB] [OR:Escherichia coli] [DB:genpept-bct1] [DE:E. coli gene
trpB (codes for tryptophan synthetase beta-SU).] [LE:1] [RE:1194] [DI:direct]
>gp:[GI:g43205] [LN:ECTRPX] [AC:V00372] [OR:Escherichia coli] [DB:genpept-bct1]
[DE:E. coli trp operon with the genes trpE, trpD, trpC, trpB and trpA.Genetic map
position approximately 27.5 minutes. These genes codefor the following enzymes:
trpE - anthranilate synthetase [E.C.4.1.3.27] trpD - glutamine
amidotransferase-phophoribosylanthranilate transferase trpC
-N-(5-phosphoribosyl)anthranilate isomerase,indole-3-glycerolphosphate synthetase
trpB - tryptophansynthetase [E.C. 4.2.1.20] B protein trpA - tryptophansynthetase
[E.C. 4.2.1.20] A protein.] [NT:trpB] [SP:P00932] [LE:4688] [RE:5881] [DI:direct]
>gp:[GI:g775132] [LN:ECU23490] [AC:U23490] [PN:tryptophan synthase beta subunit]
[GN:trpB] [OR:Escherichia coli] [DB:genpept-bct1] [DE:Escherichia coli ECOR 1
anthranilate isomerase (trpC), tryptophansynthase beta subunit (trpB), tryptophan
synthase alpha subunit(trpA), (yciG), (yciF), and (yciE) genes, complete cds.]
[LE:1385] [RE:2578] [DI:direct] >gp:[GI:g775146] [LN:ECU23492] [AC:U23492]
[PN:tryptophan synthase beta subunit] [GN:trpB] [OR:Escherichia coli]
[DB:genpept-bct1] [DE:Escherichia coli ECOR 16 anthranilate isomerase (trpC),
tryptophansynthase beta subunit (trpB), tryptophan synthase alpha subunit(trpA),
(yciG), (yciF), and (yciE) genes, complete cds.] [LE:1385] [RE:2578] [DI:direct]
>gp:[GI:g775153] [LN:ECU23493] [AC:U23493] [PN:tryptophan synthase beta subunit]
[GN:trpB] [OR:Escherichia coli] [DB:genpept-bct1] [DE:Escherichia coli ECOR 28
anthranilate isomerase (trpC), tryptophansynthase beta subunit (trpB), tryptophan
synthase alpha subunit(trpA), (yciG), (yciF), and (yciE) genes, complete cds.]
[LE:1385] [RE:2578] [DI:direct] >gp:[GI:g775197] [LN:ECU23500] [AC:U23500]
[PN:tryptophan synthase beta subunit] [GN:trpB] [OR:Escherichia coli]
[DB:genpept-bct1] [DE:Escherichia coli ECOR 71 anthranilate isomerase (trpC),
tryptophansynthase beta subunit (trpB), tryptophan synthase alpha subunit(trpA),
(yciG), (yciF), and (yciE) genes, complete cds.] [LE:1385] [RE:2578] [DI:direct]

| ORF_Name | NT_ID | AA_ID | NT/LN | AA/LN | Score | P-value |
|---|---|---|---|---|---|---|
| 4770943_c2_1808 | 756 | 7927 | 912 | 303 | 1370 | 5.6e-140 |

Description sp:[LN:YCIL_ECOLI] [AC:P37765] [GN:YCIL] [OR:Escherichia coli] [DE:HYPOTHETICAL
32.7 KD PROTEIN IN TRPL-BTUR INTERGENIC REGION (ORF4)] [SP:P37765] [DB:swissprot]
>sp:[LN:H64874] [AC:H64874] [PN:probable pseudouridylate synthase yciL] [GN:yciL]
[CL:conserved hypothetical protein HI1243] [OR:Escherichia coli] [DB:pir2]
>gp:[GI:d1015522:g1742064] [LN:D90764] [AC:D90764:AB001340] [GN:yciL]
[OR:Escherichia coli] [SR:Escherichia coli (strain:K12) DNA, clone_lib:Kohara
lambda minise] [DB:genpept-bct1] [DE:E.coli genomic DNA, Kohara clone
253(28.4-28.7 min.).] [NT:ORF_ID:o253#9; similar to [SwissProt Accession]
[LE:9472] [RE:10347] [DI:direct] >gp:[GI:d1015537:g1742080] [LN:D90765]
[AC:D90765:AB001340] [GN:yciL] [OR:Escherichia coli] [SR:Escherichia coli
(strain:K12) DNA, clone_lib:Kohara lambda minise] [DB:genpept-bct1] [DE:E.coli
genomic DNA, Kohara clone #254(28.4-28.9 min.).] [NT:ORF_ID:o253#9; similar to
[SwissProt Accession] [LE:6978] [RE:7853] [DI:direct] >gp:[GI:g1787524]
[LN:AE000225] [AC:AE000225:U00096] [PN:orf, hypothetical protein] [GN:yciL]
[FN:orf; Unknown] [OR:Escherichia coli] [DB:genpept-bct2] [DE:Escherichia coli
K-12 MG1655 section 115 of 400 of the completegenome.] [NT:o291; 100 pct
identical to YCIL_ECOLI SW:] [LE:136] [RE:1011] [DI:direct]

| ORF_Name | NT_ID | AA_ID | NT/LN | AA/LN | Score | P-value |
|---|---|---|---|---|---|---|
| 4777293_c2_1804 | 757 | 7928 | 1005 | 334 | | |

Description

NO-HIT

| ORF_Name | NT_ID | AA_ID | NT/LN | AA/LN | Score | P-value |
|---|---|---|---|---|---|---|
| 4801888_f2_586 | 758 | 7929 | 894 | 297 | 1244 | 1.2e-126 |

Description sp:[LN:D64938] [AC:D64938] [PN:hypothetical protein b1780] [OR:Escherichia coli]
[DB:pir2] >gp:[GI:g1788080] [LN:AE000273] [AC:AE000273:U00096] [PN:orf,
hypothetical protein] [GN:yeaD] [FN:orf; Unknown] [OR:Escherichia coli]
[DB:genpept-bct2] [DE:Escherichia coli K-12 MG1655 section 163 of 400 of the
completegenome.] [NT:o301; This 301 aa ORF is 42 pct identical (38 gaps)]
[LE:1259] [RE:2164] [DI:direct]

| ORF Name | NT ID | AA ID | NT LN | AA LN | Score | P-value |
|---|---|---|---|---|---|---|
| 4807076_f2_517 | 759 | 7930 | 456 | 151 | 446 | 4.6e-42 |

Description sp:[LN:YKGJ_ECOLI] [AC:P71300] [GN:YKGJ] [OR:Escherichia coli] [DE:HYPOTHETICAL
11.8 KD PROTEIN IN INTF-EAEH INTERGENIC REGION] [SP:P71300] [DB:swissprot]
>sp:[LN:H64754] [AC:H64754] [PN:ykgJ protein:conserved hypothetical protein
b0288] [GN:ykgJ] [OR:Escherichia coli] [DB:pir2] >gp:[GI:g2367105] [LN:AE000136]
[AC:AE000136:U00096] [PN:putative ferredoxin] [GN:ykgJ] [FN:putative carrier; Not
classified] [OR:Escherichia coli] [DB:genpept-bct2] [DE:Escherichia coli K-12
MG1655 section 26 of 400 of the completegenome.] [NT:f109; residues 9-103 are 47
pct identical (2 gaps)] [LE:8234] [RE:8563] [DI:complement] >gp:[GI:g1657489]
[LN:ECU73857] [AC:U73857] [OR:Escherichia coli] [DB:genpept-bct2] [DE:Escherichia
coli chromosome minutes 6-8.] [NT:similar to putative ferredoxin of A.
calcoaceticus] [LE:11651] [RE:11980] [DI:complement]

| ORF Name | NT ID | AA ID | NT LN | AA LN | Score | P-value |
|---|---|---|---|---|---|---|
| 4885790_f3_946 | 760 | 7931 | 1449 | 482 | | |

Description

NO-HIT

| ORF Name | NT ID | AA ID | NT LN | AA LN | Score | P-value |
|---|---|---|---|---|---|---|
| 4891541_c2_1752 | 761 | 7932 | 417 | 138 | 460 | 1.5e-43 |

Description sp:[LN:PTCA_ECOLI] [AC:P17335:Q57128:Q47092:Q47093:Q47094] [GN:CELC]
[OR:Escherichia coli] [EC:2.7.1.69] [DE:(EC 2.7.1.69) (EIII-CEL)]
[SP:P17335:Q57128:Q47092:Q47093:Q47094] [DB:swissprot] >sp:[LN:H64932]
[AC:H64932:S10872:I41161] [PN:phosphotransferase system enzyme II,,
cellobiose-specific, factor III:phosphotransferase system enzyme III,
phosphoenolpyruvate-dependent] [GN:celC] [CL:phosphotransferase system
lactose-specific enzyme II, factor III] [OR:Escherichia coli] [EC:2.7.1.69]
[DB:pir2] [MP:38 min] >gp:[GI:d1016240:g1742833] [LN:D90816] [AC:D90816:AB001340]
[PN:Phosphotransferase system enzyme II (EC) [GN:celC] [OR:Escherichia coli]
[SR:Escherichia coli (strain:K12) DNA, clone_lib:Kohara lambda minise]
[DB:genpept-bct1] [DE:E.coli genomic DNA, Kohara clone #325(38.9-39.2 min.).]
[NT:ORF_ID:o326#5; similar to [PIR Accession Number] [LE:12044] [RE:12394]
[DI:complement] >gp:[GI:d1016248:g1742842] [LN:D90817] [AC:D90817:AB001340]
[PN:Phosphotransferase system enzyme II (EC) [GN:celC] [OR:Escherichia coli]
[SR:Escherichia coli (strain:K12) DNA, clone_lib:Kohara lambda minise]
[DB:genpept-bct1] [DE:E.coli genomic DNA, Kohara clone #326(39.1-39.4 min.).]
[NT:ORF_ID:o326#5; similar to [PIR Accession Number] [LE:4815] [RE:5165]
[DI:complement] >gp:[GI:g145480] [LN:ECOCELA] [AC:M64438] [GN:celC]
[OR:Escherichia coli] [SR:E.coli DNA] [DB:genpept-bct1] [DE:E.coli cellobiose
permease proteins celA, celB, celC, cellobioseoperon repressor protein celD and
cellobiose phospho-B-glucosidaseprotein celF gene, complete cds.] [NT:putative]
[LE:2089] [RE:2439] [DI:direct] >gp:[GI:g145486] [LN:ECOCELCB] [AC:M93575]
[PN:PTS enzyme III cel] [GN:celC] [OR:Escherichia coli] [SR:Escherichia coli
(individual_isolate RM66C/human/Iowa, strain ECO] [DB:genpept-bct1]
[DE:Escherichia coli (strain ECOR 6, isolate RM66C/human/Iowa) PTSenzyme III cel
(celC) gene, complete cds.] [NT:putative] [LE:1] [RE:351] [DI:direct]
>gp:[GI:g145488] [LN:ECOCELCC] [AC:M93571] [PN:PTS enzyme III cel] [GN:celC]
[OR:Escherichia coli] [SR:Escherichia coli (individual_isolate RM52B/human/Iowa,
strain ECO] [DB:genpept-bct1] [DE:Escherichia coli (strain ECOR 28, isolate
RM52B/human/Iowa) PTSenzyme III cel (celC) gene, complete cds.] [NT:putative]
[LE:1] [RE:351] [DI:direct] >gp:[GI:g145490] [LN:ECOCELCD] [AC:M93572] [PN:PTS
enzyme III cel] [GN:celC] [OR:Escherichia coli] [SR:Escherichia coli
(individual_isolate RM42B/human/Iowa, strain ECO]
[DE:Escherichia coli (strain ECOR 35, isolate RM42B/human/Iowa) PTSenzyme III cel
(celC) gene, complete cds.] [NT:putative] [LE:1] [RE:351] [DI:direct]
>gp:[GI:g145492] [LN:ECOCELCE] [AC:M93592] [PN:PTS enzyme III cel] [GN:celC]

| ORF Name | NT ID | AA ID | NT LN | AA LN | Score | P-value |
|---|---|---|---|---|---|---|
| 4901516_f2_574 | 762 | 7933 | 762 | 253 | 1155 | 3.4e-117 |

Description gp:[GI:g6009517] [LN:AB020481] [AC:AB020481] [PN:acid phosphatase] [GN:pho]
[OR:Escherichia blattae] [SR:Escherichia blattae (strain:JCM1650) DNA]
[DB:genpept-bct1] [EC:3.1.3.2] [DE:Escherichia blattae gene for acid phosphatase,
complete cds.] [LE:331] [RE:1080] [DI:direct]

| ORF Name | NT ID | AA ID | NT LN | AA LN | Score | P-value |
|---|---|---|---|---|---|---|
| 4901661_c3_2000 | 763 | 7934 | 522 | 173 | 755 | 8.2e-75 |

Description gp:[GI:g775170] [LN:ECU23495] [AC:U23495] [PN:unknown] [GN:yciE] [OR:Escherichia coli] [DB:genpept-bct2] [DE:Escherichia coli ECOR 46 anthranilate isomerase (trpC), tryptophansynthase beta subunit (trpB), tryptophan synthase alpha subunit(trpA), (yciG), and (yciE) genes, complete cds.] [LE:4574] [RE:5080] [DI:direct]

| ORF Name | NT ID | AA ID | NT LN | AA LN | Score | P-value |
|---|---|---|---|---|---|---|
| 491525_f3_957 | 764 | 7935 | 870 | 289 | 699 | 7.1e-69 |

Description sp:[LN:YDJX_ECOLI] [AC:P76219;P77229] [GN:YDJX] [OR:Escherichia coli] [DE:HYPOTHETICAL 26.1 KD PROTEIN IN XTHA-GDHA INTERGENIC REGION] [SP:P76219;P77229] [DB:swissprot] >gp:[GI:d1016264:g1742859] [LN:D90818] [AC:D90818:AB001340] [GN:YQED] [OR:Escherichia coli] [SR:Escherichia coli (strain:K12) DNA, clone_lib:Kohara lambda minise] [DB:genpept-bct1] [DE:E.coli genomic DNA, Kohara clone #327(39.2-39.5 min.).] [NT:ORF_ID:o327#7; similar to [SwissProt Accession] [LE:13129] [RE:13839] [DI:direct] >gp:[GI:d1016268:g1742864] [LN:D90819] [AC:D90819:AB001340] [GN:YQED] [OR:Escherichia coli] [SR:Escherichia coli (strain:K12) DNA, clone_lib:Kohara lambda minise] [DB:genpept-bct1] [DE:E.coli genomic DNA, Kohara clone #328(39.4-39.8 min.).] [NT:ORF_ID:o327#7; similar to [SwissProt Accession] [LE:4916] [RE:5626] [DI:direct]

| ORF Name | NT ID | AA ID | NT LN | AA LN | Score | P-value |
|---|---|---|---|---|---|---|
| 5100661_f3_1090 | 765 | 7936 | 240 | 79 | 69 | 0.040 |

Description sp:[LN:S56686] [AC:S56686] [PN:histone H2B123] [CL:histone H2B] [OR:Triticum aestivum] [SR:, common wheat] [DB:pir2] >gp:[GI:d1007735:g531052] [LN:WHTPH2B12C] [AC:D37944] [PN:protein H2B123] [OR:Triticum aestivum] [SR:Triticum aestivum DNA, clone TH123] [DB:genpept-pln1] [DE:Wheat gene for protein H2B123, complete cds.] [LE:1637] [RE:2002] [DI:direct]

| ORF Name | NT ID | AA ID | NT LN | AA LN | Score | P-value |
|---|---|---|---|---|---|---|
| 5101718_f1_191 | 766 | 7937 | 1359 | 452 | 2157 | 2.2e-223 |

Description sp:[LN:A33504] [AC:A33504] [PN:glutamate dehydrogenase (NADP+),:glutamic dehydrogenase:NADP-specific glutamate dehydrogenase] [GN:gdh] [CL:glutamate dehydrogenase (NAD(P)+)] [OR:Salmonella typhimurium] [EC:1.4.1.4] [DB:pir1] [MP:27 min]

| ORF Name | NT ID | AA ID | NT/LN | AA/LN | Score | P-value |
|---|---|---|---|---|---|---|
| 5178758_c2_1708 | 767 | 7938 | 363 | 120 | 377 | 9.3e-35 |

Description sp:[LN:YEAC_ECOLI] [AC:P76231] [GN:YEAC] [OR:Escherichia coli] [DE:HYPOTHETICAL 10.3 KD PROTEIN IN ANSA-GAPA INTERGENIC REGION] [SP:P76231] [DB:swissprot]

| ORF Name | NT ID | AA ID | NT/LN | AA/LN | Score | P-value |
|---|---|---|---|---|---|---|
| 5194058_f1_88 | 768 | 7939 | 813 | 270 | 1240 | 3.3e-126 |

Description sp:[LN:S48029] [AC:S48029:A47681:C64877] [PN:enoyl-[acyl-carrier-protein] reductase (NADH),:enoyl-ACP reductase:short-chain alcohol dehydrogenase homolog envM] [GN:fabI:envM] [CL:enoyl-[acyl-carrier-protein] reductase (NADH):short-chain alcohol dehydrogenase homology] [OR:Escherichia coli] [EC:1.3.1.9] [DB:pir1] >gp:[GI:g587106] [LN:ECENVMACP] [AC:X78733] [PN:enoyl-ACP reductase] [GN:envM] [OR:Escherichia coli] [DB:genpept-bct1] [DE:E.coli envM gene.] [SP:P29132] [LE:530] [RE:1318] [DI:direct] >gp:[GI:g145851] [LN:ECOENVM] [AC:M97219] [GN:envM] [OR:Escherichia coli] [SR:Escherichia coli DNA] [DB:genpept-bct1] [DE:Escherichia coli short chain alcohol dehydrogenase homolog (envM)gene, complete cds.] [LE:404] [RE:1192] [DI:direct] >gp:[GI:g1787545] [LN:AE000227] [AC:AE000227:U00096] [PN:enoyl-[acyl-carrier-protein] reductase (NADH)] [GN:fabI] [FN:enzyme; Fatty acid and phosphatidic acid] [OR:Escherichia coli] [DB:genpept-bct2] [EC:1.3.1.9] [DE:Escherichia coli K-12 MG1655 section 117 of 400 of the completegenome.] [NT:f262; 100 pct identical to FABI_ECOLI SW: P29132;] [LE:1335] [RE:2123] [DI:complement]

| ORF Name | NT ID | AA ID | NT/LN | AA/LN | Score | P-value |
|---|---|---|---|---|---|---|
| 5194193_f2_559 | 769 | 7940 | 1188 | 395 | 1574 | 1.3e-161 |

Description sp:[LN:B64935] [AC:B64935] [PN:hypothetical protein b1754] [OR:Escherichia coli] [DB:pir2] >gp:[GI:g1788051] [LN:AE000270] [AC:AE000270:U00096] [PN:orf, hypothetical protein] [GN:b1754] [FN:orf; Unknown] [OR:Escherichia coli] [DB:genpept-bct2] [DE:Escherichia coli K-12 MG1655 section 160 of 400 of the completegenome.] [NT:o389; This 389 aa ORF is 26 pct identical (14 gaps)] [LE:3895] [RE:5064] [DI:direct]

| ORF Name | NT ID | AA ID | NT LN | AA LN | Score | P-value |
|---|---|---|---|---|---|---|
| 551425_f3_833 | 770 | 7941 | 1002 | 333 | 1422 | 1.7e-145 |

Description sp:[LN:B64879] [AC:B64879:JC6028] [PN:transcription activator pspF] [GN:pspF] [CL:Pseudomonas syringae hrpS protein:RNA polymerase sigma factor interaction domain homology] [OR:Escherichia coli] [DB:pir2] >gp:[GI:g1787561] [LN:AE000228] [AC:AE000228:U00096] [PN:psp operon transcriptional activator] [GN:pspF] [FN:regulator; Phage-related functions and] [OR:Escherichia coli] [DB:genpept-bct2] [DE:Escherichia coli K-12 MG1655 section 118 of 400 of the completegenome.] [NT:f330; 100 pct identical to 110 aa] [LE:7600] [RE:8592] [DI:complement]

| ORF Name | NT ID | AA ID | NT LN | AA LN | Score | P-value |
|---|---|---|---|---|---|---|
| 580327_f3_778 | 771 | 7942 | 366 | 121 | | |

Description

NO-HIT

| ORF Name | NT ID | AA ID | NT LN | AA LN | Score | P-value |
|---|---|---|---|---|---|---|
| 5959568_c2_1632 | 772 | 7943 | 375 | 124 | | |

Description

NO-HIT

| ORF Name | NT ID | AA ID | NT LN | AA LN | Score | P-value |
|---|---|---|---|---|---|---|
| 6033267_c3_1933 | 773 | 7944 | 1281 | 426 | 1844 | 3.3e-190 |

Description gp:[GI:d1036922:g4062688] [LN:D90747] [AC:D90747:AB001340] [PN:Hypothetical protein HI1555] [OR:Escherichia coli] [SR:Escherichia coli(strain:K12) DNA, clone:Kohara clone #238] [DB:genpept-bct1] [DE:Escherichia coli genomic DNA. (25.2 - 25.6 min).] [NT:ORF_ID:o238#5; similar to PIR Accession Number] [LE:7063] [RE:8313] [DI:direct]

| ORF Name | NT ID | AA ID | NT LN | AA LN | Score | P-value |
|---|---|---|---|---|---|---|
| 6050280_f2_698 | 774 | 7945 | 192 | 63 | | |

Description

NO-HIT

| ORF Name | NT ID | AA ID | NT/LN | AA/LN | Score | P-value |
|---|---|---|---|---|---|---|
| 6256533_f2_566 | 775 | 7946 | 441 | 146 | 455 | 5.1e-43 |

Description sp:[LN:G64935] [AC:G64935] [PN:hypothetical protein b1759] [CL:mutator mutT:mutT domain homology] [OR:Escherichia coli] [DB:pir2] >gp:[GI:d1016272:g1742868] [LN:D90819] [AC:D90819:AB001340] [PN:Mutator MutT protein] [OR:Escherichia coli] [SR:Escherichia coli (strain:K12) DNA, clone_lib:Kohara lambda minise] [DB:genpept-bct1] [DE:E.coli genomic DNA, Kohara clone #328(39.4-39.8 min.).] [NT:ORF_ID:o328#12; similar to [SwissProt Accession] [LE:13004] [RE:13411] [DI:direct] >gp:[GI:g1788056] [LN:AE000270] [AC:AE000270:U00096] [PN:orf, hypothetical protein] [GN:b1759] [FN:orf; Unknown] [OR:Escherichia coli] [DB:genpept-bct2] [DE:Escherichia coli K-12 MG1655 section 160 of 400 of the completegenome.] [NT:o135; This 135 aa ORF is 37 pct identical (5 gaps)] [LE:9315] [RE:9722] [DI:direct]

| ORF Name | NT ID | AA ID | NT/LN | AA/LN | Score | P-value |
|---|---|---|---|---|---|---|
| 6300312_c2_1886 | 776 | 7947 | 183 | 60 | | |

Description

NO-HIT

| ORF Name | NT ID | AA ID | NT/LN | AA/LN | Score | P-value |
|---|---|---|---|---|---|---|
| 6336580_c1_1344 | 777 | 7948 | 1965 | 654 | 3037 | 0.0 |

Description sp:[LN:TOP3_ECOLI] [AC:P14294] [GN:TOPB] [OR:Escherichia coli] [EC:5.99.1.2] [DE:DNA TOPOISOMERASE III,] [SP:P14294] [DB:swissprot] >sp:[LN:JV0049] [AC:JV0049:C64936] [PN:DNA topoisomerase, III] [GN:topB] [OR:Escherichia coli] [EC:5.99.1.2] [DB:pir2] [MP:39 min] >gp:[GI:d1016274:g1742870] [LN:D90819] [AC:D90819:AB001340] [PN:DNA topoisomerase III (EC 5.99.1.-)] [GN:topB] [OR:Escherichia coli] [SR:Escherichia coli (strain:K12) DNA, clone_lib:Kohara lambda minise] [DB:genpept-bct1] [DE:E.coli genomic DNA, Kohara clone #328(39.4-39.8 min.).] [NT:ORF_ID:o328#16; similar to [PIR Accession Number] [LE:16513] [RE:18474] [DI:complement] >gp:[GI:d1016277:g1742874] [LN:D90820] [AC:D90820:AB001340] [PN:DNA topoisomerase III (EC 5.99.1.-)] [GN:topB] [OR:Escherichia coli] [SR:Escherichia coli (strain:K12) DNA, clone_lib:Kohara lambda minise] [DB:genpept-bct1] [DE:E.coli genomic DNA, Kohara clone #329(39.7-40.0 min.).] [NT:ORF_ID:o328#16; similar to [PIR Accession Number] [LE:1856] [RE:3817] [DI:complement] >gp:[GI:g148026] [LN:ECOTOPB] [AC:J05076] [PN:topoisomerase III] [GN:topB] [OR:Escherichia coli] [SR:Escherichia coli (strain HMS-83) (clone: pRD15.) DNA] [DB:genpept-bct1] [DE:E.coli topoisomerase III (topB) gene, complete cds.] [LE:345] [RE:2306] [DI:direct] >gp:[GI:g1788061] [LN:AE000271] [AC:AE000271:U00096] [PN:DNA topoisomerase III] [GN:topB] [FN:enzyme; DNA - replication, repair,] [OR:Escherichia coli] [DB:genpept-bct2] [EC:5.99.1.2] [DE:Escherichia coli K-12 MG1655 section 161 of 400 of the completegenome.] [NT:f653; 100 pct identical to TOP3_ECOLI SW: P14294;] [LE:2776] [RE:4737] [DI:complement]

| ORF_Name | NT ID | AA ID | NT/LN | AA/LN | Score | P-value |
|---|---|---|---|---|---|---|
| 6352318_c3_2074 | 778 | 7949 | 990 | 329 | 916 | 7.1e-92 |

Description gp:[GI:g4378174] [LN:AF102543] [AC:AF102543] [PN:unknown] [OR:Zymomonas mobilis] [DB:genpept-bct2] [DE:Zymomonas mobilis ZM4 fosmid clone 43A9, complete sequence.] [NT:zm4orf8] [LE:25230] [RE:26225] [DI:direct]

| ORF_Name | NT ID | AA ID | NT/LN | AA/LN | Score | P-value |
|---|---|---|---|---|---|---|
| 6384681_f1_317 | 779 | 7950 | 375 | 124 | 145 | 3.6e-10 |

Description sp:[LN:YFHP_HAEIN] [AC:P44675] [GN:HI0379] [OR:Haemophilus influenzae] [DE:HYPOTHETICAL PROTEIN HI0379] [SP:P44675] [DB:swissprot] >sp:[LN:F64150] [AC:F64150] [PN:hypothetical protein HI0379] [CL:hypothetical protein b2531] [OR:Haemophilus influenzae] [DB:pir2] >gp:[GI:g1573349] [LN:U32722] [AC:U32722:L42023] [PN:conserved hypothetical protein] [GN:HI0379] [OR:Haemophilus influenzae Rd] [DB:genpept-bct2] [DE:Haemophilus influenzae Rd section 37 of 163 of the complete genome.] [NT:similar to GB:U00096 PID:1788880 percent identity:] [LE:61] [RE:513] [DI:complement]

| ORF_Name | NT ID | AA ID | NT/LN | AA/LN | Score | P-value |
|---|---|---|---|---|---|---|
| 6437908_c3_2112 | 780 | 7951 | 1254 | 417 | 111 | 0.0014 |

Description sp:[LN:C42384] [AC:C42384] [PN:hypothetical protein Y] [OR:Escherichia coli] [DB:pir2]

| ORF_Name | NT ID | AA ID | NT/LN | AA/LN | Score | P-value |
|---|---|---|---|---|---|---|
| 6446925_c3_2239 | 781 | 7952 | 363 | 120 | 142 | 7.5e-10 |

Description sp:[LN:SP21_BACME] [AC:P35147] [GN:SPOIIAA] [OR:Bacillus megaterium] [DE:ANTI-SIGMA F FACTOR ANTAGONIST (STAGE II SPORULATION PROTEIN AA)] [SP:P35147] [DB:swissprot] >sp:[LN:A48402] [AC:A48402:S22177] [PN:stage II sporulation protein spoIIAA] [GN:spoIIAA] [CL:sporulation protein stage II] [OR:Bacillus megaterium] [DB:pir2] >gp:[GI:g580788] [LN:BMSPOIIAA] [AC:X63757:S46395] [GN:spoIIAA] [OR:Bacillus megaterium] [DB:genpept-bct1] [DE:B.megaterium genes spoIIAA, spoIIAB, spoIIAC, pbp and spoVA.] [SP:P35147] [LE:172] [RE:522] [DI:direct]

| ORF Name | NT ID | AA ID | NT LN | AA LN | Score | P-value |
|---|---|---|---|---|---|---|
| 6447187_c1_1310 | 782 | 7953 | 423 | 140 | 527 | 1.2e-50 |

Description sp:[LN:UMUD_ECOLI] [AC:P04153] [GN:UMUD] [OR:Escherichia coli] [EC:3.4.21.-]
[DE:UMUD PROTEIN, [CONTAINS: UMUD' PROTEIN]] [SP:P04153] [DB:swissprot]
>sp:[LN:ZWECD] [AC:A03551:A23157:D64864] [PN:proteinase umuD,:umuD' proprotein]
[GN:umuD] [CL:lexA repressor] [OR:Escherichia coli] [EC:3.4.21.-] [DB:pir1]
[MP:26 min] >gp:[GI:d1037016:g1651580] [LN:D90752] [AC:D90752:AB001340] [PN:UmuD
protein.] [GN:umuD] [OR:Escherichia coli] [SR:Escherichia coli(strain:K12) DNA,
clone:Kohara clone #243] [DB:genpept-bct1] [DE:Escherichia coli genomic DNA.
(26.3 - 26.7 min).] [NT:ORF_ID:o244#3; similar to PIR Accession Number]
[LE:12658] [RE:13077] [DI:direct] >gp:[GI:d1037024:g1651586] [LN:D90753]
[AC:D90753:AB001340] [PN:UmuD protein.] [GN:umuD] [OR:Escherichia coli]
[SR:Escherichia coli(strain:K12) DNA, clone:Kohara clone #244] [DB:genpept-bct1]
[DE:Escherichia coli genomic DNA. (26.5 - 26.8 min).] [NT:ORF_ID:o244#3; similar
to PIR Accession Number] [LE:2513] [RE:2932] [DI:direct] >gp:[GI:g148125]
[LN:ECOUMUCD] [AC:M10107] [GN:umuD] [OR:Escherichia coli] [SR:Escherichia coli
(strain K-12) DNA, clone pTA100] [DB:genpept-bct1] [DE:E.coli umu operon: umuD
and umuC genes encoding recA and lexAdependent UV repair enzyme.] [NT:UmuD
protein] [LE:450] [RE:869] [DI:direct] >gp:[GI:g148128] [LN:ECOUMUDC] [AC:M13387]
[GN:umuD] [OR:Escherichia coli] [SR:Escherichia coli DNA] [DB:genpept-bct1]
[DE:E.coli umuDC operon encoding proteins functional in UV mutagenesis,complete
cds.] [LE:111] [RE:530] [DI:direct] >gp:[GI:g1787431] [LN:AE000216]
[AC:AE000216:U00096] [PN:SOS mutagenesis; error-prone repair; processed]
[GN:umuD] [FN:putative enzyme; DNA - replication, repair,] [OR:Escherichia coli]
[DB:genpept-bct2] [EC:3.4.21.-] [DE:Escherichia coli K-12 MG1655 section 106 of
400 of the completegenome.] [NT:o139; 100 pct identical to UMUD_ECOLI SW: P04153]
[LE:9634] [RE:10053] [DI:direct]

| ORF Name | NT ID | AA ID | NT LN | AA LN | Score | P-value |
|---|---|---|---|---|---|---|
| 6455327_c1_1532 | 783 | 7954 | 471 | 156 | 113 | 8.8e-07 |

Description sp:[LN:S77097] [AC:S77097] [PN:hypothetical protein slr1861] [OR:Synechocystis
sp.] [SR:PCC 6803, , PCC 6803] [SR:PCC 6803, ] [DB:pir2]
>gp:[GI:d1018388:g1652736] [LN:D90908] [AC:D90908:AB001339] [PN:hypothetical
protein] [OR:Synechocystis sp.] [SR:Synechocystis sp. (strain:PCC6803) DNA]
[DB:genpept-bct1] [DE:Synechocystis sp. PCC6803 complete genome, 10/27,
1188886-1311234.] [NT:ORF_ID:slr1861] [LE:10287] [RE:10718] [DI:direct]

| ORF Name | NT ID | AA ID | NT LN | AA LN | Score | P-value |
|---|---|---|---|---|---|---|
| 6494536_f1_79 | 784 | 7955 | 423 | 140 | 210 | 4.6e-17 |

Description gp:[GI:e1420188:g4539255] [LN:SPBC2A9] [AC:AL049495] [PN:hypothetical protein]
[GN:SPBC2A9.02] [OR:Schizosaccharomyces pombe] [SR:fission yeast]
[DB:genpept-pln1] [DE:S.pombe chromosome I cosmid c2A9_3p.] [NT:SPBC2A9.02,
len:295, SIMILARITY:Saccharomyces] [LE:2272] [RE:3159] [DI:direct]

| ORF Name | NT ID | AA ID | NT LN | AA LN | Score | P-value |
|---|---|---|---|---|---|---|
| 666580_f1_8 | 785 | 7956 | 324 | 107 | | |

Description

NO-HIT

| ORF Name | NT ID | AA ID | NT LN | AA LN | Score | P-value |
|---|---|---|---|---|---|---|
| 6895952_c3_1977 | 786 | 7957 | 462 | 153 | 436 | 5.2e-41 |

Description sp:[LN:ENPP_ECOLI] [AC:P75719] [GN:YBCT] [OR:Escherichia coli] [EC:3.4.-.-]
[DE:PUTATIVE ENDOPEPTIDASE,] [SP:P75719] [DB:swissprot] >sp:[LN:B64788]
[AC:B64788] [PN:endopeptidase ybcT,] [GN:ybcT] [CL:phage PA2 endopeptidase]
[OR:Escherichia coli] [EC:3.4.-.-] [DB:pir2] >gp:[GI:g1786769] [LN:AE000161]
[AC:AE000161:U00096] [PN:bacteriophage lambda endopeptidase homolog] [GN:ybcT]
[FN:IS, phage, Tn; Phage-related functions and] [OR:Escherichia coli]
[DB:genpept-bct2] [EC:3.4.-.-] [DE:Escherichia coli K-12 MG1655 section 51 of 400
of the completegenome.] [NT:o153; 96 pct identical to ENPP_LAMBD SW: P00726]
[LE:996] [RE:1457] [DI:direct]

| ORF Name | NT ID | AA ID | NT LN | AA LN | Score | P-value |
|---|---|---|---|---|---|---|
| 6900427_c3_2251 | 787 | 7958 | 981 | 326 | 191 | 5.0e-12 |

Description sp:[LN:PRIM_BPP4] [AC:P10277] [GN:ALPHA] [OR:Bacteriophage P4] [EC:2.7.7.-]
[DE:PUTATIVE P4-SPECIFIC DNA PRIMASE,] [SP:P10277] [DB:swissprot] >sp:[LN:RPBPP4]
[AC:A26869:JW0024] [PN:DNA primase:gp alpha:gp alpha] [GN:alpha] [CL:phage P4 DNA
primase] [OR:satellite phage P4] [DB:pir1] >gp:[GI:g15152] [LN:MYP4ALPH]
[AC:X05623] [OR:Bacteriophage P4] [DB:genpept-phg] [DE:Bacteriophage P4 alpha
gene and cis replication region crr.] [NT:alpha gene (pot.P4-specific DNA primase
) (AA] [SP:P10277] [LE:354] [RE:2687] [DI:direct] >gp:[GI:g15158] [LN:MYP4CG]
[AC:X51522] [OR:Bacteriophage P4] [DB:genpept-phg] [DE:Bacteriophage P4 complete
DNA genome.] [NT:alpha gene product (AA 1-777)] [SP:P10277] [LE:4636] [RE:6969]
[DI:complement]

| ORF Name | NT ID | AA ID | NT LN | AA LN | Score | P-value |
|---|---|---|---|---|---|---|
| 6917890_c3_2179 | 788 | 7959 | 282 | 93 | 138 | 2.0e-09 |

Description sp:[LN:G72536] [AC:G72536] [PN:hypothetical protein APE1580] [GN:APE1580]
[OR:Aeropyrum pernix] [DB:pir2] >gp:[GI:d1044366:g5105267] [LN:AP000062]
[AC:AP000062] [PN:114aa long hypothetical protein] [GN:APE1580] [OR:Aeropyrum
pernix] [SR:Aeropyrum pernix (strain:K1) DNA] [DB:genpept-bct1] [DE:Aeropyrum
pernix genomic DNA, section 5/7.] [NT:similar to OWL:AB00946832 percent
identity:37.500] [LE:13911] [RE:14255] [DI:direct]

| ORF_Name | NT_ID | AA_ID | NT/LN | AA/LN | Score | P-value |
|---|---|---|---|---|---|---|
| 6933415_c3_2211 | 789 | 7960 | 330 | 109 | 107 | 3.8e-06 |

Description sp:[LN:H72706] [AC:H72706] [PN:hypothetical protein APE1071] [GN:APE1071]
[OR:Aeropyrum pernix] [DB:pir2] >gp:[GI:d1043842:g5104741] [LN:AP000060]
[AC:AP000060] [PN:117aa long hypothetical protein] [GN:APE1071] [OR:Aeropyrum
pernix] [SR:Aeropyrum pernix (strain:K1) DNA] [DB:genpept-bct1] [DE:Aeropyrum
pernix genomic DNA, section 3/7.] [LE:315643] [RE:315996] [DI:complement]

| ORF_Name | NT_ID | AA_ID | NT/LN | AA/LN | Score | P-value |
|---|---|---|---|---|---|---|
| 7119008_f2_484 | 790 | 7961 | 480 | 159 | | |

Description

NO-HIT

| ORF_Name | NT_ID | AA_ID | NT/LN | AA/LN | Score | P-value |
|---|---|---|---|---|---|---|
| 7161718_c2_1746 | 791 | 7962 | 975 | 324 | 1054 | 1.7e-106 |

Description sp:[LN:ASTE_ECOLI] [AC:P76215] [GN:ASTE] [OR:Escherichia coli] [EC:3.1.-.-]
[DE:SUCCINYLGLUTAMATE DESUCCINYLASE,] [SP:P76215] [DB:swissprot] >sp:[LN:H64933]
[AC:H64933] [PN:hypothetical protein b1744] [OR:Escherichia coli] [DB:pir2]
>gp:[GI:g1788040] [LN:AE000269] [AC:AE000269:U00096] [PN:orf, hypothetical
protein] [GN:ydjS] [FN:orf; Unknown] [OR:Escherichia coli] [DB:genpept-bct2]
[DE:Escherichia coli K-12 MG1655 section 159 of 400 of the completegenome.]
[NT:f322] [LE:4729] [RE:5697] [DI:complement]

| ORF_Name | NT_ID | AA_ID | NT/LN | AA/LN | Score | P-value |
|---|---|---|---|---|---|---|
| 7165791_c3_2104 | 792 | 7963 | 1476 | 491 | 2062 | 2.6e-213 |

Description sp:[LN:PTCC_ECOLI] [AC:P17334:P76212:P77332:P76907] [GN:CELB] [OR:Escherichia
coli] [DE:PERMEASE IIC COMPONENT) (PHOSPHOTRANSFERASE ENZYME II, C COMPONENT)]
[SP:P17334:P76212:P77332:P76907] [DB:swissprot] >sp:[LN:A64933] [AC:A64933]
[PN:celB protein] [GN:celB] [CL:phosphotransferase system enzyme II factor II,
phosphoenolpyruvate-dependent] [OR:Escherichia coli] [DB:pir2] >gp:[GI:g1788032]
[LN:AE000268] [AC:AE000268:U00096] [PN:PEP-dependent phosphotransferase enzyme II
for] [GN:celB] [FN:enzyme; Transport of small molecules:] [OR:Escherichia coli]
[DB:genpept-bct2] [DE:Escherichia coli K-12 MG1655 section 158 of 400 of the
completegenome.] [NT:f452; CG Site No. 18487; residues 1-189 are 100 pct]
[LE:9763] [RE:11121] [DI:complement]

| ORF Name | NT ID | AA ID | NT/LN | AA/LN | Score | P-value |
|---|---|---|---|---|---|---|
| 782312_f3_1120 | 793 | 7964 | 753 | 250 | 1057 | 8.2e-107 |

Description sp:[LN:PHOP_SALTY] [AC:P14146] [GN:PHOP] [OR:Salmonella typhimurium]
[DE:VIRULENCE TRANSCRIPTIONAL REGULATORY PROTEIN PHOP] [SP:P14146] [DB:swissprot]
>sp:[LN:RGEBFT] [AC:A32932:A37132] [PN:transcription regulator phoP] [GN:phoP]
[CL:ompR protein:response regulator homology] [OR:Salmonella typhimurium]
[DB:pir1] [MP:25 min] >gp:[GI:g154264] [LN:STYPHOPA] [AC:M25241] [OR:Salmonella
typhimurium] [SR:S.typhi (strain 14028s) DNA, clone pEG5381]
[DB:genpept-bct1] [DE:S.typhimurium phoP gene encoding PhoP virulence protein,
completecds.] [NT:PhoP protein] [LE:151] [RE:825] [DI:direct] >gp:[GI:g154266]
[LN:STYPHOPQ] [AC:M24424] [OR:Salmonella typhimurium] [SR:S.typhimurium (strain
LT2) DNA] [DB:genpept-bct1] [DE:S.typhimurium phoP protein and membrane protein
phoQ genes,complete cds.] [NT:phoP protein] [LE:141] [RE:815] [DI:direct]

| ORF Name | NT ID | AA ID | NT/LN | AA/LN | Score | P-value |
|---|---|---|---|---|---|---|
| 783305_c1_1506 | 794 | 7965 | 1161 | 386 | 720 | 5.2e-101 |

Description sp:[LN:YODE_PSEAE] [AC:Q01609] [OR:Pseudomonas aeruginosa] [DE:HYPOTHETICAL 40.7
KD PROTEIN IN OPDE 3'REGION (ORF2)] [SP:Q01609] [DB:swissprot] >sp:[LN:S23861]
[AC:S23861] [PN:hypothetical protein 2] [OR:Pseudomonas aeruginosa] [DB:pir2]
>gp:[GI:g45369] [LN:PAOPDEG] [AC:Z14064] [GN:ORF2] [OR:Pseudomonas aeruginosa]
[DB:genpept-bct1] [DE:P.aeruginosa opdE gene.] [SP:Q01609] [LE:2253] [RE:3368]
[DI:direct]

| ORF Name | NT ID | AA ID | NT/LN | AA/LN | Score | P-value |
|---|---|---|---|---|---|---|
| 787802_c3_2214 | 795 | 7966 | 195 | 64 | | |

Description

NO-HIT

| ORF Name | NT ID | AA ID | NT/LN | AA/LN | Score | P-value |
|---|---|---|---|---|---|---|
| 822553_c2_1569 | 796 | 7967 | 192 | 63 | | |

Description

NO-HIT

| ORF Name | NT ID | AA ID | NT LN | AA LN | Score | P-value |
|---|---|---|---|---|---|---|
| 828450_c2_1802 | 797 | 7968 | 813 | 270 | 93 | 0.023 |

Description gp:[GI:g1353519] [LN:BRU38906] [AC:U38906] [OR:Bacteriophage r1t]
[DB:genpept-phg] [DE:Bacteriophage r1t integrase, repressor protein (rro),
dUTPase,holin and lysin genes, complete cds.] [NT:ORF2] [LE:1339] [RE:1860]
[DI:complement] >gp:[GI:g496100] [LN:LC3PHIRIGA] [AC:L24560] [FN:unknown]
[OR:Bacteriophage phi-LC3] [DB:genpept-phg] [DE:Bacteriophage phi-LC3 repressor
(putative) protein gene, 3'end;complete cds.] [NT:putative] [LE:286] [RE:807]
[DI:direct]

| ORF Name | NT ID | AA ID | NT LN | AA LN | Score | P-value |
|---|---|---|---|---|---|---|
| 881633_f1_118 | 798 | 7969 | 255 | 84 | | |

Description

NO-HIT

| ORF Name | NT ID | AA ID | NT LN | AA LN | Score | P-value |
|---|---|---|---|---|---|---|
| 909757_c2_1630 | 799 | 7970 | 684 | 227 | | |

Description

NO-HIT

| ORF Name | NT ID | AA ID | NT LN | AA LN | Score | P-value |
|---|---|---|---|---|---|---|
| 910076_c1_1380 | 800 | 7971 | 1407 | 468 | 2047 | 1.0e-211 |

Description sp:[LN:CELF_ECOLI] [AC:P17411:P78290] [GN:CELF] [OR:Escherichia coli]
[EC:3.2.1.86] [DE:6-PHOSPHO-BETA-GLUCOSIDASE,] [SP:P17411:P78290] [DB:swissprot]
>sp:[LN:F64932] [AC:F64932:S10874] [PN:6-phospho-beta-glucosidase, celF]
[GN:celF] [OR:Escherichia coli] [EC:3.2.1.86] [DB:pir2]
>gp:[GI:d1016238:g1742831] [LN:D90816] [AC:D90816:AB001340]
[PN:6-phospho-b-glucosidase (EC 3.2.1.86).] [GN:celF] [OR:Escherichia coli]
[SR:Escherichia coli (strain:K12) DNA, clone_lib:Kohara lambda minise]
[DB:genpept-bct1] [DE:E.coli genomic DNA, Kohara clone #325(38.9-39.2 min.).]
[NT:ORF_ID:o326#3; similar to [SwissProt Accession] [LE:9737] [RE:11089]
[DI:complement] >gp:[GI:d1016246:g1742840] [LN:D90817] [AC:D90817:AB001340]
[PN:6-phospho-b-glucosidase (EC 3.2.1.86).] [GN:celF] [OR:Escherichia coli]
[SR:Escherichia coli (strain:K12) DNA, clone_lib:Kohara lambda minise]
[DB:genpept-bct1] [DE:E.coli genomic DNA, Kohara clone #326(39.1-39.4 min.).]
[NT:ORF_ID:o326#3; similar to [SwissProt Accession] [LE:2508] [RE:3860]
[DI:complement] >gp:[GI:g1788029] [LN:AE000268] [AC:AE000268:U00096]
[PN:phospho-beta-glucosidase; cryptic] [GN:celF] [FN:enzyme; Degradation of small
molecules: Carbon] [OR:Escherichia coli] [DB:genpept-bct2] [EC:3.2.1.86]
[DE:Escherichia coli K-12 MG1655 section 158 of 400 of the completegenome.]
[NT:f450; 100 pct identical to 371 residues] [LE:7055] [RE:8407] [DI:complement]

| ORF Name | NT ID | AA ID | NT/LN | AA/LN | Score | P-value |
|---|---|---|---|---|---|---|
| 938_c1_1238 | 801 | 7972 | 477 | 158 | 143 | 5.8e-10 |

Description sp:[LN:D70541] [AC:D70541] [PN:hypothetical protein Rv1578c] [GN:Rv1578c]
[OR:Mycobacterium tuberculosis] [DB:pir2] >gp:[GI:e317179;g2117259] [LN:MTCY336]
[AC:Z95586;AL123456] [PN:hypothetical protein Rv1578c] [GN:Rv1578c]
[OR:Mycobacterium tuberculosis] [DB:genpept-bct1] [DE:Mycobacterium tuberculosis
H37Rv complete genome; segment 70/162.] [NT:Rv1578c, (MTCY336.26), len: 156.
Function: unknown] [LE:11157] [RE:11627] [DI:complement]

| ORF Name | NT ID | AA ID | NT/LN | AA/LN | Score | P-value |
|---|---|---|---|---|---|---|
| 956532_c3_1991 | 802 | 7973 | 8043 | 2680 | 3421 | 0.0 |

Description sp:[LN:T13107] [AC:T13107] [PN:tail tip fiber protein gp21] [CL:phage lambda host
specificity protein J] [OR:phage N15] [DB:pir2] >gp:[GI:g3192704] [LN:AF064539]
[AC:AF064539] [PN:gp21] [GN:gene 21] [OR:Bacteriophage N15] [DB:genpept-phg]
[DE:Bacteriophage N15, complete genome.] [NT:tail tip fiber] [LE:15342]
[RE:18527] [DI:direct]

| ORF Name | NT ID | AA ID | NT LN | AA LN | Score | P-value |
|---|---|---|---|---|---|---|
| 9769425_c1_1275 | 803 | 7974 | 585 | 194 | 722 | 2.6e-71 |

Description sp:[LN:YCIF_ECOLI] [AC:P21362] [GN:YCIF] [OR:Escherichia coli] [DE:18.6 KD
PROTEIN IN TONB-TRPA INTERGENIC REGION (ORF2)] [SP:P21362] [DB:swissprot]
>sp:[LN:S07795] [AC:S07795;E64873;S30263] [PN:yciF protein, 19K:18.6K protein]
[GN:yciF] [OR:Escherichia coli] [DB:pir2] [MP:28 min] >gp:[GI:d1015506;g1742047]
[LN:D90763] [AC:D90763;AB001340] [GN:yciF] [OR:Escherichia coli] [SR:Escherichia
coli (strain:K12) DNA, clone_lib:Kohara lambda minise] [DB:genpept-bct1]
[DE:E.coli genomic DNA, Kohara clone #252(28.1-28.4 min.).] [NT:ORF_ID:o252#16;
similar to [PIR Accession Number] [LE:13591] [RE:14091] [DI:complement]
>gp:[GI:g43209] [LN:ECTRTOI] [AC:X13583] [OR:Escherichia coli] [DB:genpept-bct1]
[DE:E. coli DNA for intervening region between trp operon and tonBgene.] [NT:ORF2
protein (AA 1-166)] [SP:P21362] [LE:321] [RE:821] [DI:direct] >gp:[GI:g775135]
[LN:ECU23490] [AC:U23490] [PN:unknown] [GN:yciF] [OR:Escherichia coli]
[DB:genpept-bct1] [DE:Escherichia coli ECOR 1 anthranilate isomerase (trpC),
tryptophansynthase beta subunit (trpB), tryptophan synthase alpha subunit(trpA),
(yciG), (yciF), and (yciE) genes, complete cds.] [LE:4030] [RE:4530] [DI:direct]
>gp:[GI:g775142] [LN:ECU23491] [AC:U23491] [PN:unknown] [GN:yciF] [OR:Escherichia
coli] [DB:genpept-bct1] [DE:Escherichia coli ECOR 4 anthranilate isomerase
(trpC), tryptophansynthase beta subunit (trpB), tryptophan synthase alpha
subunit(trpA), (yciG), (yciF), and (yciE) genes, complete cds.] [LE:4030]
[RE:4530] [DI:direct] >gp:[GI:g775149] [LN:ECU23492] [AC:U23492] [PN:unknown]
[GN:yciF] [OR:Escherichia coli] [DB:genpept-bct1] [DE:Escherichia coli ECOR 16
anthranilate isomerase (trpC), tryptophansynthase beta subunit (trpB), tryptophan
synthase alpha subunit(trpA), (yciG), (yciF), and (yciE) genes, complete cds.]
[LE:4030] [RE:4530] [DI:direct] >gp:[GI:g924766] [LN:ECU25417] [AC:U25417]
[GN:yciF] [OR:Escherichia coli] [DB:genpept-bct1] [DE:Escherichia coli ECOR 8
anthranilate isomerase (trpC), tryptophansynthase beta subunit (trpB), tryptophan
synthase alpha subunit(trpA), (yciG), (yciF), and (yciE) genes, complete cds.]
[LE:4030] [RE:4530] [DI:direct] >gp:[GI:g924780] [LN:ECU25419] [AC:U25419]
[GN:yciF] [OR:Escherichia coli] [DB:genpept-bct1] [DE:Escherichia coli ECOR 17
anthranilate isomerase (trpC), tryptophansynthase beta subunit (trpB), tryptophan
synthase alpha subunit(trpA), (yciG), (yciF), and (yciE) genes, complete cds.]
[LE:4030] [RE:4530] [DI:direct] >gp:[GI:g924787] [LN:ECU25420] [AC:U25420]
[GN:yciF] [OR:Escherichia coli] [DB:genpept-bct1] [DE:Escherichia coli ECOR 19
anthranilate isomerase (trpC), tryptophansynthase beta subunit (trpB), tryptophan
synthase alpha subunit(trpA), (yciG), (yciF), and (yciE) genes, complete cds.]
[LE:4030] [RE:4530] [DI:direct] >gp:[GI:g924794] [LN:ECU25421] [AC:U25421]

| ORF Name | NT ID | AA ID | NT LN | AA LN | Score | P-value |
|---|---|---|---|---|---|---|
| 9803965_f3_964 | 804 | 7975 | 888 | 295 | 162 | 4.1e-09 |

Description gp:[GI:g3002799] [LN:PPU93363] [AC:U93363;AF036343] [PN:2-aminomuconic acid
semialdehyde dehydrogenase] [GN:amnC] [FN:catalyzes the NAD dependent oxidation
of] [OR:Pseudomonas pseudoalcaligenes] [DB:genpept-bct2] [DE:Pseudomonas
pseudoalcaligenes beta subunit of2-aminophenol-1,6-dioxygenase (amnB), alpha
subunit of2-aminophenol-1,6-dioxygenase (amnA), and 2-aminomuconic
acidsemialdehyde dehydrogenase (amnC) genes, complete cds.] [LE:2699] [RE:4327]
[DI:direct]

| ORF Name | NT ID | AA ID | NT/LN | AA/LN | Score | P-value |
|---|---|---|---|---|---|---|
| 9806456_c1_1194 | 805 | 7976 | 1749 | 582 | 1569 | 4.5e-161 |

Description sp:[LN:ALKK_PSEOL] [AC:Q00594] [GN:ALKK] [OR:Pseudomonas oleovorans] [EC:6.2.1.-]
[DE:ACYL-CoA SYNTHETASE)] [SP:Q00594] [DB:swissprot] >sp:[LN:S27995] [AC:S27995]
[PN:probable acid--CoA ligase,] [GN:alkK] [CL:probable acyl-CoA ligase medium
chain:acetate--CoA ligase homology] [OR:Pseudomonas oleovorans] [EC:6.2.1.-]
[DB:pir2] >gp:[GI:g5824148] [LN:POL245436]
[AC:AJ245436:J04618:J04619:S50571:X52935:X65936] [PN:acyl-CoA synthetase]
[GN:alkK] [OR:Pseudomonas putida] [DB:genpept-bct1] [DE:Pseudomonas putida OCT
plasmid alk genes cluster and flanking DNA,strain TF4-1L.] [LE:13182] [RE:14822]
[DI:direct]

| ORF Name | NT ID | AA ID | NT/LN | AA/LN | Score | P-value |
|---|---|---|---|---|---|---|
| 994005_f3_1117 | 806 | 7977 | 1374 | 457 | 2238 | 5.8e-232 |

Description sp:[LN:PUR8_ECOLI] [AC:P25739] [GN:PURB] [OR:Escherichia coli] [EC:4.3.2.2]
[DE:ADENYLOSUCCINATE LYASE, (ADENYLOSUCCINASE) (ASL)] [SP:P25739] [DB:swissprot]
>sp:[LN:S19212] [AC:S19212:C41966:A43307:H64857] [PN:adenylosuccinate
lyase,:adenylosuccinase] [GN:purB] [CL:fumarate hydratase] [OR:Escherichia coli]
[EC:4.3.2.2] [DB:pir2] >gp:[GI:d1036939:g1651559] [LN:D90748]
[AC:D90748:AB001340] [PN:Adenylosuccinate lyase (EC 4.3.2.2)] [GN:purB]
[OR:Escherichia coli] [SR:Escherichia coli(strain:K12) DNA, clone:Kohara clone
239] [DB:genpept-bct1] [DE:Escherichia coli genomic DNA. (25.6 - 25.9 min).]
[NT:ORF_ID:o240#2; similar to PIR Accession Number] [LE:6850] [RE:8220]
[DI:complement] >gp:[GI:d1036948:g1651565] [LN:D90749] [AC:D90749:AB001340]
[PN:Adenylosuccinate lyase (EC 4.3.2.2)] [GN:purB] [OR:Escherichia coli]
[SR:Escherichia coli(strain:K12) DNA, clone:Kohara clone #240] [DB:genpept-bct1]
[DE:Escherichia coli genomic DNA. (25.7 - 26.1 min).] [NT:ORF_ID:o240#2; similar
to PIR Accession Number] [LE:1167] [RE:2537] [DI:complement] >gp:[GI:g42585]
[LN:ECPURB] [AC:X59307] [PN:succinyl-AMP lyase] [GN:purB] [OR:Escherichia coli]
[DB:genpept-bct1] [EC:4.3.2.2] [DE:E.coli ORF-15, ORF-23, purB and phoP (5'end)
genes.] [NT:adenylosuccinate lyase] [SP:P25739] [LE:1376] [RE:2746] [DI:direct]
>gp:[GI:g1787376] [LN:AE000213] [AC:AE000213:U00096] [PN:adenylosuccinate lyase]
[GN:purB] [FN:enzyme; Purine ribonucleotide biosynthesis] [OR:Escherichia coli]
[DB:genpept-bct2] [EC:4.3.2.2] [DE:Escherichia coli K-12 MG1655 section 103 of
400 of the completegenome.] [NT:f456; 99 pct identical to PUR8_ECOLI SW: P25739]
[LE:4927] [RE:6297] [DI:complement]

| ORF Name | NT ID | AA ID | NT/LN | AA/LN | Score | P-value |
|---|---|---|---|---|---|---|
| 9955186_c3_1993 | 807 | 7978 | 1593 | 530 | 132 | 8.4e-08 |

Description sp:[LN:T13111] [AC:T13111] [PN:protein gp25] [OR:phage N15] [DB:pir2]
>gp:[GI:g3192708] [LN:AF064539] [AC:AF064539] [PN:gp25] [GN:gene 25]
[OR:Bacteriophage N15] [DB:genpept-phg] [DE:Bacteriophage N15, complete genome.]
[NT:probable tail fiber component] [LE:20066] [RE:21478] [DI:direct]

| ORF Name | NT ID | AA ID | NT LN | AA LN | Score | P-value |
|---|---|---|---|---|---|---|
| 10335127_f1_12 | 808 | 7979 | 2250 | 749 | 3541 | 0.0 |

Description sp:[LN:FADB_ECOLI] [AC:P21177] [GN:FADB:OLDB] [OR:Escherichia coli]
[EC:4.2.1.17:5.3.3.8:1.1.1.35:5.1.2.3] [DE:HYDROXYBUTYRYL-COA EPIMERASE,]]
[SP:P21177] [DB:swissprot] >sp:[LN:A39592]
[AC:A39592:S30737:JV0108:JQ0654:G65189] [PN:fatty acid beta oxidation complex
alpha chain] [GN:fadB] [CL:enoyl-CoA hydratase/3-hydroxyacyl-CoA
dehydrogenase:3-hydroxyacyl-CoA dehydrogenase homology:enoyl-CoA hydratase
homology] [OR:Escherichia coli] [DB:pir1] [MP:87 min] >gp:[GI:g145903]
[LN:ECOFADBA] [AC:M74164:J05332:J05498:M64935] [PN:79-kDa multifunctional
protein] [GN:fadB] [OR:Escherichia coli] [SR:Escherichia coli (clone pK52, strain
K-12) DNA] [DB:genpept-bct1] [DE:E. coli fadB and fadA genes (fadBA operon),
complete cds.] [NT:enoyl-CoA hydratase (EC 4.2.1.17); L-3] [LE:382] [RE:2571]
[DI:direct] >gp:[GI:g148246] [LN:ECOUW85] [AC:M87049] [PN:large (alpha) subunit
of the fatty] [GN:fadB (CGSC No. 793)] [OR:Escherichia coli] [DB:genpept-bct1]
[DE:E. coli genomic sequence of the region from 84.5 to 86.5 minutes.] [LE:81846]
[RE:84035] [DI:complement] >gp:[GI:g1790281] [LN:AE000460] [AC:AE000460:U00096]
[PN:4-enzyme protein: 3-hydroxyacyl-CoA] [GN:fadB] [FN:enzyme; Degradation of
small molecules: Fatty] [OR:Escherichia coli] [DB:genpept-bct2]
[EC:1.1.1.35:4.2.1.17:5.1.2.3:5.3.3.8] [DE:Escherichia coli K-12 MG1655 section
350 of 400 of the completegenome.] [NT:f729; 100 pct identical amino acid
sequence and] [LE:1523] [RE:3712] [DI:complement]

| ORF Name | NT ID | AA ID | NT LN | AA LN | Score | P-value |
|---|---|---|---|---|---|---|
| 10605216_c2_539 | 809 | 7980 | 660 | 219 | 778 | 3.0e-77 |

Description sp:[LN:YIGP_ECOLI] [AC:P27852] [GN:YIGP] [OR:Escherichia coli] [DE:HYPOTHETICAL
22.2 KD PROTEIN IN UBIE-RFAH INTERGENIC REGION] [SP:P27852] [DB:swissprot]
>sp:[LN:C65188] [AC:C65188:S30723] [PN:hypothetical 22.3 kD protein in udp-rfaH
intergenic region] [GN:yigP] [OR:Escherichia coli] [DB:pir2] >gp:[GI:g2367308]
[LN:AE000459] [AC:AE000459:U00096] [PN:orf, hypothetical protein] [GN:yigP]
[FN:orf; Unknown] [OR:Escherichia coli] [DB:genpept-bct2] [DE:Escherichia coli
K-12 MG1655 section 349 of 400 of the completegenome.] [NT:o201; sequence changes
cause internal changes to] [LE:3361] [RE:3966] [DI:direct]

| ORF_Name | NT ID | AA ID | NT LN | AA LN | Score | P-value |
|---|---|---|---|---|---|---|
| 10759712_c3_644 | 810 | 7981 | 1335 | 444 | 2173 | 4.5e-225 |

Description sp:[LN:PEPQ_ECOLI] [AC:P21165:P21176] [GN:PEPQ] [OR:Escherichia coli]
[EC:3.4.13.9] [DE:DIPEPTIDASE) (PROLIDASE) (IMIDODIPEPTIDASE)] [SP:P21165:P21176]
[DB:swissprot] >sp:[LN:H65189] [AC:H65189:S30738:JQ0753] [PN:X-Pro
dipeptidase,:iminodipeptidase:prolidase:proline dipeptidase] [GN:pepQ]
[OR:Escherichia coli] [EC:3.4.13.9] [DB:pir2] [MP:86 min] >gp:[GI:g1790282]
[LN:AE000460] [AC:AE000460:U00096] [PN:proline dipeptidase] [GN:pepQ] [FN:enzyme;
Degradation of proteins, peptides,] [OR:Escherichia coli] [DB:genpept-bct2]
[EC:3.4.13.9] [DE:Escherichia coli K-12 MG1655 section 350 of 400 of the
completegenome.] [NT:o443; 99 pct identical amino acid sequence and] [LE:3902]
[RE:5233] [DI:direct]

| ORF_Name | NT ID | AA ID | NT LN | AA LN | Score | P-value |
|---|---|---|---|---|---|---|
| 11176558_c1_369 | 811 | 7982 | 1011 | 336 | 1543 | 2.6e-158 |

Description gp:[GI:g41789] [LN:ECILVE] [AC:X02413] [OR:Escherichia coli] [DB:genpept-bct1]
[DE:E. coli ilvE gene for branched-chain amino acid aminotransferase(EC
2.6.1.42).] [NT:branched-chain amino acid aminotransferase (ilvE)] [SP:P00510]
[LE:301] [RE:1230] [DI:direct] >gp:[GI:g288531] [LN:ECILVGMED] [AC:X04890]
[GN:ilvE] [OR:Escherichia coli] [DB:genpept-bct1] [DE:E.coli ilvGMEDA operon.]
[NT:transaminase B] [SP:P00510] [LE:2657] [RE:3586] [DI:direct] >gp:[GI:g146468]
[LN:ECOILVGMED] [AC:M32253] [GN:ilvE] [FN:biosynthesis of isoleucine and valine]
[OR:Escherichia coli] [SR:Escherichia coli (strain K-12) DNA] [DB:genpept-bct1]
[DE:E.coli ilvGMEDA operon encoding biosynthesis of isoleucine andvaline,
complete cds.] [LE:2658] [RE:3587] [DI:direct] >gp:[GI:g146460] [LN:ECOILVGE]
[AC:M10313:J01634:J01635:M17624] [PN:branched-chain amino acid aminotransferase]
[GN:ilvE] [OR:Escherichia coli] [SR:Escherichia coli (strain K-12) DNA]
[DB:genpept-bct2] [EC:2.6.1.42] [DE:E.coli ilv gene cluster encoding ilvD and
ilvA peptides,acetohydroxy acid synthase II, and branched-chain amino
acidaminotransferase, complete cds.] [LE:2287] [RE:3216] [DI:direct]

| ORF_Name | NT ID | AA ID | NT LN | AA LN | Score | P-value |
|---|---|---|---|---|---|---|
| 11797758_c3_593 | 812 | 7983 | 1266 | 421 | 1803 | 7.2e-186 |

Description sp:[LN:WZXE_ECOLI] [AC:P27834] [GN:WZXE:WZX] [OR:Escherichia coli]
[DE:LIPOPOLYSACCHARIDE BIOSYNTHESIS PROTEIN WZXE] [SP:P27834] [DB:swissprot]
>sp:[LN:C65183] [AC:C65183:S30686] [PN:hypothetical 45.0 kD protein in rffE-rffT
intergenic region:hypothetical protein o416] [GN:yifJ] [OR:Escherichia coli]
[DB:pir2] >gp:[GI:g148195] [LN:ECOUW85] [AC:M87049] [GN:o416] [FN:unknown]
[OR:Escherichia coli] [DB:genpept-bct1] [DE:E. coli genomic sequence of the
region from 84.5 to 86.5 minutes.] [NT:possibly rffA or rffC] [LE:29394]
[RE:30644] [DI:direct] >gp:[GI:g1790227] [LN:AE000455] [AC:AE000455:U00096]
[PN:putative cytochrome] [GN:wzxE] [FN:putative carrier; Not classified]
[OR:Escherichia coli] [DB:genpept-bct2] [DE:Escherichia coli K-12 MG1655 section
345 of 400 of the completegenome.] [NT:o416; formerly designated yifJ] [LE:6195]
[RE:7445] [DI:direct]

| ORF Name | NT ID | AA ID | NT/LN | AA/LN | Score | P-value |
|---|---|---|---|---|---|---|
| 12002081_c3_598 | 813 | 7984 | 1113 | 370 | 1658 | 1.7e-170 |

Description sp:[LN:YIFK_SALTY] [AC:P37456] [GN:YIFK] [OR:Salmonella typhimurium] [DE:PROBABLE TRANSPORT PROTEIN YIFK] [SP:P37456] [DB:swissprot] >sp:[LN:S27728] [AC:S27728] [PN:probable transport protein] [CL:arginine permease] [OR:Salmonella typhimurium] [DB:pir2] >gp:[GI:g153898] [LN:STYCARABA] [AC:M95047] [PN:transport protein] [OR:Salmonella typhimurium] [SR:Salmonella typhimurium (strain LT2) DNA] [DB:genpept-bct1] [DE:Salmonella typhimurium transport protein, complete cds, andtransfer RNA-Arg.] [NT:putative] [LE:2225] [RE:3610] [DI:direct]

| ORF Name | NT ID | AA ID | NT/LN | AA/LN | Score | P-value |
|---|---|---|---|---|---|---|
| 12147191_c1_449 | 814 | 7985 | 1497 | 498 | 2400 | 4.0e-249 |

Description sp:[LN:TRKH_ECOLI] [AC:P21166:P76769] [GN:TRKH] [OR:Escherichia coli] [DE:TRK SYSTEM POTASSIUM UPTAKE PROTEIN TRKH] [SP:P21166:P76769] [DB:swissprot]

| ORF Name | NT ID | AA ID | NT/LN | AA/LN | Score | P-value |
|---|---|---|---|---|---|---|
| 12288941_f3_342 | 815 | 7986 | 333 | 110 | 104 | 1.3e-05 |

Description gp:[GI:g3482863] [LN:DNAVRL01] [AC:U20246:U20247] [PN:vrlB] [OR:Dichelobacter nodosus] [DB:genpept-bct2] [DE:Dichelobacter nodosus strain A198 vrl gene locus, completesequence.] [LE:1708] [RE:2292] [DI:direct]

| ORF Name | NT ID | AA ID | NT/LN | AA/LN | Score | P-value |
|---|---|---|---|---|---|---|
| 12383465_f1_67 | 816 | 7987 | 756 | 251 | 1010 | 7.8e-102 |

Description sp:[LN:HEM4_ECOLI] [AC:P09126:Q47250] [GN:HEMD] [OR:Escherichia coli] [EC:4.2.1.75] [DE:III COSYNTHETASE) (HYDROXYMETHYLBILANE HYDROLYASE [CYCLIZING])] [SP:P09126:Q47250] [DB:swissprot] >sp:[LN:E65184] [AC:E65184:I41279:S02227:S06317:S00255:S30694] [PN:uroporphyrinogen-III synthase,:uroporphyrinogen III cosynthetase] [GN:hemD] [OR:Escherichia coli] [EC:4.2.1.75] [DB:pir2] [MP:85 min] >gp:[GI:g41667] [LN:ECHEMCD] [AC:X12614] [OR:Escherichia coli] [DB:genpept-bct1] [DE:E. coli genes hemC and hemD for porphobilinogen deaminase (EC4.3.1.8) and uroporphyrinogen III cosynthetase (EC 4.2.1.75).] [NT:uroporphyrinogen III cosynthetase (AA 1 - 246)] [SP:P09126] [LE:1058] [RE:1798] [DI:direct] >gp:[GI:g148203] [LN:ECOUW85] [AC:M87049] [PN:uroporphyrinogen III synthase] [GN:hemD (CGSC No. 645)] [OR:Escherichia coli] [DB:genpept-bct1] [DE:E. coli genomic sequence of the region from 84.5 to 86.5 minutes.] [LE:42200] [RE:42940] [DI:complement] >gp:[GI:g1790236] [LN:AE000456] [AC:AE000456:U00096] [PN:uroporphyrinogen III synthase] [GN:hemD] [FN:enzyme; Biosynthesis of cofactors, carriers:] [OR:Escherichia coli] [DB:genpept-bct2] [EC:4.2.1.75] [DE:Escherichia coli K-12 MG1655 section 346 of 400 of the completegenome.] [NT:f246; 100 pct identical to HEM4_ECOLI SW: P09126] [LE:6230] [RE:6970] [DI:complement]

| ORF Name | NT ID | AA ID | NT LN | AA LN | Score | P-value |
|---|---|---|---|---|---|---|
| 125640_c1_386 | 817 | 7988 | 1182 | 393 | 1686 | 1.8e-173 |

Description sp:[LN:RFE_ECOLI] [AC:P24235:P76751] [GN:RFE] [OR:Escherichia coli] [EC:2.4.1.-]
[DE:(EC 2.4.1.-)] [SP:P24235:P76751] [DB:swissprot] >sp:[LN:C65182]
[AC:C65182:S30678:JN0259:S16608] [PN:probable undecaprenyl-phosphate
alpha-n-acetylglucosaminyltransferase:rfe protein] [GN:rfe] [OR:Escherichia coli]
[DB:pir2] [MP:85 min] >gp:[GI:g1790218] [LN:AE000454] [AC:AE000454:U00096]
[PN:UDP-GlcNAc:undecaprenylphosphate] [GN:rfe] [FN:enzyme; Central intermediary
metabolism:] [OR:Escherichia coli] [DB:genpept-bct2] [DE:Escherichia coli K-12
MG1655 section 344 of 400 of the completegenome.] [NT:o367; 99 pct identical to
257 amino acids] [LE:10001] [RE:11104] [DI:direct]

| ORF Name | NT ID | AA ID | NT LN | AA LN | Score | P-value |
|---|---|---|---|---|---|---|
| 12978791_c2_532 | 818 | 7989 | 834 | 277 | 1132 | 9.2e-115 |

Description sp:[LN:YIGL_ECOLI] [AC:P27848:P76763] [GN:YIGL] [OR:Escherichia coli]
[DE:HYPOTHETICAL 29.8 KD PROTEIN IN PLDB-METR INTERGENIC REGION]
[SP:P27848:P76763] [DB:swissprot]

| ORF Name | NT ID | AA ID | NT LN | AA LN | Score | P-value |
|---|---|---|---|---|---|---|
| 13132266_c1_374 | 819 | 7990 | 1707 | 568 | 2444 | 8.6e-254 |

Description sp:[LN:ISECKR] [AC:A65181:A26287:S30672] [PN:ketol-acid
reductoisomerase,:acetohydroxy acid isomeroreductase:dihydroxyisovalerate
dehydrogenase] [GN:ilvC] [CL:Escherichia coli ketol-acid
reductoisomerase:ketol-acid reductoisomerase homology] [OR:Escherichia coli]
[EC:1.1.1.86] [DB:pir1] [MP:85 min] >gp:[GI:g148181] [LN:ECOUW85] [AC:M87049]
[PN:ketol-acid reductoisomerase] [GN:ilvC (CGSC No. 607)] [OR:Escherichia coli]
[DB:genpept-bct1] [DE:E. coli genomic sequence of the region from 84.5 to 86.5
minutes.] [NT:protein spot sequence confirms start] [LE:11104] [RE:12579]
[DI:direct] >gp:[GI:g1790210] [LN:AE000454] [AC:AE000454:U00096] [PN:ketol-acid
reductoisomerase] [GN:ilvC] [FN:enzyme; Amino acid biosynthesis: Isoleucine,]
[OR:Escherichia coli] [DB:genpept-bct2] [EC:1.1.1.86] [DE:Escherichia coli K-12
MG1655 section 344 of 400 of the completegenome.] [NT:o491; 100 pct identical to
ILVC_ECOLI SW: P05793] [LE:61] [RE:1536] [DI:direct]

| ORF Name | NT ID | AA ID | NT/LN | AA/LN | Score | P-value |
|---|---|---|---|---|---|---|
| 1353452_c3_609 | 820 | 7991 | 828 | 275 | 1388 | 6.9e-142 |

Description sp:[LN:S01913] [AC:B65185:S30699:S01913:A37841:S24977] [PN:diaminopimelate epimerase,] [GN:dapF] [CL:diaminopimelate epimerase] [OR:Escherichia coli] [EC:5.1.1.7] [DB:pir1] [MP:85 min] >gp:[GI:g1790242] [LN:AE000457] [AC:AE000457:U00096] [PN:diaminopimelate epimerase] [GN:dapF] [FN:enzyme; Amino acid biosynthesis: Lysine] [OR:Escherichia coli] [DB:genpept-bct2] [EC:5.1.1.7] [DE:Escherichia coli K-12 MG1655 section 347 of 400 of the completegenome.] [NT:o275; 99 pct identical amino acid sequence and] [LE:391] [RE:1218] [DI:direct]

| ORF Name | NT ID | AA ID | NT/LN | AA/LN | Score | P-value |
|---|---|---|---|---|---|---|
| 13942218_c2_552 | 821 | 7992 | 372 | 123 | 182 | 4.3e-14 |

Description sp:[LN:F72628] [AC:F72628] [PN:hypothetical protein APE1486] [GN:APE1486] [OR:Aeropyrum pernix] [DB:pir2] >gp:[GI:d1044270:g5105170] [LN:AP000061] [AC:AP000061] [PN:197aa long hypothetical protein] [GN:APE1486] [OR:Aeropyrum pernix] [SR:Aeropyrum pernix (strain:K1) DNA] [DB:genpept-bct1] [DE:Aeropyrum pernix genomic DNA, section 4/7.] [LE:226772] [RE:227365] [DI:direct]

| ORF Name | NT ID | AA ID | NT/LN | AA/LN | Score | P-value |
|---|---|---|---|---|---|---|
| 14116430_c3_612 | 822 | 7993 | 2226 | 741 | 3625 | 0.0 |

Description sp:[LN:UVRD_ECOLI] [AC:P03018:Q47709:P76758] [GN:UVRD:MUTU:PDEB:RAD:RECL] [OR:Escherichia coli] [EC:3.6.1.-] [DE:DNA HELICASE II,] [SP:P03018:Q47709:P76758] [DB:swissprot] >sp:[LN:HJECD2] [AC:F65185:JS0014:A93528:A93498:S30703:E37841:A03549] [PN:DNA helicase II,] [GN:uvrD] [CL:helicase II] [OR:Escherichia coli] [EC:3.6.1.-] [DB:pir1] [MP:86 min] >gp:[GI:g43299] [LN:ECUVRD02] [AC:X04037] [OR:Escherichia coli] [DB:genpept-bct1] [DE:Escherichia coli uvrD gene for helicase II.] [NT:helicase II] [SP:P03018] [LE:430] [RE:2592] [DI:direct] >gp:[GI:g2367296] [LN:AE000457] [AC:AE000457:U00096] [PN:DNA-dependent ATPase I and helicase II] [GN:uvrD] [FN:enzyme; DNA - replication, repair,] [OR:Escherichia coli] [DB:genpept-bct2] [EC:3.6.1.-] [DE:Escherichia coli K-12 MG1655 section 347 of 400 of the completegenome.] [NT:o720; 100 pct identical to UVRD_ECOLI SW: P03018] [LE:3615] [RE:5777] [DI:direct]

| ORF Name | NT ID | AA ID | NT LN | AA LN | Score | P-value |
|---|---|---|---|---|---|---|
| 14146881_c1_407 | 823 | 7994 | 1206 | 401 | 1768 | 3.7e-182 |

Description sp:[LN:CYAA_ECOLI] [AC:P00936] [GN:CYAA:CYA] [OR:Escherichia coli] [EC:4.6.1.1]
[DE:CYCLASE)] [SP:P00936] [DB:swissprot] >gp:[GI:g581057] [LN:ECCYA01]
[AC:X01653:J01599:K02969:M68875:V00271] [PN:adenylate cyclase] [OR:Escherichia
coli] [DB:genpept-bct1] [DE:E. coli cya gene for adenylate cyclase.] [SP:P00936]
[LE:654] [RE:3200] [DI:direct] >gp:[GI:g581058] [LN:ECCYALOC] [AC:X66782]
[PN:adenylate cyclase] [GN:cya] [OR:Escherichia coli] [DB:genpept-bct1]
[EC:4.6.1.1] [DE:E.coli hemC, cya, cyaY and dapF genes for uroporphyrinogen
Isynthase, adenylate cyclase, an unknown protein, anddiaminopimelate epimerase.]
[SP:P00936] [LE:654] [RE:3200] [DI:direct]

| ORF Name | NT ID | AA ID | NT LN | AA LN | Score | P-value |
|---|---|---|---|---|---|---|
| 14463342_c1_385 | 824 | 7995 | 1347 | 448 | 2105 | 7.2e-218 |

Description sp:[LN:RHO_ECOLI] [AC:P03002] [GN:RHO:NITA:PSUA:RNSC:TSU:SBAA] [OR:Escherichia
coli] [DE:TRANSCRIPTION TERMINATION FACTOR RHO] [SP:P03002] [DB:swissprot]
>sp:[LN:TWECR] [AC:A03530:S30677:I69359:S16607:I53913:B65182] [PN:transcription
termination factor rho] [GN:rho] [CL:transcription termination factor rho]
[OR:Escherichia coli] [DB:pir1] [MP:85 min] >gp:[GI:g147607] [LN:ECORHO]
[AC:J01673:J01674] [GN:rho] [OR:Escherichia coli] [SR:Escherichia coli (strain
K-12) DNA] [DB:genpept-bct1] [DE:E.coli rho gene coding for transcription
termination factor.] [NT:transcription termination factor] [LE:468] [RE:1727]
[DI:direct] >gp:[GI:g148186] [LN:ECOUW85] [AC:M87049] [PN:transcription
termination factor rho] [GN:rho (CGSC No. 288)] [OR:Escherichia coli]
[DB:genpept-bct1] [DE:E. coli genomic sequence of the region from 84.5 to 86.5
minutes.] [NT:protein spot sequence confirms start] [LE:19545] [RE:20804]
[DI:direct] >gp:[GI:g1790217] [LN:AE000454] [AC:AE000454:U00096]
[PN:transcription termination factor Rho; polarity] [GN:rho] [FN:factor; RNA
synthesis, modification, DNA] [OR:Escherichia coli] [DB:genpept-bct2]
[DE:Escherichia coli K-12 MG1655 section 344 of 400 of the completegenome.]
[NT:o419; 100 pct identical to RHO_ECOLI SW: P03002] [LE:8502] [RE:9761]
[DI:direct]

| ORF Name | NT ID | AA ID | NT LN | AA LN | Score | P-value |
|---|---|---|---|---|---|---|
| 14579775_c3_652 | 825 | 7996 | 483 | 160 | 286 | 4.1e-25 |

Description gp:[GI:g208931] [LN:SYNORFLAC] [AC:M15619] [OR:synthetic construct] [SR:E.coli
(strain SE5000) synthetic DNA, clone pKB1] [DB:genpept-syn] [DE:Synthetic E.coli
ORF16/lacZ fusion protein, partial cds.] [NT:ORF16-lacZ fusion protein] [LE:29]
[RE:>232] [DI:direct]

| ORF_Name | NT_ID | AA_ID | NT/LN | AA/LN | Score | P-value |
|---|---|---|---|---|---|---|
| 14642708_c1_398 | 826 | 7997 | 786 | 261 | 1069 | 4.4e-108 |

Description sp:[LN:WECG_SALTY] [AC:P37457] [GN:WECG:RFFM] [OR:Salmonella typhimurium]
[EC:2.4.1.-] [DE:(UDP-MANNACA TRANSFERASE)] [SP:P37457] [DB:swissprot]
>sp:[LN:S27727] [AC:S27727] [PN:hypothetical protein] [OR:Salmonella typhimurium]
[DB:pir2] >gp:[GI:g153897] [LN:STYCARABA] [AC:M95047] [GN:rffM] [FN:synthesis of
of enterobacterial common antigen] [OR:Salmonella typhimurium] [SR:Salmonella
typhimurium (strain LT2) DNA] [DB:genpept-bct1] [DE:Salmonella typhimurium
transport protein, complete cds, andtransfer RNA-Arg.] [LE:1278] [RE:2018]
[DI:direct]

| ORF_Name | NT_ID | AA_ID | NT/LN | AA/LN | Score | P-value |
|---|---|---|---|---|---|---|
| 14870330_c1_377 | 827 | 7998 | 2229 | 742 | 3258 | 0.0 |

Description sp:[LN:REP_ECOLI] [AC:P09980] [GN:REP] [OR:Escherichia coli] [EC:3.6.1.-]
[DE:ATP-DEPENDENT DNA HELICASE REP,] [SP:P09980] [DB:swissprot] >sp:[LN:HJECDR]
[AC:E65181:S30673:A26438:I54860] [PN:ATP-dependent DNA helicase Rep,] [GN:rep]
[CL:helicase II] [OR:Escherichia coli] [EC:3.6.1.-] [DB:pir1] [MP:85 min]
>gp:[GI:g148182] [LN:ECOUW85] [AC:M87049] [PN:rep helicase] [GN:rep (CGSC No.
303)] [OR:Escherichia coli] [DB:genpept-bct1] [DE:E. coli genomic sequence of the
region from 84.5 to 86.5 minutes.] [LE:13805] [RE:15826] [DI:direct]
>gp:[GI:g1790212] [LN:AE000454] [AC:AE000454:U00096] [PN:rep helicase, a
single-stranded DNA dependent] [GN:rep] [FN:enzyme; DNA - replication, repair,]
[OR:Escherichia coli] [DB:genpept-bct2] [EC:3.6.1.-] [DE:Escherichia coli K-12
MG1655 section 344 of 400 of the completegenome.] [NT:o673; 100 pct identical to
REP_ECOLI SW: P09980] [LE:2762] [RE:4783] [DI:direct]

| ORF_Name | NT_ID | AA_ID | NT/LN | AA/LN | Score | P-value |
|---|---|---|---|---|---|---|
| 14880207_c1_412 | 828 | 7999 | 909 | 302 | 1421 | 2.2e-145 |

Description sp:[LN:XERC_SALTY] [AC:P55888] [GN:XERC] [OR:Salmonella typhimurium]
[DE:INTEGRASE/RECOMBINASE XERC] [SP:P55888] [DB:swissprot] >gp:[GI:g1916339]
[LN:STU92525] [AC:U92525] [PN:site-specific recombinase] [GN:xerC] [OR:Salmonella
typhimurium] [DB:genpept-bct2] [DE:Salmonella typhimurium site-specific
recombinase (xerC) gene,complete cds.] [NT:XerC] [LE:410] [RE:1312] [DI:direct]

| ORF_Name | NT_ID | AA_ID | NT/LN | AA/LN | Score | P-value |
|---|---|---|---|---|---|---|
| 14880457_c2_488 | 829 | 8000 | 1083 | 360 | 1421 | 2.2e-145 |

Description sp:[LN:YIFM_ECOLI] [AC:P56258] [GN:YIFM:B4404/B4405] [OR:Escherichia coli]
[DE:HYPOTHETICAL 40.6 KD PROTEIN IN WZXE-WECF INTERGENIC REGION] [SP:P56258]
[DB:swissprot]

| ORF Name | NT ID | AA ID | NT LN | AA LN | Score | P-value |
|---|---|---|---|---|---|---|
| 14956527_f1_125 | 830 | 8001 | 855 | 284 | 767 | 4.4e-76 |

Description sp:[LN:YIFA_ECOLI] [AC:P22788] [GN:YIFA] [OR:Escherichia coli] [DE:(F198)]
[SP:P22788] [DB:swissprot] >sp:[LN:E65179] [AC:E65179:S30660:JQ0874]
[PN:hypothetical 22.4 kD protein in trpT-pssR intergenic region:hypothetical 20K
protein (ilvG-rrnC intergenic region)] [GN:yifA] [OR:Escherichia coli] [DB:pir2]
[MP:82 min] >gp:[GI:g148170] [LN:ECOUW85] [AC:M87049] [GN:f198] [FN:unknown]
[OR:Escherichia coli] [DB:genpept-bct1] [DE:E. coli genomic sequence of the
region from 84.5 to 86.5 minutes.] [LE:266] [RE:862] [DI:complement]
>gp:[GI:g1790198] [LN:AE000453] [AC:AE000453:U00096] [PN:orf, hypothetical
protein] [GN:yifA] [FN:orf; Unknown] [OR:Escherichia coli] [DB:genpept-bct2]
[DE:Escherichia coli K-12 MG1655 section 343 of 400 of the completegenome.]
[NT:f198; 100 pct identical to YIFA_ECOLI SW: P22788] [LE:3489] [RE:4085]
[DI:complement]

| ORF Name | NT ID | AA ID | NT LN | AA LN | Score | P-value |
|---|---|---|---|---|---|---|
| 15626901_f3_361 | 831 | 8002 | 1665 | 554 | 1974 | 5.5e-204 |

Description sp:[LN:YIFB_ECOLI] [AC:P22787] [GN:YIFB] [OR:Escherichia coli] [DE:(F516)
[CONTAINS: ORF I]] [SP:P22787] [DB:swissprot] >sp:[LN:JQ0872]
[AC:JQ0872:H65179:S30663] [PN:hypothetical 56.2K protein (ilvG-rrnC intergenic
region):hypothetical 56.2K protein (pssR-ilvL intergenic region):hypothetical
protein f516:ORFIII protein] [GN:yifB] [CL:conserved hypothetical protein HI1117]
[OR:Escherichia coli] [DB:pir2] [MP:82 min] >gp:[GI:g147774] [LN:ECORRNILV]
[AC:M37337] [GN:ilv-related] [OR:Escherichia coli] [SR:Escherichia coli (strain
K-12) DNA] [DB:genpept-bct1] [DE:Escherichia coli acetolactate synthase II (ilvG)
gene, 5' end;ribosomal protein (rrnC) gene, complete cds.] [NT:ORF III] [LE:1767]
[RE:3317] [DI:direct] >gp:[GI:g1790201] [LN:AE000453] [AC:AE000453:U00096]
[PN:putative 2-component regulator] [GN:yifB] [FN:putative regulator; Not
classified] [OR:Escherichia coli] [DB:genpept-bct2] [DE:Escherichia coli K-12
MG1655 section 343 of 400 of the completegenome.] [NT:f516; 99 pct identical
amino acid sequence and] [LE:4809] [RE:6359] [DI:complement]

| ORF Name | NT ID | AA ID | NT LN | AA LN | Score | P-value |
|---|---|---|---|---|---|---|
| 15744511_f3_312 | 832 | 8003 | 396 | 131 | 561 | 3.0e-54 |

Description sp:[LN:CYAY_ECOLI] [AC:P27838] [GN:CYAY] [OR:Escherichia coli] [DE:CYAY PROTEIN]
[SP:P27838] [DB:swissprot] >sp:[LN:S30697] [AC:S30697:S24976:H65184] [PN:cyaY
protein:hypothetical 11K protein (cyaA-dapF intergenic region)] [GN:cyaY]
[CL:cyaY protein] [OR:Escherichia coli] [DB:pir1] [MP:86 min] >gp:[GI:g41188]
[LN:ECCYALOC] [AC:X66782] [GN:cyaY] [OR:Escherichia coli] [DB:genpept-bct1]
[DE:E.coli hemC, cya, cyaY and dapF genes for uroporphyrinogen Isynthase,
adenylate cyclase, an unknown protein, anddiaminopimelate epimerase.] [SP:P27838]
[LE:3240] [RE:3560] [DI:complement] >gp:[GI:g148206] [LN:ECOUW85] [AC:M87049]
[GN:f106] [FN:unknown] [OR:Escherichia coli] [DB:genpept-bct1] [DE:E. coli
genomic sequence of the region from 84.5 to 86.5 minutes.] [LE:46851] [RE:47171]
[DI:complement] >gp:[GI:g1790239] [LN:AE000456] [AC:AE000456:U00096] [PN:orf,
hypothetical protein] [GN:cyaY] [FN:orf; Unknown] [OR:Escherichia coli]
[DB:genpept-bct2] [DE:Escherichia coli K-12 MG1655 section 346 of 400 of the
completegenome.] [NT:f106; 100 pct identical to CYAY_ECOLI SW: P27838] [LE:10881]
[RE:11201] [DI:complement]

| ORF Name | NT ID | AA ID | NT LN | AA LN | Score | P-value |
|---|---|---|---|---|---|---|
| 16205430_c3_587 | 833 | 8004 | 1275 | 424 | 1926 | 6.7e-199 |

Description sp:[LN:WECC_ECOLI] [AC:P27829] [GN:WECC:RFFD] [OR:Escherichia coli] [EC:1.1.1.-]
[DE:(UDP-MANNAC DEHYDROGENASE)] [SP:P27829] [DB:swissprot] >sp:[LN:F65182]
[AC:F65182:B49350] [PN:UDP-ManNAc dehydrogenase:hypothetical protein 379 (nfrC 3'
region)] [GN:rffD] [CL:UDP-N-acetyl-D-mannosaminuronic acid dehydrogenase]
[OR:Escherichia coli] [DB:pir2] >gp:[GI:g2367284] [LN:AE000455]
[AC:AE000455:U00096] [PN:UDP-N-acetyl-D-mannosaminuronic acid] [GN:wecC]
[FN:enzyme; Central intermediary metabolism:] [OR:Escherichia coli]
[DB:genpept-bct2] [DE:Escherichia coli K-12 MG1655 section 345 of 400 of the
completegenome.] [NT:o420; formerly designated rffD] [LE:1177] [RE:2439]
[DI:direct]

| ORF Name | NT ID | AA ID | NT LN | AA LN | Score | P-value |
|---|---|---|---|---|---|---|
| 16511580_c3_591 | 834 | 8005 | 843 | 280 | 695 | 1.9e-68 |

Description sp:[LN:RFFC_ECOLI] [AC:P27832] [GN:RFFC:WECD] [OR:Escherichia coli]
[DE:LIPOPOLYSACCHARIDE BIOSYNTHESIS PROTEIN RFFC] [SP:P27832] [DB:swissprot]
>sp:[LN:A65183] [AC:A65183:S30684] [PN:hypothetical protein yifH:hypothetical
protein o181] [GN:yifH] [CL:Escherichia coli hypothetical protein yifH]
[OR:Escherichia coli] [DB:pir2] >gp:[GI:g148193] [LN:ECOUW85] [AC:M87049]
[GN:o181] [FN:unknown] [OR:Escherichia coli] [DB:genpept-bct1] [DE:E. coli
genomic sequence of the region from 84.5 to 86.5 minutes.] [NT:possibly rffA or
rffC] [LE:27716] [RE:28261] [DI:direct] >gp:[GI:g1790225] [LN:AE000455]
[AC:AE000455:U00096] [PN:orf, hypothetical protein] [GN:wecD] [FN:orf; Unknown]
[OR:Escherichia coli] [DB:genpept-bct2] [DE:Escherichia coli K-12 MG1655 section
345 of 400 of the completegenome.] [NT:o181; formerly designated yifH] [LE:4513]
[RE:5058] [DI:direct]

| ORF Name | NT ID | AA ID | NT/LN | AA/LN | Score | P-value |
|---|---|---|---|---|---|---|
| 16603535_f1_99 | 835 | 8006 | 1062 | 353 | 490 | 9.9e-47 |

Description sp:[LN:S76674] [AC:S76674] [PN:hypothetical protein] [OR:Synechocystis sp.]
[SR:PCC 6803, , PCC 6803] [SR:PCC 6803, ] [DB:pir2] >gp:[GI:d1011269:g1208451]
[LN:SYCSLRF] [AC:D64004:AB001339] [PN:hypothetical protein] [OR:Synechocystis
sp.] [SR:Synechocystis sp. (strain:PCC6803) DNA] [DB:genpept-bct1]
[DE:Synechocystis sp. PCC6803 complete genome, 23/27, 2868767-3002965.]
[NT:ORF_ID:slr0619] [LE:87341] [RE:88387] [DI:direct]

| ORF Name | NT ID | AA ID | NT/LN | AA/LN | Score | P-value |
|---|---|---|---|---|---|---|
| 16674056_c2_480 | 836 | 8007 | 1068 | 355 | 1522 | 4.3e-156 |

Description sp:[LN:WZZE_ECOLI] [AC:P25905:P76752] [GN:WZZE:WZZ] [OR:Escherichia coli]
[DE:LIPOPOLYSACCHARIDE BIOSYNTHESIS PROTEIN WZZE] [SP:P25905:P76752]
[DB:swissprot] >sp:[LN:D65182] [AC:D65182:JN0260] [PN:hypothetical 39.5K protein
(rfe 5' region)] [OR:Escherichia coli] [DB:pir2] [MP:85 min] >gp:[GI:g2367281]
[LN:AE000454] [AC:AE000454:U00096] [PN:putative transport protein] [GN:wzzE]
[FN:putative transport; Not classified] [OR:Escherichia coli] [DB:genpept-bct2]
[DE:Escherichia coli K-12 MG1655 section 344 of 400 of the completegenome.]
[NT:o349] [LE:11113] [RE:12162] [DI:direct]

| ORF Name | NT ID | AA ID | NT/LN | AA/LN | Score | P-value |
|---|---|---|---|---|---|---|
| 16677042_c2_545 | 837 | 8008 | 861 | 286 | 1076 | 7.9e-109 |

Description sp:[LN:YIGW_ECOLI] [AC:P27859:P27860:P78128:P78129] [GN:YIGW] [OR:Escherichia
coli] [DE:HYPOTHETICAL 29.6 KD PROTEIN IN UDP-RFAH INTERGENIC REGION]
[SP:P27859:P27860:P78128:P78129] [DB:swissprot] >gp:[GI:e1292183:g3123499]
[LN:ECO5830] [AC:AJ005830] [PN:TatD protein] [GN:tatD] [FN:Sec-independent
protein translocase] [OR:Escherichia coli] [DB:genpept-bct1] [DE:Escherichia coli
tatABCD operon.] [NT:alternative gene names: yigW, mttC] [LE:1653] [RE:2447]
[DI:direct]

| ORF Name | NT ID | AA ID | NT/LN | AA/LN | Score | P-value |
|---|---|---|---|---|---|---|
| 16823266_f2_181 | 838 | 8009 | 1350 | 449 | | |

Description

NO-HIT

| ORF Name | NT ID | AA ID | NT LN | AA LN | Score | P-value |
|---|---|---|---|---|---|---|
| 16835457_f3_290 | 839 | 8010 | 915 | 304 | 970 | 1.4e-97 |

Description sp:[LN:T14989] [AC:T14989] [PN:probable transposase] [GN:Y1072] [OR:Yersinia pestis] [DB:pir2] >gp:[GI:g5834755] [LN:YPPMT1] [AC:AL117211] [PN:hypothetical protein YPMT1.71] [GN:YPMT1.71] [OR:Yersinia pestis] [DB:genpept-bct1] [DE:Yersinia pestis plasmid pPMT1.] [NT:YPMT1.71, conserved hypothetical protein, len: 328] [LE:71857] [RE:72843] [DI:direct] >gp:[GI:g3883072] [LN:AF074611] [AC:AF074611] [PN:putative transposase] [OR:Y1072] [OR:Yersinia pestis] [DB:genpept-bct2] [DE:Yersinia pestis plasmid pMT-1, complete plasmid sequence.] [NT:f328; 78 pct identical to 313 amino acids of] [LE:59154] [RE:60140] [DI:complement]

| ORF Name | NT ID | AA ID | NT LN | AA LN | Score | P-value |
|---|---|---|---|---|---|---|
| 1992136_c1_368 | 840 | 8011 | 1689 | 562 | 2575 | 1.1e-267 |

Description sp:[LN:YCEC] [AC:A26570:S48893:A01112:JQ0875:S30665:S30666:C65180] [PN:acetolactate synthase, II large chain, ilv0 mutant:acetohydroxy acid synthase II large chain:acetolactate synthase large chain active form:acetolactate synthase valine-resistant isozyme:hypothetical protein o221:ilvG protein] [GN:ilvG_2] [CL:acetolactate synthase large chain:thiamine pyrophosphate-binding domain homology] [OR:Escherichia coli] [EC:4.1.3.18] [DB:pir1] [MP:85 min] >gp:[GI:g288529] [LN:ECILVGMED] [AC:X04890] [GN:ilvG] [OR:Escherichia coli] [DB:genpept-bct1] [DE:E.coli ilvGMEDA operon.] [NT:acetohydro x 4 acid synthase] [SP:P00892] [LE:731] [RE:2377] [DI:direct] >gp:[GI:g146458] [LN:ECOILVGE] [AC:M10313:J01634:J01635:M17624] [PN:acetohydroxy acid synthase II] [GN:ilvG] [OR:Escherichia coli] [SR:Escherichia coli (strain K-12) DNA] [DB:genpept-bct2] [EC:4.1.3.18] [DE:E.coli ilv gene cluster encoding ilvD and ilvA peptides,acetohydroxy acid synthase II, and branched-chain amino acidaminotransferase, complete cds.] [LE:361] [RE:2007] [DI:direct]

| ORF Name | NT ID | AA ID | NT LN | AA LN | Score | P-value |
|---|---|---|---|---|---|---|
| 19928451_f3_341 | 841 | 8012 | 1284 | 427 | 2133 | 7.8e-221 |

Description sp:[LN:G65181] [AC:G65181:S30675:S23696:S28610] [PN:rhlB protein:probable ATP-dependent RNA helicase] [GN:rhlB:rhlB:nmrA] [CL:unassigned DEAD/H box helicases:DEAD/H box helicase homology] [OR:Escherichia coli] [DB:pir2] >gp:[GI:g1790214] [LN:AE000454] [AC:AE000454:U00096] [PN:putative ATP-dependent RNA helicase] [GN:rhlB] [FN:putative enzyme; Not classified] [OR:Escherichia coli] [DB:genpept-bct2] [DE:Escherichia coli K-12 MG1655 section 344 of 400 of the completegenome.] [NT:f421; 99 pct identical amino acid sequence and] [LE:6450] [RE:7715] [DI:complement]

| ORF Name | NT ID | AA ID | NT/LN | AA/LN | Score | P-value |
|---|---|---|---|---|---|---|
| 2035761_f3_297 | 842 | 8013 | 924 | 307 | 1353 | 3.5e-138 |

Description sp:[LN:RARD_ECOLI] [AC:P27844] [GN:RARD] [OR:Escherichia coli] [DE:RARD PROTEIN]
[SP:P27844] [DB:swissprot] >sp:[LN:S30746] [AC:S30746] [PN:rarD protein]
[CL:Escherichia coli rarD protein] [OR:Escherichia coli] [DB:pir2]
>gp:[GI:g145580] [LN:ECOCORAX] [AC:L02122] [GN:rarD] [OR:Escherichia coli]
[SR:Escherichia coli (individual_isolate pBD434, strain K-12) DNA]
[DB:genpept-bct2] [DE:E. coli DNA helicase II (uvrD) gene, 3' end, Mg-transport
system I(corA) gene, complete cds, chloamphenicol sensitive (rarD) gene,complete
cds, detergent-resistant phospholipase A (pldA) gene, 5'end.] [LE:3146] [RE:4036]
[DI:complement]

| ORF Name | NT ID | AA ID | NT/LN | AA/LN | Score | P-value |
|---|---|---|---|---|---|---|
| 21907762_f3_343 | 843 | 8014 | 951 | 316 | 496 | 2.3e-47 |

Description gp:[GI:g3643996] [LN:AF087482] [AC:AF087482] [PN:putative regulatory protein]
[GN:ohbR] [OR:Pseudomonas aeruginosa] [DB:genpept-bct2] [DE:Pseudomonas
aeruginosa clcC and ohbH genes, Lys-R type regulatoryprotein (clcR),
chlorocatechol-1,2-dioxygenase (clcA),chloromuconate cycloisomerase (clcB),
dienelactone hydrolase(clcD), maleylacetate reductase (clcE), transposase
(tnpA),ATP-binding protein (tnpB), putative regulatory protein
(ohbR),o-halobenzoate dioxygenase reductase (ohbA), o-halobenzoatedioxygenase
alpha subunit (ohbB), o-halobenzoate dioxygenase betasubunit (ohbC),
o-halobenzoate dioxygenase ferredoxin (ohbD),putative membrane spanning protein
(ohbE), ATP-binding protein(ohbF), putative substrate binding protein (ohbG), and
putativedioxygenase genes, complete cds; and unknown gene.] [NT:similar to Lys-R
type regulatory proteins.] [LE:13389] [RE:14321] [DI:complement]

| ORF Name | NT ID | AA ID | NT/LN | AA/LN | Score | P-value |
|---|---|---|---|---|---|---|
| 22144142_f2_228 | 844 | 8015 | 318 | 105 | 339 | 9.9e-31 |

Description sp:[LN:S48658] [AC:S48658:S45525:S43654:B65181] [PN:peptidylprolyl
isomerase,:parvulin:PPIase] [GN:ppiC] [OR:Escherichia coli] [EC:5.2.1.8]
[DB:pir2] >gp:[GI:g836657] [LN:ECOUW85] [AC:M87049] [PN:peptidyl-prolyl cis-trans
isomerase C] [GN:ppiC] [FN:accelerates the folding of proteins] [OR:Escherichia
coli] [DB:genpept-bct1] [EC:5.2.1.8] [DE:E. coli genomic sequence of the region
from 84.5 to 86.5 minutes.] [LE:12663] [RE:12944] [DI:complement]
>gp:[GI:g693800] [LN:S73874] [AC:S73874] [PN:parvulin] [GN:parvA] [OR:Escherichia
coli] [SR:Escherichia coli K-12 HB101] [DB:genpept-bct1] [DE:parvA=parvulin
[Escherichia coli, K-12 HB101, Genomic, 1135 nt].] [NT:putative member of new
third PPIase family__.] [LE:560] [RE:841] [DI:direct] >gp:[GI:g1790211]
[LN:AE000454] [AC:AE000454:U00096] [PN:peptidyl-prolyl cis-trans isomerase C
(rotamase] [GN:ppiC] [FN:enzyme; Proteins - translation and] [OR:Escherichia
coli] [DB:genpept-bct2] [EC:5.2.1.8] [DE:Escherichia coli K-12 MG1655 section 344
of 400 of the completegenome.] [NT:f93; 100 pct identical to CYPC_ECOLI SW:
P39159] [LE:1620] [RE:1901] [DI:complement]

| ORF Name | NT ID | AA ID | NT LN | AA LN | Score | P-value |
|---|---|---|---|---|---|---|
| 22306677_f2_158 | 845 | 8016 | 963 | 320 | 1130 | 1.5e-114 |

Description sp:[LN:DLHH_ECOLI] [AC:P56262] [GN:YSGA] [OR:Escherichia coli] [EC:3.1.1.45]
[DE:HYDROLASE) (DLH)] [SP:P56262] [DB:swissprot]

| ORF Name | NT ID | AA ID | NT LN | AA LN | Score | P-value |
|---|---|---|---|---|---|---|
| 22522090_c1_384 | 846 | 8017 | 375 | 124 | 604 | 8.2e-59 |

Description gp:[GI:g147611] [LN:ECORHOB] [AC:K02845] [PN:thioredoxin] [GN:trxA]
[OR:Escherichia coli] [SR:Escherichia coli (sub_strain SK3983, strain K-12) DNA]
[DB:genpept-bct1] [DE:E.coli (clone pBHK10) thioredoxin (trxA) and termination
factor(rho) genes, complete cds.] [LE:194] [RE:577] [DI:direct] >gp:[GI:g148185]
[LN:ECOUW85] [AC:M87049] [PN:thioredoxin] [GN:trxA (CGSC No. 65)] [OR:Escherichia
coli] [DB:genpept-bct1] [DE:E. coli genomic sequence of the region from 84.5 to
86.5 minutes.] [LE:18835] [RE:19218] [DI:direct] >gp:[GI:g1790215] [LN:AE000454]
[AC:AE000454:U00096] [PN:thioredoxin 1] [GN:trxA] [FN:enzyme; Biosynthesis of
cofactors, carriers:] [OR:Escherichia coli] [DB:genpept-bct2] [DE:Escherichia
coli K-12 MG1655 section 344 of 400 of the completegenome.] [NT:o127; 100 pct
identical to 108 amino acids] [LE:7792] [RE:8175] [DI:direct]

| ORF Name | NT ID | AA ID | NT LN | AA LN | Score | P-value |
|---|---|---|---|---|---|---|
| 22687778_f1_18 | 847 | 8018 | 495 | 164 | 707 | 1.0e-69 |

Description sp:[LN:RFAH_ECOLI] [AC:P26614] [GN:RFAH:HLYT:SFRB] [OR:Escherichia coli]
[DE:TRANSCRIPTIONAL ACTIVATOR RFAH] [SP:P26614] [DB:swissprot] >sp:[LN:S30732]
[AC:S30732:S20906:C65189] [PN:transcription activator rfaH:hlyT protein]
[GN:rfaH:hlyT] [OR:Escherichia coli] [DB:pir2] [MP:87 min] >gp:[GI:g41729]
[LN:ECHLYT] [AC:X65013] [PN:transcriptional activator of haemolysin] [GN:hlyT]
[OR:Escherichia coli] [DB:genpept-bct1] [DE:E.coli DNA sequence of hlyT (rfaH,
sfrB) locus and ORF.] [NT:allelic to rfaH and sfrB locus] [SP:P26614] [LE:1971]
[RE:2459] [DI:direct] >gp:[GI:g1209302] [LN:ECORFAH] [AC:M94889] [GN:rfaH]
[OR:Escherichia coli] [SR:Escherichia coli (strain K-12) DNA] [DB:genpept-bct1]
[DE:E. coli rfaH gene, complete cds.] [LE:770] [RE:1258] [DI:direct]
>gp:[GI:g148241] [LN:ECOUW85] [AC:M87049] [GN:rfaH (CGSC No. 164)] [FN:regulator
of lipopolysacharide, sex factor and] [OR:Escherichia coli] [DB:genpept-bct1]
[DE:E. coli genomic sequence of the region from 84.5 to 86.5 minutes.] [NT:also
called sfrB, hlyT] [LE:77400] [RE:77888] [DI:complement] >gp:[GI:g1790276]
[LN:AE000459] [AC:AE000459:U00096] [PN:transcriptional activator affecting
biosynthesis] [GN:rfaH] [FN:regulator; Macromolecule metabolism:] [OR:Escherichia
coli] [DB:genpept-bct2] [DE:Escherichia coli K-12 MG1655 section 349 of 400 of
the completegenome.] [NT:f162; 100 pct identical to RFAH_ECOLI SW: P26614;]
[LE:8073] [RE:8561] [DI:complement]

| ORF Name | NT ID | AA ID | NT LN | AA LN | Score | P-value |
|---|---|---|---|---|---|---|
| 22852266_c2_485 | 848 | 8019 | 1170 | 389 | 1788 | 2.8e-184 |

Description sp:[LN:RFFA_ECOLI] [AC:P27833] [GN:RFFA:WECE] [OR:Escherichia coli]
[DE:LIPOPOLYSACCHARIDE BIOSYNTHESIS PROTEIN RFFA] [SP:P27833] [DB:swissprot]
>sp:[LN:B65183] [AC:B65183:S30685] [PN:probable hydro-lyase,:hypothetical 41.9K
protein rffE-rffT intergenetic region] [GN:yifI] [CL:erythromycin resistance
protein] [OR:Escherichia coli] [EC:4.2.1.-] [DB:pir1] >gp:[GI:g2367285]
[LN:AE000455] [AC:AE000455:U00096] [PN:putative regulator] [GN:wecE] [FN:putative
regulator; Not classified] [OR:Escherichia coli] [DB:genpept-bct2]
[DE:Escherichia coli K-12 MG1655 section 345 of 400 of the completegenome.]
[NT:o376; formerly designated yifI] [LE:5063] [RE:6193] [DI:direct]

| ORF Name | NT ID | AA ID | NT LN | AA LN | Score | P-value |
|---|---|---|---|---|---|---|
| 239541_c3_640 | 849 | 8020 | 741 | 246 | 1067 | 7.1e-108 |

Description sp:[LN:A39434] [AC:A39434:E65189:S30735] [PN:NAD(P)H dehydrogenase (FMN),:flavin
reductase:FMN reductase] [GN:ubiB:fre] [CL:cytochrome-b5 reductase homology]
[OR:Escherichia coli] [EC:1.6.8.1] [DB:pir2] >gp:[GI:g145908] [LN:ECOFADI]
[AC:M85227:M38338] [PN:activator protein] [GN:fadI] [OR:Escherichia coli]
[SR:Escherichia coli (strain K-12) DNA] [DB:genpept-bct1] [DE:E.coli activator
protein (fadI) gene, complete cds.] [NT:activator of fadB and fadE genes]
[LE:253] [RE:954] [DI:direct] >gp:[GI:g1209296] [LN:ECOFRE] [AC:M74448]
[PN:NAD(P)H: FMN oxidoreductase] [GN:fre] [OR:Escherichia coli] [SR:Escherichia
coli (strain K-12) DNA] [DB:genpept-bct1] [DE:Escherichia coli NAD(P)H:FMN
oxidoreductase (fre) gene, completecds.] [LE:1452] [RE:2153] [DI:direct]
>gp:[GI:g146002] [LN:ECOFREX] [AC:M61182] [PN:flavin oxidoreductase] [GN:fre]
[OR:Escherichia coli] [SR:Escherichia coli (strain K-12) DNA] [DB:genpept-bct1]
[DE:E.coli flavin reductase (fre) gene, complete cds.] [LE:121] [RE:822]
[DI:direct] >gp:[GI:g2367314] [LN:AE000459] [AC:AE000459:U00096]
[PN:ferrisiderophore reductase; flavin reductase] [GN:ubiB] [FN:enzyme; Energy
metabolism, carbon: Electron] [OR:Escherichia coli] [DB:genpept-bct2]
[EC:1.6.8.-] [DE:Escherichia coli K-12 MG1655 section 349 of 400 of the
completegenome.] [NT:o233; 99 pct identical amino acid sequence and] [LE:10267]
[RE:10968] [DI:direct]

| ORF Name | NT ID | AA ID | NT LN | AA LN | Score | P-value |
|---|---|---|---|---|---|---|
| 24257807_c1_418 | 850 | 8021 | 894 | 297 | 1536 | 1.4e-157 |

Description sp:[LN:PA1_KLEPN] [AC:P37446] [GN:PLDA] [OR:Klebsiella pneumoniae] [EC:3.1.1.32]
[DE:ACYLHYDROLASE) (OUTER MEMBRANE PHOSPHOLIPASE A) (OM PLA)] [SP:P37446]
[DB:swissprot] >sp:[LN:B36971] [AC:B36971:S40129] [PN:outer membrane
phospholipase A, precursor] [GN:pldA] [CL:bacterial phospholipase A1]
[OR:Klebsiella pneumoniae] [EC:3.1.1.-] [DB:pir2] >gp:[GI:g436881] [LN:KPPLDA]
[AC:X76901] [PN:outer membrane phospholipase A] [GN:pldA] [OR:Klebsiella
pneumoniae] [DB:genpept-bct1] [DE:K.pneumoniae pldA gene for outer membrane
phospholipase A.] [SP:P37446] [LE:225] [RE:1085] [DI:direct]

| ORF Name | NT ID | AA ID | NT LN | AA LN | Score | P-value |
|---|---|---|---|---|---|---|
| 24275910_c3_623 | 851 | 8022 | 1041 | 346 | 1445 | 6.3e-148 |

Description gp:[GI:g42427] [LN:ECPLDB] [AC:X03155] [OR:Escherichia coli] [DB:genpept-bct1]
[DE:E. coli pldB gene for inner membrane lysophospholipase L2.]
[NT:lysophospholipase L2 (aa 1-340)] [SP:P07000] [LE:118] [RE:1140] [DI:direct]

| ORF Name | NT ID | AA ID | NT LN | AA LN | Score | P-value |
|---|---|---|---|---|---|---|
| 24634666_f1_69 | 852 | 8023 | 1200 | 399 | 1860 | 6.6e-192 |

Description sp:[LN:HEMY_ECOLI] [AC:P09128] [GN:HEMY] [OR:Escherichia coli] [DE:HEMY PROTEIN]
[SP:P09128] [DB:swissprot] >sp:[LN:S01694] [AC:S01694:S30692:C65184] [PN:hemY
protein] [GN:hemY] [OR:Escherichia coli] [DB:pir2] [MP:85 min] >gp:[GI:g41669]
[LN:ECHEMCD] [AC:X12614] [OR:Escherichia coli] [DB:genpept-bct1] [DE:E. coli
genes hemC and hemD for porphobilinogen deaminase (EC4.3.1.8) and
uroporphyrinogen III cosynthetase (EC 4.2.1.75).] [NT:ORF Y (AA 1 - 398)]
[SP:P09128] [LE:3004] [RE:4200] [DI:direct] >gp:[GI:g148201] [LN:ECOUW85]
[AC:M87049] [GN:hemY] [FN:unknown] [OR:Escherichia coli] [DE:E.
coli genomic sequence of the region from 84.5 to 86.5 minutes.] [LE:39798]
[RE:40994] [DI:complement] >gp:[GI:g1790234] [LN:AE000456] [AC:AE000456:U00096]
[PN:a late step of protoheme IX synthesis] [GN:hemY] [FN:enzyme; Biosynthesis of
cofactors, carriers:] [OR:Escherichia coli] [DB:genpept-bct2] [DE:Escherichia
coli K-12 MG1655 section 346 of 400 of the completegenome.] [NT:f398; 100 pct
identical to HEMY_ECOLI SW: P09128] [LE:3828] [RE:5024] [DI:complement]

| ORF Name | NT ID | AA ID | NT LN | AA LN | Score | P-value |
|---|---|---|---|---|---|---|
| 24743941_c3_624 | 853 | 8024 | 978 | 325 | 1334 | 3.6e-136 |

Description sp:[LN:D65187] [AC:D65187:S30717] [PN:hypothetical 33.7 kD protein in pldB-metR
intergenic region:hypothetical protein o299] [GN:yigM] [OR:Escherichia coli]
[DB:pir2] >gp:[GI:g148226] [LN:ECOUW85] [AC:M87049] [GN:o299] [FN:unknown]
[OR:Escherichia coli] [DB:genpept-bct1] [DE:E. coli genomic sequence of the
region from 84.5 to 86.5 minutes.] [NT:overlaps metR] [LE:64162] [RE:65061]
[DI:direct] >gp:[GI:g1790261] [LN:AE000458] [AC:AE000458:U00096] [PN:orf,
hypothetical protein] [GN:yigM] [FN:orf; Unknown] [OR:Escherichia coli]
[DB:genpept-bct2] [DE:Escherichia coli K-12 MG1655 section 348 of 400 of the
completegenome.] [NT:o299; 100 pct identical to YIGM_ECOLI SW: P27849] [LE:6274]
[RE:7173] [DI:direct]

| ORF Name | NT ID | AA ID | NT LN | AA LN | Score | P-value |
|---|---|---|---|---|---|---|
| 24792216_c3_561 | 854 | 8025 | 201 | 66 | 124 | 6.0e-08 |

Description gp:[GI:g148172] [LN:ECOUW85] [AC:M87049] [GN:o137] [FN:unknown] [OR:Escherichia
coli] [DB:genpept-bct1] [DE:E. coli genomic sequence of the region from 84.5 to
86.5 minutes.] [LE:1223] [RE:1636] [DI:direct]

| ORF Name | NT ID | AA ID | NT/LN | AA/LN | Score | P-value |
|---|---|---|---|---|---|---|
| 25791026_c1_440 | 855 | 8026 | 540 | 179 | 606 | 5.1e-59 |

Description gp:[GI:e1292181:g3123497] [LN:ECO5830] [AC:AJ005830] [PN:TatB protein] [GN:tatB] [FN:Sec-independent protein translocase] [OR:Escherichia coli] [DB:genpept-bct1] [DE:Escherichia coli tatABCD operon.] [LE:329] [RE:844] [DI:direct] >gp:[GI:g3193218] [LN:AF067848] [AC:AF067848] [PN:MttA2] [GN:mttA2] [FN:involved in folded protein translocation and] [OR:Escherichia coli] [DB:genpept-bct2] [DE:Escherichia coli MttA1 (mttA1), MttA2 (mttA2), MttB (mttB), andMttC (mttC) genes, complete cds.] [NT:TatB; YigT] [LE:957] [RE:1472] [DI:direct]

| ORF Name | NT ID | AA ID | NT/LN | AA/LN | Score | P-value |
|---|---|---|---|---|---|---|
| 2594205_c1_439 | 856 | 8027 | 381 | 126 | 362 | 3.6e-33 |

Description sp:[LN:E65188] [AC:E65188] [PN:hypothetical 11.3 kD protein in udp-rfaH intergenic region] [CL:conserved hypothetical secreted protein HP0320] [OR:Escherichia coli] [DB:pir2] >gp:[GI:g2367310] [LN:AE000459] [AC:AE000459:U00096] [PN:orf, hypothetical protein] [GN:b3836] [FN:orf; Unknown] [OR:Escherichia coli] [DB:genpept-bct2] [DE:Escherichia coli K-12 MG1655 section 349 of 400 of the completegenome.] [NT:o103; sequence change split ORF of earlier] [LE:5640] [RE:5951] [DI:direct] >gp:[GI:g3193217] [LN:AF067848] [AC:AF067848] [PN:MttA1] [GN:mttA1] [FN:involved in folded protein translocation and] [OR:Escherichia coli] [DB:genpept-bct2] [DE:Escherichia coli MttA1 (mttA1), MttA2 (mttA2), MttB (mttB), andMttC (mttC) genes, complete cds.] [NT:TatA; YigT] [LE:642] [RE:953] [DI:direct]

| ORF Name | NT ID | AA ID | NT/LN | AA/LN | Score | P-value |
|---|---|---|---|---|---|---|
| 2626038_c2_527 | 857 | 8028 | 381 | 126 | | |

Description

NO-HIT

| ORF Name | NT ID | AA ID | NT LN | AA LN | Score | P-value |
|---|---|---|---|---|---|---|
| 26454137_c3_569 | 858 | 8029 | 276 | 91 | 332 | 5.5e-30 |

Description sp:[LN:B26570] [AC:B26570:S30667:D65180] [PN:acetolactate synthase, II small
chain:acetohydroxy-acid synthase II] [GN:ilvM] [OR:Escherichia coli]
[EC:4.1.3.18] [DB:pir2] >gp:[GI:g288530] [LN:ECILVGMED] [AC:X04890] [GN:ilvM]
[OR:Escherichia coli] [DB:genpept-bct1] [DE:E.coli ilvGMEDA operon.] [NT:AHASII
small subunit] [SP:P13048] [LE:2374] [RE:2637] [DI:direct] >gp:[GI:g148176]
[LN:ECOUW85] [AC:M87049] [PN:acetohydroxy acid synthase II, small subunit]
[GN:ilvM (CGSC No. 18214)] [OR:Escherichia coli] [DB:genpept-bct1] [DE:E. coli
genomic sequence of the region from 84.5 to 86.5 minutes.] [LE:5337] [RE:5600]
[DI:direct] >gp:[GI:g1790204] [LN:AE000453] [AC:AE000453:U00096] [PN:acetolactate
synthase II, valine insensitive,] [GN:ilvM] [FN:enzyme; Amino acid biosynthesis:
Isoleucine,] [OR:Escherichia coli] [DB:genpept-bct2] [EC:4.1.3.18]
[DE:Escherichia coli K-12 MG1655 section 343 of 400 of the completegenome.]
[NT:o87; 100 pct identical to ILVM_ECOLI SW: P13048] [LE:8561] [RE:8824]
[DI:direct]

| ORF Name | NT ID | AA ID | NT LN | AA LN | Score | P-value |
|---|---|---|---|---|---|---|
| 2775416_f2_229 | 859 | 8030 | 333 | 110 | 472 | 8.0e-45 |

Description sp:[LN:S48658] [AC:S48658:S45525:S43654:B65181] [PN:peptidylprolyl
isomerase,:parvulin:PPIase] [GN:ppiC] [OR:Escherichia coli] [EC:5.2.1.8]
[DB:pir2] >gp:[GI:g836657] [LN:ECOUW85] [AC:M87049] [PN:peptidyl-prolyl cis-trans
isomerase C] [GN:ppiC] [FN:accelerates the folding of proteins] [OR:Escherichia
coli] [DB:genpept-bct1] [EC:5.2.1.8] [DE:E. coli genomic sequence of the region
from 84.5 to 86.5 minutes.] [LE:12663] [RE:12944] [DI:complement]
>gp:[GI:g693800] [LN:S73874] [AC:S73874] [PN:parvulin] [GN:parvA] [OR:Escherichia
coli] [SR:Escherichia coli K-12 HB101] [DB:genpept-bct1] [DE:parvA=parvulin
[Escherichia coli, K-12 HB101, Genomic, 1135 nt].] [NT:putative member of new
third PPIase family__.] [LE:560] [RE:841] [DI:direct] >gp:[GI:g1790211]
[LN:AE000454] [AC:AE000454:U00096] [PN:peptidyl-prolyl cis-trans isomerase C
(rotamase)] [GN:ppiC] [FN:enzyme; Proteins - translation and] [OR:Escherichia
coli] [DB:genpept-bct2] [EC:5.2.1.8] [DE:Escherichia coli K-12 MG1655 section 344
of 400 of the completegenome.] [NT:f93; 100 pct identical to CYPC_ECOLI SW:
P39159] [LE:1620] [RE:1901] [DI:complement]

| ORF Name | NT ID | AA ID | NT LN | AA LN | Score | P-value |
|---|---|---|---|---|---|---|
| 2819140_c2_537 | 860 | 8031 | 897 | 298 | 1269 | 2.8e-129 |

Description sp:[LN:UDP_KLEAE] [AC:O08444] [GN:UDP] [OR:Klebsiella aerogenes] [EC:2.4.2.3]
[DE:URIDINE PHOSPHORYLASE, (UDRPASE)] [SP:O08444] [DB:swissprot]
>gp:[GI:e320954:g2181932] [LN:KAUDPHOS] [AC:Y13414] [PN:uridine phosphorylase]
[GN:udp] [OR:Klebsiella aerogenes] [DB:genpept-bct1] [EC:2.4.2.3] [DE:Klebsiella
aerogenes udp gene.] [SP:O08444] [LE:258] [RE:1019] [DI:direct]

| ORF_Name | NT_ID | AA_ID | $\frac{NT}{LN}$ | $\frac{AA}{LN}$ | Score | P-value |
|---|---|---|---|---|---|---|
| 29335162_c1_416 | 861 | 8032 | 1017 | 338 | 1516 | 1.9e-155 |

Description sp:[LN:CORA_ECOLI] [AC:P27841] [GN:CORA] [OR:Escherichia coli] [DE:MAGNESIUM AND COBALT TRANSPORT PROTEIN CORA] (SP:P27841] [DB:swissprot] >sp:[LN:B47157] [AC:B47157:S30743:A65186] [PN:magnesium transport protein corA:magnesium transport system I] [GN:corA] [OR:Escherichia coli] [DB:pir2] >gp:[GI:g2367297] [LN:AE000457] [AC:AE000457:U00096] [PN:Mg2+ transport, system I] [GN:corA] [FN:transport; Transport of small molecules:] [OR:Escherichia coli] [DB:genpept-bct2] [DE:Escherichia coli K-12 MG1655 section 347 of 400 of the completegenome.] [NT:o316; 99 pct identical amino acid sequence and] [LE:7057] [RE:8007] [DI:direct] >gp:[GI:g145577] [LN:ECOCORAX] [AC:L02122] [GN:corA] [FN:Mg-transport system I] [OR:Escherichia coli] [SR:Escherichia coli (individual_isolate pBD434, strain K-12) DNA] [DB:genpept-bct2] [DE:E. coli DNA helicase II (uvrD) gene, 3' end, Mg-transport system I(corA) gene, complete cds, chloamphenicol sensitive (rarD) gene,complete cds, detergent-resistant phospholipase A (pldA) gene, 5'end.] [LE:1284] [RE:2234] [DI:direct]

| ORF_Name | NT_ID | AA_ID | $\frac{NT}{LN}$ | $\frac{AA}{LN}$ | Score | P-value |
|---|---|---|---|---|---|---|
| 29344760_c3_650 | 862 | 8033 | 615 | 204 | 707 | 1.0e-69 |

Description sp:[LN:HEMG_ECOLI] [AC:P27863] [GN:HEMG] [OR:Escherichia coli] [EC:1.3.3.4] [DE:PROTOPORPHYRINOGEN OXIDASE, (PPO)] [SP:P27863] [DB:swissprot] >sp:[LN:JC2513] [AC:JC2513:S41629:C65190:S30741] [PN:protoporphyrinogen oxidase,:hypothetical protein o181] [GN:hemG] [OR:Escherichia coli] [EC:1.3.3.4] [DB:pir2] [MP:86 min] >gp:[GI:g581103] [LN:ECHEMGA] [AC:X68660] [PN:protoporphyrinogen oxidase] [GN:hemG] [OR:Escherichia coli] [DB:genpept-bct1] [DE:E.coli hemG gene for protoporphyrinogen oxidase.] [SP:P27863] [LE:98] [RE:643] [DI:direct] >gp:[GI:g1790285] [LN:AE000460] [AC:AE000460:U00096] [PN:protoporphyrin oxidase] [GN:hemG] [FN:enzyme; Biosynthesis of cofactors, carriers:] [OR:Escherichia coli] [DB:genpept-bct2] [DE:Escherichia coli K-12 MG1655 section 350 of 400 of the completegenome.] [NT:o181] [LE:7348] [RE:7893] [DI:direct]

| ORF_Name | NT_ID | AA_ID | $\frac{NT}{LN}$ | $\frac{AA}{LN}$ | Score | P-value |
|---|---|---|---|---|---|---|
| 29807015_c3_592 | 863 | 8034 | 216 | 71 | 102 | 4.4e-07 |

Description gp:[GI:g148194] [LN:ECOUW85] [AC:M87049] [GN:o299] [FN:unknown] [OR:Escherichia coli] [DB:genpept-bct1] [DE:E. coli genomic sequence of the region from 84.5 to 86.5 minutes.] [NT:possibly rffA or rffC] [LE:28266] [RE:29165] [DI:direct]

| ORF_Name | NT_ID | AA_ID | NT/LN | AA/LN | Score | P-value |
|---|---|---|---|---|---|---|
| 29816675_c2_547 | 864 | 8035 | 1509 | 502 | 2530 | 6.6e-263 |

Description sp:[LN:D65189] [AC:D65189] [PN:yigC protein] [GN:yigC] [CL:conserved hypothetical protein sll0936] [OR:Escherichia coli] [DB:pir2] >gp:[GI:g1790277] [LN:AE000459] [AC:AE000459:U00096] [PN:putative oxidoreductase] [GN:yigC] [FN:putative enzyme; Not classified] [OR:Escherichia coli] [DB:genpept-bct2] [DE:Escherichia coli K-12 MG1655 section 349 of 400 of the completegenome.] [NT:o497; ??? pct identical to conceptual] [LE:8728] [RE:10221] [DI:direct]

| ORF_Name | NT_ID | AA_ID | NT/LN | AA/LN | Score | P-value |
|---|---|---|---|---|---|---|
| 29963432_c3_629 | 865 | 8036 | 1251 | 416 | 1749 | 3.8e-180 |

Description sp:[LN:YIGN_ECOLI] [AC:P27850] [GN:YIGN] [OR:Escherichia coli] [DE:HYPOTHETICAL 54.7 KD PROTEIN IN UDP-UBIE INTERGENIC REGION PRECURSOR] [SP:P27850] [DB:swissprot] >sp:[LN:A65188] [AC:A65188:S30721] [PN:hypothetical 54.7 kD protein in udp 3' region precursor (o475):hypothetical protein o475] [GN:yigN] [OR:Escherichia coli] [DB:pir2] >gp:[GI:g1790266] [LN:AE000459] [AC:AE000459:U00096] [PN:putative alpha helix chain] [GN:yigN] [FN:phenotype; Not classified] [OR:Escherichia coli] [DB:genpept-bct2] [DE:Escherichia coli K-12 MG1655 section 349 of 400 of the completegenome.] [NT:o475; 99 pct identical amino acid sequence and] [LE:1070] [RE:2497] [DI:direct]

| ORF_Name | NT_ID | AA_ID | NT/LN | AA/LN | Score | P-value |
|---|---|---|---|---|---|---|
| 31411402_c1_397 | 866 | 8037 | 1374 | 457 | 1948 | 3.1e-201 |

Description gp:[GI:g836658] [LN:ECOUW85] [AC:M87049] [PN:4-alpha-l-fucosyltransferase] [GN:rffT] [FN:biosynthesis of enterobacterial common antigen] [OR:Escherichia coli] [DB:genpept-bct1] [EC:2.4.1.-] [DE:E. coli genomic sequence of the region from 84.5 to 86.5 minutes.] [LE:30641] [RE:33067] [DI:direct]

| ORF_Name | NT_ID | AA_ID | NT/LN | AA/LN | Score | P-value |
|---|---|---|---|---|---|---|
| 31662801_c2_451 | 867 | 8038 | 390 | 129 | 554 | 1.6e-53 |

Description sp:[LN:G65179] [AC:G65179:S30662] [PN:hypothetical 13.1 kD protein in pssR-ilvL intergenic region] [GN:yifE] [OR:Escherichia coli] [DB:pir2] >gp:[GI:g2367277] [LN:AE000453] [AC:AE000453:U00096] [PN:orf, hypothetical protein] [GN:yifE] [FN:orf; Unknown] [OR:Escherichia coli] [DB:genpept-bct2] [DE:Escherichia coli K-12 MG1655 section 343 of 400 of the completegenome.] [NT:o112; sequence change shortens and] [LE:4446] [RE:4784] [DI:direct]

| ORF Name | NT ID | AA ID | NT LN | AA LN | Score | P-value |
|---|---|---|---|---|---|---|
| 31720802_c1_450 | 868 | 8039 | 261 | 86 | | |

Description

NO-HIT

| ORF Name | NT ID | AA ID | NT LN | AA LN | Score | P-value |
|---|---|---|---|---|---|---|
| 32244828_f3_363 | 869 | 8040 | 294 | 97 | 69 | 0.040 |

Description sp:[LN:F71059] [AC:F71059] [PN:hypothetical protein PH1172] [GN:PH1172]
[OR:Pyrococcus horikoshii] [DB:pir2] >gp:[GI:d1031215:g3257589] [LN:AP000005]
[AC:AP000005:AB009504:AB009505:AB009506:AB009507:AB009508:AB009509] [PN:101aa
long hypothetical protein] [GN:PH1172] [OR:Pyrococcus horikoshii] [SR:Pyrococcus
horikoshii (strain:OT3) DNA] [DB:genpept-bct1] [DE:Pyrococcus horikoshii OT3
genomic DNA, 994001-1166000 nt. position(5/7).] [LE:67480] [RE:67785]
[DI:complement]

| ORF Name | NT ID | AA ID | NT LN | AA LN | Score | P-value |
|---|---|---|---|---|---|---|
| 32463543_c2_506 | 870 | 8041 | 375 | 124 | 270 | 2.0e-23 |

Description sp:[LN:YZCX_ECOLI] [AC:P11291] [OR:Escherichia coli] [DE:VERY HYPOTHETICAL 17.3
KD PROTEIN IN CYAA REGION (CYAX) (O161)] [SP:P11291] [DB:swissprot]
>sp:[LN:S30698] [AC:S30698:A30264:A65185] [PN:cyaX protein:hypothetical 17.3K
protein (cyaA region)] [GN:cyaX] [CL:Escherichia coli cyaX protein]
[OR:Escherichia coli] [DB:pir2] [MP:85 min] >gp:[GI:g148207] [LN:ECOUW85]
[AC:M87049] [GN:o161] [FN:unknown] [OR:Escherichia coli] [DB:genpept-bct1] [DE:E.
coli genomic sequence of the region from 84.5 to 86.5 minutes.] [NT:called cyaX
in X01653] [LE:46962] [RE:47447] [DI:direct] >gp:[GI:g1790240] [LN:AE000456]
[AC:AE000456:U00096] [PN:orf, hypothetical protein] [GN:b3808] [FN:orf; Unknown]
[OR:Escherichia coli] [DB:genpept-bct2] [DE:Escherichia coli K-12 MG1655 section
346 of 400 of the completegenome.] [NT:o161; 100 pct identical to YZCX_ECOLI SW:
P11291] [LE:10992] [RE:11477] [DI:direct]

| ORF Name | NT ID | AA ID | NT LN | AA LN | Score | P-value |
|---|---|---|---|---|---|---|
| 32517036_f2_136 | 871 | 8042 | 642 | 213 | 510 | 7.5e-49 |

Description sp:[LN:S19737] [AC:S19737] [PN:hypothetical protein (fadB 5' region)]
[CL:Escherichia coli hypothetical protein (fadB 5' region)] [OR:Escherichia coli]
[DB:pir2] >gp:[GI:e1424609:g4584721] [LN:ECFADAB] [AC:X52837] [OR:Escherichia
coli] [DB:genpept-bct1] [DE:Escherichia coli fadB and fadA genes and DNA for
ORF315 (EC5.1.2.3,EC 5.3.3.8,EC 4.2.1.17,EC 1.1.1.35,EC 2.3.1.9).] [NT:ORF315 (AA
1 - 315)] [LE:277] [RE:1224] [DI:direct]

| ORF Name | NT ID | AA ID | NT/LN | AA/LN | Score | P-value |
|---|---|---|---|---|---|---|
| 32661083_f1_35 | 872 | 8043 | 183 | 60 | 248 | 4.4e-21 |

Description sp:[LN:G65187] [AC:G65187] [PN:hypothetical protein b3830] [OR:Escherichia coli] [DB:pir2] >gp:[GI:g2367305] [LN:AE000458] [AC:AE000458:U00096] [PN:putative enzyme] [GN:ysgA] [FN:putative enzyme; Not classified] [OR:Escherichia coli] [DB:genpept-bct2] [DE:Escherichia coli K-12 MG1655 section 348 of 400 of the completegenome.] [NT:f332; revealed by sequence change relative] [LE:10329] [RE:11327] [DI:complement]

| ORF Name | NT ID | AA ID | NT/LN | AA/LN | Score | P-value |
|---|---|---|---|---|---|---|
| 3317205_c1_437 | 873 | 8044 | 954 | 317 | 1218 | 7.1e-124 |

Description sp:[LN:UBIE_ECOLI] [AC:P27851] [GN:UBIE] [OR:Escherichia coli] [EC:2.1.1.-] [DE:(EC 2.1.1.-)] [SP:P27851] [DB:swissprot] >sp:[LN:B65188] [AC:B65188:S30722] [PN:hypothetical 28.1 kD protein in udp-rfaH intergenic region:hypothetical protein o251] [GN:yigO] [CL:spore germination protein C2:bioC homology] [OR:Escherichia coli] [DB:pirl] >gp:[GI:g2367307] [LN:AE000459] [AC:AE000459:U00096] [PN:2-octaprenyl-6-methoxy-1,4-benzoquinone -->] [GN:ubiE] [FN:enzyme; Biosynthesis of cofactors, carriers:] [OR:Escherichia coli] [DB:genpept-bct2] [DE:Escherichia coli K-12 MG1655 section 349 of 400 of the completegenome.] [NT:o251; 100 pct identical to YIGO_ECOLI SW: P27851] [LE:2592] [RE:3347] [DI:direct]

| ORF Name | NT ID | AA ID | NT/LN | AA/LN | Score | P-value |
|---|---|---|---|---|---|---|
| 33885176_f2_252 | 874 | 8045 | 213 | 70 | | |

Description

NO-HIT

| ORF Name | NT ID | AA ID | NT/LN | AA/LN | Score | P-value |
|---|---|---|---|---|---|---|
| 34194812_c1_409 | 875 | 8046 | 237 | 78 | 265 | 6.9e-23 |

Description sp:[LN:YIFL_ECOLI] [AC:P39166] [GN:YIFL] [OR:Escherichia coli] [DE:HYPOTHETICAL 7.2 KD PROTEIN IN CYAY-DAPF INTERGENIC REGION] [SP:P39166] [DB:swissprot]

| ORF Name | NT ID | AA ID | NT/LN | AA/LN | Score | P-value |
|---|---|---|---|---|---|---|
| 34504832_c1_444 | 876 | 8047 | 1719 | 572 | | |

Description

NO-HIT

| ORF Name | NT ID | AA ID | NT LN | AA LN | Score | P-value |
|---|---|---|---|---|---|---|
| 34572207_f1_96 | 877 | 8048 | 924 | 307 | 1321 | 8.6e-135 |

Description gp:[GI:g146252] [LN:ECOGPPA] [AC:M83316] [PN:pppGpp phosphohydrolase] [GN:gppA]
[FN:conversion of pppGpp to ppGpp] [OR:Escherichia coli] [SR:Escherichia coli
(strain K-12) DNA] [DB:genpept-bct2] [DE:E.coli RNA helicase-like gene, 3' end;
pppGpp phosphohydrolasegene, complete cds.] [NT:putative] [LE:420] [RE:1748]
[DI:direct]

| ORF Name | NT ID | AA ID | NT LN | AA LN | Score | P-value |
|---|---|---|---|---|---|---|
| 35286458_c1_438 | 878 | 8049 | 1689 | 562 | 2607 | 4.6e-271 |

Description sp:[LN:AARF_ECOLI] [AC:P27854:P27855:P76764:P27853] [GN:AARF] [OR:Escherichia
coli] [DE:UBIQUINONE BIOSYNTHESIS PROTEIN AARF] [SP:P27854:P27855:P76764:P27853]
[DB:swissprot] >sp:[LN:D65188] [AC:D65188:S30724:S30725:S30726] [PN:hypothetical
63.2 kD protein in udp-rfaH intergenic region] [CL:Synechocystis ABC transporter
slr1919] [OR:Escherichia coli] [DB:pir2] >gp:[GI:g2367309] [LN:AE000459]
[AC:AE000459:U00096] [PN:orf, hypothetical protein] [GN:yigR] [FN:Unknown]
[OR:Escherichia coli] [DB:genpept-bct2] [DE:Escherichia coli K-12 MG1655 section
349 of 400 of the completegenome.] [NT:o546; sequence change joins ORFs yigQ,
yigR, and] [LE:3963] [RE:5603] [DI:direct]

| ORF Name | NT ID | AA ID | NT LN | AA LN | Score | P-value |
|---|---|---|---|---|---|---|
| 35288902_c3_572 | 879 | 8050 | 1566 | 521 | 2528 | 1.1e-262 |

Description sp:[LN:THD1_ECOLI] [AC:P04968] [GN:ILVA] [OR:Escherichia coli] [EC:4.2.1.16]
[DE:DEAMINASE)] [SP:P04968] [DB:swissprot] >sp:[LN:DWECTS]
[AC:B27310:C26287:E26570:S48895:S30670:I41304:G65180] [PN:threonine dehydratase,,
biosynthetic:L-serine dehydratase:serine deaminase:threonine deaminase] [GN:ilvA]
[CL:threonine dehydratase] [OR:Escherichia coli] [EC:4.2.1.16] [DB:pir1] [MP:85
min] >gp:[GI:g288533] [LN:ECILVGMED] [AC:X04890] [GN:ilvA] [OR:Escherichia coli]
[DB:genpept-bct1] [DE:E.coli ilvGMEDA operon.] [NT:threonine deaminase]
[SP:P04968] [LE:5504] [RE:7048] [DI:direct] >gp:[GI:g1790207] [LN:AE000453]
[AC:AE000453:U00096] [PN:threonine deaminase (dehydratase)] [GN:ilvA] [FN:enzyme;
Amino acid biosynthesis: Isoleucine,] [OR:Escherichia coli] [DB:genpept-bct2]
[EC:4.2.1.16] [DE:Escherichia coli K-12 MG1655 section 343 of 400 of the
completegenome.] [NT:o514; 99 pct identical amino acid sequence and] [LE:11689]
[RE:13233] [DI:direct] >gp:[GI:g146462] [LN:ECOILVGE]
[AC:M10313:J01634:J01635:M17624] [PN:threonine deaminase] [GN:ilvA]
[OR:Escherichia coli] [SR:Escherichia coli (strain K-12) DNA] [DB:genpept-bct2]
[EC:4.2.1.16] [DE:E.coli ilv gene cluster encoding ilvD and ilvA
peptides,acetohydroxy acid synthase II, and branched-chain amino
acidaminotransferase, complete cds.] [LE:5134] [RE:6678] [DI:direct]

| ORF Name | NT ID | AA ID | NT LN | AA LN | Score | P-value |
|---|---|---|---|---|---|---|
| 35354792_c3_565 | 880 | 8051 | 183 | 60 | | |

Description

NO-HIT

| ORF Name | NT ID | AA ID | NT LN | AA LN | Score | P-value |
|---|---|---|---|---|---|---|
| 35941302_f2_247 | 881 | 8052 | 315 | 104 | 151 | 8.3e-11 |

Description gp:[GI:g6015894] [LN:SSU18930] [AC:Y18930] [PN:hypothetical protein]
[GN:ORF-c21_020] [OR:Sulfolobus solfataricus] [DB:genpept-bct1] [DE:Sulfolobus
solfataricus 281 kb genomic DNA fragment, strain P2.] [LE:216796] [RE:217362]
[DI:complement]

| ORF Name | NT ID | AA ID | NT LN | AA LN | Score | P-value |
|---|---|---|---|---|---|---|
| 36035766_c2_483 | 882 | 8053 | 1110 | 369 | 1641 | 1.1e-168 |

Description sp:[LN:RFFG_ECOLI] [AC:P27830:P76754] [GN:RFFG] [OR:Escherichia coli]
[EC:4.2.1.46] [DE:DTDP-GLUCOSE 4,6-DEHYDRATASE,] [SP:P27830:P76754]
[DB:swissprot] >sp:[LN:G65182] [AC:G65182:S30682] [PN:dTDPglucose
4,6-dehydratase,] [GN:rffG] [CL:Escherichia coli UDPglucose
4-epimerase:UDPglucose 4-epimerase homology] [OR:Escherichia coli] [EC:4.2.1.46]
[DB:pir2] >gp:[GI:g1790223] [LN:AE000455] [AC:AE000455:U00096] [PN:dTDP-glucose
4,6-dehydratase] [GN:rffG] [FN:enzyme; Central intermediary metabolism:]
[OR:Escherichia coli] [DB:genpept-bct2] [EC:5.1.3.-] [DE:Escherichia coli K-12
MG1655 section 345 of 400 of the completegenome.] [NT:100 pct identical to
RFFE_ECOLI SW: P27830] [LE:2439] [RE:3506] [DI:direct]

| ORF Name | NT ID | AA ID | NT LN | AA LN | Score | P-value |
|---|---|---|---|---|---|---|
| 36065681_c2_490 | 883 | 8054 | 555 | 184 | 557 | 4.2e-56 |

Description sp:[LN:YIFK_SALTY] [AC:P37456] [GN:YIFK] [OR:Salmonella typhimurium] [DE:PROBABLE
TRANSPORT PROTEIN YIFK] [SP:P37456] [DB:swissprot] >sp:[LN:S27728] [AC:S27728]
[PN:probable transport protein] [CL:arginine permease] [OR:Salmonella
typhimurium] [DB:pir2] >gp:[GI:g153898] [LN:STYCARABA] [AC:M95047] [PN:transport
protein] [OR:Salmonella typhimurium] [SR:Salmonella typhimurium (strain LT2) DNA]
[DB:genpept-bct1] [DE:Salmonella typhimurium transport protein, complete cds,
andtransfer RNA-Arg.] [NT:putative] [LE:2225] [RE:3610] [DI:direct]

| ORF Name | NT ID | AA ID | $\frac{NT}{LN}$ | $\frac{AA}{LN}$ | Score | P-value |
|---|---|---|---|---|---|---|
| 36214012_c2_536 | 884 | 8055 | 2283 | 760 | 3721 | 0.0 |

Description sp:[LN:A42863] [AC:F65187:A42863:S30719:I79560]
[PN:5-methyltetrahydropteroyltriglutamate--homocysteine
S-methyltransferase,:cobalamin-independent methionine
synthase:tetrahydropteroylglutamate methyltransferase] [GN:metE]
[CL:cobalamin-independent methionine synthase] [OR:Escherichia coli]
[EC:2.1.1.14] [DB:pir1] >gp:[GI:g2367304] [LN:AE000458] [AC:AE000458:U00096]
[PN:tetrahydropteroyltriglutamate methyltransferase] [GN:metE] [FN:enzyme; Amino
acid biosynthesis: Methionine] [OR:Escherichia coli] [DB:genpept-bct2]
[EC:2.1.1.14] [DE:Escherichia coli K-12 MG1655 section 348 of 400 of the
completegenome.] [NT:o753; 99 pct identical to METE_ECOLI SW: P25665; CG]
[LE:8251] [RE:10512] [DI:direct]

| ORF Name | NT ID | AA ID | $\frac{NT}{LN}$ | $\frac{AA}{LN}$ | Score | P-value |
|---|---|---|---|---|---|---|
| 36344430_c2_484 | 885 | 8056 | 900 | 299 | 1386 | 1.1e-141 |

Description sp:[LN:RFFH_ECOLI] [AC:P27831:P76755] [GN:RFFH] [OR:Escherichia coli]
[EC:2.7.7.24] [DE:SYNTHASE) (DTDP-GLUCOSE PYROPHOSPHORYLASE)] [SP:P27831:P76755]
[DB:swissprot] >sp:[LN:H65182] [AC:H65182:S30683] [PN:glucose-1-phosphate
thymidylyltransferase,:protein o292] [GN:rffH] [CL:glucose-1-phosphate
thymidylyltransferase] [OR:Escherichia coli] [EC:2.7.7.24] [DB:pir2]
>gp:[GI:g1790224] [LN:AE000455] [AC:AE000455:U00096] [PN:glucose-1-phosphate
thymidylyltransferase] [GN:rffH] [FN:enzyme; Central intermediary metabolism:]
[OR:Escherichia coli] [DB:genpept-bct2] [DE:Escherichia coli K-12 MG1655 section
345 of 400 of the completegenome.] [NT:o293; formerly designated yifG] [LE:3525]
[RE:4406] [DI:direct]

| ORF Name | NT ID | AA ID | $\frac{NT}{LN}$ | $\frac{AA}{LN}$ | Score | P-value |
|---|---|---|---|---|---|---|
| 36367175_c1_370 | 886 | 8057 | 1911 | 636 | 3070 | 0.0 |

Description sp:[LN:DWECDA] [AC:A27310:D26570:S48894:S30669:F65180] [PN:dihydroxy-acid
dehydratase,] [GN:ilvD] [CL:dihydroxy-acid dehydratase] [OR:Escherichia coli]
[EC:4.2.1.9] [DB:pir1] [MP:85 min] >gp:[GI:g288532] [LN:ECILVGMED] [AC:X04890]
[GN:ilvD] [OR:Escherichia coli] [DB:genpept-bct1] [DE:E.coli ilvGMEDA operon.]
[NT:dihydroxy acid] [SP:P05791] [LE:3651] [RE:5501] [DI:direct] >gp:[GI:g146461]
[LN:ECOILVGE] [AC:M10313:J01634:J01635:M17624] [PN:dihydroxyacid dehydrase]
[GN:ilvD] [OR:Escherichia coli] [SR:Escherichia coli (strain K-12) DNA]
[DB:genpept-bct2] [EC:4.2.1.9] [DE:E.coli ilv gene cluster encoding ilvD and ilvA
peptides,acetohydroxy acid synthase II, and branched-chain amino
acidaminotransferase, complete cds.] [LE:3281] [RE:5131] [DI:direct]

| ORF Name | NT ID | AA ID | NT/LN | AA/LN | Score | P-value |
|---|---|---|---|---|---|---|
| 36432035_f1_79 | 887 | 8058 | 390 | 129 | 160 | 2.2e-11 |

Description sp:[LN:PRP3_MOUSE] [AC:P05143] [GN:PRP] [OR:Mus musculus] [SR:,Mouse]
[DE:PROLINE-RICH PROTEIN MP-3 (FRAGMENT)] [SP:P05143] [DB:swissprot]
>gp:[GI:g200549] [LN:MUSPRPMPC] [AC:M12100] [OR:Mus musculus] [SR:Mouse (strain
CD-1) DNA, library of O.Smithies, clone pUMP-3 HB] [DB:genpept-rod] [DE:Mouse PRP
gene encoding proline-rich protein MP-3, exon 2.] [NT:proline-rich protein MP-3]
[LE:<1] [RE:893] [DI:direct]

| ORF Name | NT ID | AA ID | NT/LN | AA/LN | Score | P-value |
|---|---|---|---|---|---|---|
| 36588156_f2_221 | 888 | 8059 | 651 | 216 | 827 | 1.9e-82 |

Description sp:[LN:GPPA_ECOLI] [AC:P25552] [GN:GPPA] [OR:Escherichia coli] [EC:3.6.1.40]
[DE:5'-PHOSPHOHYDROLASE)] [SP:P25552] [DB:swissprot] >sp:[LN:A48285]
[AC:A48285:S30674:F65181]
[PN:exopolyphosphatase,:guanosine-5'-triphosphate,3'-diphosphate pyrophosphatase
(guanosine pentaphosphatase)] [GN:gppA] [CL:exopolyphosphatase] [OR:Escherichia
coli] [EC:3.6.1.11] [DB:pir2] >gp:[GI:g148183] [LN:ECOUW85] [AC:M87049]
[PN:guanosine pentaphosphatase] [GN:gppA (CGSC No. 664)] [OR:Escherichia coli]
[DB:genpept-bct1] [DE:E. coli genomic sequence of the region from 84.5 to 86.5
minutes.] [LE:15873] [RE:17357] [DI:complement] >gp:[GI:g1790213] [LN:AE000454]
[AC:AE000454:U00096] [PN:guanosine pentaphosphatase; exopolyphosphatase]
[GN:gppA] [FN:enzyme; Global regulatory functions] [OR:Escherichia coli]
[DB:genpept-bct2] [DE:Escherichia coli K-12 MG1655 section 344 of 400 of the
completegenome.] [NT:f494; 100 pct identical to GPPA_ECOLI SW: P25552] [LE:4830]
[RE:6314] [DI:complement]

| ORF Name | NT ID | AA ID | NT/LN | AA/LN | Score | P-value |
|---|---|---|---|---|---|---|
| 4040877_f3_344 | 889 | 8060 | 726 | 241 | 564 | 1.4e-54 |

Description sp:[LN:YQGA_ECOLI] [AC:Q46831] [GN:YQGA] [OR:Escherichia coli] [DE:HYPOTHETICAL
24.6 KD PROTEIN IN SPEC-GLCB INTERGENIC REGION] [SP:Q46831] [DB:swissprot]
>sp:[LN:E65082] [AC:E65082] [PN:hypothetical protein b2966] [CL:conserved
hypothetical protein b2966] [OR:Escherichia coli] [DB:pir2] >gp:[GI:g882496]
[LN:ECU28377] [AC:U28377] [OR:Escherichia coli] [DB:genpept-bct1] [DE:Escherichia
coli K-12 genome; approximately 65 to 68 minutes.] [NT:ORF_o235] [LE:63946]
[RE:64653] [DI:direct] >gp:[GI:g1789338] [LN:AE000379] [AC:AE000379:U00096]
[PN:putative transport protein] [GN:yqgA] [FN:putative transport; Not classified]
[OR:Escherichia coli] [DB:genpept-bct2] [DE:Escherichia coli K-12 MG1655 section
269 of 400 of the completegenome.] [NT:o235; This 235 aa ORF is 23 pct identical
(10 gaps)] [LE:5183] [RE:5890] [DI:direct]

| ORF Name | NT ID | AA ID | NT LN | AA LN | Score | P-value |
|---|---|---|---|---|---|---|
| 4066882_f3_351 | 890 | 8061 | 984 | 327 | 1472 | 8.6e-151 |

Description sp:[LN:ILVY_ECOLI] [AC:P05827] [GN:ILVY] [OR:Escherichia coli]
[DE:TRANSCRIPTIONAL ACTIVATOR PROTEIN ILVY] [SP:P05827] [DB:swissprot]
>sp:[LN:RGECIY] [AC:B26287:H65180:S30671] [PN:regulatory protein ilvY:ilvC
activator ilvY] [GN:ilvY] [CL:regulatory protein ilvY] [OR:Escherichia coli]
[DB:pir1] [MP:85 min] >gp:[GI:g146476] [LN:ECOILVYC] [AC:M11689:M14492]
[PN:positive regulatory protein] [GN:ilvY] [FN:positive regulation of ilvC gene]
[OR:Escherichia coli] [SR:Escherichia coli (strain K-12) (library: Clarke-Carbon)
DNA] [DB:genpept-bct1] [DE:E.coli (clone pRW[1Y,1C]) threonine deaminase (ilvA)
gene, 3' end;acetohydroxy acid isomeroreductase (ilvC) and its positive
controlfactor (ilvY) genes, complete cds.] [LE:107] [RE:1000] [DI:complement]
>gp:[GI:g148180] [LN:ECOUW85] [AC:M87049] [GN:ilvY (CGSC No. 598)] [FN:positive
activator of ilvC] [OR:Escherichia coli] [DB:genpept-bct1] [DE:E. coli genomic
sequence of the region from 84.5 to 86.5 minutes.] [NT:other potential starts]
[LE:10061] [RE:10954] [DI:complement] >gp:[GI:g1790208] [LN:AE000453]
[AC:AE000453:U00096] [PN:positive regulator for ilvC] [GN:ilvY] [FN:regulator;
Amino acid biosynthesis: Isoleucine,] [OR:Escherichia coli] [DB:genpept-bct2]
[DE:Escherichia coli K-12 MG1655 section 343 of 400 of the completegenome.]
[NT:f297; 100 pct identical amino acid sequence and] [LE:13285] [RE:14178]
[DI:complement]

| ORF Name | NT ID | AA ID | NT LN | AA LN | Score | P-value |
|---|---|---|---|---|---|---|
| 4297842_f1_39 | 891 | 8062 | 963 | 320 | 1501 | 7.3e-154 |

Description sp:[LN:METR_ECOLI] [AC:P19797] [GN:METR] [OR:Escherichia coli]
[DE:TRANSCRIPTIONAL ACTIVATOR PROTEIN METR] [SP:P19797] [DB:swissprot]
>sp:[LN:A36066] [AC:A36066:S30718:E65187] [PN:trans-activator of metE and
metH:metR protein] [GN:metR] [OR:Escherichia coli] [DB:pir2] [MP:86 min.]
>gp:[GI:g146849] [LN:ECOMETR] [AC:M37630] [GN:metR] [OR:Escherichia coli]
[SR:Escherichia coli (clone pSRE562, strain K-12) DNA] [DB:genpept-bct1]
[DE:E.coli (clone pRSE562) metR gene, complete cds.] [LE:40] [RE:993] [DI:direct]
>gp:[GI:g1790262] [LN:AE000458] [AC:AE000458:U00096] [PN:regulator for metE and
metH] [GN:metR] [FN:regulator; Amino acid biosynthesis: Methionine]
[OR:Escherichia coli] [DB:genpept-bct2] [DE:Escherichia coli K-12 MG1655 section
348 of 400 of the completegenome.] [NT:f317; 99 pct identical amino acid sequence
and] [LE:7061] [RE:8014] [DI:complement]

| ORF Name | NT ID | AA ID | NT/LN | AA/LN | Score | P-value |
|---|---|---|---|---|---|---|
| 4491032_c3_636 | 892 | 8063 | 789 | 262 | 1119 | 2.2e-113 |

Description sp:[LN:TATC_ECOLI] [AC:P27857:P27858:P76765:P76766] [GN:TATC:MTTB]
[OR:Escherichia coli] [DE:SEC-INDEPENDENT PROTEIN TRANSLOCASE PROTEIN TATC]
[SP:P27857:P27858:P76765:P76766] [DB:swissprot] >sp:[LN:H65188] [AC:H65188]
[PN:yigU protein] [GN:yigU] [CL:conserved hypothetical protein HI0188]
[OR:Escherichia coli] [DB:pir2] >gp:[GI:e1292182:g3123498] [LN:ECO5830]
[AC:AJ005830] [PN:TatC protein] [GN:tatC] [FN:Sec-independent protein
translocase] [OR:Escherichia coli] [DB:genpept-bct1] [DE:Escherichia coli tatABCD
operon.] [NT:alternative gene names: yigU, mttB] [SP:P27857] [LE:847] [RE:1623]
[DI:direct] >gp:[GI:g2367313] [LN:AE000459] [AC:AE000459:U00096] [PN:orf,
hypothetical protein] [GN:yigU] [FN:orf; Unknown] [OR:Escherichia coli]
[DB:genpept-bct2] [DE:Escherichia coli K-12 MG1655 section 349 of 400 of the
completegenome.] [NT:o258; sequence change joins two ORFs relative] [LE:6475]
[RE:7251] [DI:direct] >gp:[GI:g3193219] [LN:AF067848] [AC:AF067848] [PN:MttB]
[GN:mttB] [FN:involved in folded protein translocation and] [OR:Escherichia coli]
[DB:genpept-bct2] [DE:Escherichia coli MttA1 (mttA1), MttA2 (mttA2), MttB (mttB),
andMttC (mttC) genes, complete cds.] [NT:membrane protein; TatC; YigU] [LE:1475]
[RE:2251] [DI:direct]

| ORF Name | NT ID | AA ID | NT/LN | AA/LN | Score | P-value |
|---|---|---|---|---|---|---|
| 4728840_f2_193 | 893 | 8064 | 966 | 321 | 1343 | 4.0e-137 |

Description gp:[GI:g2367293] [LN:AE000456] [AC:AE000456:U00096] [PN:porphobilinogen deaminase
= hydroxymethylbilane] [GN:hemC] [FN:enzyme; Biosynthesis of cofactors,
carriers;] [OR:Escherichia coli] [DB:genpept-bct2] [EC:4.3.1.8] [DE:Escherichia
coli K-12 MG1655 section 346 of 400 of the completegenome.] [NT:f320; 98 pct
identical to 313 amino acids] [LE:6967] [RE:7929] [DI:complement]

| ORF Name | NT ID | AA ID | NT/LN | AA/LN | Score | P-value |
|---|---|---|---|---|---|---|
| 4800443_f1_13 | 894 | 8065 | 1173 | 390 | 1842 | 5.3e-190 |

Description gp:[GI:g145901] [LN:ECOFADAB] [AC:M59368:M36149] [PN:fatty acid oxidizing
complex] [GN:fadA] [OR:Escherichia coli] [SR:Escherichia coli (strain K-12) DNA]
[DB:genpept-bct1] [DE:E.coli fatty acid oxidizing complex (fadA, fadB) genes,
completecds.] [LE:2525] [RE:3688] [DI:direct] >gp:[GI:g145904] [LN:ECOFADBA]
[AC:M74164:J05332:J05498:M64935] [PN:3-ketoacyl-coenzyme A thiolase] [GN:fadA]
[OR:Escherichia coli] [SR:Escherichia coli (clone pK52, strain K-12) DNA]
[DB:genpept-bct1] [EC:2.3.1.16] [DE:E. coli fadB and fadA genes (fadBA operon),
complete cds.] [LE:2581] [RE:3744] [DI:direct]

| ORF Name | NT ID | AA ID | NT/LN | AA/LN | Score | P-value |
|---|---|---|---|---|---|---|
| 4807687_f3_289 | 895 | 8066 | 645 | 214 | 965 | 4.6e-97 |

Description sp:[LN:RHTB_ECOLI] [AC:P27847] [GN:RHTB] [OR:Escherichia coli]
[DE:HOMOSERINE/HOMOSERINE LACTONE EFFLUX PROTEIN] [SP:P27847] [DB:swissprot]

| ORF Name | NT ID | AA ID | NT/LN | AA/LN | Score | P-value |
|---|---|---|---|---|---|---|
| 4876462_f3_296 | 896 | 8067 | 507 | 168 | 710 | 4.8e-70 |

Description sp:[LN:YIGI_ECOLI] [AC:P27845:P76761] [GN:YIGI] [OR:Escherichia coli]
[DE:HYPOTHETICAL 17.1 KD PROTEIN IN RARD-PLDA INTERGENIC REGION]
[SP:P27845:P76761] [DB:swissprot]

| ORF Name | NT ID | AA ID | NT/LN | AA/LN | Score | P-value |
|---|---|---|---|---|---|---|
| 4902332_c3_611 | 897 | 8068 | 729 | 242 | 949 | 2.3e-95 |

Description sp:[LN:YIGB_ECOLI] [AC:P23306:P76757] [GN:YIGB] [OR:Escherichia coli]
[DE:HYPOTHETICAL 27.1 KD PROTEIN IN XERC-UVRD INTERGENIC REGION (ORF 238)]
[SP:P23306:P76757] [DB:swissprot] >sp:[LN:D37841] [AC:D37841:E65185:S30702]
[PN:hypothetical 27.1K protein (xerC-uvrD intergenic region):hypothetical protein
o238] [GN:yigB] [OR:Escherichia coli] [DB:pir2] >gp:[GI:g2367295] [LN:AE000457]
[AC:AE000457:U00096] [PN:putative phosphatase] [GN:yigB] [FN:putative enzyme; Not
classified] [OR:Escherichia coli] [DB:genpept-bct2] [DE:Escherichia coli K-12
MG1655 section 347 of 400 of the completegenome.] [NT:o238; 99 pct identical
amino acid sequence and] [LE:2815] [RE:3531] [DI:direct]

| ORF Name | NT ID | AA ID | NT/LN | AA/LN | Score | P-value |
|---|---|---|---|---|---|---|
| 4964080_c1_388 | 898 | 8069 | 1146 | 381 | 1679 | 1.0e-172 |

Description sp:[LN:E65182] [AC:E65182:S30680:A49350] [PN:bacteriophage N4 adsorption
protein:hypothetical protein o389] [GN:rffE:nfrC] [OR:Escherichia coli] [DB:pir2]
>gp:[GI:g2367283] [LN:AE000455] [AC:AE000455:U00096] [PN:UDP-N-acetyl glucosamine
-2-epimerase; synthesis] [GN:wecB] [FN:enzyme; Central intermediary metabolism:]
[OR:Escherichia coli] [DB:genpept-bct2] [DE:Escherichia coli K-12 MG1655 section
345 of 400 of the completegenome.] [NT:o389; formerly designated rffE] [LE:11]
[RE:1180] [DI:direct]

| ORF Name | NT ID | AA ID | NT/LN | AA/LN | Score | P-value |
|---|---|---|---|---|---|---|
| 5163891_f3_254 | 899 | 8070 | 213 | 70 | | |

Description

NO-HIT

| ORF Name | NT ID | AA ID | NT/LN | AA/LN | Score | P-value |
|---|---|---|---|---|---|---|
| 6423502_c3_606 | 900 | 8071 | 1593 | 530 | 2428 | 4.3e-252 |

Description sp:[LN:OYEC] [AC:G65184:A01163:S24975:S30696] [PN:adenylate cyclase,] [GN:cyaA]
[CL:adenylate cyclase] [OR:Escherichia coli] [EC:4.6.1.1] [DB:pir1] [MP:85 min]
>gp:[GI:g148205] [LN:ECOUW85] [AC:M87049] [PN:adenylate cyclase] [GN:cyaA (CGSC
No. 902)] [OR:Escherichia coli] [DB:genpept-bct1] [DE:E. coli genomic sequence of
the region from 84.5 to 86.5 minutes.] [NT:unusual TTG start] [LE:44265]
[RE:46811] [DI:direct] >gp:[GI:g1790238] [LN:AE000456] [AC:AE000456:U00096]
[PN:adenylate cyclase] [GN:cyaA] [FN:enzyme; Global regulatory functions]
[OR:Escherichia coli] [DB:genpept-bct2] [DE:Escherichia coli K-12 MG1655 section
346 of 400 of the completegenome.] [NT:o848; ttg start; CGSC No. 902] [LE:8295]
[RE:10841] [DI:direct]

| ORF Name | NT ID | AA ID | NT/LN | AA/LN | Score | P-value |
|---|---|---|---|---|---|---|
| 6423541_f2_137 | 901 | 8072 | 282 | 93 | 277 | 3.7e-24 |

Description sp:[LN:S19737] [AC:S19737] [PN:hypothetical protein (fadB 5' region)]
[CL:Escherichia coli hypothetical protein (fadB 5' region)] [OR:Escherichia coli]
[DB:pir2] >gp:[GI:e1424609:g4584721] [LN:ECFADAB] [AC:X52837] [OR:Escherichia
coli] [DB:genpept-bct1] [DE:Escherichia coli fadB and fadA genes and DNA for
ORF315 (EC5.1.2.3,EC 5.3.3.8,EC 4.2.1.17,EC 1.1.1.35,EC 2.3.1.9).] [NT:ORF315 (AA
1 - 315)] [LE:277] [RE:1224] [DI:direct]

| ORF Name | NT ID | AA ID | NT/LN | AA/LN | Score | P-value |
|---|---|---|---|---|---|---|
| 82775_c2_538 | 902 | 8073 | 393 | 130 | 208 | 4.4e-16 |

Description sp:[LN:YIGN_ECOLI] [AC:P27850] [GN:YIGN] [OR:Escherichia coli] [DE:HYPOTHETICAL
54.7 KD PROTEIN IN UDP-UBIE INTERGENIC REGION PRECURSOR] [SP:P27850]
[DB:swissprot] >sp:[LN:A65188] [AC:A65188:S30721] [PN:hypothetical 54.7 kD
protein in udp 3' region precursor (o475):hypothetical protein o475] [GN:yigN]
[OR:Escherichia coli] [DB:pir2] >gp:[GI:g1790266] [LN:AE000459]
[AC:AE000459:U00096] [PN:putative alpha helix chain] [GN:yigN] [FN:phenotype; Not
classified] [OR:Escherichia coli] [DB:genpept-bct2] [DE:Escherichia coli K-12
MG1655 section 349 of 400 of the completegenome.] [NT:o475; 99 pct identical
amino acid sequence and] [LE:1070] [RE:2497] [DI:direct]

| ORF Name | NT ID | AA ID | NT LN | AA LN | Score | P-value |
|---|---|---|---|---|---|---|
| 897526_f1_68 | 903 | 8074 | 1203 | 400 | 1586 | 7.2e-163 |

Description sp:[LN:HEMX_ECOLI] [AC:P09127] [GN:HEMX] [OR:Escherichia coli] [EC:2.1.1.107]
[DE:III METHYLASE) (ORF X)] [SP:P09127] [DB:swissprot] >sp:[LN:S02185]
[AC:S02185:S01693:S30693:D65184] [PN:uroporphyrin-III C-methyltransferase,]
[GN:hemX] [OR:Escherichia coli] [EC:2.1.1.107] [DB:pir2] [MP:85 min]
>gp:[GI:g41668] [LN:ECHEMCD] [AC:X12614] [OR:Escherichia coli] [DB:genpept-bct1]
[DE:E. coli genes hemC and hemD for porphobilinogen deaminase (EC4.3.1.8) and
uroporphyrinogen III cosynthetase (EC 4.2.1.75).] [NT:ORF X (AA 1 - 393)]
[SP:P09127] [LE:1820] [RE:3001] [DI:direct] >gp:[GI:g41678] [LN:ECHENX]
[AC:X13406] [OR:Escherichia coli] [DB:genpept-bct1] [DE:E. coli hemX gene for
putative urogenIII methylase.] [NT:put. urogenIII methylase (AA 1 - 393); hemX
gene] [SP:P09127] [LE:25] [RE:1206] [DI:direct] >gp:[GI:g148202] [LN:ECOUW85]
[AC:M87049] [PN:uroporphyrinogen III methylase] [GN:hemX] [OR:Escherichia coli]
[DB:genpept-bct1] [DE:E. coli genomic sequence of the region from 84.5 to 86.5
minutes.] [LE:40997] [RE:42178] [DI:complement] >gp:[GI:g1790235] [LN:AE000456]
[AC:AE000456:U00096] [PN:uroporphyrinogen III methylase] [GN:hemX] [FN:enzyme;
Biosynthesis of cofactors, carriers:] [OR:Escherichia coli] [DB:genpept-bct2]
[EC:2.1.1.107] [DE:Escherichia coli K-12 MG1655 section 346 of 400 of the
completegenome.] [NT:f393; 100 pct identical to HEMX_ECOLI SW: P09127] [LE:5027]
[RE:6208] [DI:complement]

| ORF Name | NT ID | AA ID | NT LN | AA LN | Score | P-value |
|---|---|---|---|---|---|---|
| 9775166_c2_524 | 904 | 8075 | 1860 | 619 | 2884 | 2.0e-300 |

Description sp:[LN:BVECRQ] [AC:G65186:JS0137:A35776:S30712] [PN:DNA helicase
recQ:DNA-dependent ATPase recQ,] [GN:recQ] [CL:recQ protein:DEAD/H box helicase
homology:recQ helicase homology] [OR:Escherichia coli] [EC:3.6.1.-] [DB:pir1]
[MP:85 min] >gp:[GI:g2367301] [LN:AE000458] [AC:AE000458:U00096]
[PN:ATP-dependent DNA helicase] [GN:recQ] [FN:enzyme; DNA - replication, repair,]
[OR:Escherichia coli] [DB:genpept-bct2] [EC:3.6.1.-] [DE:Escherichia coli K-12
MG1655 section 348 of 400 of the completegenome.] [NT:o610; 99 pct identical to
607 amino acids] [LE:1077] [RE:2909] [DI:direct]

| ORF Name | NT ID | AA ID | NT LN | AA LN | Score | P-value |
|---|---|---|---|---|---|---|
| 9847000_c3_619 | 905 | 8076 | 654 | 217 | 944 | 7.7e-95 |

Description sp:[LN:RHTC_ECOLI] [AC:P27846] [GN:RHTC] [OR:Escherichia coli] [DE:THREONINE
EFFLUX PROTEIN] [SP:P27846] [DB:swissprot]

| ORF_Name | NT_ID | AA_ID | NT LN | AA LN | Score | P-value |
|---|---|---|---|---|---|---|
| 9922215_c2_510 | 906 | 8077 | 723 | 240 | 935 | 6.9e-94 |

Description sp:[LN:YIGA_ECOLI] [AC:P23305] [GN:YIGA] [OR:Escherichia coli] [DE:HYPOTHETICAL 26.7 KD PROTEIN IN DAPF-XERC INTERGENIC REGION (ORF 235)] [SP:P23305] [DB:swissprot] >sp:[LN:B37841] [AC:B37841:S30700:C65185] [PN:hypothetical 26.7K protein (dapF-xerC intergenic region)] [GN:yigA] [OR:Escherichia coli] [DB:pir2] >gp:[GI:g148209] [LN:ECOUW85] [AC:M87049] [GN:o235] [FN:unknown] [OR:Escherichia coli] [DB:genpept-bct1] [DE:E. coli genomic sequence of the region from 84.5 to 86.5 minutes.] [LE:48695] [RE:49402] [DI:direct] >gp:[GI:g148269] [LN:ECOXERC] [AC:M38257] [GN:ORF 235] [OR:Escherichia coli] [SR:Escherichia coli (strain K-12) DNA] [DB:genpept-bct1] [DE:Escherichia coli lambda-integrase (XerC) gene, complete cds,diaminopimelate (dapF), 3' end, and helicase II (uvrD) gene, 5'end.] [LE:48] [RE:755] [DI:direct] >gp:[GI:g1790243] [LN:AE000457] [AC:AE000457:U00096] [PN:orf, hypothetical protein] [GN:yigA] [FN:orf; Unknown] [OR:Escherichia coli] [DB:genpept-bct2] [DE:Escherichia coli K-12 MG1655 section 347 of 400 of the completegenome.] [NT:o235; 100 pct identical to YIGA_ECOLI SW: P23305] [LE:1215] [RE:1922] [DI:direct]

| ORF_Name | NT_ID | AA_ID | NT LN | AA LN | Score | P-value |
|---|---|---|---|---|---|---|
| 9971016_c2_555 | 907 | 8078 | 672 | 223 | 900 | 3.5e-90 |

Description gp:[GI:g42358] [LN:ECPEPQ] [AC:X54687] [OR:Escherichia coli] [DB:genpept-bct1] [DE:E. coli pepQ and ORF401 genes.] [NT:pepQ product, proline dipeptidase] [SP:P27862] [LE:55] [RE:1995] [DI:direct]

| ORF_Name | NT_ID | AA_ID | NT LN | AA LN | Score | P-value |
|---|---|---|---|---|---|---|
| 10053891_f3_939 | 908 | 8079 | 273 | 90 | 107 | 2.2e-05 |

Description gp:[GI:g4884836] [LN:AF131877] [AC:AF131877] [PN:NapG oxidoreductase] [GN:napG] [OR:Streptomyces collinus] [DB:genpept-bct2] [DE:Streptomyces collinus putative naphthomycin AHBA biosynthetic genecluster, complete sequence.] [LE:4666] [RE:5691] [DI:direct]

| ORF_Name | NT_ID | AA_ID | NT LN | AA LN | Score | P-value |
|---|---|---|---|---|---|---|
| 10269530_f2_478 | 909 | 8080 | 357 | 118 | 109 | 2.3e-06 |

Description sp:[LN:G72510] [AC:G72510] [PN:hypothetical protein APE2061] [GN:APE2061] [OR:Aeropyrum pernix] [DB:pir2] >gp:[GI:d1044857:g5105759] [LN:AP000063] [AC:AP000063] [PN:114aa long hypothetical protein] [GN:APE2061] [OR:Aeropyrum pernix] [SR:Aeropyrum pernix (strain:K1) DNA] [DB:genpept-bct1] [DE:Aeropyrum pernix genomic DNA, section 6/7.] [NT:similar to OWL:AP00000656 percent identity:52.747] [LE:58153] [RE:58497] [DI:direct]

| ORF_Name | NT ID | AA ID | NT/LN | AA/LN | Score | P-value |
|---|---|---|---|---|---|---|
| 10401091_f3_785 | 910 | 8081 | 291 | 96 | 100 | 2.1e-05 |

Description sp:[LN:H71057] [AC:H71057] [PN:hypothetical protein PH1158] [GN:PH1158]
[OR:Pyrococcus horikoshii] [DB:pir2] >gp:[GI:d1031201:g3257575] [LN:AP000005]
[AC:AP000005:AB009504:AB009505:AB009506:AB009507:AB009508:AB009509] [PN:165aa
long hypothetical protein] [GN:PH1158] [OR:Pyrococcus horikoshii] [SR:Pyrococcus
horikoshii (strain:OT3) DNA] [DB:genpept-bct1] [DE:Pyrococcus horikoshii OT3
genomic DNA, 994001-1166000 nt. position(5/7).] [LE:56932] [RE:57429] [DI:direct]

| ORF_Name | NT ID | AA ID | NT/LN | AA/LN | Score | P-value |
|---|---|---|---|---|---|---|
| 10425677_f1_154 | 911 | 8082 | 2244 | 747 | | |

Description

NO-HIT

| ORF_Name | NT ID | AA ID | NT/LN | AA/LN | Score | P-value |
|---|---|---|---|---|---|---|
| 10548427_c2_1409 | 912 | 8083 | 972 | 323 | 309 | 1.5e-27 |

Description sp:[LN:YFER_ECOLI] [AC:P77500] [GN:YFER] [OR:Escherichia coli] [DE:HYPOTHETICAL
TRANSCRIPTIONAL REGULATOR IN XAPA-LIG INTERGENIC REGION] [SP:P77500]
[DB:swissprot] >sp:[LN:H65014] [AC:H65014] [PN:hypothetical protein b2409]
[CL:hypothetical protein b2409] [OR:Escherichia coli] [DB:pir2]
>gp:[GI:d1017008:g1799823] [LN:D90870] [AC:D90870:AB001340] [GN:YYBE]
[OR:Escherichia coli] [SR:Escherichia coli (strain:K12) DNA, clone_lib:Kohara
lambda minise] [DB:genpept-bct1] [DE:E.coli genomic DNA, Kohara clone
417(54.4-54.6 min.).] [NT:similar to [SwissProt Accession Number P37499]]
[LE:5256] [RE:6182] [DI:complement] >gp:[GI:g1788748] [LN:AE000328]
[AC:AE000328:U00096] [PN:putative transcriptional regulator LYSR-type] [GN:yfeR]
[FN:putative regulator; Not classified] [OR:Escherichia coli] [DB:genpept-bct2]
[DE:Escherichia coli K-12 MG1655 section 218 of 400 of the completegenome.]
[NT:f308] [LE:7619] [RE:8545] [DI:complement]

| ORF_Name | NT ID | AA ID | NT/LN | AA/LN | Score | P-value |
|---|---|---|---|---|---|---|
| 10550932_f2_496 | 913 | 8084 | 762 | 253 | 345 | 2.3e-31 |

Description sp:[LN:Y912_HAEIN] [AC:P44074] [GN:HI0912] [OR:Haemophilus influenzae]
[DE:HYPOTHETICAL PROTEIN HI0912] [SP:P44074] [DB:swissprot] >sp:[LN:B64016]
[AC:B64016] [PN:hypothetical protein HI0912] [CL:bioC homology] [OR:Haemophilus
influenzae] [DB:pir2] >gp:[GI:g1573933] [LN:U32773] [AC:U32773:L42023] [PN:H.
influenzae predicted coding region HI0912] [GN:HI0912] [OR:Haemophilus influenzae
Rd] [DB:genpept-bct2] [DE:Haemophilus influenzae Rd section 88 of 163 of the
complete genome.] [NT:hypothetical protein; identified by GeneMark;] [LE:81]
[RE:845] [DI:direct]

| ORF_Name | NT ID | AA ID | NT LN | AA LN | Score | P-value |
|---|---|---|---|---|---|---|
| 10555391_f1_3 | 914 | 8085 | 1146 | 381 | 1719 | 5.8e-177 |

Description gp:[GI:e1326163:g3676229] [LN:KOX011521] [AC:AJ011521] [PN:hypothetical protein]
[OR:Klebsiella oxytoca] [DB:genpept-bct1] [DE:Klebsiella oxytoca cymJ gene and
gene encoding Orf366.] [NT:ORF366] [LE:423] [RE:1523] [DI:direct]

| ORF_Name | NT ID | AA ID | NT LN | AA LN | Score | P-value |
|---|---|---|---|---|---|---|
| 10585877_c2_1495 | 915 | 8086 | 771 | 256 | 1239 | 4.2e-126 |

Description sp:[LN:RFB1_KLEPN] [AC:Q48476] [GN:RFBB] [OR:Klebsiella pneumoniae] [DE:O-ANTIGEN
EXPORT SYSTEM ATP-BINDING PROTEIN RFBB] [SP:Q48476] [DB:swissprot]
>sp:[LN:S60883] [AC:S60883] [PN:ATP-binding protein rfbB] [GN:rfbB]
[CL:ATP-binding cassette homology] [OR:Klebsiella pneumoniae] [DB:pir2]
>gp:[GI:g567183] [LN:KPNRFBA] [AC:L31775] [PN:ATP-binding protein] [GN:wzt]
[OR:Klebsiella pneumoniae] [DB:genpept-bct2] [DE:Klebsiella pneumoniae integral
membrane O-antigen translocatorprotein (wzm) and ATP-binding protein (wzt) genes,
complete cds;and WbbM (wbbM) gene, partial cds.] [NT:contains an ATP-binding
consensus sequence, similar] [LE:1103] [RE:1843] [DI:direct]

| ORF_Name | NT ID | AA ID | NT LN | AA LN | Score | P-value |
|---|---|---|---|---|---|---|
| 10589787_f3_697 | 916 | 8087 | 1035 | 344 | 1491 | 8.4e-153 |

Description gp:[GI:g5739472] [LN:AF172324] [AC:AF172324] [PN:WbnF] [GN:wbnF] [FN:putative
nucleotide sugar epimerase] [OR:Escherichia coli] [DB:genpept-bct2]
[DE:Escherichia coli GalF (galF) gene, partial cds; O-antigen repeatunit
transporter Wzx (wzx), WbnA (wbnA), O-antigen polymerase Wzy(wzy), WbnB (wbnB),
WbnC (wbnC), WbnD (wbnD), WbnE (wbnE),UDP-Glc-4-epimerase GalE (galE),
6-phosphogluconate dehydrogenaseGnd (gnd), UDP-Glc-6-dehydrogenase Ugd (ugd), and
WbnF (wbnF)genes, complete cds; and chain length determinant Wzz (wzz)
gene,partial cds.] [LE:12561] [RE:13565] [DI:complement]

| ORF_Name | NT ID | AA ID | NT LN | AA LN | Score | P-value |
|---|---|---|---|---|---|---|
| 10626252_f3_789 | 917 | 8088 | 1881 | 626 | 518 | 3.7e-65 |

Description sp:[LN:ADEC_ARCFU] [AC:O29999] [GN:AF0240] [OR:Archaeoglobus fulgidus]
[EC:3.5.4.2] [DE:PROBABLE ADENINE DEAMINASE, (ADENASE) (ADENINE AMINASE)]
[SP:O29999] [DB:swissprot] >sp:[LN:H69279] [AC:H69279] [PN:adenine deaminase
(adeC) homolog] [CL:adenine deaminase adeC] [OR:Archaeoglobus fulgidus] [DB:pir2]
>gp:[GI:g2650401] [LN:AE001089] [AC:AE001089:AE000782] [PN:adenine deaminase
(adeC)] [GN:AF0240] [OR:Archaeoglobus fulgidus] [DB:genpept-bct2]
[DE:Archaeoglobus fulgidus section 18 of 172 of the complete genome.] [NT:similar
to GB:L77117 PID:1592101 percent identity:] [LE:3234] [RE:4904] [DI:direct]

| ORF Name | NT ID | AA ID | NT LN | AA LN | Score | P-value |
|---|---|---|---|---|---|---|
| 10650831_c2_1279 | 918 | 8089 | 1362 | 453 | 2088 | 4.6e-216 |

Description sp:[LN:E64995] [AC:E64995] [PN:hypothetical protein b2247] [OR:Escherichia coli]
[DB:pir2] >gp:[GI:d1016799:g1799600] [LN:D90856] [AC:D90856:AB001340] [GN:yidU]
[OR:Escherichia coli] [SR:Escherichia coli (strain:K12) DNA, clone_lib:Kohara
lambda minise] [DB:genpept-bct1] [DE:E.coli genomic DNA, Kohara clone
379(50.8-51.2 min.).] [NT:similar to [SwissProt Accession Number P31458]]
[LE:3602] [RE:4819] [DI:complement] >gp:[GI:g1788580] [LN:AE000314]
[AC:AE000314:U00096] [PN:putative racemase] [GN:b2247] [FN:putative enzyme; Not
classified] [OR:Escherichia coli] [DB:genpept-bct2] [DE:Escherichia coli K-12
MG1655 section 204 of 400 of the completegenome.] [NT:f405; This 405 aa ORF is 30
pct identical (25 gaps)] [LE:10660] [RE:11877] [DI:complement]

| ORF Name | NT ID | AA ID | NT LN | AA LN | Score | P-value |
|---|---|---|---|---|---|---|
| 10739040_c2_1362 | 919 | 8090 | 1062 | 353 | 1613 | 9.9e-166 |

Description sp:[LN:DGAL_CITFR] [AC:P23925] [GN:MGLB] [OR:Citrobacter freundii] [DE:D-GLUCOSE
BINDING PROTEIN) (GGBP)] [SP:P23925] [DB:swissprot] >sp:[LN:S15554] [AC:S15554]
[PN:D-galactose-binding protein] [GN:mglB] [CL:D-galactose-binding protein]
[OR:Citrobacter freundii] [DB:pir1] >gp:[GI:g40473] [LN:CFMGLB] [AC:X59389]
[PN:galactose binding protein] [GN:MglB] [OR:Citrobacter freundii]
[DB:genpept-bct1] [DE:C.freundii MglB gene for a galactose binding protein.]
[SP:P23925] [LE:1] [RE:999] [DI:direct]

| ORF Name | NT ID | AA ID | NT LN | AA LN | Score | P-value |
|---|---|---|---|---|---|---|
| 1073907_f1_159 | 920 | 8091 | 723 | 240 | 466 | 3.5e-44 |

Description sp:[LN:PTCR_ALCFA] [AC:P31668] [OR:Alcaligenes faecalis]
[DE:PHOSPHINOTHRICIN-RESISTANCE PROTEIN (PTC-RESISTANCE PROTEIN)] [SP:P31668]
[DB:swissprot] >gp:[GI:g345145] [LN:A01504] [AC:A01504] [PN:PTC-resistance
protein] [OR:Alcaligenes faecalis] [DB:genpept-pat] [DE:A.faecalis DNA for
PTC-resistance protein (PTC=phosphinothricin).] [NT:PTC is phospinothricin]
[SP:P31668] [LE:1] [RE:594] [DI:direct]

| ORF Name | NT ID | AA ID | NT LN | AA LN | Score | P-value |
|---|---|---|---|---|---|---|
| 10816877_f3_671 | 921 | 8092 | 1590 | 529 | 2187 | 1.5e-226 |

Description sp:[LN:EX1_ECOLI] [AC:P04995] [GN:SBCB:XONA:CPEA] [OR:Escherichia coli]
[EC:3.1.11.1] [DE:DEOXYRIBOPHOSPHODIESTERASE) (DRPASE)] [SP:P04995]
[DB:swissprot] >sp:[LN:NCECX1] [AC:B64966:A26123] [PN:exodeoxyribonuclease
I,:exonuclease I] [GN:sbcB:xonA:cpeA] [CL:exodeoxyribonuclease I] [OR:Escherichia
coli] [EC:3.1.11.1] [DB:pir1] [MP:44 min] >gp:[GI:d1016563:g1736685] [LN:D90839]
[AC:D90839:AB001340] [PN:Exodeoxyribonuclease I (EC 3.1.11.1)] [GN:sbcB, xonA,
cpeA] [OR:Escherichia coli] [SR:Escherichia coli (strain:K12) DNA,
clone_lib:Kohara lambda minise] [DB:genpept-bct1] [DE:E.coli genomic DNA, Kohara
clone #349(44.6-45.0 min.).] [NT:ORF_ID:o349#2; similar to [SwissProt Accession]
[LE:11408] [RE:12835] [DI:direct] >gp:[GI:d1016568:g1736691] [LN:D90840]
[AC:D90840:AB001340] [PN:Exodeoxyribonuclease I (EC 3.1.11.1)] [GN:sbcB, xonA,
cpeA] [OR:Escherichia coli] [SR:Escherichia coli (strain:K12) DNA,
clone_lib:Kohara lambda minise] [DB:genpept-bct1] [DE:E.coli genomic DNA, Kohara
clone #350(44.9-45.2 min.).] [NT:ORF_ID:o349#2; similar to [SwissProt Accession]
[LE:99] [RE:1526] [DI:direct] >gp:[GI:g405954] [LN:ECOHU43] [AC:U00009]
[PN:exonuclease I] [OR:Escherichia coli] [SR:Escherichia coli K12 BHB2600]
[DB:genpept-bct1] [DE:sbcB region of E.coli K12 BHB2600.] [LE:2613] [RE:4040]
[DI:direct] >gp:[GI:g1788321] [LN:AE000292] [AC:AE000292:U00096] [PN:exonuclease
I, 3' --> 5' specific;] [GN:sbcB] [FN:enzyme; Degradation of DNA] [OR:Escherichia
coli] [DB:genpept-bct2] [EC:3.1.11.1] [DE:Escherichia coli K-12 MG1655 section
182 of 400 of the completegenome.] [NT:o475; 100 pct identical to EX1_ECOLI SW:
P04995; CG] [LE:8071] [RE:9498] [DI:direct]

| ORF Name | NT ID | AA ID | NT LN | AA LN | Score | P-value |
|---|---|---|---|---|---|---|
| 10953_f1_96 | 922 | 8093 | 3078 | 1025 | 4727 | 0.0 |

Description sp:[LN:YEGO_ECOLI] [AC:P76399:O08006] [GN:YEGO] [OR:Escherichia coli]
[DE:HYPOTHETICAL 111.0 KD PROTEIN IN ALKA-BAES INTERGENIC REGION]
[SP:P76399:O08006] [DB:swissprot] >sp:[LN:C64974] [AC:C64974] [PN:hypothetical
protein b2076] [CL:hypothetical protein b2075] [OR:Escherichia coli] [DB:pir2]
>gp:[GI:d1016656:g1736785] [LN:D90846] [AC:D90846:AB001340] [PN:Acriflavin
resistance protein F (EnvD protein).] [OR:Escherichia coli] [SR:Escherichia coli
(strain:K12) DNA, clone_lib:Kohara lambda minise] [DB:genpept-bct1] [DE:E.coli
genomic DNA, Kohara clone #357(46.5-46.8 min.).] [NT:ORF_ID:o357#1; similar to
[SwissProt Accession] [LE:1138] [RE:4215] [DI:direct] >gp:[GI:g1788391]
[LN:AE000297] [AC:AE000297:U00096] [PN:orf, hypothetical protein] [GN:yegO]
[FN:orf; Unknown] [OR:Escherichia coli] [DB:genpept-bct2] [DE:Escherichia coli
K-12 MG1655 section 187 of 400 of the completegenome.] [NT:o1025; This 1025 aa
ORF is 29 pct identical] [LE:11779] [RE:14856] [DI:direct]

| ORF Name | NT ID | AA ID | NT LN | AA LN | Score | P-value |
|---|---|---|---|---|---|---|
| 11057326_f3_905 | 923 | 8094 | 807 | 268 | 149 | 1.3e-07 |

Description gp:[GI:e1517400:g5525059] [LN:SCI28] [AC:AL096844] [PN:putative integral membrane protein] [GN:SCI28.01] [OR:Streptomyces coelicolor A3(2)] [DB:genpept-bct1] [DE:Streptomyces coelicolor cosmid I28.] [NT:SCI28.01, possible integral membrane protein, len:] [LE:7] [RE:2061] [DI:direct]

| ORF Name | NT ID | AA ID | NT LN | AA LN | Score | P-value |
|---|---|---|---|---|---|---|
| 11057706_c1_1177 | 924 | 8095 | 1449 | 482 | | |

Description

NO-HIT

| ORF Name | NT ID | AA ID | NT LN | AA LN | Score | P-value |
|---|---|---|---|---|---|---|
| 11067715_c1_1078 | 925 | 8096 | 1743 | 580 | 2510 | 8.7e-261 |

Description sp:[LN:PTFB_ECOLI] [AC:P20966] [GN:FRUA:PTSF] [OR:Escherichia coli] [EC:2.7.1.69] [DE:(EC 2.7.1.69) (EII-FRU)] [SP:P20966] [DB:swissprot] >sp:[LN:A34962] [AC:A34962:C37245:F64985] [PN:phosphotransferase system enzyme II,, fructose-specific] [GN:fruA:ptsF] [CL:phosphotransferase system enzyme II, fructose-specific:phosphotransferase system mannitol-specific enzyme II factor III homology] [OR:Escherichia coli] [EC:2.7.1.69] [DB:pir2] [MP:47 min] >gp:[GI:g450372] [LN:ECOFRUA] [AC:M23196] [PN:enzyme II-fru] [GN:fruA] [OR:Escherichia coli] [DB:genpept-bct1] [DE:E. coli phosphotransferase system enzyme II (fruA) gene, completecds.] [LE:120] [RE:1811] [DI:direct] >gp:[GI:g405893] [LN:ECOHU47] [AC:U00007] [PN:fructose-specific IIBC component] [OR:Escherichia coli] [SR:Escherichia coli K12 BHB2600] [DB:genpept-bct1] [DE:47 to 48 centisome region of E.coli K12 BHB2600.] [LE:67463] [RE:69154] [DI:complement] >gp:[GI:g1788492] [LN:AE000306] [AC:AE000306:U00096] [PN:PTS system, fructose-specific transport protein] [GN:fruA] [FN:regulator; Degradation of small molecules:] [OR:Escherichia coli] [DB:genpept-bct2] [EC:2.7.1.69] [DE:Escherichia coli K-12 MG1655 section 196 of 400 of the completegenome.] [NT:f563; 100 pct identical to PTFB_ECOLI SW: P20966] [LE:2367] [RE:4058] [DI:complement]

| ORF Name | NT ID | AA ID | NT/LN | AA/LN | Score | P-value |
|---|---|---|---|---|---|---|
| 11913168_c2_1311 | 926 | 8097 | 1647 | 548 | 2114 | 8.0e-219 |

Description sp:[LN:MQO_ECOLI] [AC:P33940:P76454:O08017] [GN:YOJH] [OR:Escherichia coli]
[EC:1.1.99.16] [DE:DEHYDROGENASE [ACCEPTOR]) (MQO)] [SP:P33940:P76454:O08017]
[DB:swissprot] >sp:[LN:H64990] [AC:H64990] [PN:yojH protein] [GN:yojH]
[OR:Escherichia coli] [DB:pir2] >gp:[GI:d1016718:g1736851] [LN:D90850]
[AC:D90850:AB001340] [GN:yojH] [OR:Escherichia coli] [SR:Escherichia coli
(strain:K12) DNA, clone_lib:Kohara lambda minise] [DB:genpept-bct1] [DE:E.coli
genomic DNA, Kohara clone #373(49.5-49.9 min.).] [NT:ORF_ID:o372#5; similar to
[SwissProt Accession] [LE:4626] [RE:6272] [DI:complement] >gp:[GI:g1788539]
[LN:AE000310] [AC:AE000310:U00096] [PN:orf, hypothetical protein] [GN:yojH]
[FN:orf; Unknown] [OR:Escherichia coli] [DB:genpept-bct2] [DE:Escherichia coli
K-12 MG1655 section 200 of 400 of the completegenome.] [NT:f548; This 548 aa ORF
is 100 pct identical to] [LE:1428] [RE:3074] [DI:complement]

| ORF Name | NT ID | AA ID | NT/LN | AA/LN | Score | P-value |
|---|---|---|---|---|---|---|
| 11933506_c1_1098 | 927 | 8098 | 837 | 278 | 334 | 3.4e-30 |

Description sp:[LN:S42207] [AC:S42207] [PN:porin] [CL:Pseudomonas porin oprB] [OR:Pseudomonas
aeruginosa] [DB:pir2] >gp:[GI:g444004] [LN:PAOPRB] [AC:X77131] [PN:porin]
[GN:oprB] [OR:Pseudomonas aeruginosa] [DB:genpept-bct1] [DE:P.aeruginosa oprB
gene.] [LE:238] [RE:1602] [DI:direct]

| ORF Name | NT ID | AA ID | NT/LN | AA/LN | Score | P-value |
|---|---|---|---|---|---|---|
| 11970150_c2_1263 | 928 | 8099 | 525 | 174 | 595 | 7.4e-58 |

Description sp:[LN:ELAA_ECOLI] [AC:P52077:Q47011] [GN:ELAA] [OR:Escherichia coli] [DE:ELAA
PROTEIN] [SP:P52077:Q47011] [DB:swissprot] >sp:[LN:A64998] [AC:A64998]
[PN:hypothetical protein b2267] [CL:hypothetical protein b2267] [OR:Escherichia
coli] [DB:pir2] >gp:[GI:d1016822:g1799624] [LN:D90857] [AC:D90857:AB001340]
[GN:yfbC] [OR:Escherichia coli] [SR:Escherichia coli (strain:K12) DNA,
clone_lib:Kohara lambda minise] [DB:genpept-bct1] [DE:E.coli genomic DNA, Kohara
clone #380(51.1-51.4 min.).] [NT:similar to [SwissProt Accession Number P52077]]
[LE:13709] [RE:14170] [DI:complement] >gp:[GI:d1016829:g1799632] [LN:D90858]
[AC:D90858:AB001340] [GN:yfbC] [OR:Escherichia coli] [SR:Escherichia coli
(strain:K12) DNA, clone_lib:Kohara lambda minise] [DB:genpept-bct1] [DE:E.coli
genomic DNA, Kohara clone #401(51.3-51.6 min.).] [NT:similar to [SwissProt
Accession Number P52077]] [LE:3168] [RE:3629] [DI:complement] >gp:[GI:g1381660]
[LN:ECU58768] [AC:U58768] [GN:elaA] [OR:Escherichia coli] [SR:Escherichia coli
strain=K12] [DB:genpept-bct1] [DE:Escherichia coli ela locus, menF gene, partial
cds, elaB, elaA,elaC and elaD genes, complete cds.] [NT:putative 17 kD protein]
[LE:1088] [RE:1549] [DI:complement] >gp:[GI:g1788602] [LN:AE000316]
[AC:AE000316:U00096] [PN:orf, hypothetical protein] [GN:elaA] [FN:orf; Unknown]
[OR:Escherichia coli] [DB:genpept-bct2] [DE:Escherichia coli K-12 MG1655 section
206 of 400 of the completegenome.] [NT:f153; This 153 aa ORF is 38 pct identical
(4 gaps)] [LE:7504] [RE:7965] [DI:complement]

| ORF Name | NT ID | AA ID | NT/LN | AA/LN | Score | P-value |
|---|---|---|---|---|---|---|
| 12116512_c1_1121 | 929 | 8100 | 318 | 105 | 408 | 4.8e-38 |

Description sp:[LN:YEHT_ECOLI] [AC:P33356:P76433:P76432] [GN:YEHT] [OR:Escherichia coli]
[DE:HYPOTHETICAL 27.9 KD PROTEIN IN MOLR-BGLX INTERGENIC REGION]
[SP:P33356:P76433:P76432] [DB:swissprot] >sp:[LN:D64980] [AC:D64980] [PN:yehT
protein] [GN:yehT] [CL:yehT protein:response regulator homology] [OR:Escherichia
coli] [DB:pir2] >gp:[GI:g405856] [LN:ECOHU47] [AC:U00007] [PN:yehT]
[OR:Escherichia coli] [SR:Escherichia coli K12 BHB2600] [DB:genpept-bct1] [DE:47
to 48 centisome region of E.coli K12 BHB2600.] [NT:belongs to uhpA family of
transcriptional] [LE:25012] [RE:25746] [DI:complement] >gp:[GI:g2367130]
[LN:AE000301] [AC:AE000301:U00096] [PN:orf, hypothetical protein] [GN:yehT]
[FN:orf; Unknown] [OR:Escherichia coli] [DB:genpept-bct2] [DE:Escherichia coli
K-12 MG1655 section 191 of 400 of the completegenome.] [NT:f244; 100 pct
identical to YEHT_ECOLI SW:] [LE:8053] [RE:8787] [DI:complement]

| ORF Name | NT ID | AA ID | NT/LN | AA/LN | Score | P-value |
|---|---|---|---|---|---|---|
| 12135162_c2_1264 | 930 | 8101 | 1371 | 456 | 1449 | 2.4e-148 |

Description sp:[LN:MENF_ECOLI] [AC:P38051:Q47009:Q47704:P76479:P78297] [GN:MENF]
[OR:Escherichia coli] [EC:5.4.99.6] [DE:MENAQUINONE-SPECIFIC ISOCHORISMATE
SYNTHASE,] [SP:P38051:Q47009:Q47704:P76479:P78297] [DB:swissprot]
>gp:[GI:d1016820:g1799622] [LN:D90857] [AC:D90857:AB001340]
[PN:MENAQUINONE-SPECIFIC ISOCHORISMATE SYNTHASE (EC] [GN:menF] [OR:Escherichia
coli] [SR:Escherichia coli (strain:K12) DNA, clone_lib:Kohara lambda minise]
[DB:genpept-bct1] [DE:E.coli genomic DNA, Kohara clone #380(51.1-51.4 min.).]
[NT:similar to [SwissProt Accession Number P38051]] [LE:11975] [RE:13270]
[DI:complement] >gp:[GI:d1016827:g1799630] [LN:D90858] [AC:D90858:AB001340]
[PN:MENAQUINONE-SPECIFIC ISOCHORISMATE SYNTHASE (EC] [GN:menF] [OR:Escherichia
coli] [SR:Escherichia coli (strain:K12) DNA, clone_lib:Kohara lambda minise]
[DB:genpept-bct1] [DE:E.coli genomic DNA, Kohara clone #401(51.3-51.6 min.).]
[NT:similar to [SwissProt Accession Number P38051]] [LE:1434] [RE:2729]
[DI:complement] >gp:[GI:e1252264:g2909343] [LN:ECMENFGN] [AC:Z50849]
[PN:isochorismate synthase] [GN:menF] [OR:Escherichia coli] [DB:genpept-bct1]
[DE:E.coli menF gene.] [SP:P38051] [LE:63] [RE:1358] [DI:direct]

| ORF Name | NT ID | AA ID | NT/LN | AA/LN | Score | P-value |
|---|---|---|---|---|---|---|
| 12195182_f2_557 | 931 | 8102 | 828 | 275 | 325 | 3.0e-29 |

Description sp:[LN:YZBC_ECOLI] [AC:P28247] [GN:BICB] [OR:Escherichia coli] [DE:VERY
HYPOTHETICAL 19.2 KD PROTEIN IN BCR 3'REGION] [SP:P28247] [DB:swissprot]
>gp:[GI:g405943] [LN:ECOHU49] [AC:U00008] [PN:bicB/yeiD] [OR:Escherichia coli]
[SR:Escherichia coli K12 BHB2600] [DB:genpept-bct1] [DE:centisome 49 region of
E.coli K12 BHB2600.] [NT:probably not expressed; yejD on opposite strand has]
[LE:7156] [RE:7659] [DI:direct]

| ORF Name | NT ID | AA ID | NT/LN | AA/LN | Score | P-value |
|---|---|---|---|---|---|---|
| 12241341_f3_802 | 932 | 8103 | 630 | 209 | 181 | 3.6e-13 |

Description sp:[LN:S22697] [AC:S22697:S21006] [PN:extensin] [OR:Volvox carteri] [DB:pir2]

| ORF Name | NT ID | AA ID | NT/LN | AA/LN | Score | P-value |
|---|---|---|---|---|---|---|
| 12534577_c2_1483 | 933 | 8104 | 1095 | 364 | 247 | 1.5e-19 |

Description gp:[GI:e322225:g3413449] [LN:CJY11648] [AC:Y11648] [GN:wlaE] [OR:Campylobacter jejuni] [DB:genpept-bct1] [DE:Campylobacter jejuni waaC, galE, wla[B,C,D,E,F,G,H,I,K,L,M], cheYgenes and orf1.] [LE:5829] [RE:6926] [DI:direct]

| ORF Name | NT ID | AA ID | NT/LN | AA/LN | Score | P-value |
|---|---|---|---|---|---|---|
| 12541425_f1_140 | 934 | 8105 | 498 | 165 | 250 | 2.7e-21 |

Description gp:[GI:g2565354] [LN:AF025662] [AC:AF025662] [PN:unknown] [OR:Vibrio cholerae] [DB:genpept-bct2] [DE:Vibrio cholerae lipoprotein (vlpA) and unknown proteins genes,complete cds.] [NT:ORF3] [LE:1454] [RE:1879] [DI:direct]

| ORF Name | NT ID | AA ID | NT LN | AA LN | Score | P-value |
|---|---|---|---|---|---|---|
| 12586438_f1_46 | 935 | 8106 | 699 | 232 | 929 | 3.0e-93 |

Description sp:[LN:HIS5_ECOLI] [AC:P10375] [GN:HISH] [OR:Escherichia coli] [EC:2.4.2.-]
[DE:AMIDOTRANSFERASE HISH,] [SP:P10375] [DB:swissprot] >sp:[LN:XQECHH]
[AC:JS0132:F64967] [PN:imidazole glycerol phosphate synthase, chain
hisH:amidotransferase] [GN:hisH] [CL:amidotransferase hisH:trpG homology]
[OR:Escherichia coli] [EC:2.4.2.-] [DB:pir1] [MP:44 min]
>gp:[GI:d1041510:g4867933] [LN:AB008676] [AC:AB008676] [PN:aminotransferase]
[GN:hisH] [OR:Escherichia coli] [SR:Escherichia coli (strain:184) DNA,
clone:1-4-1] [DB:genpept-bct1] [DE:Escherichia coli O157 DNA, map position at 46
min., complete cds.] [NT:putative] [LE:21801] [RE:22391] [DI:complement]
>gp:[GI:d1016578:g1736701] [LN:D90840] [AC:D90840:AB001340] [PN:Amidotransferase
HisH (EC 2.4.2.-)] [GN:hisH] [OR:Escherichia coli] [SR:Escherichia coli
(strain:K12) DNA, clone_lib:Kohara lambda minise] [DB:genpept-bct1] [DE:E.coli
genomic DNA, Kohara clone #350(44.9-45.2 min.).] [NT:ORF_ID:o350#9; similar to
[PIR Accession Number] [LE:11877] [RE:12467] [DI:direct]
>gp:[GI:d1016586:g1736710] [LN:D90841] [AC:D90841:AB001340] [PN:Amidotransferase
HisH (EC 2.4.2.-)] [GN:hisH] [OR:Escherichia coli] [SR:Escherichia coli
(strain:K12) DNA, clone_lib:Kohara lambda minise] [DB:genpept-bct1] [DE:E.coli
genomic DNA, Kohara clone #351(45.1-45.5 min.).] [NT:ORF_ID:o350#9; similar to
[PIR Accession Number] [LE:835] [RE:1425] [DI:direct] >gp:[GI:g41712]
[LN:ECHISOP] [AC:X13462] [OR:Escherichia coli] [DB:genpept-bct1] [DE:Escherichia
coli DNA for histidin operon genes hisGDCBHAFIE.] [NT:hisH ORF (AA 1-196)]
[SP:P10375] [LE:4617] [RE:5207] [DI:direct] >gp:[GI:g1788334] [LN:AE000293]
[AC:AE000293:U00096] [PN:glutamine amidotransferase subunit of] [GN:hisH]
[FN:enzyme; Amino acid biosynthesis: Histidine] [OR:Escherichia coli]
[DB:genpept-bct2] [EC:2.4.2.-] [DE:Escherichia coli K-12 MG1655 section 183 of
400 of the completegenome.] [NT:o196; 100 pct identical to HIS5_ECOLI SW:
P10375;] [LE:8951] [RE:9541] [DI:direct]

| ORF Name | NT ID | AA ID | NT LN | AA LN | Score | P-value |
|---|---|---|---|---|---|---|
| 12604642_c3_1667 | 936 | 8107 | 1170 | 389 | 1176 | 2.0e-119 |

Description sp:[LN:YEHY_ECOLI] [AC:P33361:P76435] [GN:YEHY] [OR:Escherichia coli]
[DE:HYPOTHETICAL ABC TRANSPORTER PERMEASE PROTEIN YEHY] [SP:P33361:P76435]
[DB:swissprot] >sp:[LN:A64981] [AC:A64981] [PN:yehY protein] [GN:yehY]
[OR:Escherichia coli] [DB:pir2] >gp:[GI:g1788451] [LN:AE000302]
[AC:AE000302:U00096] [PN:putative transport system permease protein] [GN:yehY]
[FN:putative transport; Not classified] [OR:Escherichia coli] [DB:genpept-bct2]
[DE:Escherichia coli K-12 MG1655 section 192 of 400 of the completegenome.]
[NT:f385; residues 51-345 are 100 pct identical to] [LE:2675] [RE:3832]
[DI:complement]

| ORF Name | NT ID | AA ID | NT LN | AA LN | Score | P-value |
|---|---|---|---|---|---|---|
| 13009543_c1_1234 | 937 | 8108 | 1095 | 364 | 1228 | 6.2e-125 |

Description gp:[GI:g535767] [LN:STYCOBT] [AC:L35477] [PN:dimethylbenzimidazole phosphoribosyltransferase] [GN:cobT] [OR:Salmonella typhimurium] [SR:Salmonella typhimurium (strain LT2) DNA] [DB:genpept-bct1] [EC:2.4.2.21] [DE:Salmonella typhimurium transfer RNA-Asn (tRNA-Asn) anddimethylbenzimidazole phosphoribosyltransferase (cobT) gene,complete cds.] [NT:The first 757 base pairs of the cobT sequence have] [LE:1] [RE:1101] [DI:direct]

| ORF Name | NT ID | AA ID | NT LN | AA LN | Score | P-value |
|---|---|---|---|---|---|---|
| 13016416_c2_1393 | 938 | 8109 | 630 | 209 | 166 | 1.5e-10 |

Description gp:[GI:g3450883] [LN:AF083334] [AC:AF083334] [PN:fibroin] [OR:Antheraea pernyi] [SR:Chinese oak silkmoth] [DB:genpept-inv2] [DE:Antheraea pernyi fibroin gene, complete cds.] [LE:1111:1273] [RE:1152:9150] [DI:directJoin]

| ORF Name | NT ID | AA ID | NT LN | AA LN | Score | P-value |
|---|---|---|---|---|---|---|
| 13022707_f2_630 | 939 | 8110 | 384 | 127 | 122 | 8.6e-07 |

Description gp:[GI:e1453977:g4835304] [LN:SC5H1] [AC:AL049863] [PN:putative serine/threonine protein kinase] [GN:SC5H1.01] [OR:Streptomyces coelicolor] [DB:genpept-bct1] [DE:Streptomyces coelicolor cosmid 5H1.] [NT:SC5H1.01, probable serine/threonine protein kinase,] [LE:<1] [RE:1381] [DI:direct]

| ORF Name | NT ID | AA ID | NT LN | AA LN | Score | P-value |
|---|---|---|---|---|---|---|
| 13067511_c1_1188 | 940 | 8111 | 2226 | 741 | 2974 | 0.0 |

Description gp:[GI:g4512007] [LN:AF104912] [AC:AF104912] [PN:putative transmembrane protein Wzc] [GN:wzc] [OR:Escherichia coli] [DB:genpept-bct2] [DE:Escherichia coli K30 capsule biosynthesis cluster, partialsequence.] [NT:MPA1 protein family homologue] [LE:3923] [RE:6088] [DI:direct]

| ORF Name | NT ID | AA ID | NT LN | AA LN | Score | P-value |
|---|---|---|---|---|---|---|
| 13125137_f3_684 | 941 | 8112 | 609 | 202 | 136 | 3.2e-09 |

Description gp:[GI:g1072069] [LN:RSU35443] [AC:U35443] [OR:Rhodobacter sphaeroides] [DB:genpept-bct2] [DE:Rhodobacter sphaeroides ORF277 gene, partial cds.] [NT:Rs-ORF277; similar to ORF277 of Bradyrhizobium] [LE:<1] [RE:>339] [DI:complement]

| ORF_Name | NT ID | AA ID | NT LN | AA LN | Score | P-value |
|---|---|---|---|---|---|---|
| 13126642_f1_176 | 942 | 8113 | 723 | 240 | 1060 | 3.9e-107 |

Description sp:[LN:YOHK_ECOLI] [AC:P33373] [GN:YOHK] [OR:Escherichia coli] [DE:HYPOTHETICAL 24.5 KD PROTEIN IN PBPG-CDD INTERGENIC REGION] [SP:P33373] [DB:swissprot] >sp:[LN:E64982] [AC:E64982] [PN:yohK protein] [GN:yohK] [CL:yohK protein] [OR:Escherichia coli] [DB:pir1] >gp:[GI:g1788464] [LN:AE000303] [AC:AE000303:U00096] [PN:putative seritonin transporter] [GN:yohK] [FN:putative transport; Not classified] [OR:Escherichia coli] [DB:genpept-bct2] [DE:Escherichia coli K-12 MG1655 section 193 of 400 of the completegenome.] [NT:o231; residues 10295 are 100 pct identical to] [LE:6088] [RE:6783] [DI:direct]

| ORF_Name | NT ID | AA ID | NT LN | AA LN | Score | P-value |
|---|---|---|---|---|---|---|
| 13143793_c2_1310 | 943 | 8114 | 1488 | 495 | 533 | 2.8e-51 |

Description sp:[LN:G72287] [AC:G72287] [PN:hypothetical protein TM1161] [GN:TM1161] [CL:magnesium transport protein mgtE] [OR:Thermotoga maritima] [DB:pir2] >gp:[GI:g4981710] [LN:AE001773] [AC:AE001773:AE000512] [PN:Mg2+ transporter MgtE, putative] [GN:TM1161] [OR:Thermotoga maritima] [DB:genpept-bct2] [DE:Thermotoga maritima section 85 of 136 of the complete genome.] [NT:similar to PID:1652477 percent identity: 61.31;] [LE:4479] [RE:5819] [DI:complement]

| ORF_Name | NT ID | AA ID | NT LN | AA LN | Score | P-value |
|---|---|---|---|---|---|---|
| 13152283_f1_87 | 944 | 8115 | 402 | 133 | 135 | 4.1e-09 |

Description gp:[GI:g6015444] [LN:AB032905] [AC:AB032905] [PN:dopamine receptor D4] [GN:drd4] [OR:Hylobates concolor] [SR:Hylobates concolor DNA] [DB:genpept-pri1] [DE:Hylobates concolor gene for dopamine receptor D4, partial cds, drd48-repeat allele.] [NT:drd4 8-repeat allele] [LE:<1] [RE:>555] [DI:direct]

| ORF Name | NT ID | AA ID | NT/LN | AA/LN | Score | P-value |
|---|---|---|---|---|---|---|
| 13167337_c1_1117 | 945 | 8116 | 960 | 319 | 1220 | 4.4e-124 |

Description sp:[LN:YEHX_ECOLI] [AC:P33360] [GN:YEHX] [OR:Escherichia coli] [DE:HYPOTHETICAL ABC TRANSPORTER ATP-BINDING PROTEIN YEHX] [SP:P33360] [DB:swissprot] >sp:[LN:H64980] [AC:H64980] [PN:hypothetical ABC transporter in molR-bglX intergenic region] [GN:yehX] [CL:ATP-binding cassette homology] [OR:Escherichia coli] [DB:pir2] >gp:[GI:g405860] [LN:ECOHU47] [AC:U00007] [PN:yehX] [OR:Escherichia coli] [SR:Escherichia coli K12 BHB2600] [DB:genpept-bct1] [DE:47 to 48 centisome region of E.coli K12 BHB2600.] [NT:ABC-type ATP-dependent protein protein.] [LE:29250] [RE:30176] [DI:complement] >gp:[GI:g1788450] [LN:AE000302] [AC:AE000302:U00096] [PN:putative ATP-binding component of a transport] [GN:yehX] [FN:putative transport; Not classified] [OR:Escherichia coli] [DB:genpept-bct2] [DE:Escherichia coli K-12 MG1655 section 192 of 400 of the completegenome.] [NT:f308; 100 pct identical to YEHX_ECOLI SW: P33360] [LE:1756] [RE:2682] [DI:complement]

| ORF Name | NT ID | AA ID | NT/LN | AA/LN | Score | P-value |
|---|---|---|---|---|---|---|
| 1369787_c2_1517 | 946 | 8117 | 1218 | 405 | 1659 | 1.3e-170 |

Description sp:[LN:DACD_SALTY] [AC:P37604:P37605] [GN:DACD:PHSE:PHSF] [OR:Salmonella typhimurium] [EC:3.4.16.4] [DE:(PBP-6B)] [SP:P37604:P37605] [DB:swissprot]

| ORF Name | NT ID | AA ID | NT/LN | AA/LN | Score | P-value |
|---|---|---|---|---|---|---|
| 13914018_c2_1479 | 947 | 8118 | 1566 | 521 | 2622 | 1.2e-272 |

Description gp:[GI:g4512004] [LN:AF104912] [AC:AF104912] [OR:Escherichia coli] [DB:genpept-bct2] [DE:Escherichia coli K30 capsule biosynthesis cluster, partialsequence.] [NT:OrfX; Klebsiella K2 Orf3 homologue] [LE:672] [RE:2186] [DI:direct]

| ORF Name | NT ID | AA ID | NT LN | AA LN | Score | P-value |
|---|---|---|---|---|---|---|
| 13942967_f3_880 | 948 | 8119 | 498 | 165 | 414 | 1.1e-38 |

Description sp:[LN:RL25_ECOLI] [AC:P02426] [GN:RPLY] [OR:Escherichia coli] [DE:50S RIBOSOMAL PROTEIN L25] [SP:P02426] [DB:swissprot] >sp:[LN:R5EC25] [AC:S16002:A02821:A30428:A30429:H64987] [PN:ribosomal protein L25] [GN:rplY] [CL:Escherichia coli ribosomal protein L25] [OR:Escherichia coli] [DB:pir1] [MP:48 min] >gp:[GI:d1003088:g216640] [LN:ECORPLY] [AC:D13326:X62801] [PN:ribosomal protein L25] [GN:rplY] [OR:Escherichia coli] [SR:Escherichia coli (strain:K-12) DNA] [DB:genpept-bct1] [DE:Escherichia coli rplY gene for ribosomal protein L25.] [LE:382] [RE:666] [DI:direct] >gp:[GI:g1788512] [LN:AE000308] [AC:AE000308:U00096] [PN:50S ribosomal subunit protein L25] [GN:rplY] [FN:structural component; Ribosomal proteins -] [OR:Escherichia coli] [DB:genpept-bct2] [DE:Escherichia coli K-12 MG1655 section 198 of 400 of the completegenome.] [NT:o94; 100 pct identical to RL25_ECOLI SW: P02426] [LE:4144] [RE:4428] [DI:direct]

| ORF Name | NT ID | AA ID | NT LN | AA LN | Score | P-value |
|---|---|---|---|---|---|---|
| 14277265_f3_755 | 949 | 8120 | 1431 | 476 | 2312 | 8.4e-240 |

Description sp:[LN:YEGQ_ECOLI] [AC:P76403:O08007:O08010] [GN:YEGQ] [OR:Escherichia coli] [EC:3.4.-.-] [DE:PUTATIVE PROTEASE YEGQ,] [SP:P76403:O08007:O08010] [DB:swissprot] >sp:[LN:H64974] [AC:H64974] [PN:hypothetical protein b2081] [CL:collagenase prtC] [OR:Escherichia coli] [DB:pir2] >gp:[GI:d1016660:g1736789] [LN:D90846] [AC:D90846:AB001340] [PN:Collagenase precursor (EC 3.4.-.-).] [OR:Escherichia coli] [SR:Escherichia coli (strain:K12) DNA, clone_lib:Kohara lambda minise] [DB:genpept-bct1] [DE:E.coli genomic DNA, Kohara clone #357(46.5-46.8 min.).] [NT:ORF_ID:o357#6; similar to [SwissProt Accession] [LE:8420] [RE:9781] [DI:direct] >gp:[GI:d1016671:g1736801] [LN:D90847] [AC:D90847:AB001340] [PN:Collagenase precursor (EC 3.4.-.-).] [OR:Escherichia coli] [SR:Escherichia coli (strain:K12) DNA, clone_lib:Kohara lambda minise] [DB:genpept-bct1] [DE:E.coli genomic DNA, Kohara clone #358(46.6-46.9 min.).] [NT:ORF_ID:o357#6; similar to [SwissProt Accession] [LE:3065] [RE:4426] [DI:direct] >gp:[GI:g1788397] [LN:AE000298] [AC:AE000298:U00096] [PN:orf, hypothetical protein] [GN:yegQ] [FN:orf; Unknown] [OR:Escherichia coli] [DB:genpept-bct2] [DE:Escherichia coli K-12 MG1655 section 188 of 400 of the completegenome.] [NT:o453; This 453 aa ORF is 80 pct identical (4 gaps)] [LE:624] [RE:1985] [DI:direct]

| ORF Name | NT ID | AA ID | NT LN | AA LN | Score | P-value |
|---|---|---|---|---|---|---|
| 14300332_c2_1425 | 950 | 8121 | 1419 | 472 | 2191 | 5.6e-227 |

Description gp:[GI:g2735581] [LN:AF045245] [AC:AF045245:U97126] [PN:D-arabinitol transporter] [GN:dalT] [OR:Klebsiella pneumoniae] [DB:genpept-bct2] [DE:Klebsiella pneumoniae D-arabinitol transporter (dalT), D-arabinitolkinase (dalK), D-arabinitol dehydrogenase (dalD), and repressor(dalR) genes, complete cds.] [LE:421] [RE:1698] [DI:complement]

| ORF Name | NT ID | AA ID | NT LN | AA LN | Score | P-value |
|---|---|---|---|---|---|---|
| 14349205_c3_1662 | 951 | 8122 | 192 | 63 | | |

Description

NO-HIT

| ORF Name | NT ID | AA ID | NT LN | AA LN | Score | P-value |
|---|---|---|---|---|---|---|
| 14454637_f1_71 | 952 | 8123 | 183 | 60 | | |

Description

NO-HIT

| ORF Name | NT ID | AA ID | NT LN | AA LN | Score | P-value |
|---|---|---|---|---|---|---|
| 14495417_c1_1115 | 953 | 8124 | 2310 | 769 | 3662 | 0.0 |

Description gp:[GI:g405863] [LN:ECOHU47] [AC:U00007] [PN:yohA] [OR:Escherichia coli]
[SR:Escherichia coli K12 BHB2600] [DB:genpept-bct1] [DE:47 to 48 centisome region
of E.coli K12 BHB2600.] [NT:probable beta-glucosidase.] [LE:32462] [RE:34831]
[DI:complement]

| ORF Name | NT ID | AA ID | NT LN | AA LN | Score | P-value |
|---|---|---|---|---|---|---|
| 14496087_c1_1223 | 954 | 8125 | 1083 | 360 | 1716 | 1.2e-176 |

Description sp:[LN:YEEF_ECOLI] [AC:P33016] [GN:YEEF] [OR:Escherichia coli] [DE:HYPOTHETICAL
49.8 KD TRANSPORT PROTEIN IN SBCB-HISL INTERGENIC REGION] [SP:P33016]
[DB:swissprot] >sp:[LN:E64966] [AC:E64966] [PN:probable amino acid permease yeeF]
[GN:yeeF] [OR:Escherichia coli] [DB:pir2] >gp:[GI:d1016566:g1736688] [LN:D90839]
[AC:D90839:AB001340] [PN:Proline transport protein] [GN:yeeF] [OR:Escherichia
coli] [SR:Escherichia coli (strain:K12) DNA, clone_lib:Kohara lambda minise]
[DB:genpept-bct1] [DE:E.coli genomic DNA, Kohara clone #349(44.6-45.0 min.).]
[NT:ORF_ID:o349#5; similar to [PIR Accession Number] [LE:14356] [RE:15720]
[DI:complement] >gp:[GI:d1016571:g1736694] [LN:D90840] [AC:D90840:AB001340]
[PN:Proline transport protein] [GN:yeeF] [OR:Escherichia coli] [SR:Escherichia
coli (strain:K12) DNA, clone_lib:Kohara lambda minise] [DB:genpept-bct1]
[DE:E.coli genomic DNA, Kohara clone #350(44.9-45.2 min.).] [NT:ORF_ID:o349#5;
similar to [PIR Accession Number] [LE:3047] [RE:4411] [DI:complement]
>gp:[GI:g405957] [LN:ECOHU43] [AC:U00009] [PN:yeeF] [OR:Escherichia coli]
[SR:Escherichia coli K12 BHB2600] [DB:genpept-bct1] [DE:sbcB region of E.coli K12
BHB2600.] [NT:probable permease, perhaps of amino acids.] [LE:5561] [RE:6925]
[DI:complement] >gp:[GI:g1788325] [LN:AE000293] [AC:AE000293:U00096] [PN:putative
amino acid/amine transport protein] [GN:yeeF] [FN:putative transport; Not
classified] [OR:Escherichia coli] [DB:genpept-bct2] [DE:Escherichia coli K-12
MG1655 section 183 of 400 of the completegenome.] [NT:f454; 100 pct identical to
YEEF_ECOLI SW: P33016] [LE:120] [RE:1484] [DI:complement]

| ORF Name | NT ID | AA ID | NT/LN | AA/LN | Score | P-value |
|---|---|---|---|---|---|---|
| 1464541_f2_593 | 955 | 8126 | 285 | 94 | | |

Description

NO-HIT

| ORF Name | NT ID | AA ID | NT/LN | AA/LN | Score | P-value |
|---|---|---|---|---|---|---|
| 14645965_c2_1369 | 956 | 8127 | 687 | 228 | 286 | 8.1e-25 |

Description sp:[LN:S42207] [AC:S42207] [PN:porin] [CL:Pseudomonas porin oprB] [OR:Pseudomonas aeruginosa] [DB:pir2] >gp:[GI:g444004] [LN:PAOPRB] [AC:X77131] [PN:porin] [GN:oprB] [OR:Pseudomonas aeruginosa] [DB:genpept-bct1] [DE:P.aeruginosa oprB gene.] [LE:238] [RE:1602] [DI:direct]

| ORF Name | NT ID | AA ID | NT/LN | AA/LN | Score | P-value |
|---|---|---|---|---|---|---|
| 14714385_f1_49 | 957 | 8128 | 651 | 216 | 1019 | 8.7e-103 |

Description sp:[LN:HIS2_KLEPN] [AC:O24714] [GN:HISI:HISIE] [OR:Klebsiella pneumoniae] [EC:3.5.4.19:3.6.1.31] [DE:PYROPHOSPHOHYDROLASE,] [SP:O24714] [DB:swissprot] >gp:[GI:d1024106:g2588933] [LN:AB000126] [AC:AB000126] [PN:phosphoribosyl-ATP pyrophosphohydrolase] [GN:hisI] [OR:Klebsiella pneumoniae] [SR:Klebsiella pneumoniae (strain:K53 serotype O3) DNA] [DB:genpept-bct1] [EC:3.5.4.19] [DE:Klebsiella pneumoniae DNA for mannosyl transferase,phosphoribosyl-ATP pyrophosphohydrolase, complete cds.] [NT:phosphoribosyl-AMP cyclohydrolase] [LE:1022] [RE:1618] [DI:complement]

| ORF Name | NT ID | AA ID | NT/LN | AA/LN | Score | P-value |
|---|---|---|---|---|---|---|
| 14847705_f1_88 | 958 | 8129 | 1458 | 485 | 1950 | 1.9e-201 |

Description sp:[LN:YEGD_ECOLI] [AC:P36928:P76392] [GN:YEGD] [OR:Escherichia coli] [DE:HYPOTHETICAL 49.4 KD PROTEIN IN ALKA-BAES INTERGENIC REGION] [SP:P36928:P76392] [DB:swissprot] >gp:[GI:d1016651:g1736779] [LN:D90845] [AC:D90845:AB001340] [GN:yegD] [OR:Escherichia coli] [SR:Escherichia coli (strain:K12) DNA, clone_lib:Kohara lambda minise] [DB:genpept-bct1] [DE:E.coli genomic DNA, Kohara clone #356(46.1-46.5 min.).] [NT:ORF_ID:o356#2; similar to [SwissProt Accession] [LE:6395] [RE:7747] [DI:direct]

| ORF Name | NT ID | AA ID | NT LN | AA LN | Score | P-value |
|---|---|---|---|---|---|---|
| 14879150_c2_1261 | 959 | 8130 | 1464 | 487 | 1989 | 1.4e-205 |

Description sp:[LN:NUON_ECOLI] [AC:P33608;P78281] [GN:NUON] [OR:Escherichia coli]
[EC:1.6.5.3] [DE:OXIDOREDUCTASE CHAIN 14) (NUO14)] [SP:P33608;P78281]
[DB:swissprot] >sp:[LN:B64999] [AC:B64999;S37071] [PN:NADH dehydrogenase
(ubiquinone), I chain N] [GN:nuoN] [CL:NADH dehydrogenase (ubiquinone) chain 2]
[OR:Escherichia coli] [EC:1.6.5.3] [DB:pir2] >gp:[GI:d1016831;g1799634]
[LN:D90858] [AC:D90858;AB001340] [PN:NADH DEHYDROGENASE I CHAIN N (EC 1.6.5.3)]
[GN:nuoN] [OR:Escherichia coli] [SR:Escherichia coli (strain:K12) DNA,
clone_lib:Kohara lambda minise] [DB:genpept-bct1] [DE:E.coli genomic DNA, Kohara
clone #401(51.3-51.6 min.).] [NT:similar to [SwissProt Accession Number P33608]]
[LE:12136] [RE:13413] [DI:complement] >gp:[GI:d1016832;g1799636] [LN:D90859]
[AC:D90859;AB001340] [PN:NADH DEHYDROGENASE I CHAIN N (EC 1.6.5.3)] [GN:nuoN]
[OR:Escherichia coli] [SR:Escherichia coli (strain:K12) DNA, clone_lib:Kohara
lambda minise] [DB:genpept-bct1] [DE:E.coli genomic DNA, Kohara clone
403(51.5-51.9 min.).] [NT:similar to [SwissProt Accession Number P33608]]
[LE:1466] [RE:2743] [DI:complement] >gp:[GI:g1788612] [LN:AE000317]
[AC:AE000317;U00096] [PN:NADH dehydrogenase I chain N] [GN:nuoN] [FN:enzyme;
Energy metabolism, carbon: Aerobic] [OR:Escherichia coli] [DB:genpept-bct2]
[EC:1.6.5.3] [DE:Escherichia coli K-12 MG1655 section 207 of 400 of the
completegenome.] [NT:f425; 96 pct identical to NUON_ECOLI SW: P33608] [LE:6119]
[RE:7396] [DI:complement]

| ORF Name | NT ID | AA ID | NT LN | AA LN | Score | P-value |
|---|---|---|---|---|---|---|
| 14886061_c2_1533 | 960 | 8131 | 342 | 113 | 146 | 2.8e-10 |

Description sp:[LN:YOAG_ECOLI] [AC:P76247] [GN:YOAG] [OR:Escherichia coli] [DE:HYPOTHETICAL
6.6 KD PROTEIN IN GAPA-RND INTERGENIC REGION] [SP:P76247] [DB:swissprot]
>sp:[LN:D64940] [AC:D64940] [PN:hypothetical protein b1796] [OR:Escherichia coli]
[DB:pir2] >gp:[GI:g1788097] [LN:AE000274] [AC:AE000274;U00096] [PN:orf,
hypothetical protein] [GN:yoaG] [FN:orf; Unknown] [OR:Escherichia coli]
[DB:genpept-bct2] [DE:Escherichia coli K-12 MG1655 section 164 of 400 of the
completegenome.] [NT:f60; This 60 aa ORF is 33 pct identical (2 gaps)] [LE:5142]
[RE:5324] [DI:complement]

| ORF Name | NT ID | AA ID | NT LN | AA LN | Score | P-value |
|---|---|---|---|---|---|---|
| 14942041_c2_1364 | 961 | 8132 | 195 | 64 | 70 | 0.031 |

Description gp:[GI:g211650] [LN:CHKCOXIIA] [AC:M17375] [OR:Gallus gallus] [SR:Chicken, cDNA
to mRNA, clone pMG377] [DB:genpept-vrt] [DE:Chicken alpha-1 type XII collagen
mRNA, 3' end.] [NT:type XII collagen] [LE:<1] [RE:354] [DI:direct]

| ORF_Name | NT_ID | AA_ID | NT/LN | AA/LN | Score | P-value |
|---|---|---|---|---|---|---|
| 14980161_c3_1641 | 962 | 8133 | 2100 | 699 | 2919 | 0.0 |

Description sp:[LN:CIRA_ECOLI] [AC:P17315] [GN:CIRA:CIR:FEUA] [OR:Escherichia coli]
[DE:COLICIN I RECEPTOR PRECURSOR] [SP:P17315] [DB:swissprot] >sp:[LN:QRECIC]
[AC:B64984:A32056:A33868:A28377:C41871:A35408:S24561] [PN:colicin I receptor
precursor] [GN:cir:cirA:feuA] [CL:ferrienterochelin receptor:tonB-dependent
receptor amino-terminal homology:tonB-dependent receptor carboxyl-terminal
homology] [OR:Escherichia coli] [DB:pir1] [MP:43 min] >gp:[GI:g405900]
[LN:ECOHU47] [AC:U00007] [PN:colicin I receptor] [OR:Escherichia coli]
[SR:Escherichia coli K12 BHB2600] [DB:genpept-bct1] [DE:47 to 48 centisome region
of E.coli K12 BHB2600.] [LE:52523] [RE:54514] [DI:complement] >gp:[GI:g1788478]
[LN:AE000304] [AC:AE000304:U00096] [PN:outer membrane receptor for
iron-regulated] [GN:cirA] [FN:membrane; Outer membrane constituents]
[OR:Escherichia coli] [DB:genpept-bct2] [DE:Escherichia coli K-12 MG1655 section
194 of 400 of the completegenome.] [NT:f663; 99 pct identical to CIRA_ECOLI SW:
P17315] [LE:8187] [RE:10178] [DI:complement]

| ORF_Name | NT_ID | AA_ID | NT/LN | AA/LN | Score | P-value |
|---|---|---|---|---|---|---|
| 15082693_f3_967 | 963 | 8134 | 933 | 310 | 1138 | 2.1e-115 |

Description sp:[LN:ELAC_ECOLI] [AC:Q47012:P77449] [GN:ELAC] [OR:Escherichia coli] [DE:ELAC
PROTEIN] [SP:Q47012:P77449] [DB:swissprot] >sp:[LN:B64998] [AC:B64998]
[PN:hypothetical protein b2268] [CL:conserved hypothetical protein MJ1502]
[OR:Escherichia coli] [DB:pir2] >gp:[GI:d1016823:g1799625] [LN:D90857]
[AC:D90857:AB001340] [GN:YQJK] [OR:Escherichia coli] [SR:Escherichia coli
(strain:K12) DNA, clone_lib:Kohara lambda minise] [DB:genpept-bct1] [DE:E.coli
genomic DNA, Kohara clone #380(51.1-51.4 min.).] [NT:similar to [SwissProt
Accession Number P54548]] [LE:14217] [RE:15152] [DI:direct]
>gp:[GI:d1016830:g1799633] [LN:D90858] [AC:D90858:AB001340] [GN:YQJK]
[OR:Escherichia coli] [SR:Escherichia coli (strain:K12) DNA, clone_lib:Kohara
lambda minise] [DB:genpept-bct1] [DE:E.coli genomic DNA, Kohara clone
401(51.3-51.6 min.).] [NT:similar to [SwissProt Accession Number P54548]]
[LE:3676] [RE:4611] [DI:direct] >gp:[GI:g1788603] [LN:AE000316]
[AC:AE000316:U00096] [PN:orf, hypothetical protein] [GN:elaC] [FN:orf; Unknown]
[OR:Escherichia coli] [DB:genpept-bct2] [DE:Escherichia coli K-12 MG1655 section
206 of 400 of the completegenome.] [NT:o311; This 311 aa ORF is 35 pct identical
(9 gaps)] [LE:8012] [RE:8947] [DI:direct]

| ORF Name | NT ID | AA ID | NT LN | AA LN | Score | P-value |
|---|---|---|---|---|---|---|
| 15641937_c2_1294 | 964 | 8135 | 2838 | 945 | 3879 | 0.0 |

Description sp:[LN:BVECCC] [AC:H64991:JV0069:A48659] [PN:sensor protein rcsC,:regulatory protein rcsC] [GN:rcsC] [CL:rcsC protein:response regulator homology] [OR:Escherichia coli] [EC:2.7.3.-] [DB:pir1] [MP:48 min] >gp:[GI:g1788548] [LN:AE000311] [AC:AE000311:U00096] [PN:sensor for ctr capsule biosynthesis, probable] [GN:rcsC] [FN:enzyme; Surface polysaccharides and antigens] [OR:Escherichia coli] [DB:genpept-bct2] [EC:2.7.3.-] [DE:Escherichia coli K-12 MG1655 section 201 of 400 of the completegenome.] [NT:f949; 99 pct identical RCSC_ECOLI SW: P14376] [LE:130] [RE:2931] [DI:complement]

| ORF Name | NT ID | AA ID | NT LN | AA LN | Score | P-value |
|---|---|---|---|---|---|---|
| 15672913_c1_991 | 965 | 8136 | 315 | 104 | 168 | 3.3e-12 |

Description gp:[GI:d1038870:g4512487] [LN:AB021078] [AC:AB021078] [GN:ydgA] [OR:Plasmid ColIb-P9] [SR:Plasmid ColIb-P9 (specific_host:Shigella sonnei strain P9] [DB:genpept-bct1] [DE:plasmid ColIb-P9 DNA, complete sequence.] [NT:55 pct identical (4 gaps) to] [LE:36191] [RE:37132] [DI:direct]
>gp:[GI:e1426719:g4688836] [LN:ECO238399] [AC:AJ238399] [PN:yadD homologue] [OR:Escherichia coli] [DB:genpept-bct1] [DE:Escherichia coli ColIb P-9 plasmid, ardA, psiA, psiB and ssb genesand ORF1, ORF2, ORF3, ORF4, ORF5 and ORF6.] [NT:ORF2] [LE:2503] [RE:3444] [DI:complement]

| ORF Name | NT ID | AA ID | NT LN | AA LN | Score | P-value |
|---|---|---|---|---|---|---|
| 15761035_f3_793 | 966 | 8137 | 360 | 119 | 371 | 4.0e-34 |

Description sp:[LN:B64978] [AC:B64978] [PN:hypothetical protein b2107] [CL:Escherichia coli hypothetical protein b2107] [OR:Escherichia coli] [DB:pir2] >gp:[GI:g1788424] [LN:AE000299] [AC:AE000299:U00096] [PN:orf, hypothetical protein] [GN:b2107] [FN:orf; Unknown] [OR:Escherichia coli] [DB:genpept-bct2] [DE:Escherichia coli K-12 MG1655 section 189 of 400 of the completegenome.] [NT:o172; This 172 aa ORF is 25 pct identical (2 gaps)] [LE:9449] [RE:9967] [DI:direct]

| ORF Name | NT ID | AA ID | NT LN | AA LN | Score | P-value |
|---|---|---|---|---|---|---|
| 15801625_f3_947 | 967 | 8138 | 261 | 86 | | |

Description

NO-HIT

| ORF Name | NT ID | AA ID | NT LN | AA LN | Score | P-value |
|---|---|---|---|---|---|---|
| 15815912_c2_1490 | 968 | 8139 | 1050 | 349 | 1498 | 1.5e-153 |

Description gp:[GI:g5739472] [LN:AF172324] [AC:AF172324] [PN:WbnF] [GN:wbnF] [FN:putative nucleotide sugar epimerase] [OR:Escherichia coli] [DB:genpept-bct2] [DE:Escherichia coli GalF (galF) gene, partial cds; O-antigen repeatunit transporter Wzx (wzx), WbnA (wbnA), O-antigen polymerase Wzy(wzy), WbnB (wbnB), WbnC (wbnC), WbnD (wbnD), WbnE (wbnE),UDP-Glc-4-epimerase GalE (galE), 6-phosphogluconate dehydrogenaseGnd (gnd), UDP-Glc-6-dehydrogenase Ugd (ugd), and WbnF (wbnF)genes, complete cds; and chain length determinant Wzz (wzz) gene,partial cds.] [LE:12561] [RE:13565] [DI:complement]

| ORF Name | NT ID | AA ID | NT LN | AA LN | Score | P-value |
|---|---|---|---|---|---|---|
| 15917138_f3_661 | 969 | 8140 | 294 | 97 | 144 | 1.1e-09 |

Description sp:[LN:B39066] [AC:B39066] [PN:proline-rich protein 15] [CL:proline-rich protein] [OR:Rattus norvegicus] [SR:, Norway rat] [DB:pir2]

| ORF Name | NT ID | AA ID | NT LN | AA LN | Score | P-value |
|---|---|---|---|---|---|---|
| 16021055_f3_756 | 970 | 8141 | 222 | 73 | | |

Description

NO-HIT

| ORF Name | NT ID | AA ID | NT LN | AA LN | Score | P-value |
|---|---|---|---|---|---|---|
| 16040956_f1_232 | 971 | 8142 | 765 | 254 | 634 | 5.5e-62 |

Description gp:[GI:e1541793:g5824091] [LN:SCF85] [AC:AL110470] [PN:regulator] [GN:SCF85.10] [OR:Streptomyces coelicolor A3(2)] [DB:genpept-bct1] [DE:Streptomyces coelicolor cosmid F85.] [NT:SCF85.10, probable regulator, Len 254 aa. similar] [LE:9054] [RE:9818] [DI:direct]

| ORF Name | NT ID | AA ID | NT LN | AA LN | Score | P-value |
|---|---|---|---|---|---|---|
| 16052091_f3_968 | 972 | 8143 | 1302 | 433 | 137 | 1.5e-05 |

Description gp:[GI:g190396] [LN:HUMPROFILA] [AC:M60494:J02929] [PN:profilaggrin] [GN:FLG] [OR:Homo sapiens] [SR:Human placenta DNA, clone g-lambda-HF5] [DB:genpept-pri2] [DE:Human profilaggrin gene, 3' end.] [NT:potential; putative] [LE:1478] [RE:4447] [DI:direct]

| ORF Name | NT ID | AA ID | NT LN | AA LN | Score | P-value |
|---|---|---|---|---|---|---|
| 16147706_f3_677 | 973 | 8144 | 375 | 124 | 249 | 3.4e-21 |

Description sp:[LN:E69767] [AC:E69767] [PN:transcription regulator ArsR family homolog yczG]
[GN:yczG] [CL:arsenical resistance operon repressor] [OR:Bacillus subtilis]
[DB:pir2] >gp:[GI:e1182355:g2632689] [LN:BSUB0003] [AC:Z99106:AL009126] [GN:yczG]
[FN:unknown] [OR:Bacillus subtilis] [DB:genpept-bct1] [DE:Bacillus subtilis
complete genome (section 3 of 21): from 402751 to611850.] [NT:similar to
transcriptional regulator (ArsR family)] [LE:36539] [RE:36853] [DI:direct]

| ORF Name | NT ID | AA ID | NT LN | AA LN | Score | P-value |
|---|---|---|---|---|---|---|
| 16204406_c2_1521 | 974 | 8145 | 378 | 125 | 525 | 1.9e-50 |

Description sp:[LN:YEEX_ECOLI] [AC:P76367:O07995:O07992] [GN:YEEX] [OR:Escherichia coli]
[DE:HYPOTHETICAL 15.1 KD PROTEIN IN COBU-SBMC INTERGENIC REGION]
[SP:P76367:O07995:O07992] [DB:swissprot] >sp:[LN:F64965] [AC:F64965]
[PN:hypothetical protein b2007] [OR:Escherichia coli] [DB:pir2]
>gp:[GI:d1016552:g1736673] [LN:D90838] [AC:D90838:AB001340] [OR:Escherichia coli]
[SR:Escherichia coli (strain:K12) DNA, clone_lib:Kohara lambda minise]
[DB:genpept-bct1] [DE:E.coli genomic DNA, Kohara clone #348(44.5-44.9 min.).]
[NT:ORF_ID:o348#19; similar to [SwissProt Accession] [LE:14598] [RE:14993]
[DI:complement] >gp:[GI:d1016559:g1736681] [LN:D90839] [AC:D90839:AB001340]
[OR:Escherichia coli] [SR:Escherichia coli (strain:K12) DNA, clone_lib:Kohara
lambda minise] [DB:genpept-bct1] [DE:E.coli genomic DNA, Kohara clone
349(44.6-45.0 min.).] [NT:ORF_ID:o348#19; similar to [SwissProt Accession]
[LE:7684] [RE:8079] [DI:complement] >gp:[GI:g1788317] [LN:AE000292]
[AC:AE000292:U00096] [PN:putative alpha helix protein] [GN:yeeX] [FN:phenotype;
Not classified] [OR:Escherichia coli] [DB:genpept-bct2] [DE:Escherichia coli K-12
MG1655 section 182 of 400 of the completegenome.] [NT:f131; residues 29-113 are
62 pct identical to] [LE:4347] [RE:4742] [DI:complement]

| ORF Name | NT ID | AA ID | NT LN | AA LN | Score | P-value |
|---|---|---|---|---|---|---|
| 16204693_f1_92 | 975 | 8146 | 624 | 207 | 102 | 0.0012 |

Description gp:[GI:g4096799] [LN:SCU40158] [AC:U40158] [OR:Staphylococcus carnosus]
[DB:genpept-bct2] [DE:Staphylococcus carnosus response regulator-like protein
(orfx)gene, partial cds.] [NT:orfx; function unknown; similar to response]
[LE:<1] [RE:560] [DI:direct]

| ORF Name | NT ID | AA ID | NT LN | AA LN | Score | P-value |
|---|---|---|---|---|---|---|
| 16284581_f3_953 | 976 | 8147 | 276 | 91 | | |

Description

NO-HIT

| ORF Name | NT ID | AA ID | NT/LN | AA/LN | Score | P-value |
|---|---|---|---|---|---|---|
| 16292682_f1_95 | 977 | 8148 | 3141 | 1046 | 4685 | 0.0 |

Description sp:[LN:YEGN_ECOLI] [AC:P76398:O08005] [GN:YEGN] [OR:Escherichia coli]
[DE:HYPOTHETICAL 112.1 KD PROTEIN IN ALKA-BAES INTERGENIC REGION]
[SP:P76398:O08005] [DB:swissprot] >sp:[LN:B64974] [AC:B64974] [PN:hypothetical
protein b2075] [CL:hypothetical protein b2075] [OR:Escherichia coli] [DB:pir2]
>gp:[GI:d1016653:g1736781] [LN:D90845] [AC:D90845:AB001340] [PN:Acriflavin
resistance protein D.] [OR:Escherichia coli] [SR:Escherichia coli (strain:K12)
DNA, clone_lib:Kohara lambda minise] [DB:genpept-bct1] [DE:E.coli genomic DNA,
Kohara clone #356(46.1-46.5 min.).] [NT:ORF_ID:o356#9; similar to [SwissProt
Accession] [LE:13984] [RE:17106] [DI:direct] >gp:[GI:g1788390] [LN:AE000297]
[AC:AE000297:U00096] [PN:orf, hypothetical protein] [GN:yegN] [FN:Unknown]
[OR:Escherichia coli] [DB:genpept-bct2] [DE:Escherichia coli K-12 MG1655 section
187 of 400 of the completegenome.] [NT:o1040; This 1040 aa ORF is 30 pct
identical] [LE:8656] [RE:11778] [DI:direct]

| ORF Name | NT ID | AA ID | NT/LN | AA/LN | Score | P-value |
|---|---|---|---|---|---|---|
| 16297512_c2_1411 | 978 | 8149 | 1185 | 394 | 1258 | 4.1e-128 |

Description sp:[LN:THID_ECOLI] [AC:P76422] [GN:THID] [OR:Escherichia coli] [EC:2.7.4.7]
[DE:(HMP-P KINASE)] [SP:P76422] [DB:swissprot] >sp:[LN:F64977] [AC:F64977]
[PN:hypothetical protein b2103] [CL:phosphomethylpyrimidine phosphate kinase]
[OR:Escherichia coli] [DB:pir2] >gp:[GI:d1040495:g4589382] [LN:D84200]
[AC:D84200] [PN:phosphomethylpyrimidine kinase] [GN:thiD] [OR:Escherichia coli]
[SR:Escherichia coli (strain:W3310) DNA, clone_lib:Kohara 8F4] [DB:genpept-bct1]
[DE:Escherichia coli DNA for phosphomethylpyrimidine kinase, completecds.] [LE:1]
[RE:801] [DI:direct] >gp:[GI:d1016696:g1736827] [LN:D90848] [AC:D90848:AB001340]
[OR:Escherichia coli] [SR:Escherichia coli (strain:K12) DNA, clone_lib:Kohara
lambda minise] [DB:genpept-bct1] [DE:E.coli genomic DNA, Kohara clone
359(46.8-47.2 min.).] [NT:ORF_ID:o359#15; similar to [SwissProt Accession]
[LE:11637] [RE:12437] [DI:complement] >gp:[GI:g1788420] [LN:AE000299]
[AC:AE000299:U00096] [PN:phosphomethylpyrimidine kinase] [GN:thiD] [FN:enzyme;
Biosynthesis of cofactors, carriers:] [OR:Escherichia coli] [DB:genpept-bct2]
[DE:Escherichia coli K-12 MG1655 section 189 of 400 of the completegenome.]
[NT:f266; This 266 aa ORF is 42 pct identical (7 gaps)] [LE:6385] [RE:7185]
[DI:complement]

| ORF Name | NT ID | AA ID | NT/LN | AA/LN | Score | P-value |
|---|---|---|---|---|---|---|
| 16307035_c3_1725 | 979 | 8150 | 1269 | 422 | 162 | 3.0e-08 |

Description gp:[GI:g190394] [LN:HUMPROFIL2] [AC:M60503] [PN:profilaggrin] [OR:Homo sapiens]
[SR:Human placenta DNA, clone g-lambda-HF222] [DB:genpept-pri2] [DE:Human
profilaggrin gene, 3' end.] [LE:M60501.1:1:1] [RE:1381:1876] [DI:directJoin]

| ORF Name | NT ID | AA ID | NT LN | AA LN | Score | P-value |
|---|---|---|---|---|---|---|
| 16307633_f3_859 | 980 | 8151 | 315 | 104 | 122 | 3.2e-07 |

Description sp:[LN:YEIP_ECOLI] [AC:P33028] [GN:YEIP] [OR:Escherichia coli] [DE:HYPOTHETICAL 30.9 KD PROTEIN IN FRUB-SPR INTERGENIC REGION] [SP:P33028] [DB:swissprot] >sp:[LN:B64986] [AC:B64986] [PN:hypothetical 30.9 kD protein in fruB 5'region] [GN:yeiP] [OR:Escherichia coli] [DB:pir2] >gp:[GI:d1016705:g1736837] [LN:D90849] [AC:D90849:AB001340] [PN:Elongation factor P (EF-P).] [GN:yeiP] [OR:Escherichia coli] [SR:Escherichia coli (strain:K12) DNA, clone_lib:Kohara lambda minise] [DB:genpept-bct1] [DE:E.coli genomic DNA, Kohara clone #369(48.6-49.0 min.).] [NT:ORF_ID:o369#3; similar to [SwissProt Accession] [LE:4880] [RE:5707] [DI:direct] >gp:[GI:g405887] [LN:ECOHU47] [AC:U00007] [PN:yeiP] [OR:Escherichia coli] [SR:Escherichia coli K12 BHB2600] [DB:genpept-bct1] [DE:47 to 48 centisome region of E.coli K12 BHB2600.] [NT:homolog of elongation factor P.] [LE:72939] [RE:73766] [DI:direct] >gp:[GI:g1788496] [LN:AE000306] [AC:AE000306:U00096] [PN:putative elongation factor] [GN:yeiP] [FN:putative factor; Not classified] [OR:Escherichia coli] [DB:genpept-bct2] [DE:Escherichia coli K-12 MG1655 section 196 of 400 of the completegenome.] [NT:o275; 100 pct identical to YEIP_ECOLI SW: P33028] [LE:7843] [RE:8670] [DI:direct]

| ORF Name | NT ID | AA ID | NT LN | AA LN | Score | P-value |
|---|---|---|---|---|---|---|
| 163886_c3_1546 | 981 | 8152 | 1698 | 565 | 2507 | 1.8e-260 |

Description gp:[GI:d1016817:g1799619] [LN:D90857] [AC:D90857:AB001340] [PN:2-SUCCINYL-6-HYDROXY-2,] [GN:menD] [OR:Escherichia coli] [SR:Escherichia coli (strain:K12) DNA, clone_lib:Kohara lambda minise] [DB:genpept-bct1] [DE:E.coli genomic DNA, Kohara clone #380(51.1-51.4 min.).] [NT:similar to [SwissProt Accession Number P17109]] [LE:10216] [RE:12090] [DI:complement]

| ORF Name | NT ID | AA ID | NT LN | AA LN | Score | P-value |
|---|---|---|---|---|---|---|
| 16442953_c1_1205 | 982 | 8153 | 1143 | 380 | 1914 | 1.3e-197 |

Description gp:[GI:g557195] [LN:KPNRFBC] [AC:L31762] [PN:galactosyl transferase] [GN:wbbO] [OR:Klebsiella pneumoniae] [DB:genpept-bct2] [DE:Klebsiella pneumoniae wbbM, glf, wbbN, and galactosyl transferase(wbbO) genes, complete cds.] [NT:putative] [LE:4042] [RE:5175] [DI:direct]

| ORF Name | NT ID | AA ID | NT LN | AA LN | Score | P-value |
|---|---|---|---|---|---|---|
| 16447178_f2_363 | 983 | 8154 | 1485 | 494 | | |

Description

NO-HIT

| ORF Name | NT ID | AA ID | NT LN | AA LN | Score | P-value |
|---|---|---|---|---|---|---|
| 16598452_f3_917 | 984 | 8155 | 1245 | 414 | | |

Description

NO-HIT

| ORF Name | NT ID | AA ID | NT LN | AA LN | Score | P-value |
|---|---|---|---|---|---|---|
| 16603300_c2_1401 | 985 | 8156 | 1146 | 381 | 1801 | 1.2e-185 |

Description sp:[LN:MRP_ECOLI] [AC:P21590] [GN:MRP] [OR:Escherichia coli] [DE:MRP PROTEIN]
[SP:P21590] [DB:swissprot] >sp:[LN:H64978] [AC:H64978:S11948] [PN:probable ATPase
mrp] [GN:mrp] [CL:conserved probable membrane protein YIL003w] [OR:Escherichia
coli] [DB:pir2] >gp:[GI:g405896] [LN:ECOHU47] [AC:U00007] [PN:mrp]
[OR:Escherichia coli] [SR:Escherichia coli K12 BHB2600] [DB:genpept-bct1] [DE:47
to 48 centisome region of E.coli K12 BHB2600.] [NT:ATPase of unknown function.]
[LE:5827] [RE:6966] [DI:complement] >gp:[GI:g1788431] [LN:AE000300]
[AC:AE000300:U00096] [PN:putative ATPase] [GN:mrp] [FN:putative enzyme; Not
classified] [OR:Escherichia coli] [DB:genpept-bct2] [DE:Escherichia coli K-12
MG1655 section 190 of 400 of the completegenome.] [NT:f379; 100 pct identical to
MRP_ECOLI SW: P21590] [LE:5750] [RE:6889] [DI:complement]

| ORF Name | NT ID | AA ID | NT LN | AA LN | Score | P-value |
|---|---|---|---|---|---|---|
| 16688540_c2_1273 | 986 | 8157 | 1395 | 464 | 1749 | 3.8e-180 |

Description sp:[LN:MENE_ECOLI] [AC:P37353:P78253:P78178] [GN:MENE] [OR:Escherichia coli]
[EC:6.2.1.26] [DE:(O-SUCCINYLBENZOATE-COA SYNTHASE)] [SP:P37353:P78253:P78178]
[DB:swissprot] >sp:[LN:B64997] [AC:B64997] [PN:O-succinylbenzoate--CoA ligase,]
[GN:menE] [CL:O-succinylbenzoate--CoA ligase] [OR:Escherichia coli] [EC:6.2.1.26]
[DB:pir2] >gp:[GI:d1016812:g1799614] [LN:D90857] [AC:D90857:AB001340]
[PN:O-SUCCINYLBENZOIC ACID--COA LIGASE (EC 6.2.1.26)] [GN:menE] [OR:Escherichia
coli] [SR:Escherichia coli (strain:K12) DNA, clone_lib:Kohara lambda minise]
[DB:genpept-bct1] [DE:E.coli genomic DNA, Kohara clone #380(51.1-51.4 min.).]
[NT:similar to [SwissProt Accession Number P37353]] [LE:6275] [RE:7630]
[DI:complement] >gp:[GI:g1788595] [LN:AE000316] [AC:AE000316:U00096]
[PN:o-succinylbenzoate-CoA ligase] [GN:menE] [FN:enzyme; Biosynthesis of
cofactors, carriers:] [OR:Escherichia coli] [DB:genpept-bct2] [EC:6.2.1.26]
[DE:Escherichia coli K-12 MG1655 section 206 of 400 of the completegenome.]
[NT:f451; 99 pct identical to MENE_ECOLI SW: P37353] [LE:70] [RE:1425]
[DI:complement]

| ORF Name | NT ID | AA ID | NT/LN | AA/LN | Score | P-value |
|---|---|---|---|---|---|---|
| 16839062_c2_1481 | 987 | 8158 | 1029 | 342 | 727 | 7.6e-72 |

Description sp:[LN:S22619] [AC:S22619] [PN:hypothetical protein] [OR:Salmonella choleraesuis] [DB:pir2] >gp:[GI:g47011] [LN:SERFBC2] [AC:X61917] [PN:second mannosyl transferase] [OR:Salmonella enterica] [DB:genpept-bct1] [DE:S.enterica rfbJ gene cluster.] [NT:wbaW; Referred to as orf17.9 in reference [2]] [LE:6313] [RE:7323] [DI:direct]

| ORF Name | NT ID | AA ID | NT/LN | AA/LN | Score | P-value |
|---|---|---|---|---|---|---|
| 16881256_c2_1417 | 988 | 8159 | 249 | 82 | 411 | 2.3e-38 |

Description sp:[LN:RBTR_KLEAE] [AC:P07760] [GN:RBTR] [OR:Klebsiella aerogenes] [DE:RIBITOL OPERON REPRESSOR (RBT OPERON REPRESSOR)] [SP:P07760] [DB:swissprot] >sp:[LN:A22839] [AC:A22839] [PN:rbt operon repressor] [GN:rbtR] [OR:Klebsiella pneumoniae] [DB:pir2] >gp:[GI:g43781] [LN:KARBT] [AC:X02448] [OR:Klebsiella aerogenes] [DB:genpept-bct1] [DE:Klebsiella aerogenes ribitol (rbt) operon control region.] [NT:repressor protein (rbt-R) (aa 1-270)] [SP:P07760] [LE:459] [RE:1271] [DI:direct]

| ORF Name | NT ID | AA ID | NT/LN | AA/LN | Score | P-value |
|---|---|---|---|---|---|---|
| 16896931_f1_206 | 989 | 8160 | 441 | 146 | 102 | 8.4e-06 |

Description gp:[GI:e228728:g1228093] [LN:SAPKSGENE] [AC:Z46913] [PN:polyketide synthase] [OR:Streptomyces ambofaciens] [DB:genpept-bct1] [DE:S.ambofaciens gene for hypothetical polyketide gene.] [NT:putative] [LE:<1] [RE:>3596] [DI:direct]

| ORF Name | NT ID | AA ID | NT/LN | AA/LN | Score | P-value |
|---|---|---|---|---|---|---|
| 16900665_f2_615 | 990 | 8161 | 294 | 97 | | |

Description

NO-HIT

| ORF Name | NT ID | AA ID | NT/LN | AA/LN | Score | P-value |
|---|---|---|---|---|---|---|
| 16911056_f3_774 | 991 | 8162 | 774 | 257 | 1241 | 2.6e-126 |

Description gp:[GI:g149319] [LN:KPNRBTDK] [AC:M25606] [OR:Klebsiella aerogenes] [SR:K.aerogenes DNA, clones lambda-[prbt,prbt dal] and pJCW1] [DB:genpept-bct1] [DE:K.aerogenes ribitol dehydrogenase (rbtD and rbtK) genes, completecds and 5' end respectively.] [NT:ribitol dehydrogenase rbtD] [LE:28] [RE:777] [DI:direct]

| ORF Name | NT ID | AA ID | NT LN | AA LN | Score | P-value |
|---|---|---|---|---|---|---|
| 16922830_c1_983 | 992 | 8163 | 285 | 94 | 108 | 3.0e-06 |

Description gp:[GI:d1016819:g1799621] [LN:D90857] [AC:D90857:AB001340] [PN:menD protein] [GN:menD] [OR:Escherichia coli] [SR:Escherichia coli (strain:K12) DNA, clone_lib:Kohara lambda minise] [DB:genpept-bct1] [DE:E.coli genomic DNA, Kohara clone #380(51.1-51.4 min.).] [NT:similar to [PIR Accession Number A33860]] [LE:11199] [RE:11408] [DI:complement] >gp:[GI:d1016826:g1799629] [LN:D90858] [AC:D90858:AB001340] [PN:menD protein] [GN:menD] [OR:Escherichia coli] [SR:Escherichia coli (strain:K12) DNA, clone_lib:Kohara lambda minise] [DB:genpept-bct1] [DE:E.coli genomic DNA, Kohara clone #401(51.3-51.6 min.).] [NT:similar to [PIR Accession Number A33860]] [LE:658] [RE:867] [DI:complement]

| ORF Name | NT ID | AA ID | NT LN | AA LN | Score | P-value |
|---|---|---|---|---|---|---|
| 16932753_f1_209 | 993 | 8164 | 756 | 251 | 858 | 1.0e-85 |

Description sp:[LN:YEIU_ECOLI] [AC:P76445] [GN:YEIU] [OR:Escherichia coli] [DE:HYPOTHETICAL 26.8 KD PROTEIN IN FRUB-SPR INTERGENIC REGION] [SP:P76445] [DB:swissprot]

| ORF Name | NT ID | AA ID | NT LN | AA LN | Score | P-value |
|---|---|---|---|---|---|---|
| 16994033_c2_1394 | 994 | 8165 | 741 | 246 | 906 | 8.2e-91 |

Description sp:[LN:YEHW_ECOLI] [AC:P33359] [GN:YEHW] [OR:Escherichia coli] [DE:HYPOTHETICAL ABC TRANSPORTER PERMEASE PROTEIN YEHW] [SP:P33359] [DB:swissprot] >sp:[LN:G64980] [AC:G64980] [PN:hypothetical 25.5 kD protein in molR-bglX intergenic region] [GN:yehW] [CL:glycine betaine/carnitine/choline ABC transporter] [OR:Escherichia coli] [DB:pir1] >gp:[GI:g405859] [LN:ECOHU47] [AC:U00007] [PN:yehW] [OR:Escherichia coli] [SR:Escherichia coli K12 BHB2600] [DB:genpept-bct1] [DE:47 to 48 centisome region of E.coli K12 BHB2600.] [NT:probable membrane component of transport complex.] [LE:28514] [RE:29245] [DI:complement] >gp:[GI:g1788449] [LN:AE000302] [AC:AE000302:U00096] [PN:putative transport system permease protein] [GN:yehW] [FN:putative transport; Not classified] [OR:Escherichia coli] [DB:genpept-bct2] [DE:Escherichia coli K-12 MG1655 section 192 of 400 of the completegenome.] [NT:f243; 100 pct identical to YEHW_ECOLI SW: P33359] [LE:1020] [RE:1751] [DI:complement]

| ORF Name | NT ID | AA ID | NT LN | AA LN | Score | P-value |
|---|---|---|---|---|---|---|
| 17048950_c2_1280 | 995 | 8166 | 1332 | 443 | 1899 | 4.9e-196 |

Description sp:[LN:D64995] [AC:D64995] [PN:hypothetical protein b2246] [OR:Escherichia coli] [DB:pir2] >gp:[GI:g1788579] [LN:AE000314] [AC:AE000314:U00096] [PN:putative transport protein] [GN:b2246] [FN:putative transport; Not classified] [OR:Escherichia coli] [DB:genpept-bct2] [DE:Escherichia coli K-12 MG1655 section 204 of 400 of the completegenome.] [NT:f442; 31 pct identical (9 gaps) to 425 residues] [LE:9314] [RE:10642] [DI:complement]

| ORF Name | NT ID | AA ID | NT LN | AA LN | Score | P-value |
|---|---|---|---|---|---|---|
| 17069465_c3_1740 | 996 | 8167 | 894 | 297 | 980 | 1.2e-98 |

Description sp:[LN:3MG2_ECOLI] [AC:P04395] [GN:ALKA:AIDA] [OR:Escherichia coli] [EC:3.2.2.21]
[DE:II)] [SP:P04395] [DB:swissprot] >sp:[LN:DGECMA] [AC:A00904:C64973]
[PN:DNA-3-methyladenine glycosidase II,] [GN:alkA] [CL:3-methyladenine DNA
glycosylase II] [OR:Escherichia coli] [EC:3.2.2.21] [DB:pir1] [MP:43 min]
>gp:[GI:d1016650:g1736778] [LN:D90845] [AC:D90845:AB001340]
[PN:DNA-3-methyladenine glycosidase II (EC 3.2.2.21)] [GN:alkA, aidA]
[OR:Escherichia coli] [SR:Escherichia coli (strain:K12) DNA, clone_lib:Kohara
lambda minise] [DB:genpept-bct1] [DE:E.coli genomic DNA, Kohara clone
356(46.1-46.5 min.).] [NT:ORF_ID:o356#1; similar to [SwissProt Accession]
[LE:5413] [RE:6261] [DI:complement] >gp:[GI:g145226] [LN:ECOALKA] [AC:K02498]
[PN:3-methyladenine DNA glycosylase II] [GN:alkA] [OR:Escherichia coli] [SR:E.
coli K12 (strain W363) DNA, clone pYN1000] [DB:genpept-bct1] [DE:E. coli alkA
gene encoding 3-methyladenine DNA glycosylase II,complete cds.] [LE:572]
[RE:1420] [DI:direct] >gp:[GI:g1788383] [LN:AE000297] [AC:AE000297:U00096]
[PN:3-methyl-adenine DNA glycosylase II, inducible] [GN:alkA] [FN:enzyme; DNA -
replication, repair,] [OR:Escherichia coli] [DB:genpept-bct2] [EC:3.2.2.21]
[DE:Escherichia coli K-12 MG1655 section 187 of 400 of the completegenome.]
[NT:f282; 100 pct identical to 3MG2_ECOLI SW: P04395;] [LE:85] [RE:933]
[DI:complement]

| ORF Name | NT ID | AA ID | NT LN | AA LN | Score | P-value |
|---|---|---|---|---|---|---|
| 19645093_c1_1027 | 997 | 8168 | 1092 | 363 | 1219 | 5.6e-124 |

Description gp:[GI:g145191] [LN:ECOADAA] [AC:M10315] [OR:Escherichia coli] [SR:E.coli (strain
B/r) DNA, clone pCS68] [DB:genpept-bct1] [DE:E.coli (strain B) ada gene coding
for Ada polyprotein, regulatoryprotein of adaptive response.] [NT:Ada
polyprotein] [LE:102] [RE:1166] [DI:direct]

| ORF Name | NT ID | AA ID | NT LN | AA LN | Score | P-value |
|---|---|---|---|---|---|---|
| 19704533_f1_18 | 998 | 8169 | 426 | 141 | 397 | 7.1e-37 |

Description sp:[LN:YRDN_BACSU] [AC:P94502:O08187] [GN:YRDN] [OR:Bacillus subtilis]
[DE:HYPOTHETICAL PROTEIN IN CZCD-GLTR INTERGENIC REGION (ORF129)]
[SP:P94502:O08187] [DB:swissprot] >sp:[LN:E69973] [AC:E69973] [PN:hypothetical
protein yrdN] [GN:yrdN] [CL:hypothetical protein yrdN] [OR:Bacillus subtilis]
[DB:pir1] >gp:[GI:g1710376] [LN:BSU79494] [AC:U79494] [PN:Orf129] [GN:orf129]
[FN:putative target of GltR] [OR:Bacillus subtilis] [DB:genpept-bct1]
[DE:Bacillus subtilis BrnQ (brnQ), Orf105 (orf105), LysR-typetranscription
regulator GltR (gltR) and Orf129 (orf129) genes,complete cds.] [NT:putative 15K
protein] [LE:3076] [RE:3465] [DI:direct] >gp:[GI:e1183895:g2635111] [LN:BSUB0014]
[AC:Z99117:AL009126] [GN:yrdN] [FN:unknown] [OR:Bacillus subtilis]
[DB:genpept-bct1] [DE:Bacillus subtilis complete genome (section 14 of 21): from
2594510 2812870.] [LE:124933] [RE:125322] [DI:complement] >gp:[GI:g1934655]
[LN:BSU93876] [AC:U93876] [PN:YrdN] [GN:yrdN] [OR:Bacillus subtilis]
[DB:genpept-bct2] [DE:Bacillus subtilis aminoglycoside 6-adenylyltransferase
(aadK) gene,partial cds, and YrdA (yrdA), YrdB (yrdB), hypothetical proteinYrdC
(yrdC), YrdD (yrdD), hypothetical cytochrome P450 protein YrdE(yrdE),
ribonuclease inhibitor (yrdF), regulatory protein YrdG(yrdG), hypothetical
protein YrdH (yrdH), hypothetical protein YrdI(yrdI), amino acid transporter
(yrdJ), YrdK (yrdK), LysR familyregulatory protein YrdL (yrdL), YrdN (yrdN),
cation transportprotein YrdO (yrdO), hypothetical protein YrdP (yrdP), LysR
familytranscription regulator YrdQ (yrdQ), hypothetical protein YrdR(yrdR) and
hypothetical protein YrkA (yrkA) genes, complete cds.] [LE:10966] [RE:11355]
[DI:direct]

| ORF Name | NT ID | AA ID | NT LN | AA LN | Score | P-value |
|---|---|---|---|---|---|---|
| 19814763_c3_1756 | 999 | 8170 | 1167 | 388 | 1336 | 2.2e-136 |

Description sp:[LN:S22620] [AC:S22620] [PN:hypothetical protein] [CL:hypothetical protein
sll1534] [OR:Salmonella choleraesuis] [DB:pir2] >gp:[GI:g47012] [LN:SERFBC2]
[AC:X61917] [PN:first mannosyl transferase] [OR:Salmonella enterica]
[DB:genpept-bct1] [DE:S.enterica rfbJ gene cluster.] [NT:wbaZ; Referred to as
orf18.9 in reference [2]] [LE:7310] [RE:8467] [DI:direct]

| ORF Name | NT ID | AA ID | NT LN | AA LN | Score | P-value |
|---|---|---|---|---|---|---|
| 1986661_f2_552 | 1000 | 8171 | 1824 | 607 | 2555 | 1.5e-265 |

Description sp:[LN:YEJA_ECOLI] [AC:P33913:P76447] [GN:YEJA] [OR:Escherichia coli]
[DE:HYPOTHETICAL 69.7 KD PROTEIN IN RTN-BCR INTERGENIC REGION PRECURSOR]
[SP:P33913:P76447] [DB:swissprot]

| ORF Name | NT ID | AA ID | NT LN | AA LN | Score | P-value |
|---|---|---|---|---|---|---|
| 20056588_cl_1152 | 1001 | 8172 | 876 | 291 | 609 | 2.4e-59 |

Description sp:[LN:Y4TR_RHISN] [AC:Q53193] [GN:Y4TR] [OR:Rhizobium sp] [SR:,strain NGR234]
[DE:PROBABLE PEPTIDE ABC TRANSPORTER ATP-BINDING PROTEIN Y4TR] [SP:Q53193]
[DB:swissprot] >gp:[GI:e213886:g1486422] [LN:RSPNGR234] [AC:Z68203] [PN:OppD
homologue] [GN:orf3] [OR:Rhizobium sp.] [SR:Rhizobium sp] [DB:genpept-bct1]
[DE:Rhizobium sp. plasmid NGR234a DNA.] [NT:putative; at pos. 1443 also T
possible without] [SP:Q53193] [LE:1505] [RE:2512] [DI:direct] >gp:[GI:g2182648]
[LN:AE000098] [AC:AE000098:U00090] [PN:Y4tR] [GN:y4tR] [OR:Rhizobium sp. NGR234]
[DB:genpept-bct2] [DE:Rhizobium sp. NGR234 plasmid pNGR234a, section 35 of 46 of
thecomplete plasmid sequence.] [NT:probable peptide ABC transporter ATP-binding]
[LE:13785] [RE:14792] [DI:direct]

| ORF Name | NT ID | AA ID | NT LN | AA LN | Score | P-value |
|---|---|---|---|---|---|---|
| 20312805_f1_197 | 1002 | 8173 | 1107 | 368 | 1519 | 9.0e-156 |

Description sp:[LN:YEIH_ECOLI] [AC:P33019] [GN:YEIH] [OR:Escherichia coli] [DE:HYPOTHETICAL
36.9 KD PROTEIN IN LYSP-NFO INTERGENIC REGION] [SP:P33019] [DB:swissprot]
>sp:[LN:E64984] [AC:E64984] [PN:hypothetical 36.9 kD protein in lysP-nfo
intergenic region] [GN:yeiH] [OR:Escherichia coli] [DB:pir2] >gp:[GI:g405879]
[LN:ECOHU47] [AC:U00007] [PN:yeiH] [OR:Escherichia coli] [SR:Escherichia coli K12
BHB2600] [DB:genpept-bct1] [DE:47 to 48 centisome region of E.coli K12 BHB2600.]
[LE:57462] [RE:58511] [DI:direct] >gp:[GI:g1788482] [LN:AE000305]
[AC:AE000305:U00096] [PN:orf, hypothetical protein] [GN:yeiH] [FN:orf; Unknown]
[OR:Escherichia coli] [DB:genpept-bct2] [DE:Escherichia coli K-12 MG1655 section
195 of 400 of the completegenome.] [NT:o349; 100 pct identical to YEIH_ECOLI SW:
P33019] [LE:2831] [RE:3880] [DI:direct]

| ORF Name | NT ID | AA ID | NT LN | AA LN | Score | P-value |
|---|---|---|---|---|---|---|
| 20441253_cl_1057 | 1003 | 8174 | 390 | 129 | | |

Description

NO-HIT

| ORF_Name | NT ID | AA ID | NT/LN | AA/LN | Score | P-value |
|---|---|---|---|---|---|---|
| 20501562_c2_1426 | 1004 | 8175 | 1737 | 578 | 418 | 4.2e-39 |

Description gp:[GI:d1015861:g1742427] [LN:D90789] [AC:D90789:AB001340] [PN:Periplasmic dipeptide transport protein] [OR:Escherichia coli] [SR:Escherichia coli (strain:K12) DNA, clone_lib:Kohara lambda minise] [DB:genpept-bct1] [DE:E.coli genomic DNA, Kohara clone #278(33.3-33.7 min.).] [NT:ORF_ID:o279#5; similar to [SwissProt Accession] [LE:15111] [RE:16799] [DI:complement]
>gp:[GI:d1015871:g1742438] [LN:D90790] [AC:D90790:AB001340] [PN:Periplasmic dipeptide transport protein] [OR:Escherichia coli] [SR:Escherichia coli (strain:K12) DNA, clone_lib:Kohara lambda minise] [DB:genpept-bct1] [DE:E.coli genomic DNA, Kohara clone #279(33.5-33.9 min.).] [NT:ORF_ID:o279#5; similar to [SwissProt Accession] [LE:7214] [RE:8902] [DI:complement]

| ORF_Name | NT ID | AA ID | NT/LN | AA/LN | Score | P-value |
|---|---|---|---|---|---|---|
| 20521005_f2_574 | 1005 | 8176 | 489 | 162 | 115 | 1.9e-05 |

Description sp:[LN:A36128] [AC:A36128] [PN:regulatory protein algP] [OR:Pseudomonas aeruginosa] [DB:pir2]

| ORF_Name | NT ID | AA ID | NT/LN | AA/LN | Score | P-value |
|---|---|---|---|---|---|---|
| 2063750_c1_1189 | 1006 | 8177 | 1521 | 506 | 2144 | 5.3e-222 |

Description gp:[GI:g4512008] [LN:AF104912] [AC:AF104912] [PN:UDP-Gal::undecaprenolphosphate Gal-1-P] [GN:wbaP] [OR:Escherichia coli] [DB:genpept-bct2] [DE:Escherichia coli K30 capsule biosynthesis cluster, partialsequence.] [NT:glycosyltransferase] [LE:6168] [RE:7598] [DI:direct]

| ORF_Name | NT ID | AA ID | NT/LN | AA/LN | Score | P-value |
|---|---|---|---|---|---|---|
| 20882711_f2_567 | 1007 | 8178 | 1773 | 590 | 2523 | 3.7e-262 |

Description sp:[LN:YEJM_ECOLI] [AC:P33922:P33923] [GN:YEJM] [OR:Escherichia coli] [DE:HYPOTHETICAL 67.3 KD PROTEIN IN RPLY-PROL INTERGENIC REGION] [SP:P33922:P33923] [DB:swissprot] >sp:[LN:C64988] [AC:C64988] [PN:hypothetical 67.3 kD protein in rplY-proL intergenic region] [GN:yejM] [CL:hypothetical protein HI0841] [OR:Escherichia coli] [DB:pir1] >gp:[GI:g453987] [LN:ECOHU49] [AC:U00008] [PN:yejM] [OR:Escherichia coli] [SR:Escherichia coli K12 BHB2600] [DB:genpept-bct1] [DE:centisome 49 region of E.coli K12 BHB2600.] [LE:11429] [RE:13189] [DI:direct] >gp:[GI:g1788515] [LN:AE000308] [AC:AE000308:U00096] [PN:putative sulfatase] [GN:yejM] [FN:putative enzyme; Not classified] [OR:Escherichia coli] [DB:genpept-bct2] [DE:Escherichia coli K-12 MG1655 section 198 of 400 of the completegenome.] [NT:o586; 100 pct identical to YEJM_ECOLI SW: P33922] [LE:6003] [RE:7763] [DI:direct]

402

| ORF Name | NT ID | AA ID | NT LN | AA LN | Score | P-value |
|---|---|---|---|---|---|---|
| 20964782_f2_566 | 1008 | 8179 | 396 | 131 | 320 | 1.0e-28 |

Description sp:[LN:YEJL_ECOLI] [AC:P33921] [GN:YEJL] [OR:Escherichia coli] [DE:HYPOTHETICAL
8.3 KD PROTEIN IN RPLY-PROL INTERGENIC REGION] [SP:P33921] [DB:swissprot]
>sp:[LN:B64988] [AC:B64988] [PN:hypothetical 8.3 kD protein in rplY-proL
intergenic region] [GN:yejL] [CL:hypothetical protein HI0840] [OR:Escherichia
coli] [DB:pir2] >gp:[GI:g405915] [LN:ECOHU49] [AC:U00008] [PN:yejL]
[OR:Escherichia coli] [SR:Escherichia coli K12 BHB2600] [DB:genpept-bct1]
[DE:centisome 49 region of E.coli K12 BHB2600.] [LE:11182] [RE:11409] [DI:direct]
>gp:[GI:g1788514] [LN:AE000308] [AC:AE000308:U00096] [PN:orf, hypothetical
protein] [GN:yejL] [FN:orf; Unknown] [OR:Escherichia coli] [DB:genpept-bct2]
[DE:Escherichia coli K-12 MG1655 section 198 of 400 of the completegenome.]
[NT:o75; 100 pct identical to YEJL_ECOLI SW: P33921] [LE:5756] [RE:5983]
[DI:direct]

| ORF Name | NT ID | AA ID | NT LN | AA LN | Score | P-value |
|---|---|---|---|---|---|---|
| 20975138_f2_597 | 1009 | 8180 | 1239 | 412 | 1910 | 3.3e-197 |

Description gp:[GI:g510349] [LN:STNRDABA] [AC:X72948] [GN:nrdB] [OR:Salmonella typhimurium]
[DB:genpept-bct1] [DE:S.typhimurium nrdA gene.] [SP:P37427] [LE:3385] [RE:4515]
[DI:direct]

| ORF Name | NT ID | AA ID | NT LN | AA LN | Score | P-value |
|---|---|---|---|---|---|---|
| 2111550_c2_1378 | 1010 | 8181 | 1461 | 486 | 1466 | 3.7e-150 |

Description sp:[LN:YOHG_ECOLI] [AC:P33369] [GN:YOHG] [OR:Escherichia coli] [DE:HYPOTHETICAL
43.3 KD PROTEIN IN PBPG-CDD INTERGENIC REGION] [SP:P33369] [DB:swissprot]
>sp:[LN:A64982] [AC:A64982] [PN:hypothetical 43.3 kD protein in pbpG-cdd
intergenic region] [GN:yohG] [OR:Escherichia coli] [DB:pir2] >gp:[GI:g405964]
[LN:ECOHU47] [AC:U00007] [PN:yohG] [OR:Escherichia coli] [SR:Escherichia coli K12
BHB2600] [DB:genpept-bct1] [DE:47 to 48 centisome region of E.coli K12 BHB2600.]
[NT:similar to nodulation protein T and a fusaric acid] [LE:40092] [RE:41288]
[DI:complement] >gp:[GI:g1788460] [LN:AE000303] [AC:AE000303:U00096] [PN:putative
channel/filament proteins] [GN:yohG] [FN:orf; Not classified] [OR:Escherichia
coli] [DB:genpept-bct2] [DE:Escherichia coli K-12 MG1655 section 193 of 400 of
the completegenome.] [NT:f398; 100 pct identical YOHG_ECOLI SW: P33369] [LE:2392]
[RE:3588] [DI:complement]

| ORF Name | NT ID | AA ID | NT LN | AA LN | Score | P-value |
|---|---|---|---|---|---|---|
| 21535142_f1_311 | 1011 | 8182 | 558 | 186 | 214 | 2.5e-16 |

Description sp:[LN:T06291] [AC:T06291] [PN:extensin homolog T9E8.80] [OR:Arabidopsis thaliana] [SR:, mouse-ear cress] [DB:pir2] [MP:4] >gp:[GI:e1424373:g4584539] [LN:ATT9E8] [AC:AL049608] [PN:extensin-like protein] [GN:T9E8.80] [OR:Arabidopsis thaliana] [SR:thale cress] [DB:genpept-pln1] [DE:Arabidopsis thaliana DNA chromosome 4, BAC clone T9E8 (ESSAproject).] [NT:similarity to extensin-like protein, Zea mays,] [LE:29372] [RE:31654] [DI:direct]

| ORF Name | NT ID | AA ID | NT LN | AA LN | Score | P-value |
|---|---|---|---|---|---|---|
| 21538530_f1_33 | 1012 | 8183 | 198 | 65 | | |

Description

NO-HIT

| ORF Name | NT ID | AA ID | NT LN | AA LN | Score | P-value |
|---|---|---|---|---|---|---|
| 21679516_f3_924 | 1013 | 8184 | 2454 | 817 | 3781 | 0.0 |

Description sp:[LN:RIR1_SALTY] [AC:P37426] [GN:NRDA] [OR:Salmonella typhimurium] [EC:1.17.4.1] [DE:(RIBONUCLEOTIDE REDUCTASE 1) (B1 PROTEIN) (R1 PROTEIN)] [SP:P37426] [DB:swissprot] >sp:[LN:S32629] [AC:S32629] [PN:ribonucleoside-diphosphate reductase,] [CL:herpesvirus ribonucleoside-diphosphate reductase large chain] [OR:Salmonella typhimurium] [EC:1.17.4.1] [DB:pir2] >gp:[GI:g295896] [LN:STNRDABA] [AC:X72948] [PN:ribonucleoside-diphosphate reductase] [GN:nrdA] [OR:Salmonella typhimurium] [DB:genpept-bct1] [EC:1.17.4.1] [DE:S.typhimurium nrdA gene.] [NT:subunit B1] [SP:P37426] [LE:987] [RE:3272] [DI:direct]

| ORF Name | NT ID | AA ID | NT LN | AA LN | Score | P-value |
|---|---|---|---|---|---|---|
| 2194667_c1_1206 | 1014 | 8185 | 237 | 78 | | |

Description

NO-HIT

| ORF Name | NT ID | AA ID | NT LN | AA LN | Score | P-value |
|---|---|---|---|---|---|---|
| 22009713_c2_1480 | 1015 | 8186 | 450 | 149 | 616 | 4.4e-60 |

Description gp:[GI:g4512006] [LN:AF104912] [AC:AF104912] [PN:putative acid phosphatase Wzb] [GN:wzb] [OR:Escherichia coli] [DB:genpept-bct2] [DE:Escherichia coli K30 capsule biosynthesis cluster, partialsequence.] [LE:3459] [RE:3905] [DI:direct]

| ORF_Name | NT_ID | AA_ID | NT/LN | AA/LN | Score | P-value |
|---|---|---|---|---|---|---|
| 22109457_f2_538 | 1016 | 8187 | 681 | 226 | 965 | 4.6e-97 |

Description sp:[LN:YEIP_ECOLI] [AC:P33028] [GN:YEIP] [OR:Escherichia coli] [DE:HYPOTHETICAL 30.9 KD PROTEIN IN FRUB-SPR INTERGENIC REGION] [SP:P33028] [DB:swissprot] >sp:[LN:B64986] [AC:B64986] [PN:hypothetical 30.9 kD protein in fruB 5'region] [GN:yeiP] [OR:Escherichia coli] [DB:pir2] >gp:[GI:d1016705:g1736837] [LN:D90849] [AC:D90849:AB001340] [PN:Elongation factor P (EF-P).] [GN:yeiP] [OR:Escherichia coli] [SR:Escherichia coli (strain:K12) DNA, clone_lib:Kohara lambda minise] [DB:genpept-bct1] [DE:E.coli genomic DNA, Kohara clone #369(48.6-49.0 min.).] [NT:ORF_ID:o369#3; similar to [SwissProt Accession] [LE:4880] [RE:5707] [DI:direct] >gp:[GI:g405887] [LN:ECOHU47] [AC:U00007] [PN:yeiP] [OR:Escherichia coli] [SR:Escherichia coli K12 BHB2600] [DB:genpept-bct1] [DE:47 to 48 centisome region of E.coli K12 BHB2600.] [NT:homolog of elongation factor P.] [LE:72939] [RE:73766] [DI:direct] >gp:[GI:g1788496] [LN:AE000306] [AC:AE000306:U00096] [PN:putative elongation factor] [GN:yeiP] [FN:putative factor; Not classified] [OR:Escherichia coli] [DB:genpept-bct2] [DE:Escherichia coli K-12 MG1655 section 196 of 400 of the completegenome.] [NT:o275; 100 pct identical to YEIP_ECOLI SW: P33028] [LE:7843] [RE:8670] [DI:direct]

| ORF_Name | NT_ID | AA_ID | NT/LN | AA/LN | Score | P-value |
|---|---|---|---|---|---|---|
| 22125380_f1_278 | 1017 | 8188 | 1305 | 434 | 1757 | 5.4e-181 |

Description sp:[LN:GLPC_ECOLI] [AC:P13034:P77679:P76927] [GN:GLPC] [OR:Escherichia coli] [DE:DEHYDROGENASE)] [SP:P13034:P77679:P76927] [DB:swissprot] >sp:[LN:DEECNC] [AC:A64995:C32006] [PN:glycerol-3-phosphate dehydrogenase, (anaerobic) chain C] [GN:glpC] [CL:glycerol-3-phosphate dehydrogenase (anaerobic) chain C:ferredoxin 2[4Fe-4S] homology] [OR:Escherichia coli] [EC:1.1.99.5] [DB:pir1] [MP:49 min] >gp:[GI:d1016790:g1799590] [LN:D90855] [AC:D90855:AB001340] [PN:glycerol-3-phosphate dehydrogenase (EC 1.1.99.5)] [GN:glpC] [OR:Escherichia coli] [SR:Escherichia coli (strain:K12) DNA, clone_lib:Kohara lambda minise] [DB:genpept-bct1] [DE:E.coli genomic DNA, Kohara clone #377(50.5-50.9 min.).] [NT:similar to [PIR Accession Number C32006]] [LE:15805] [RE:16995] [DI:direct] >gp:[GI:g1788576] [LN:AE000314] [AC:AE000314:U00096] [PN:sn-glycerol-3-phosphate dehydrogenase] [GN:glpC] [FN:enzyme; Energy metabolism, carbon: Anaerobic] [OR:Escherichia coli] [DB:genpept-bct2] [DE:Escherichia coli K-12 MG1655 section 204 of 400 of the completegenome.] [NT:o396; 99 pct identical GLPC_ECOLI SW: P13034] [LE:5972] [RE:7162] [DI:direct]

| ORF_Name | NT_ID | AA_ID | NT/LN | AA/LN | Score | P-value |
|---|---|---|---|---|---|---|
| 22445962_c2_1497 | 1018 | 8189 | 1167 | 388 | 2064 | 1.6e-213 |

Description sp:[LN:GLF1_KLEPN] [AC:Q48485] [GN:RFBD] [OR:Klebsiella pneumoniae] [EC:5.4.99.9] [DE:PROBABLE UDP-GALACTOPYRANOSE MUTASE,] [SP:Q48485] [DB:swissprot] >gp:[GI:g557193] [LN:KPNRFBC] [AC:L31762] [GN:glf] [FN:unknown] [OR:Klebsiella pneumoniae] [DB:genpept-bct2] [DE:Klebsiella pneumoniae wbbM, glf, wbbN, and galactosyl transferase(wbbO) genes, complete cds.] [NT:putative] [LE:1985] [RE:3139] [DI:direct]

| ORF Name | NT ID | AA ID | NT/LN | AA/LN | Score | P-value |
|---|---|---|---|---|---|---|
| 22839516_f1_100 | 1019 | 8190 | 1524 | 507 | 1529 | 7.9e-157 |

Description sp:[LN:BAES_ECOLI] [AC:P30847:P76401] [GN:BAES] [OR:Escherichia coli]
[EC:2.7.3.-] [DE:SENSOR PROTEIN BAES,] [SP:P30847:P76401] [DB:swissprot]
>sp:[LN:E64974] [AC:E64974:JX0282] [PN:sensory kinase BaeS,:signal transduction
protein] [GN:baeS] [CL:sensor histidine kinase homology] [OR:Escherichia coli]
[EC:2.7.3.-] [DB:pir2] >gp:[GI:d1016658:g1736787] [LN:D90846]
[AC:D90846:AB001340] [PN:Sensor protein BaeS (EC 2.7.3.-).] [GN:baeS]
[OR:Escherichia coli] [SR:Escherichia coli (strain:K12) DNA, clone_lib:Kohara
lambda minise] [DB:genpept-bct1] [DE:E.coli genomic DNA, Kohara clone
357(46.5-46.8 min.).] [NT:ORF_ID:o357#3; similar to [SwissProt Accession]
[LE:5628] [RE:7031] [DI:direct] >gp:[GI:d1016669:g1736799] [LN:D90847]
[AC:D90847:AB001340] [PN:Sensor protein BaeS (EC 2.7.3.-).] [GN:baeS]
[OR:Escherichia coli] [SR:Escherichia coli (strain:K12) DNA, clone_lib:Kohara
lambda minise] [DB:genpept-bct1] [DE:E.coli genomic DNA, Kohara clone
358(46.6-46.9 min.).] [NT:ORF_ID:o357#3; similar to [SwissProt Accession]
[LE:273] [RE:1676] [DI:direct] >gp:[GI:g1788393] [LN:AE000297]
[AC:AE000297:U00096] [PN:sensor protein (for BaeR)] [GN:baeS] [FN:enzyme; RNA
synthesis, modification, DNA] [OR:Escherichia coli] [DB:genpept-bct2]
[EC:2.7.3.-] [DE:Escherichia coli K-12 MG1655 section 187 of 400 of the
completegenome.] [NT:o467; 98 pct identical (1 gap) to BAES_ECOLI] [LE:16269]
[RE:17672] [DI:direct]

| ORF Name | NT ID | AA ID | NT/LN | AA/LN | Score | P-value |
|---|---|---|---|---|---|---|
| 22849137_c2_1403 | 1020 | 8191 | 1020 | 339 | 358 | 9.6e-33 |

Description sp:[LN:YEAT_ECOLI] [AC:P76250] [GN:YEAT] [OR:Escherichia coli] [DE:HYPOTHETICAL
TRANSCRIPTIONAL REGULATOR IN GAPA-RND INTERGENIC REGION] [SP:P76250]
[DB:swissprot] >gp:[GI:d1016318:g1736422] [LN:D90823] [AC:D90823:AB001340]
[GN:ygiP] [OR:Escherichia coli] [SR:Escherichia coli (strain:K12) DNA,
clone_lib:Kohara lambda minise] [DB:genpept-bct1] [DE:E.coli genomic DNA, Kohara
clone #332(40.4-40.7 min.).] [NT:ORF_ID:o332#7; similar to [SwissProt Accession]
[LE:7082] [RE:8005] [DI:complement] >gp:[GI:d1016327:g1736432] [LN:D90824]
[AC:D90824:AB001340] [GN:ygiP] [OR:Escherichia coli] [SR:Escherichia coli
(strain:K12) DNA, clone_lib:Kohara lambda minise] [DB:genpept-bct1] [DE:E.coli
genomic DNA, Kohara clone #333(40.5-40.8 min.).] [NT:ORF_ID:o332#7; similar to
[SwissProt Accession] [LE:2552] [RE:3475] [DI:complement]

| ORF Name | NT ID | AA ID | NT/LN | AA/LN | Score | P-value |
|---|---|---|---|---|---|---|
| 22850033_f3_704 | 1021 | 8192 | 1227 | 408 | | |

Description

NO-HIT

| ORF Name | NT ID | AA ID | NT LN | AA LN | Score | P-value |
|---|---|---|---|---|---|---|
| 2345012_c1_1192 | 1022 | 8193 | 1476 | 491 | 310 | 1.5e-25 |

Description sp:[LN:D69727] [AC:D69727] [PN:biosynthesis of teichuronic acid tuaB] [GN:tuaB]
[CL:hypothetical protein b2046] [OR:Bacillus subtilis] [DB:pir1]
>gp:[GI:e1184466:g2636086] [LN:BSUB0019] [AC:Z99122:AL009126] [GN:tuaB]
[FN:biosynthesis of teichuronic acid] [OR:Bacillus subtilis] [DB:genpept-bct1]
[DE:Bacillus subtilis complete genome (section 19 of 21): from 3597091to
3809700.] [NT:alternate gene name: yvhB] [LE:58722] [RE:60173] [DI:complement]
>gp:[GI:g2454557] [LN:AF015609] [AC:AF015609] [PN:unknown] [GN:tuaB] [OR:Bacillus
subtilis] [DB:genpept-bct2] [DE:Bacillus subtilis 168 teichuronic acid operon,
tuaABCDEFGH genes,complete sequence.] [LE:920] [RE:2371] [DI:direct]

| ORF Name | NT ID | AA ID | NT LN | AA LN | Score | P-value |
|---|---|---|---|---|---|---|
| 23475275_c3_1598 | 1023 | 8194 | 1434 | 477 | | |

Description

NO-HIT

| ORF Name | NT ID | AA ID | NT LN | AA LN | Score | P-value |
|---|---|---|---|---|---|---|
| 23600015_c3_1772 | 1024 | 8195 | 1251 | 416 | 307 | 2.4e-27 |

Description sp:[LN:A70037] [AC:A70037] [PN:capsular polysaccharide biosynthesis homolog yveT]
[GN:yveT] [OR:Bacillus subtilis] [DB:pir2] >gp:[GI:e1186116:g2635941]
[LN:BSUB0018] [AC:Z99121:AL009126] [GN:yveT] [FN:unknown] [OR:Bacillus subtilis]
[DB:genpept-bct1] [DE:Bacillus subtilis complete genome (section 18 of 21): from
3399551to 3609060.] [NT:similar to capsular polysaccharide biosynthesis]
[LE:118509] [RE:119543] [DI:complement] >gp:[GI:e238666:g1495288] [LN:BSYVEFGNS]
[AC:Z71928] [PN:hypothetical protein] [GN:yveT] [OR:Bacillus subtilis]
[DB:genpept-bct1] [DE:B.subtilis pnbA, sigL, yve[J,K,L,M,N,O,P,Q,R,S,T]
andyvf[A,B,C,D,E,F,G,H] genes.] [NT:similar to Ggab of B.subtilis] [LE:12203]
[RE:13237] [DI:direct] >gp:[GI:e313133:g1945699] [LN:BSZ94043] [AC:Z94043]
[PN:hypothetical protein] [GN:yveT] [OR:Bacillus subtilis] [DB:genpept-bct1]
[DE:B.subtilis genomic DNA fragment (88 kb).] [NT:similar to tremblnew:ST40830_10
epsI Streptococcus] [LE:62128] [RE:63162] [DI:direct]

| ORF_Name | NT ID | AA ID | NT/LN | AA/LN | Score | P-value |
|---|---|---|---|---|---|---|
| 23601087_c2_1302 | 1025 | 8196 | 1149 | 382 | 1762 | 1.6e-181 |

Description sp:[LN:OMPC_KLEPN] [AC:Q48473] [GN:OMPC:OMPK36] [OR:Klebsiella pneumoniae] [DE:OUTER MEMBRANE PROTEIN C PRECURSOR (PORIN OMPC) (PORIN OMPK36)] [SP:Q48473] [DB:swissprot] >sp:[LN:S51104] [AC:S51104] [PN:outer membrane porin ompK36 precursor] [GN:ompK36] [CL:outer membrane protein phoE] [OR:Klebsiella pneumoniae] [DB:pir2] >gp:[GI:g619891] [LN:KPOMP36G] [AC:Z33506] [PN:OmpK36 porin] [GN:ompK36] [OR:Klebsiella pneumoniae] [DB:genpept-bct1] [DE:K.pneumoniae (C3) ompK36 gene for OmpK36 porin and micF gene.] [SP:Q48473] [LE:427] [RE:1518] [DI:direct]

| ORF_Name | NT ID | AA ID | NT/LN | AA/LN | Score | P-value |
|---|---|---|---|---|---|---|
| 23630453_f3_757 | 1026 | 8197 | 408 | 135 | 111 | 8.4e-06 |

Description sp:[LN:D72536] [AC:D72536] [PN:hypothetical protein APE1577] [GN:APE1577] [OR:Aeropyrum pernix] [DB:pir2] >gp:[GI:d1044363:g5105264] [LN:AP000062] [AC:AP000062] [PN:345aa long hypothetical protein] [GN:APE1577] [OR:Aeropyrum pernix] [SR:Aeropyrum pernix (strain:K1) DNA] [DB:genpept-bct1] [DE:Aeropyrum pernix genomic DNA, section 5/7.] [LE:12861] [RE:13898] [DI:direct]

| ORF_Name | NT ID | AA ID | NT/LN | AA/LN | Score | P-value |
|---|---|---|---|---|---|---|
| 23682800_c1_1198 | 1027 | 8198 | 1182 | 393 | 1960 | 1.7e-202 |

Description gp:[GI:g2104504] [LN:ECU90519] [AC:U90519] [PN:putative UDP-glucose dehydrogenase] [GN:ugd] [OR:Escherichia coli] [DB:genpept-bct2] [DE:Escherichia coli putative UDP-glucose dehydrogenase (ugd) gene, complete cds, and IS1 transposable element InsA (insA) andtransposase (insB) genes, complete cds.] [LE:164] [RE:1330] [DI:direct]

| ORF Name | NT ID | AA ID | NT LN | AA LN | Score | P-value |
|---|---|---|---|---|---|---|
| 23695127_f2_360 | 1028 | 8199 | 801 | 266 | 1296 | 3.9e-132 |

Description sp:[LN:HIS6_ECOLI] [AC:P10373] [GN:HISF] [OR:Escherichia coli] [DE:HISF PROTEIN
(CYCLASE)] [SP:P10373] [DB:swissprot] >sp:[LN:OYECHF] [AC:JS0134:I76779:H64967]
[PN:imidazole glycerol phosphate synthas, chain hisF:cyclase] [GN:hisF]
[CL:cyclase hisF] [OR:Escherichia coli] [EC:2.4.2.-] [DB:pir1] [MP:44 min]
>gp:[GI:d1041508:g4867931] [LN:AB008676] [AC:AB008676] [PN:cyclase] [GN:hisF]
[OR:Escherichia coli] [SR:Escherichia coli (strain:184) DNA, clone:1-4-1]
[DB:genpept-bct1] [DE:Escherichia coli O157 DNA, map position at 46 min.,
complete cds.] [NT:putative] [LE:20306] [RE:21082] [DI:complement]
>gp:[GI:d1016581:g1736704] [LN:D90840] [AC:D90840:AB001340] [PN:Cyclase hisF]
[GN:hisF] [OR:Escherichia coli] [SR:Escherichia coli (strain:K12) DNA,
clone_lib:Kohara lambda minise] [DB:genpept-bct1] [DE:E.coli genomic DNA, Kohara
clone #350(44.9-45.2 min.).] [NT:ORF_ID:o350#12; similar to [PIR Accession
Number] [LE:13186] [RE:13962] [DI:direct] >gp:[GI:d1016589:g1736713] [LN:D90841]
[AC:D90841:AB001340] [PN:Cyclase hisF] [GN:hisF] [OR:Escherichia coli]
[SR:Escherichia coli (strain:K12) DNA, clone_lib:Kohara lambda minise]
[DB:genpept-bct1] [DE:E.coli genomic DNA, Kohara clone #351(45.1-45.5 min.).]
[NT:ORF_ID:o350#12; similar to [PIR Accession Number] [LE:2144] [RE:2920]
[DI:direct] >gp:[GI:g41714] [LN:ECHISOP] [AC:X13462] [OR:Escherichia coli]
[DB:genpept-bct1] [DE:Escherichia coli DNA for histidin operon genes
hisGDCBHAFIE.] [NT:hisF ORF (AA 1-258)] [SP:P10373] [LE:5926] [RE:6702]
[DI:direct] >gp:[GI:g1788336] [LN:AE000293] [AC:AE000293:U00096] [PN:imidazole
glycerol phosphate synthase subunit in] [GN:hisF] [FN:enzyme; Amino acid
biosynthesis: Histidine] [OR:Escherichia coli] [DB:genpept-bct2] [DE:Escherichia
coli K-12 MG1655 section 183 of 400 of the completegenome.] [NT:o258; 100 pct
identical to HIS6_ECOLI SW: P10373;] [LE:10260] [RE:11036] [DI:direct]

| ORF Name | NT ID | AA ID | NT LN | AA LN | Score | P-value |
|---|---|---|---|---|---|---|
| 23709637_c1_1237 | 1029 | 8200 | 768 | 255 | 391 | 3.1e-36 |

Description gp:[GI:e246538:g1684732] [LN:PSDNGC] [AC:Z73914] [PN:ORF378 protein] [GN:orf378]
[FN:A membrane-bound protein] [OR:Pseudomonas stutzeri] [DB:genpept-bct1]
[DE:Pseudomonas stutzeri orf175 gene.] [LE:5539] [RE:6675] [DI:complement]

| ORF Name | NT ID | AA ID | NT LN | AA LN | Score | P-value |
|---|---|---|---|---|---|---|
| 23728180_c2_1496 | 1030 | 8201 | 1911 | 636 | 3321 | 0.0 |

Description gp:[GI:g557192] [LN:KPNRFBC] [AC:L31762] [GN:wbbM] [FN:unknown] [OR:Klebsiella
pneumoniae] [DB:genpept-bct2] [DE:Klebsiella pneumoniae wbbM, glf, wbbN, and
galactosyl transferase(wbbO) genes, complete cds.] [NT:putative] [LE:62]
[RE:1969] [DI:direct]

| ORF Name | NT ID | AA ID | NT/LN | AA/LN | Score | P-value |
|---|---|---|---|---|---|---|
| 239541_f2_368 | 1031 | 8202 | 186 | 61 | 70 | 0.043 |

Description sp:[LN:T08048] [AC:T08048] [PN:coproporphyrinogen oxidase,] [GN:CPX]
[CL:coproporphyrinogen oxidase] [OR:Chlamydomonas reinhardtii] [EC:1.3.3.3]
[DB:pir2]

| ORF Name | NT ID | AA ID | NT/LN | AA/LN | Score | P-value |
|---|---|---|---|---|---|---|
| 23960062_c1_1204 | 1032 | 8203 | 930 | 309 | 1486 | 2.8e-152 |

Description gp:[GI:g557194] [LN:KPNRFBC] [AC:L31762] [GN:wbbN] [FN:unknown] [OR:Klebsiella
pneumoniae] [DB:genpept-bct2] [DE:Klebsiella pneumoniae wbbM, glf, wbbN, and
galactosyl transferase(wbbO) genes, complete cds.] [NT:putative] [LE:3157]
[RE:4029] [DI:direct]

| ORF Name | NT ID | AA ID | NT/LN | AA/LN | Score | P-value |
|---|---|---|---|---|---|---|
| 24042281_c3_1715 | 1033 | 8204 | 921 | 306 | 716 | 1.1e-70 |

Description sp:[LN:E75202] [AC:E75202] [PN:dipeptide abc transporter, dipeptide-binding
protein PAB0093] [GN:dppC-1:PAB0093] [OR:Pyrococcus abyssi] [DB:pir2]
>gp:[GI:g5457577] [LN:CNSPAX01] [AC:AJ248283:AL096836] [PN:dipeptide ABC
transporter, dipeptide-binding] [GN:dppC-1] [OR:Pyrococcus abyssi]
[DB:genpept-bct1] [DE:Pyrococcus abyssi complete genome; segment 1/6.]
[NT:PAB0093] [LE:145005] [RE:145868] [DI:direct]

| ORF Name | NT ID | AA ID | NT/LN | AA/LN | Score | P-value |
|---|---|---|---|---|---|---|
| 24089083_c2_1390 | 1034 | 8205 | 948 | 315 | 1330 | 9.6e-136 |

Description sp:[LN:YEHZ_ECOLI] [AC:P33362] [GN:YEHZ] [OR:Escherichia coli] [DE:HYPOTHETICAL
32.6 KD PROTEIN IN MOLR-BGLX INTERGENIC REGION PRECURSOR] [SP:P33362]
[DB:swissprot] >sp:[LN:B64981] [AC:B64981] [PN:hypothetical 32.6 kD protein in
molR-bglX intergenic region] [GN:yehZ] [OR:Escherichia coli] [DB:pir2]
>gp:[GI:g405862] [LN:ECOHU47] [AC:U00007] [PN:yehZ] [OR:Escherichia coli]
[SR:Escherichia coli K12 BHB2600] [DB:genpept-bct1] [DE:47 to 48 centisome region
of E.coli K12 BHB2600.] [LE:31334] [RE:32251] [DI:complement] >gp:[GI:g1788452]
[LN:AE000302] [AC:AE000302:U00096] [PN:putative transport system permease
protein] [GN:yehZ] [FN:putative transport; Not classified] [OR:Escherichia coli]
[DB:genpept-bct2] [DE:Escherichia coli K-12 MG1655 section 192 of 400 of the
completegenome.] [NT:f305; 100 pct identical to YEHZ_ECOLI SW: P33362] [LE:3839]
[RE:4756] [DI:complement]

410

| ORF Name | NT ID | AA ID | NT LN | AA LN | Score | P-value |
|---|---|---|---|---|---|---|
| 24226636_c3_1810 | 1035 | 8206 | 618 | 205 | | |

Description

NO-HIT

| ORF Name | NT ID | AA ID | NT LN | AA LN | Score | P-value |
|---|---|---|---|---|---|---|
| 2425391_c1_1246 | 1036 | 8207 | 528 | 175 | 93 | 0.012 |

Description sp:[LN:H70384] [AC:H70384] [PN:hypothetical protein aq_979] [GN:aq_979]
[CL:hypothetical protein AF0171] [OR:Aquifex aeolicus] [DB:pir2]
>gp:[GI:g2983490] [LN:AE000716] [AC:AE000716:AE000657] [PN:putative protein]
[GN:aq_979] [OR:Aquifex aeolicus] [DB:genpept-bct2] [DE:Aquifex aeolicus section
48 of 109 of the complete genome.] [LE:11547] [RE:12149] [DI:complement]

| ORF Name | NT ID | AA ID | NT LN | AA LN | Score | P-value |
|---|---|---|---|---|---|---|
| 24258561_c2_1260 | 1037 | 8208 | 1548 | 515 | 2522 | 4.7e-262 |

Description sp:[LN:NUOM_ECOLI] [AC:P31978:P78248] [GN:NUOM] [OR:Escherichia coli]
[EC:1.6.5.3] [DE:OXIDOREDUCTASE CHAIN 13) (NUO13)] [SP:P31978:P78248]
[DB:swissprot] >sp:[LN:C64999] [AC:C64999:A48643:S37070:S38322] [PN:NADH
dehydrogenase (ubiquinone), chain 4:NADH dehydrogenase I chain M] [GN:nuoM]
[CL:NADH dehydrogenase (ubiquinone) chain 4] [OR:Escherichia coli] [EC:1.6.5.3]
[DB:pir2] >gp:[GI:d1016833:g1799637] [LN:D90859] [AC:D90859:AB001340] [PN:NADH
dehydrogenase (ubiquinone) (EC 1.6.5.3)] [OR:Escherichia coli] [SR:Escherichia
coli (strain:K12) DNA, clone_lib:Kohara lambda minise] [DB:genpept-bct1]
[DE:E.coli genomic DNA, Kohara clone #403(51.5-51.9 min.).] [NT:similar to [PIR
Accession Number A48643]] [LE:2929] [RE:4458] [DI:complement] >gp:[GI:g1788613]
[LN:AE000317] [AC:AE000317:U00096] [PN:NADH dehydrogenase I chain M] [GN:nuoM]
[FN:enzyme; Energy metabolism, carbon: Aerobic] [OR:Escherichia coli]
[DB:genpept-bct2] [EC:1.6.5.3] [DE:Escherichia coli K-12 MG1655 section 207 of
400 of the completegenome.] [NT:f509; 99 pct identical to NUOM_ECOLI SW: P31978]
[LE:7583] [RE:9112] [DI:complement]

| ORF Name | NT ID | AA ID | NT LN | AA LN | Score | P-value |
|---|---|---|---|---|---|---|
| 2427036_f2_573 | 1038 | 8209 | 1278 | 425 | 994 | 3.9e-100 |

Description sp:[LN:S77665] [AC:JC6190:S77664:S77665] [PN:integral membrane protein HP0228
homolog] [CL:integral membrane protein HP0228] [OR:Mycobacterium smegmatis]
[DB:pir1] >gp:[GI:g1477568] [LN:MSU50335] [AC:U50335] [PN:ORF2] [OR:Mycobacterium
smegmatis] [DB:genpept-bct1] [DE:Mycobacterium smegmatis phage resistance (mpr)
gene, complete cds.] [LE:1673] [RE:3169] [DI:complement]

| ORF Name | NT ID | AA ID | NT LN | AA LN | Score | P-value |
|---|---|---|---|---|---|---|
| 24339177_f1_199 | 1039 | 8210 | 1770 | 589 | 115 | 0.0022 |

Description gp:[GI:g190400] [LN:HUMPROFILC] [AC:M60499] [PN:profilaggrin] [GN:FLG] [OR:Homo sapiens] [SR:Human, cDNA to mRNA, clone lambda-HF604] [DB:genpept-pri2] [DE:Human profilaggrin mRNA, 5' end.] [LE:102] [RE:1496] [DI:direct]

| ORF Name | NT ID | AA ID | NT LN | AA LN | Score | P-value |
|---|---|---|---|---|---|---|
| 24397666_f3_685 | 1040 | 8211 | 1113 | 370 | 1556 | 1.1e-159 |

Description sp:[LN:HIS8_ECOLI] [AC:P06986] [GN:HISC] [OR:Escherichia coli] [EC:2.6.1.9]
[DE:PHOSPHATE TRANSAMINASE)] [SP:P06986] [DB:swissprot] >sp:[LN:XNECHC]
[AC:D64967:I73527:A30270] [PN:histidinol-phosphate
transaminase,:histidinol-phosphate aminotransferase:imidazolylacetolphosphate
aminotransferase] [GN:hisC] [CL:histidinol-phosphate aminotransferase]
[OR:Escherichia coli] [EC:2.6.1.9] [DB:pir1] [MP:44 min]
>gp:[GI:d1016576:g1736699] [LN:D90840] [AC:D90840:AB001340]
[PN:Histidinol-phosphate aminotransferase (EC] [GN:hisC] [OR:Escherichia coli]
[SR:Escherichia coli (strain:K12) DNA, clone_lib:Kohara lambda minise]
[DB:genpept-bct1] [DE:E.coli genomic DNA, Kohara clone #350(44.9-45.2 min.).]
[NT:ORF_ID:o350#7; similar to [SwissProt Accession] [LE:9740] [RE:10810]
[DI:direct] >gp:[GI:g509819] [LN:ECU02071] [AC:U02071] [PN:histidinol-phosphate
aminotransferase] [GN:hisC] [OR:Escherichia coli] [DB:genpept-bct1]
[DE:Escherichia coli K-12 histidinol-phosphate aminotransferase (hisC)gene,
complete cds.] [LE:1] [RE:1071] [DI:direct] >gp:[GI:g1788332] [LN:AE000293]
[AC:AE000293:U00096] [PN:histidinol-phosphate aminotransferase] [GN:hisC]
[FN:enzyme; Amino acid biosynthesis: Histidine] [OR:Escherichia coli]
[DB:genpept-bct2] [EC:2.6.1.9] [DE:Escherichia coli K-12 MG1655 section 183 of
400 of the completegenome.] [NT:o356; 100 pct identical to HIS8_ECOLI SW:
P06986;] [LE:6814] [RE:7884] [DI:direct]

| ORF Name | NT ID | AA ID | NT LN | AA LN | Score | P-value |
|---|---|---|---|---|---|---|
| 24402165_c3_1656 | 1041 | 8212 | 1971 | 656 | 2655 | 3.8e-276 |

Description gp:[GI:g1432153] [LN:KOU61727] [AC:U61727] [PN:cellobiose-specific PTS permease]
[GN:casA] [OR:Klebsiella oxytoca] [DB:genpept-bct1] [DE:Klebsiella oxytoca PTS
antiterminator (casR) gene, partial cds,cellobiose-specific PTS permease (casA)
and phospho-cellobiase(casB) genes, complete cds.] [NT:PTS enzyme II homolog]
[LE:456] [RE:2321] [DI:direct]

| ORF Name | NT ID | AA ID | NT LN | AA LN | Score | P-value |
|---|---|---|---|---|---|---|
| 24406508_f2_379 | 1042 | 8213 | 234 | 77 | 89 | 0.0047 |

Description gp:[GI:g4587717] [LN:AF027500] [AC:AF027500] [PN:ATP-dependent Clp protease regulatory subunit] [GN:clpA] [OR:Aquifex pyrophilus] [DB:genpept-bct2] [DE:Aquifex pyrophilus alanyl-tRNA synthetase (alaS) gene, completecds; and ATP-dependent Clp protease regulatory subunit (clpA) gene,partial cds.] [LE:3400] [RE:>5292] [DI:direct]

| ORF Name | NT ID | AA ID | NT LN | AA LN | Score | P-value |
|---|---|---|---|---|---|---|
| 24415927_c1_992 | 1043 | 8214 | 546 | 181 | 761 | 1.9e-75 |

Description sp:[LN:H64995] [AC:H64995] [PN:hypothetical protein b2250] [OR:Escherichia coli] [DB:pir2] >gp:[GI:g1788584] [LN:AE000315] [AC:AE000315:U00096] [PN:orf, hypothetical protein] [GN:b2250] [FN:orf; Unknown] [OR:Escherichia coli] [DB:genpept-bct2] [DE:Escherichia coli K-12 MG1655 section 205 of 400 of the completegenome.] [NT:f187; This 187 aa ORF is 27 pct identical (12 gaps)] [LE:1442] [RE:2005] [DI:complement]

| ORF Name | NT ID | AA ID | NT LN | AA LN | Score | P-value |
|---|---|---|---|---|---|---|
| 24472655_c3_1764 | 1044 | 8215 | 333 | 110 | 265 | 6.9e-23 |

Description gp:[GI:g2645860] [LN:AF034211] [AC:AF034211] [PN:transposase OrfA] [OR:Desulfovibrio vulgaris vulgaris] [DB:genpept-bct2] [DE:Desulfovibrio vulgaris vulgaris insertion sequence ISD1 transposasegene, complete cds.] [NT:N-terminal of transposase] [LE:77] [RE:343] [DI:direct]

| ORF Name | NT ID | AA ID | NT LN | AA LN | Score | P-value |
|---|---|---|---|---|---|---|
| 24478125_f3_810 | 1045 | 8216 | 1833 | 610 | 2666 | 2.6e-277 |

Description sp:[LN:DEECDL] [AC:A21893:I41048:D64981] [PN:D-lactate dehydrogenase,] [GN:dld] [CL:D-lactate dehydrogenase] [OR:Escherichia coli] [EC:1.1.1.28] [DB:pir1] [MP:47 min] >gp:[GI:g41287] [LN:ECDLD] [AC:X01067] [PN:D-lactate dehydrogenase] [OR:Escherichia coli] [DB:genpept-bct1] [DE:E. coli gene dld for D-lactate dehydrogenase.] [SP:P06149] [LE:244] [RE:1959] [DI:direct] >gp:[GI:g145753] [LN:ECODLDH] [AC:M10038] [PN:D-lactate dehydrogenase] [GN:dld] [OR:Escherichia coli] [SR:E.coli DNA, clone pIY2] [DB:genpept-bct1] [DE:E.coli dld gene encoding D-lactate dehydrogenase, complete cds.] [LE:244] [RE:1959] [DI:direct] >gp:[GI:g1788454] [LN:AE000302] [AC:AE000302:U00096] [PN:D-lactate dehydrogenase, FAD protein, NADH] [GN:dld] [FN:enzyme; Energy metabolism, carbon: Aerobic] [OR:Escherichia coli] [DB:genpept-bct2] [EC:1.1.1.28] [DE:Escherichia coli K-12 MG1655 section 192 of 400 of the completegenome.] [NT:o571; 100 pct identical to LDHD_ECOLI SW: P06149;] [LE:7460] [RE:9175] [DI:direct]

| ORF Name | NT ID | AA ID | NT LN | AA LN | Score | P-value |
|---|---|---|---|---|---|---|
| 24501030_f1_81 | 1046 | 8217 | 1701 | 566 | 2257 | 5.6e-234 |

Description sp:[LN:F64972] [AC:F64972] [PN:hypothetical protein b2063] [OR:Escherichia coli] [DB:pir2] >gp:[GI:g1788377] [LN:AE000296] [AC:AE000296:U00096] [PN:putative transport protein] [GN:yegH] [FN:putative transport; Not classified] [OR:Escherichia coli] [DB:genpept-bct2] [DE:Escherichia coli K-12 MG1655 section 186 of 400 of the completegenome.] [NT:o549; This 549 aa ORF is 50 pct identical (0 gaps)] [LE:4423] [RE:6072] [DI:direct]

| ORF Name | NT ID | AA ID | NT LN | AA LN | Score | P-value |
|---|---|---|---|---|---|---|
| 2457555_c3_1661 | 1047 | 8218 | 708 | 235 | 936 | 5.4e-94 |

Description sp:[LN:YOHC_ECOLI] [AC:P33365] [GN:YOHC] [OR:Escherichia coli] [DE:HYPOTHETICAL 22.4 KD PROTEIN IN PBPG-CDD INTERGENIC REGION] [SP:P33365] [DB:swissprot] >sp:[LN:F64981] [AC:F64981] [PN:hypothetical 22.4 kD protein in pbpg-cdd intergenic region] [GN:yohC] [OR:Escherichia coli] [DB:pir2] >gp:[GI:g405865] [LN:ECOHU47] [AC:U00007] [PN:yohC] [OR:Escherichia coli K12 BHB2600] [SR:Escherichia coli K12 BHB2600] [DB:genpept-bct1] [DE:47 to 48 centisome region of E.coli K12 BHB2600.] [LE:37814] [RE:38425] [DI:complement] >gp:[GI:g1788457] [LN:AE000303] [AC:AE000303:U00096] [PN:orf, hypothetical protein] [GN:yohC] [FN:orf; Unknown] [OR:Escherichia coli] [DB:genpept-bct2] [DE:Escherichia coli K-12 MG1655 section 193 of 400 of the completegenome.] [NT:f203; 100 pct identical to YOHC_ECOLI SW: P33365] [LE:113] [RE:724] [DI:complement]

| ORF Name | NT ID | AA ID | NT LN | AA LN | Score | P-value |
|---|---|---|---|---|---|---|
| 24618903_c2_1291 | 1048 | 8219 | 2400 | 799 | | |

Description

NO-HIT

| ORF Name | NT ID | AA ID | NT LN | AA LN | Score | P-value |
|---|---|---|---|---|---|---|
| 24619058_c1_993 | 1049 | 8220 | 1200 | 399 | 1702 | 3.7e-175 |

Description sp:[LN:G64995] [AC:G64995] [PN:hypothetical protein b2249] [OR:Escherichia coli] [DB:pir2] >gp:[GI:d1016801:g1799602] [LN:D90856] [AC:D90856:AB001340] [PN:PUTATIVE COMPETENCE-DAMAGE PROTEIN.] [GN:CINA] [OR:Escherichia coli] [SR:Escherichia coli (strain:K12) DNA, clone_lib:Kohara lambda minise] [DB:genpept-bct1] [DE:E.coli genomic DNA, Kohara clone #379(50.8-51.2 min.).] [NT:similar to [SwissProt Accession Number P46323]] [LE:5824] [RE:7026] [DI:complement] >gp:[GI:g1788583] [LN:AE000315] [AC:AE000315:U00096] [PN:orf, hypothetical protein] [GN:b2249] [FN:orf; Unknown] [OR:Escherichia coli] [DB:genpept-bct2] [DE:Escherichia coli K-12 MG1655 section 205 of 400 of the completegenome.] [NT:f400; This 400 aa ORF is 37 pct identical (0 gaps)] [LE:140] [RE:1342] [DI:complement]

| ORF_Name | NT_ID | AA_ID | NT/LN | AA/LN | Score | P-value |
|---|---|---|---|---|---|---|
| 24647838_c2_1535 | 1050 | 8221 | 978 | 325 | 370 | 6.1e-55 |

Description sp:[LN:S77453] [AC:S77453] [PN:hypothetical protein slr1143] [OR:Synechocystis sp.] [SR:PCC 6803, , PCC 6803] [SR:PCC 6803, ] [DB:pir2] >gp:[GI:d1018033:g1652378] [LN:D90905] [AC:D90905:AB001339] [PN:hypothetical protein] [OR:Synechocystis sp.] [SR:Synechocystis sp. (strain:PCC6803) DNA] [DB:genpept-bct1] [DE:Synechocystis sp. PCC6803 complete genome, 7/27, 781449-920915.] [NT:ORF_ID:slr1143] [LE:20759] [RE:21790] [DI:direct]

| ORF_Name | NT_ID | AA_ID | NT/LN | AA/LN | Score | P-value |
|---|---|---|---|---|---|---|
| 24660305_f3_893 | 1051 | 8222 | 498 | 165 | 643 | 6.1e-63 |

Description gp:[GI:g453992] [LN:ECOHU49] [AC:U00008] [PN:ecotin (protease inhibitor)] [OR:Escherichia coli] [SR:Escherichia coli K12 BHB2600] [DB:genpept-bct1] [DE:centisome 49 region of E.coli K12 BHB2600.] [NT:DNA repair protein.] [LE:30935] [RE:31444] [DI:direct]

| ORF_Name | NT_ID | AA_ID | NT/LN | AA/LN | Score | P-value |
|---|---|---|---|---|---|---|
| 24805410_f3_865 | 1052 | 8223 | 1581 | 526 | 1506 | 2.2e-154 |

Description sp:[LN:RTN_ECOLI] [AC:P76446:Q52613] [GN:RTN] [OR:Escherichia coli] [DE:RTN PROTEIN] [SP:P76446:Q52613] [DB:swissprot] >sp:[LN:G64986] [AC:G64986] [PN:hypothetical protein b2176] [OR:Escherichia coli] [DB:pir2] >gp:[GI:d1016709:g1736841] [LN:D90849] [AC:D90849:AB001340] [GN:yjcC] [OR:Escherichia coli] [SR:Escherichia coli (strain:K12) DNA, clone_lib:Kohara lambda minise] [DB:genpept-bct1] [DE:E.coli genomic DNA, Kohara clone #369(48.6-49.0 min.).] [NT:ORF_ID:o369#9; similar to [SwissProt Accession] [LE:10410] [RE:11966] [DI:direct] >gp:[GI:g1788502] [LN:AE000307] [AC:AE000307:U00096] [PN:orf, hypothetical protein] [GN:rtn] [FN:orf; Unknown] [OR:Escherichia coli] [DB:genpept-bct2] [DE:Escherichia coli K-12 MG1655 section 197 of 400 of the completegenome.] [NT:o518; This 518 aa ORF is 27 pct identical (26 gaps)] [LE:2986] [RE:4542] [DI:direct]

| ORF_Name | NT_ID | AA_ID | NT/LN | AA/LN | Score | P-value |
|---|---|---|---|---|---|---|
| 24823305_c3_1657 | 1053 | 8224 | 1410 | 469 | 2262 | 1.7e-234 |

Description sp:[LN:CASB_KLEOX] [AC:Q48409] [GN:CASB] [OR:Klebsiella oxytoca] [EC:3.2.1.-] [DE:PHOSPHO-CELLOBIASE,] [SP:Q48409] [DB:swissprot] >gp:[GI:g1432154] [LN:KOU61727] [AC:U61727] [PN:phospho-cellobiase] [GN:casB] [OR:Klebsiella oxytoca] [DB:genpept-bct1] [DE:Klebsiella oxytoca PTS antiterminator (casR) gene, partial cds,cellobiose-specific PTS permease (casA) and phospho-cellobiase(casB) genes, complete cds.] [NT:glycohydrolase homolog] [LE:2339] [RE:3733] [DI:direct]

| ORF Name | NT ID | AA ID | NT LN | AA LN | Score | P-value |
|---|---|---|---|---|---|---|
| 2507818_f3_692 | 1054 | 8225 | 363 | 120 | | |

Description

NO-HIT

| ORF Name | NT ID | AA ID | NT LN | AA LN | Score | P-value |
|---|---|---|---|---|---|---|
| 2552202_c3_1573 | 1055 | 8226 | 2730 | 909 | 4135 | 0.0 |

Description sp:[LN:GYRA_KLEPN] [AC:P14829] [GN:GYRA] [OR:Klebsiella pneumoniae] [EC:5.99.1.3] [DE:DNA GYRASE SUBUNIT A,] [SP:P14829] [DB:swissprot] >gp:[GI:g43808] [LN:KPGYRA] [AC:X16817] [OR:Klebsiella pneumoniae] [DB:genpept-bct1] [DE:Klebsiella pneumoniae gyrA gene for DNA gyrase subunit A (EC5.99.1.3).] [NT:gyrase subunit A (AA 1-876)] [SP:P14829] [LE:288] [RE:2918] [DI:direct]

| ORF Name | NT ID | AA ID | NT LN | AA LN | Score | P-value |
|---|---|---|---|---|---|---|
| 25570836_c1_1140 | 1056 | 8227 | 1035 | 344 | 976 | 3.1e-98 |

Description sp:[LN:RBTR_KLEAE] [AC:P07760] [GN:RBTR] [OR:Klebsiella aerogenes] [DE:RIBITOL OPERON REPRESSOR (RBT OPERON REPRESSOR)] [SP:P07760] [DB:swissprot] >sp:[LN:A22839] [AC:A22839] [PN:rbt operon repressor] [GN:rbtR] [OR:Klebsiella pneumoniae] [DB:pir2] >gp:[GI:g43781] [LN:KARBT] [AC:X02448] [OR:Klebsiella aerogenes] [DB:genpept-bct1] [DE:Klebsiella aerogenes ribitol (rbt) operon control region.] [NT:repressor protein (rbt-R) (aa 1-270)] [SP:P07760] [LE:459] [RE:1271] [DI:direct]

| ORF Name | NT ID | AA ID | NT LN | AA LN | Score | P-value |
|---|---|---|---|---|---|---|
| 25585252_f3_773 | 1057 | 8228 | 1056 | 351 | 1604 | 8.9e-165 |

Description gp:[GI:g2905645] [LN:AF045245] [AC:AF045245:U97126] [PN:repressor] [GN:dalR] [OR:Klebsiella pneumoniae] [DB:genpept-bct2] [DE:Klebsiella pneumoniae D-arabinitol transporter (dalT), D-arabinitolkinase (dalK), D-arabinitol dehydrogenase (dalD), and repressor(dalR) genes, complete cds.] [LE:4816] [RE:5757] [DI:direct]

| ORF Name | NT ID | AA ID | NT/LN | AA/LN | Score | P-value |
|---|---|---|---|---|---|---|
| 25595075_f2_509 | 1058 | 8229 | 435 | 144 | 606 | 5.1e-59 |

Description sp:[LN:YOHJ_ECOLI] [AC:P33372] [GN:YOHJ] [OR:Escherichia coli] [DE:HYPOTHETICAL 14.6 KD PROTEIN IN PBPG-CDD INTERGENIC REGION] [SP:P33372] [DB:swissprot] >sp:[LN:D64982] [AC:D64982] [PN:yohJ protein] [GN:yohJ] [CL:conserved hypothetical protein HI1297] [OR:Escherichia coli] [DB:pir2] >gp:[GI:g405872] [LN:ECOHU47] [AC:U00007] [PN:yohJ] [OR:Escherichia coli] [SR:Escherichia coli K12 BHB2600] [DB:genpept-bct1] [DE:47 to 48 centisome region of E.coli K12 BHB2600.] [LE:43394] [RE:43792] [DI:direct] >gp:[GI:g1788463] [LN:AE000303] [AC:AE000303:U00096] [PN:orf, hypothetical protein] [GN:yohJ] [FN:orf; Unknown] [OR:Escherichia coli] [DB:genpept-bct2] [DE:Escherichia coli K-12 MG1655 section 193 of 400 of the completegenome.] [NT:o132; 100 pct identical to YOHJ_ECOLI SW: P33372] [LE:5693] [RE:6091] [DI:direct]

| ORF Name | NT ID | AA ID | NT/LN | AA/LN | Score | P-value |
|---|---|---|---|---|---|---|
| 25626252_c3_1608 | 1059 | 8230 | 381 | 126 | 499 | 1.1e-47 |

Description sp:[LN:YEJG_ECOLI] [AC:P33917] [GN:YEJG] [OR:Escherichia coli] [DE:HYPOTHETICAL 12.5 KD PROTEIN IN RTN-BCR INTERGENIC REGION] [SP:P33917] [DB:swissprot] >sp:[LN:D64987] [AC:D64987] [PN:hypothetical 12.5 kD protein in bcr 5'region] [GN:yejG] [OR:Escherichia coli] [DB:pir2] >gp:[GI:g405910] [LN:ECOHU49] [AC:U00008] [PN:yejG] [OR:Escherichia coli] [SR:Escherichia coli K12 BHB2600] [DB:genpept-bct1] [DE:centisome 49 region of E.coli K12 BHB2600.] [NT:GTG start codon.] [LE:4946] [RE:5290] [DI:complement] >gp:[GI:g1788507] [LN:AE000307] [AC:AE000307:U00096] [PN:orf, hypothetical protein] [GN:yejG] [FN:orf; Unknown] [OR:Escherichia coli] [DB:genpept-bct2] [DE:Escherichia coli K-12 MG1655 section 197 of 400 of the completegenome.] [NT:f114; 100 pct identical to YEJG_ECOLI SW: P33917] [LE:10153] [RE:10497] [DI:complement]

| ORF Name | NT ID | AA ID | NT/LN | AA/LN | Score | P-value |
|---|---|---|---|---|---|---|
| 260200_c3_1741 | 1060 | 8231 | 708 | 235 | 1021 | 5.3e-103 |

Description sp:[LN:A64973] [AC:A64973:I55002:S32738] [PN:uridine kinase,] [GN:udk] [CL:uridine kinase] [OR:Escherichia coli] [EC:2.7.1.48] [DB:pir2] >gp:[GI:g1788380] [LN:AE000296] [AC:AE000296:U00096] [PN:uridine/cytidine kinase] [GN:udk] [FN:enzyme; Central intermediary metabolism:] [OR:Escherichia coli] [DB:genpept-bct2] [EC:2.7.1.48] [DE:Escherichia coli K-12 MG1655 section 186 of 400 of the completegenome.] [NT:f231; 100 pct identical to URK_ECOLI SW: P31218 but] [LE:8894] [RE:9589] [DI:complement]

| ORF Name | NT ID | AA ID | NT LN | AA LN | Score | P-value |
|---|---|---|---|---|---|---|
| 26254062_c3_1817 | 1061 | 8232 | 189 | 62 | 50 | 0.0054 |

Description gp:[GI:g1791125] [LN:HSU80141] [AC:U80141] [PN:immunoglobulin heavy chain variable region] [GN:V4-4b] [OR:Homo sapiens] [SR:human] [DB:genpept-pri3] [DE:Human immunoglobulin heavy chain variable region (V4-4b) gene,partial cds.] [NT:Ig VH4 heavy chain] [LE:<1] [RE:>366] [DI:direct]

| ORF Name | NT ID | AA ID | NT LN | AA LN | Score | P-value |
|---|---|---|---|---|---|---|
| 26304707_f1_276 | 1062 | 8233 | 1644 | 547 | 2297 | 3.3e-238 |

Description sp:[LN:GLPA_ECOLI] [AC:P13032:P78238] [GN:GLPA] [OR:Escherichia coli]
[EC:1.1.99.5] [DE:(G-3-P DEHYDROGENASE)] [SP:P13032:P78238] [DB:swissprot]
>sp:[LN:DEECNA] [AC:A32006:G64994] [PN:glycerol-3-phosphate dehydrogenase, chain A, anaerobic] [GN:glpA] [CL:glycerol-3-phosphate dehydrogenase (aerobic)]
[OR:Escherichia coli] [EC:1.1.99.5] [DB:pir1] [MP:49 min]
>gp:[GI:d1016788:g1799588] [LN:D90855] [AC:D90855:AB001340]
[PN:glycerol-3-phosphate dehydrogenase (EC 1.1.99.5)] [GN:glpA] [OR:Escherichia coli] [SR:Escherichia coli (strain:K12) DNA, clone_lib:Kohara lambda minise]
[DB:genpept-bct1] [DE:E.coli genomic DNA, Kohara clone #377(50.5-50.9 min.).]
[NT:similar to [PIR Accession Number A32006]] [LE:12931] [RE:14559] [DI:direct]
>gp:[GI:g1788574] [LN:AE000314] [AC:AE000314:U00096] [PN:sn-glycerol-3-phosphate dehydrogenase] [GN:glpA] [FN:enzyme; Energy metabolism, carbon: Anaerobic]
[OR:Escherichia coli] [DB:genpept-bct2] [EC:1.1.99.5] [DE:Escherichia coli K-12 MG1655 section 204 of 400 of the completegenome.] [NT:o542; 99 pct identical to GLPA_ECOLI SW: P13032] [LE:3098] [RE:4726] [DI:direct]

| ORF Name | NT ID | AA ID | NT LN | AA LN | Score | P-value |
|---|---|---|---|---|---|---|
| 26442707_f1_43 | 1063 | 8234 | 993 | 330 | 1448 | 3.0e-148 |

Description sp:[LN:HIS1_SALTY] [AC:P00499] [GN:HISG] [OR:Salmonella typhimurium]
[EC:2.4.2.17] [DE:ATP PHOSPHORIBOSYLTRANSFERASE,] [SP:P00499] [DB:swissprot]
>sp:[LN:XREBT] [AC:JS0156:A00584:A33864] [PN:ATP phosphoribosyltransferase,]
[GN:hisG] [CL:ATP phosphoribosyltransferase] [OR:Salmonella typhimurium]
[EC:2.4.2.17] [DB:pir1] [MP:42 min] >gp:[GI:g47721] [LN:STHISOP] [AC:X13464]
[OR:Salmonella typhimurium] [DB:genpept-bct1] [DE:Salmonella typhimurium DNA for
histidin operon genes hisGDCBHAFIE.] [NT:hisG ORF (AA 1-299)] [SP:P00499]
[LE:276] [RE:1175] [DI:direct] >gp:[GI:g154114] [LN:STYHISGA] [AC:M28367]
[GN:hisG] [OR:Salmonella typhimurium] [SR:Salmonella typhimurium DNA]
[DB:genpept-bct1] [DE:Salmonella typhimurium hisG2148 gene, complete cds.] [LE:1]
[RE:900] [DI:direct] >gp:[GI:g154118] [LN:STYHISOGD] [AC:J01804] [PN:ATP
phosphoribosyltransferase] [GN:hisG] [OR:Salmonella typhimurium] [SR:Salmonella
typhimurium (strain LT2) DNA] [DB:genpept-bct1] [DE:S.typhimurium his operon
encoding ATP phosphoribosyl transferase(hisG), histidinol dehydrogenase (hisD),
histidinol phosphateaminotransferase (hisC) complete cds, and
imidazole-glycerolphosphate dehydratase (hisB), 5' end.] [LE:904] [RE:1803]
[DI:direct] >gp:[GI:g1045578] [LN:CVU37023] [AC:U37023] [PN:ATP
phosphoribosyltransferase] [OR:Cloning vector pHUKH1] [DB:genpept-syn]
[DE:Cloning vector pHUKH1, complete sequence.] [LE:169] [RE:1068] [DI:complement]
>gp:[GI:g1045581] [LN:CVU37023] [AC:U37023] [PN:ATP phosphoribosyltransferase]
[OR:Cloning vector pHUKH1] [DB:genpept-syn] [DE:Cloning vector pHUKH1, complete
sequence.] [LE:4108] [RE:5007] [DI:complement] >gp:[GI:g1045584] [LN:CVU37024]
[AC:U37024] [PN:ATP phosphoribosyltransferase] [OR:Cloning vector pHUKH2]
[DB:genpept-syn] [DE:Cloning vector pHUKH2, complete sequence.] [LE:148]
[RE:1047] [DI:complement] >gp:[GI:g1045587] [LN:CVU37024] [AC:U37024] [PN:ATP
phosphoribosyltransferase] [OR:Cloning vector pHUKH2] [DB:genpept-syn]
[DE:Cloning vector pHUKH2, complete sequence.] [LE:4087] [RE:4986]
[DI:complement] >gp:[GI:g1045590] [LN:CVU37068] [AC:U37068] [PN:ATP
phosphoribosyltransferase] [OR:Cloning vector pHUKH3] [DB:genpept-syn]
[DE:Cloning vector pHUKH3, complete sequence.] [LE:169] [RE:1068] [DI:complement]
>gp:[GI:g1045593] [LN:CVU37068] [AC:U37068] [PN:ATP phosphoribosyltransferase]
[OR:Cloning vector pHUKH3] [DB:genpept-syn] [DE:Cloning vector pHUKH3, complete
sequence.] [LE:4108] [RE:5007] [DI:complement] >gp:[GI:g1045596] [LN:CVU37069]
[AC:U37069] [PN:ATP phosphoribosyltransferase] [OR:Cloning vector pHUKH4]
[DB:genpept-syn] [DE:Cloning vector pHUKH4, complete sequence.] [LE:148]
[RE:1047] [DI:complement] >gp:[GI:g1045599] [LN:CVU37069] [AC:U37069] [PN:ATP

| ORF Name | NT ID | AA ID | NT LN | AA LN | Score | P-value |
|---|---|---|---|---|---|---|
| 26448588_c3_1540 | 1064 | 8235 | 516 | 171 | 293 | 2.0e-24 |

Description sp:[LN:T03166] [AC:T03166] [PN:probable immediate early protein] [OR:alcelaphine
herpesvirus 1] [DB:pir2] >gp:[GI:g2338034] [LN:AF005370] [AC:AF005370]
[PN:putative immediate early protein] [OR:Alcelaphine herpesvirus 1]
[SR:wildebeest herpesvirus] [DB:genpept-vrl] [DE:Alcelaphine herpesvirus 1 L-DNA,
complete sequence.] [NT:ORF73; similar to H. saimiri and KSHV ORF73] [LE:116376]
[RE:120278] [DI:complement]

| ORF Name | NT ID | AA ID | NT/LN | AA/LN | Score | P-value |
|---|---|---|---|---|---|---|
| 26449088_c1_972 | 1065 | 8236 | 537 | 178 | 245 | 1.0e-19 |

Description gp:[GI:g4218005] [LN:ATAC006135] [AC:AC006135] [PN:putative vicilin storage protein] [GN:F24H14.11] [OR:Arabidopsis thaliana] [SR:thale cress] [DB:genpept-pln2] [DE:Arabidopsis thaliana chromosome II BAC F24H14 genomic sequence, complete sequence.] [LE:41423:42147:42375:42802] [RE:41799:42279:42704:44061] [DI:directJoin]

| ORF Name | NT ID | AA ID | NT/LN | AA/LN | Score | P-value |
|---|---|---|---|---|---|---|
| 26594131_c2_1309 | 1066 | 8237 | 1650 | 549 | 2395 | 1.3e-248 |

Description sp:[LN:YOJI_ECOLI] [AC:P33941:P33942] [GN:YOJI] [OR:Escherichia coli] [DE:HYPOTHETICAL ABC TRANSPORTER ATP-BINDING PROTEIN YOJI] [SP:P33941:P33942] [DB:swissprot] >sp:[LN:A64991] [AC:A64991] [PN:hypothetical ABC transporter in eco-alkB intergenic region] [GN:yojI] [CL:ATP-binding cassette homology] [OR:Escherichia coli] [DB:pir2] >gp:[GI:d1016719:g1736852] [LN:D90850] [AC:D90850:AB001340] [PN:ATP-binding protein SyrD.] [GN:yojI] [OR:Escherichia coli] [SR:Escherichia coli (strain:K12) DNA, clone_lib:Kohara lambda minise] [DB:genpept-bct1] [DE:E.coli genomic DNA, Kohara clone #373(49.5-49.9 min.).] [NT:ORF_ID:o372#6; similar to [SwissProt Accession] [LE:6490] [RE:8133] [DI:complement] >gp:[GI:g453991] [LN:ECOHU49] [AC:U00008] [PN:yojI] [OR:Escherichia coli] [SR:Escherichia coli K12 BHB2600] [DB:genpept-bct1] [DE:centisome 49 region of E.coli K12 BHB2600.] [NT:ABC-type ATP-dependent transport protein. Match to] [LE:34023] [RE:35666] [DI:complement] >gp:[GI:g1788540] [LN:AE000310] [AC:AE000310:U00096] [PN:putative ATP-binding component of a transport] [GN:yojI] [FN:putative transport; Not classified] [OR:Escherichia coli] [DB:genpept-bct2] [DE:Escherichia coli K-12 MG1655 section 200 of 400 of the completegenome.] [NT:f547; 100 pct identical to YOJI_ECOLI SW: P33941] [LE:3292] [RE:4935] [DI:complement]

| ORF Name | NT ID | AA ID | NT/LN | AA/LN | Score | P-value |
|---|---|---|---|---|---|---|
| 26696058_f3_892 | 1067 | 8238 | 1125 | 374 | 357 | 1.2e-32 |

Description sp:[LN:A70365] [AC:A70365] [PN:conserved hypothetical protein aq_740] [GN:aq_740] [OR:Aquifex aeolicus] [DB:pir2] >gp:[GI:g2983326] [LN:AE000705] [AC:AE000705:AE000657] [PN:hypothetical protein] [GN:aq_740] [OR:Aquifex aeolicus] [DB:genpept-bct2] [DE:Aquifex aeolicus section 37 of 109 of the complete genome.] [LE:8344] [RE:9405] [DI:direct]

| ORF Name | NT ID | AA ID | NT LN | AA LN | Score | P-value |
|---|---|---|---|---|---|---|
| 26750341_c2_1433 | 1068 | 8239 | 792 | 263 | 517 | 1.4e-49 |

Description sp:[LN:A71952] [AC:A71952] [PN:dipeptide transport system ATP-binding protein] [GN:dppF] [CL:inner membrane protein malK:ATP-binding cassette homology] [OR:Helicobacter pylori] [SR:strain J99, , strain J99] [SR:strain J99, ] [DB:pir2] >gp:[GI:g4154801] [LN:AE001465] [AC:AE001465:AE001439] [PN:DIPEPTIDE TRANSPORT SYSTEM ATP-BINDING PROTEIN] [GN:dppF] [OR:Helicobacter pylori J99] [DB:genpept-bct2] [DE:Helicobacter pylori, strain J99 section 26 of 132 of the completegenome.] [NT:similar to H. pylori 26695 gene HP0302] [LE:13442] [RE:14248] [DI:direct]

| ORF Name | NT ID | AA ID | NT LN | AA LN | Score | P-value |
|---|---|---|---|---|---|---|
| 26772938_f2_590 | 1069 | 8240 | 1584 | 527 | 147 | 2.0e-15 |

Description gp:[GI:e137039:g1226023] [LN:MSGYRAB] [AC:X84077] [GN:ORF617] [OR:Mycobacterium smegmatis] [DB:genpept-bct1] [DE:M.smegmatis gyrB and gyrA genes.] [NT:val start codon] [LE:3075] [RE:4925] [DI:complement]

| ORF Name | NT ID | AA ID | NT LN | AA LN | Score | P-value |
|---|---|---|---|---|---|---|
| 26816943_c1_1166 | 1070 | 8241 | 1221 | 406 | 105 | 0.0071 |

Description sp:[LN:T08176] [AC:T08176] [PN:glucose-1-phosphate adenylyltransferase, large chain, precursor] [GN:sta6] [OR:Chlamydomonas reinhardtii] [EC:2.7.7.27] [DB:pir2] >gp:[GI:e201253:g1149717] [LN:CRSTA6GEN] [AC:X91736] [PN:glucose-1-phosphate adenylyltransferase] [GN:sta6] [OR:Chlamydomonas reinhardtii] [DB:genpept-pln1] [EC:2.7.7.27] [DE:C.reinhardtii mRNA for ADP-glucose pyrophosphorylase.] [NT:ADP-glucose pyrophosphorylase; large subunit] [LE:15] [RE:884] [DI:direct]

| ORF Name | NT ID | AA ID | NT LN | AA LN | Score | P-value |
|---|---|---|---|---|---|---|
| 27017_f1_84 | 1071 | 8242 | 342 | 113 | 117 | 1.2e-06 |

Description gp:[GI:g2062670] [LN:PWU88714] [AC:U88714] [PN:Nkx-3.2] [GN:PwNkx-3.2] [OR:Pleurodeles waltl] [SR:Iberian ribbed newt] [DB:genpept-vrt] [DE:Pleurodeles waltl homeodomain protein Nkx-3.2 (PwNkx-3.2) mRNA,complete cds.] [NT:homeobox gene; homeodomain protein] [LE:568] [RE:1395] [DI:direct]

| ORF_Name | NT ID | AA ID | NT/LN | AA/LN | Score | P-value |
|---|---|---|---|---|---|---|
| 276430_f3_795 | 1072 | 8243 | 2151 | 716 | 3429 | 0.0 |

Description gp:[GI:g405895] [LN:ECOHU47] [AC:U00007] [PN:methionyl-tRNA synthetase]
[OR:Escherichia coli] [SR:Escherichia coli K12 BHB2600] [DB:genpept-bct1] [DE:47
to 48 centisome region of E.coli K12 BHB2600.] [NT:methionyl-tRNA synthetase.]
[LE:7059] [RE:9101] [DI:direct]

| ORF_Name | NT ID | AA ID | NT/LN | AA/LN | Score | P-value |
|---|---|---|---|---|---|---|
| 2819452_c1_1088 | 1073 | 8244 | 669 | 222 | 1051 | 3.5e-106 |

Description sp:[LN:H64983] [AC:H64983:S27052:S18399:A59024] [PN:GTP cyclohydrolase I,]
[GN:folE] [CL:GTP cyclohydrolase I] [OR:Escherichia coli] [EC:3.5.4.16] [DB:pir2]
>gp:[GI:g312964] [LN:ECFOLE] [AC:X63910:S85480] [PN:GTP cyclohydrolase i]
[GN:folE] [OR:Escherichia coli] [DB:genpept-bct1] [EC:3.5.4.16] [DE:E.coli folE
gene for GTP cyclohydrolase I.] [SP:P27511] [LE:232] [RE:900] [DI:direct]
>gp:[GI:g405902] [LN:ECOHU47] [AC:U00007] [PN:GTP cyclohydrolase I]
[OR:Escherichia coli] [SR:Escherichia coli K12 BHB2600] [DB:genpept-bct1] [DE:47
to 48 centisome region of E.coli K12 BHB2600.] [NT:GTP cyclohydrolase I.]
[LE:50729] [RE:51397] [DI:complement] >gp:[GI:g1788476] [LN:AE000304]
[AC:AE000304:U00096] [PN:GTP cyclohydrolase I] [GN:folE] [FN:enzyme; Biosynthesis
of cofactors, carriers:] [OR:Escherichia coli] [DB:genpept-bct2] [EC:3.5.4.16]
[DE:Escherichia coli K-12 MG1655 section 194 of 400 of the completegenome.]
[NT:f222; 100 pct identical to GCH1_ECOLI SW: P27511] [LE:6393] [RE:7061]
[DI:complement]

| ORF_Name | NT ID | AA ID | NT/LN | AA/LN | Score | P-value |
|---|---|---|---|---|---|---|
| 2923913_f2_421 | 1074 | 8245 | 1251 | 416 | 1632 | 9.6e-168 |

Description sp:[LN:YEGM_ECOLI] [AC:P76397] [GN:YEGM] [OR:Escherichia coli] [DE:HYPOTHETICAL
44.5 KD PROTEIN IN ALKA-BAES INTERGENIC REGION PRECURSOR] [SP:P76397]
[DB:swissprot]

| ORF_Name | NT ID | AA ID | NT/LN | AA/LN | Score | P-value |
|---|---|---|---|---|---|---|
| 29474050_f3_695 | 1075 | 8246 | 228 | 75 | | |

Description

NO-HIT

| ORF Name | NT ID | AA ID | NT LN | AA LN | Score | P-value |
|---|---|---|---|---|---|---|
| 29484662_c1_1119 | 1076 | 8247 | 1863 | 620 | 2452 | 1.2e-254 |

Description sp:[LN:YEHU_ECOLI] [AC:P33357:P76434] [GN:YEHU] [OR:Escherichia coli]
[DE:HYPOTHETICAL 62.1 KD PROTEIN IN MOLR-BGLX INTERGENIC REGION PRECURSOR]
[SP:P33357:P76434] [DB:swissprot] >sp:[LN:E64980] [AC:E64980] [PN:hypothetical
62.1 kD protein in molR-bglX intergenic region] [GN:yehU] [CL:hypothetical
protein b2380] [OR:Escherichia coli] [DB:pir1] >gp:[GI:g1788446] [LN:AE000301]
[AC:AE000301:U00096] [PN:putative 2-component sensor protein] [GN:yehU]
[FN:putative regulator; Not classified] [OR:Escherichia coli] [DB:genpept-bct2]
[DE:Escherichia coli K-12 MG1655 section 191 of 400 of the completegenome.]
[NT:f561; 99 pct identical to YEHU_ECOLI SW: P33357] [LE:8769] [RE:10454]
[DI:complement]

| ORF Name | NT ID | AA ID | NT LN | AA LN | Score | P-value |
|---|---|---|---|---|---|---|
| 29589012_c2_1531 | 1077 | 8248 | 1926 | 641 | 846 | 1.9e-84 |

Description sp:[LN:Y4LL_RHISN] [AC:P55552] [GN:Y4LL] [OR:Rhizobium sp] [SR:,strain NGR234]
[DE:HYPOTHETICAL 91.8 KD PROTEIN Y4LL] [SP:P55552] [DB:swissprot]
>gp:[GI:g2182511] [LN:AE000083] [AC:AE000083:U00090] [PN:Y4lL] [GN:y4lL]
[OR:Rhizobium sp. NGR234] [DB:genpept-bct2] [DE:Rhizobium sp. NGR234 plasmid
pNGR234a, section 20 of 46 of thecomplete plasmid sequence.] [NT:hypothetical
91.8 kd protein (member of Escherichia] [LE:8259] [RE:10742] [DI:complement]

| ORF Name | NT ID | AA ID | NT LN | AA LN | Score | P-value |
|---|---|---|---|---|---|---|
| 29850006_f3_912 | 1078 | 8249 | 2748 | 915 | 3444 | 0.0 |

Description gp:[GI:g4960196] [LN:AF153717] [AC:AF153717] [PN:putative regulator YojN]
[GN:yojN] [OR:Salmonella typhimurium] [DB:genpept-bct2] [DE:Salmonella
typhimurium putative regulator YojN (yojN) gene,complete cds; and regulator RcsB
(rcsB) gene, partial cds.] [NT:similar to RbsA protein.] [LE:304] [RE:2973]
[DI:direct]

| ORF Name | NT ID | AA ID | NT/LN | AA/LN | Score | P-value |
|---|---|---|---|---|---|---|
| 29890791_f2_357 | 1079 | 8250 | 1089 | 362 | 1632 | 9.6e-168 |

Description sp:[LN:HIS7_ECOLI] [AC:P06987:P78077] [GN:HISB] [OR:Escherichia coli]
[EC:4.2.1.19:3.1.3.15] [DE:HISTIDINOL-PHOSPHATASE,]] [SP:P06987:P78077]
[DB:swissprot] >gp:[GI:d1016577:g1736700] [LN:D90840] [AC:D90840:AB001340]
[PN:HisB bifunctional enzyme] [GN:hisB] [OR:Escherichia coli] [SR:Escherichia
coli (strain:K12) DNA, clone_lib:Kohara lambda minise] [DB:genpept-bct1]
[DE:E.coli genomic DNA, Kohara clone #350(44.9-45.2 min.).] [NT:ORF_ID:o350#8;
similar to [PIR Accession Number] [LE:10810] [RE:11877] [DI:direct]
>gp:[GI:g41696] [LN:ECHISCBH] [AC:X03416:K00054] [OR:Escherichia coli]
[DB:genpept-bct1] [DE:E. coli genes hisC and hisB
forimidazolylacetolphosphate:L-glutamate aminotransferase (EC 2.6.1.9)and
bifunctional enzyme (imidazoleglycerolphosphate dehydratase (EC4.2.1.19) and
histinolphosphate phosphatase (EC 3.1.3.15).] [NT:hisB protein] [SP:P06987]
[LE:1082] [RE:2149] [DI:direct] >gp:[GI:g41711] [LN:ECHISOP] [AC:X13462]
[OR:Escherichia coli] [DB:genpept-bct1] [DE:Escherichia coli DNA for histidin
operon genes hisGDCBHAFIE.] [NT:hisB ORF (AA 1-355)] [SP:P06987] [LE:3550]
[RE:4617] [DI:direct]

| ORF Name | NT ID | AA ID | NT/LN | AA/LN | Score | P-value |
|---|---|---|---|---|---|---|
| 29925058_f1_60 | 1080 | 8251 | 294 | 97 | 125 | 1.5e-07 |

Description sp:[LN:YIA_RHISP] [AC:P17986] [OR:Rhizobium sp] [DE:INSERTION ELEMENT ISR1
HYPOTHETICAL 30.8 KD PROTEIN A] [SP:P17986] [DB:swissprot] >sp:[LN:S09662]
[AC:S09662] [PN:hypothetical protein A (insertion sequence ISR1)] [OR:Rhizobium
sp.] [DB:pir2] >gp:[GI:g581509] [LN:RHISR1] [AC:X06616] [OR:Rhizobium sp.]
[SR:Rhizobium sp] [DB:genpept-bct1] [DE:Rhizobium insertion element ISR1.]
[NT:ORF A (AA 1-278)] [SP:P17986] [LE:34] [RE:870] [DI:complement]

| ORF Name | NT ID | AA ID | NT/LN | AA/LN | Score | P-value |
|---|---|---|---|---|---|---|
| 29925461_c1_1116 | 1081 | 8252 | 450 | 149 | 114 | 6.9e-07 |

Description gp:[GI:e1370576:g4158213] [LN:SC1A11] [AC:AL035205] [PN:hypothetical protein
SC1A11.02c] [GN:SC1A11.02c] [OR:Streptomyces coelicolor] [DB:genpept-bct1]
[DE:Streptomyces coelicolor cosmid 1A11.] [NT:SC1A11.02c, partial CDS, unknown,
len: 134aa;] [LE:302] [RE:>760] [DI:complement]

| ORF Name | NT ID | AA ID | NT/LN | AA/LN | Score | P-value |
|---|---|---|---|---|---|---|
| 29978956_f2_414 | 1082 | 8253 | 195 | 64 | 50 | 0.028 |

Description gp:[GI:g1894913] [LN:HSU67319] [AC:U67319] [PN:Lice2 beta cysteine protease]
[OR:Homo sapiens] [SR:human] [DB:genpept-pri3] [DE:Human Lice2 beta cysteine
protease mRNA, complete cds.] [NT:similar to ICE and CED-3 cysteine protease]
[LE:229] [RE:1239] [DI:direct]

| ORF Name | NT ID | AA ID | NT LN | AA LN | Score | P-value |
|---|---|---|---|---|---|---|
| 30272030_c1_1096 | 1083 | 8254 | 255 | 84 | | |

Description

NO-HIT

| ORF Name | NT ID | AA ID | NT LN | AA LN | Score | P-value |
|---|---|---|---|---|---|---|
| 30285926_f3_883 | 1084 | 8255 | 1482 | 493 | 352 | 4.2e-32 |

Description gp:[GI:d1001999:g216807] [LN:PSE6AHDH] [AC:D10678] [PN:6-aminohexanoate-dimer
hydrolase] [GN:nylB] [OR:Pseudomonas sp.] [SR:Pseudomonas sp. (strain:NK87)
plasmid:pNAD2 DNA] [DB:genpept-bct1] [EC:3.5.1.46] [DE:Pseudomonas sp. plasmid
pNAD2 gene for 6-aminohexanoate-dimerhydrolase, complete cds.] [LE:611] [RE:1801]
[DI:direct]

| ORF Name | NT ID | AA ID | NT LN | AA LN | Score | P-value |
|---|---|---|---|---|---|---|
| 30652058_c3_1751 | 1085 | 8256 | 666 | 221 | 977 | 2.5e-98 |

Description sp:[LN:YC02_KLEPN] [AC:Q48448] [OR:Klebsiella pneumoniae] [DE:HYPOTHETICAL 22.5
KD PROTEIN IN CPS REGION (ORF2)] [SP:Q48448] [DB:swissprot]
>gp:[GI:d1005306:g747659] [LN:KPNCPS] [AC:D21242] [PN:ORF2] [OR:Klebsiella
pneumoniae] [SR:Klebsiella pneumoniae (strain:Chedid) DNA] [DB:genpept-bct1]
[DE:Klebsiella pneumoniae cps gene cluster for ORFs.] [LE:3562] [RE:4191]
[DI:direct]

| ORF Name | NT ID | AA ID | NT LN | AA LN | Score | P-value |
|---|---|---|---|---|---|---|
| 31256632_f2_617 | 1086 | 8257 | 510 | 169 | 598 | 3.6e-58 |

Description sp:[LN:YFAO_ECOLI] [AC:P52006:P77305] [GN:YFAO] [OR:Escherichia coli]
[DE:HYPOTHETICAL 16.4 KD PROTEIN IN GLPC-AIS INTERGENIC REGION]
[SP:P52006:P77305] [DB:swissprot] >sp:[LN:A64996] [AC:A64996] [PN:hypothetical
protein b2251] [CL:mutT domain homology] [OR:Escherichia coli] [DB:pir2]
>gp:[GI:d1016802:g1799603] [LN:D90856] [AC:D90856:AB001340] [GN:yfaO]
[OR:Escherichia coli] [SR:Escherichia coli (strain:K12) DNA, clone_lib:Kohara
lambda minise] [DB:genpept-bct1] [DE:E.coli genomic DNA, Kohara clone
379(50.8-51.2 min.).] [NT:similar to [SwissProt Accession Number P52006]]
[LE:7946] [RE:8371] [DI:direct] >gp:[GI:g1788585] [LN:AE000315]
[AC:AE000315:U00096] [PN:orf, hypothetical protein] [GN:yfaO] [FN:orf; Unknown]
[OR:Escherichia coli] [DB:genpept-bct2] [DE:Escherichia coli K-12 MG1655 section
205 of 400 of the completegenome.] [NT:o141; This 141 aa ORF is 30 pct identical
(8 gaps)] [LE:2263] [RE:2688] [DI:direct]

| ORF Name | NT ID | AA ID | NT LN | AA LN | Score | P-value |
|---|---|---|---|---|---|---|
| 31270342_c3_1581 | 1087 | 8258 | 1068 | 355 | 1406 | 8.5e-144 |

Description sp:[LN:APBE_SALTY] [AC:P41780:O06948] [GN:APBE] [OR:Salmonella typhimurium]
[DE:THIAMINE BIOSYNTHESIS LIPOPROTEIN APBE PRECURSOR] [SP:P41780:O06948]
[DB:swissprot] >gp:[GI:g2739188] [LN:AF035376] [AC:AF035376] [PN:inner membrane
lipoprotein] [GN:apbE] [FN:synthesis of the pyrimidine moiety of thiamine]
[OR:Salmonella typhimurium] [DB:genpept-bct2] [DE:Salmonella typhimurium inner
membrane lipoprotein (apbE) gene,complete cds.] [NT:ApbE] [LE:67] [RE:1119]
[DI:direct]

| ORF Name | NT ID | AA ID | NT LN | AA LN | Score | P-value |
|---|---|---|---|---|---|---|
| 31333406_f2_603 | 1088 | 8259 | 1392 | 463 | 1383 | 2.3e-141 |

Description sp:[LN:GLPB_ECOLI] [AC:P13033] [GN:GLPB] [OR:Escherichia coli] [EC:1.1.99.5]
[DE:(G-3-P DEHYDROGENASE)] [SP:P13033] [DB:swissprot] >sp:[LN:DEECNB]
[AC:B32006:H64994] [PN:glycerol-3-phosphate dehydrogenase, chain B, anaerobic]
[GN:glpB] [CL:glycerol-3-phosphate dehydrogenase (anaerobic) chain B]
[OR:Escherichia coli] [EC:1.1.99.5] [DB:pir1] [MP:49 min]
>gp:[GI:d1016789:g1799589] [LN:D90855] [AC:D90855:AB001340]
[PN:glycerol-3-phosphate dehydrogenase (EC 1.1.99.5)] [GN:glpB] [OR:Escherichia
coli] [SR:Escherichia coli (strain:K12) DNA, clone_lib:Kohara lambda minise]
[DB:genpept-bct1] [DE:E.coli genomic DNA, Kohara clone #377(50.5-50.9 min.).]
[NT:similar to [PIR Accession Number B32006]] [LE:14549] [RE:15808] [DI:direct]
>gp:[GI:g146178] [LN:ECOGLPA] [AC:M20938] [PN:glycerol-3-phosphate dehydrogenase
subunit B] [GN:glpB] [OR:Escherichia coli] [SR:Escherichia coli (strain JM83)
(clone: pGLP1.) DNA] [DB:genpept-bct1] [DE:E.coli glpABC operon encoding
glycerol-3-phosphate dehydrogenase,complete cds.] [LE:1841] [RE:3100] [DI:direct]
>gp:[GI:g1788575] [LN:AE000314] [AC:AE000314:U00096] [PN:sn-glycerol-3-phosphate
dehydrogenase] [GN:glpB] [FN:enzyme; Energy metabolism, carbon: Anaerobic]
[OR:Escherichia coli] [DB:genpept-bct2] [EC:1.1.99.5] [DE:Escherichia coli K-12
MG1655 section 204 of 400 of the completegenome.] [NT:o419; 99 pct identical to
GLPB_ECOLI SW: P13033] [LE:4716] [RE:5975] [DI:direct]

| ORF Name | NT ID | AA ID | NT/LN | AA/LN | Score | P-value |
|---|---|---|---|---|---|---|
| 31531528_c1_985 | 1089 | 8260 | 1146 | 381 | 1464 | 6.1e-150 |

Description sp:[LN:MENB_ECOLI] [AC:P27290] [GN:MENB] [OR:Escherichia coli] [EC:4.1.3.36]
[DE:(DHNA SYNTHETASE)] [SP:P27290] [DB:swissprot] >sp:[LN:D64997]
[AC:A42714:D64997] [PN:naphthoate synthase,:DHNA synthase:menaquinone
biosynthesis enzyme MenB:mitochondrial enoyl-CoA hydratase homolog] [GN:menB]
[CL:naphthoate synthase:enoyl-CoA hydratase homology] [OR:Escherichia coli]
[EC:4.1.3.36] [DB:pir1] >gp:[GI:d1016814:g1799616] [LN:D90857]
[AC:D90857:AB001340] [PN:naphthoate synthase, DHNA synthase,] [OR:Escherichia
coli] [SR:Escherichia coli (strain:K12) DNA, clone_lib:Kohara lambda minise]
[DB:genpept-bct1] [DE:E.coli genomic DNA, Kohara clone #380(51.1-51.4 min.).]
[NT:similar to [PIR Accession Number A42714]] [LE:8589] [RE:9446] [DI:complement]
>gp:[GI:g145740] [LN:ECODHNASYN] [AC:M93421] [PN:DHNA synthase] [GN:menB]
[OR:Escherichia coli] [SR:Escherichia coli (individual_isolate PL2024, strain
K-12) DNA] [DB:genpept-bct1] [DE:E.coli DHNA synthase (menB) gene, complete cds.]
[LE:357] [RE:1214] [DI:direct] >gp:[GI:g1788597] [LN:AE000316]
[AC:AE000316:U00096] [PN:dihydroxynaphtoic acid synthetase] [GN:menB] [FN:enzyme;
Biosynthesis of cofactors, carriers:] [OR:Escherichia coli] [DB:genpept-bct2]
[EC:4.1.3.36] [DE:Escherichia coli K-12 MG1655 section 206 of 400 of the
completegenome.] [NT:f285; 100 pct identical to MENB_ECOLI SW: P27290] [LE:2384]
[RE:3241] [DI:complement]

| ORF Name | NT ID | AA ID | NT/LN | AA/LN | Score | P-value |
|---|---|---|---|---|---|---|
| 31536656_c1_1035 | 1090 | 8261 | 465 | 154 | 104 | 7.9e-06 |

Description gp:[GI:g5714603] [LN:PSTRTETC1] [AC:AF157797] [PN:hypothetical protein G]
[OR:Pseudomonas sp. R9] [DB:genpept-bct2] [DE:Pseudomonas sp. R9 transposon
tetracycline resistance TetChypothetical protein D, hypothetical protein C,
hypotheticalprotein B, hypothetical protein E, hypothetical protein F,
sulfatepermease, hypothetical protein G, and hypothetical protein H
genes,complete cds.] [NT:ORFG] [LE:2651] [RE:2962] [DI:direct]

| ORF Name | NT ID | AA ID | NT/LN | AA/LN | Score | P-value |
|---|---|---|---|---|---|---|
| 31657638_c2_1491 | 1091 | 8262 | 855 | 284 | 686 | 1.7e-67 |

Description gp:[GI:g2645861] [LN:AF034211] [AC:AF034211] [PN:transposase OrfB]
[OR:Desulfovibrio vulgaris vulgaris] [DB:genpept-bct2] [DE:Desulfovibrio vulgaris
vulgaris insertion sequence ISD1 transposasegene, complete cds.] [NT:transposase
C-terminal; orfA and orfB express] [LE:<256] [RE:1188] [DI:direct]

| ORF Name | NT ID | AA ID | NT/LN | AA/LN | Score | P-value |
|---|---|---|---|---|---|---|
| 31674041_f2_373 | 1092 | 8263 | 1317 | 438 | | |

Description

NO-HIT

| ORF Name | NT ID | AA ID | NT/LN | AA/LN | Score | P-value |
|---|---|---|---|---|---|---|
| 31804150_c3_1782 | 1093 | 8264 | 915 | 304 | 842 | 5.0e-84 |

Description sp:[LN:YEEY_ECOLI] [AC:P76369:O07996] [GN:YEEY] [OR:Escherichia coli] [DE:HYPOTHETICAL TRANSCRIPTIONAL REGULATOR IN SBCB-HISL INTERGENIC REGION] [SP:P76369:O07996] [DB:swissprot] >sp:[LN:F64966] [AC:F64966] [PN:probable transcription regulator yeeY] [GN:yeeY] [CL:probable transcription regulator ybbS] [OR:Escherichia coli] [DB:pir1] >gp:[GI:d1016572:g1736695] [LN:D90840] [AC:D90840:AB001340] [PN:Transcriptional activator protein MetR.] [OR:Escherichia coli] [SR:Escherichia coli (strain:K12) DNA, clone_lib:Kohara lambda minise] [DB:genpept-bct1] [DE:E.coli genomic DNA, Kohara clone #350(44.9-45.2 min.).] [NT:ORF_ID:o350#1; similar to [SwissProt Accession] [LE:4672] [RE:5622] [DI:complement] >gp:[GI:g1788326] [LN:AE000293] [AC:AE000293:U00096] [PN:putative transcriptional regulator LYSR-type] [GN:yeeY] [FN:putative regulator; Not classified] [OR:Escherichia coli] [DB:genpept-bct2] [DE:Escherichia coli K-12 MG1655 section 183 of 400 of the completegenome.] [NT:f316; This 316 aa ORF is 38 pct identical (4 gaps)] [LE:1745] [RE:2695] [DI:complement]

| ORF Name | NT ID | AA ID | NT/LN | AA/LN | Score | P-value |
|---|---|---|---|---|---|---|
| 31812750_f3_734 | 1094 | 8265 | 231 | 76 | | |

Description

NO-HIT

| ORF Name | NT ID | AA ID | NT/LN | AA/LN | Score | P-value |
|---|---|---|---|---|---|---|
| 31883267_f1_273 | 1095 | 8266 | 291 | 96 | 398 | 5.6e-37 |

Description sp:[LN:YFAE_ECOLI] [AC:P37910:P77220] [GN:YFAE] [OR:Escherichia coli] [DE:HYPOTHETICAL 9.3 KD PROTEIN IN NRDB-INAA INTERGENIC REGION] [SP:P37910:P77220] [DB:swissprot] >sp:[LN:B64994] [AC:B64994] [PN:hypothetical 9.3 kD protein in nrdB 5'region] [GN:yfaE] [CL:ferredoxin [2Fe-2S] homology] [OR:Escherichia coli] [DB:pir2] >gp:[GI:d1016783:g1799583] [LN:D90855] [AC:D90855:AB001340] [GN:yfaE] [OR:Escherichia coli] [SR:Escherichia coli (strain:K12) DNA, clone_lib:Kohara lambda minise] [DB:genpept-bct1] [DE:E.coli genomic DNA, Kohara clone #377(50.5-50.9 min.).] [NT:similar to SwissProt Accession Number P37910]] [LE:8798] [RE:9052] [DI:direct] >gp:[GI:g1788568] [LN:AE000313] [AC:AE000313:U00096] [PN:orf, hypothetical protein] [GN:yfaE] [FN:orf; Unknown] [OR:Escherichia coli] [DB:genpept-bct2] [DE:Escherichia coli K-12 MG1655 section 203 of 400 of the completegenome.] [NT:o84; 98 pct identical to YFAE_ECOLI SW: P37910] [LE:9051] [RE:9305] [DI:direct]

| ORF Name | NT ID | AA ID | NT/LN | AA/LN | Score | P-value |
|---|---|---|---|---|---|---|
| 31900757_f2_537 | 1096 | 8267 | 1221 | 406 | 1699 | 7.6e-175 |

Description sp:[LN:YEIO_ECOLI] [AC:P33026] [GN:YEIO] [OR:Escherichia coli] [DE:HYPOTHETICAL 42.7 KD PROTEIN IN FRUB-SPR INTERGENIC REGION] [SP:P33026] [DB:swissprot] >sp:[LN:A64986] [AC:A64986] [PN:probable membrane protein yeiO] [GN:yeiO] [OR:Escherichia coli] [DB:pir2] >gp:[GI:d1016704:g1736836] [LN:D90849] [AC:D90849:AB001340] [GN:yeiO] [OR:Escherichia coli] [SR:Escherichia coli (strain:K12) DNA, clone_lib:Kohara lambda minise] [DB:genpept-bct1] [DE:E.coli genomic DNA, Kohara clone #369(48.6-49.0 min.).] [NT:ORF_ID:o369#1; similar to [SwissProt Accession] [LE:3548] [RE:4729] [DI:direct] >gp:[GI:g405884] [LN:ECOHU47] [AC:U00007] [PN:yeiO] [OR:Escherichia coli] [SR:Escherichia coli K12 BHB2600] [DB:genpept-bct1] [DE:47 to 48 centisome region of E.coli K12 BHB2600.] [LE:71607] [RE:72788] [DI:direct] >gp:[GI:g1788495] [LN:AE000306] [AC:AE000306:U00096] [PN:putative transport] [GN:yeiO] [FN:orf; Not classified] [OR:Escherichia coli] [DB:genpept-bct2] [DE:Escherichia coli K-12 MG1655 section 196 of 400 of the completegenome.] [NT:o393; 100 pct identical to YEIO_ECOLI SW: P33026] [LE:6511] [RE:7692] [DI:direct]

| ORF Name | NT ID | AA ID | NT/LN | AA/LN | Score | P-value |
|---|---|---|---|---|---|---|
| 31901028_f2_619 | 1097 | 8268 | 600 | 199 | 158 | 2.6e-10 |

Description gp:[GI:g726436] [LN:CELZK84] [AC:U23181] [GN:ZK84.1] [OR:Caenorhabditis elegans] [SR:Caenorhabditis elegans strain=Bristol N2] [DB:genpept-inv2] [DE:Caenorhabditis elegans cosmid ZK84.] [NT:final exon in repeat region; similar to long tandem] [LE:24170:24288:24411:24654] [RE:24234:24357:24597:26737] [DI:directJoin]

| ORF Name | NT ID | AA ID | NT/LN | AA/LN | Score | P-value |
|---|---|---|---|---|---|---|
| 31910455_f1_44 | 1098 | 8269 | 1344 | 447 | 1922 | 1.8e-198 |

Description sp:[LN:DEECHT] [AC:C64967:A26022:JQ0522:I41286] [PN:histidinol dehydrogenase,] [GN:hisD] [CL:histidinol dehydrogenase:histidinol dehydrogenase homology] [OR:Escherichia coli] [EC:1.1.1.23] [DB:pir1] [MP:44 min] >gp:[GI:g1788331] [LN:AE000293] [AC:AE000293:U00096] [PN:L-histidinal:NAD+ oxidoreductase;] [GN:hisD] [FN:enzyme; Amino acid biosynthesis: Histidine] [OR:Escherichia coli] [DB:genpept-bct2] [EC:1.1.1.23] [DE:Escherichia coli K-12 MG1655 section 183 of 400 of the completegenome.] [NT:o434; 99 pct identical to HISX_ECOLI SW: P06988; CG] [LE:5513] [RE:6817] [DI:direct]

| ORF Name | NT ID | AA ID | NT LN | AA LN | Score | P-value |
|---|---|---|---|---|---|---|
| 32302202_c3_1633 | 1099 | 8270 | 939 | 312 | 1560 | 4.1e-160 |

Description sp:[LN:K1PF_ECOLI] [AC:P23539] [GN:FRUK:FPK] [OR:Escherichia coli] [EC:2.7.1.56]
[DE:1-PHOSPHOFRUCTOKINASE, (FRUCTOSE 1-PHOSPHATE KINASE)] [SP:P23539]
[DB:swissprot] >sp:[LN:B37245] [AC:B37245:G64985:S17404]
[PN:1-phosphofructokinase,] [GN:fruK] [CL:6-phosphofructokinase 2]
[OR:Escherichia coli] [EC:2.7.1.56] [DB:pir2] >gp:[GI:d1016702:g1736834]
[LN:D90849] [AC:D90849:AB001340] [PN:1-phosphofructokinase (EC 2.7.1.56)
(Fructose] [GN:fruK, fpk] [OR:Escherichia coli] [SR:Escherichia coli (strain:K12)
DNA, clone_lib:Kohara lambda minise] [DB:genpept-bct1] [DE:E.coli genomic DNA,
Kohara clone #369(48.6-49.0 min.).] [NT:ORF_ID:o368#6; similar to [SwissProt
Accession] [LE:1112] [RE:2050] [DI:complement] >gp:[GI:g41487] [LN:ECFRUK]
[AC:X53948] [PN:1-phosphofructokinase] [GN:fruK] [OR:Escherichia coli]
[DB:genpept-bct1] [EC:2.7.1.56] [DE:E. coli fruK gene for
1-phosphofructokinanse.] [SP:P23539] [LE:313] [RE:1251] [DI:direct]
>gp:[GI:g405894] [LN:ECOHU47] [AC:U00007] [PN:1-phosphofructokinase]
[OR:Escherichia coli] [SR:Escherichia coli K12 BHB2600] [DB:genpept-bct1] [DE:47
to 48 centisome region of E.coli K12 BHB2600.] [LE:69171] [RE:70109]
[DI:complement] >gp:[GI:g1788493] [LN:AE000306] [AC:AE000306:U00096]
[PN:fructose-1-phosphate kinase] [GN:fruK] [FN:enzyme; Energy metabolism, carbon:
Glycolysis] [OR:Escherichia coli] [DB:genpept-bct2] [EC:2.7.1.56] [DE:Escherichia
coli K-12 MG1655 section 196 of 400 of the completegenome.] [NT:f312; 100 pct
identical to K1PF_ECOLI SW: P23539] [LE:4075] [RE:5013] [DI:complement]

| ORF Name | NT ID | AA ID | NT LN | AA LN | Score | P-value |
|---|---|---|---|---|---|---|
| 32423186_f3_863 | 1100 | 8271 | 1098 | 365 | 1392 | 2.6e-142 |

Description sp:[LN:YEIR_ECOLI] [AC:P33030:P76444] [GN:YEIR] [OR:Escherichia coli]
[DE:HYPOTHETICAL 36.1 KD PROTEIN IN FRUB-SPR INTERGENIC REGION]
[SP:P33030:P76444] [DB:swissprot] >sp:[LN:D64986] [AC:D64986] [PN:yeiR protein]
[GN:yeiR] [CL:cobW protein] [OR:Escherichia coli] [DB:pir2] >gp:[GI:g1788499]
[LN:AE000307] [AC:AE000307:U00096] [PN:orf, hypothetical protein] [GN:yeiR]
[FN:orf; Unknown] [OR:Escherichia coli] [DB:genpept-bct2] [DE:Escherichia coli
K-12 MG1655 section 197 of 400 of the completegenome.] [NT:o328; 100 pct
identical to 102 residues of] [LE:89] [RE:1075] [DI:direct]

| ORF Name | NT ID | AA ID | NT LN | AA LN | Score | P-value |
|---|---|---|---|---|---|---|
| 3244162_c2_1326 | 1101 | 8272 | 1200 | 399 | 1731 | 3.1e-178 |

Description sp:[LN:E64987] [AC:E64987:JN0659] [PN:bicyclomycin resistance protein] [GN:bcr]
[CL:bicyclomycin resistance protein] [OR:Escherichia coli] [DB:pir1]
>gp:[GI:g1788509] [LN:AE000308] [AC:AE000308:U00096] [PN:bicyclomycin resistance
protein; transmembrane] [GN:bcr] [FN:transport; Drug/analog sensitivity]
[OR:Escherichia coli] [DB:genpept-bct2] [DE:Escherichia coli K-12 MG1655 section
198 of 400 of the completegenome.] [NT:f396; 99 pct identical to BCR_ECOLI SW:
P28246] [LE:197] [RE:1387] [DI:complement]

| ORF Name | NT ID | AA ID | NT LN | AA LN | Score | P-value |
|---|---|---|---|---|---|---|
| 32442750_c2_1469 | 1102 | 8273 | 465 | 154 | 160 | 1.2e-10 |

Description sp:[LN:EBN1_EBV] [AC:P03211] [GN:BKRF1] [OR:Epstein-barr virus] [SR:,strain B95-8:Human herpesvirus 4] [DE:EBNA-1 NUCLEAR PROTEIN] [SP:P03211] [DB:swissprot] >sp:[LN:QQBE31] [AC:C43043:A03773:S33021] [PN:probable nuclear antigen] [CL:Epstein-Barr virus nuclear antigen] [OR:human herpesvirus 4:Epstein-Barr virus] [DB:pir1] >gp:[GI:g1334880] [LN:EBV] [AC:V01555:J02070:K01729:K01730:V01554:X00498:X00499:X00784] [OR:Human herpesvirus 4] [SR:Epstein-Barr virus] [DB:genpept-vrl] [DE:Epstein-Barr virus (EBV) genome, strain B95-8.] [NT:BKRF1 encodes EBNA-1 protein, latent cycle gene.] [SP:P03211] [LE:107950] [RE:109875] [DI:direct]

| ORF Name | NT ID | AA ID | NT LN | AA LN | Score | P-value |
|---|---|---|---|---|---|---|
| 32504163_f1_31 | 1103 | 8274 | 951 | 316 | 502 | 5.3e-48 |

Description sp:[LN:YHA2_EIKCO] [AC:P35649] [OR:Eikenella corrodens] [DE:HYPOTHETICAL 66.3 KD PROTEIN IN HAG2 5'REGION] [SP:P35649] [DB:swissprot] >sp:[LN:S23847] [AC:S23847] [PN:hypothetical protein] [CL:Eikenella corrodens hypothetical protein] [OR:Eikenella corrodens] [DB:pir2] >gp:[GI:g41654] [LN:ECHAGTUF] [AC:Z12610] [PN:hypothetical 66.3 KD protein in HAG2 5'region] [GN:fus] [OR:Eikenella corrodens] [DB:genpept-bct1] [DE:E.corrodens hag2, tufA, fus, rpsG and rpsL genes encodinghemagglutinin protein, elongation factor Tu, elongation factor G,ribosomal protein S7, and ribosomal protein S12.] [SP:P35649] [LE:310] [RE:2046] [DI:direct]

| ORF Name | NT ID | AA ID | NT LN | AA LN | Score | P-value |
|---|---|---|---|---|---|---|
| 3251386_f1_130 | 1104 | 8275 | 459 | 152 | 141 | 9.5e-10 |

Description sp:[LN:USPA_HAEIN] [AC:P44880] [GN:USPA:HI0815] [OR:Haemophilus influenzae] [DE:UNIVERSAL STRESS PROTEIN A HOMOLOG] [SP:P44880] [DB:swissprot] >sp:[LN:A64096] [AC:A64096] [PN:universal stress protein A] [CL:universal stress protein A] [OR:Haemophilus influenzae] [DB:pir2] >gp:[GI:g1573828] [LN:U32764] [AC:U32764:L42023] [PN:universal stress protein A (uspA)] [GN:HI0815] [OR:Haemophilus influenzae Rd] [DB:genpept-bct2] [DE:Haemophilus influenzae Rd section 79 of 163 of the complete genome.] [NT:similar to GB:U00039 SP:P28242 GB:X67639 PID:43280] [LE:124] [RE:549] [DI:complement]

431

| ORF_Name | NT ID | AA ID | NT/LN | AA/LN | Score | P-value |
|---|---|---|---|---|---|---|
| 32542035_c3_1811 | 1105 | 8276 | 1029 | 342 | 1137 | 2.7e-115 |

Description sp:[LN:JN0828] [AC:JN0828:S27615] [PN:chloroperoxidase, precursor] [GN:cpo]
[CL:peroxidase] [OR:Pseudomonas pyrrocinia] [EC:1.11.1.-] [DB:pir2]
>gp:[GI:g151186] [LN:PSECPOA] [AC:M60743] [PN:chloroperoxidase] [GN:cpo]
[OR:Burkholderia pyrrocinia] [SR:P.pyorocivia (ATCC 15958) DNA] [DB:genpept-bct1]
[DE:P.pyorocivia chloroperoxidase gene, complete cds.] [LE:299] [RE:1135]
[DI:direct]

| ORF_Name | NT ID | AA ID | NT/LN | AA/LN | Score | P-value |
|---|---|---|---|---|---|---|
| 32601055_c1_1221 | 1106 | 8277 | 855 | 284 | 1193 | 3.2e-121 |

Description sp:[LN:YEEZ_ECOLI] [AC:P76370] [GN:YEEZ] [OR:Escherichia coli] [DE:HYPOTHETICAL
29.7 KD PROTEIN IN SBCB-HISL INTERGENIC REGION PRECURSOR] [SP:P76370]
[DB:swissprot] >sp:[LN:G64966] [AC:G64966] [PN:hypothetical protein b2016]
[OR:Escherichia coli] [DB:pir2] >gp:[GI:g1788327] [LN:AE000293]
[AC:AE000293:U00096] [PN:putative enzyme of sugar metabolism] [GN:b2016]
[FN:putative enzyme; Not classified] [OR:Escherichia coli] [DB:genpept-bct2]
[DE:Escherichia coli K-12 MG1655 section 183 of 400 of the completegenome.]
[NT:f274; This 274 aa ORF is 26 pct identical (18 gaps)] [LE:2720] [RE:3544]
[DI:complement]

| ORF_Name | NT ID | AA ID | NT/LN | AA/LN | Score | P-value |
|---|---|---|---|---|---|---|
| 32602011_f3_970 | 1107 | 8278 | 1296 | 431 | 128 | 5.1e-05 |

Description gp:[GI:g190400] [LN:HUMPROFILC] [AC:M60499] [PN:profilaggrin] [GN:FLG] [OR:Homo
sapiens] [SR:Human, cDNA to mRNA, clone lambda-HF604] [DB:genpept-pri2] [DE:Human
profilaggrin mRNA, 5' end.] [LE:102] [RE:1496] [DI:direct]

| ORF_Name | NT ID | AA ID | NT/LN | AA/LN | Score | P-value |
|---|---|---|---|---|---|---|
| 32616303_f1_270 | 1108 | 8279 | 408 | 135 | 304 | 5.5e-26 |

Description gp:[GI:g146965] [LN:ECONRDA] [AC:K02672] [GN:nrdB] [OR:Escherichia coli]
[SR:Escherichia coli K-12 DNA, clone pPS2] [DB:genpept-bct1] [DE:E.coli
ribonucleoside diphosphate reductase operon: nrdA and nrdBgenes encoding subunits
B1 and B2.] [NT:ribonucleoside diphosphate reductase B1 subunit] [LE:3505]
[RE:5835] [DI:direct] >gp:[GI:g146966] [LN:ECONRDA] [AC:K02672]
[PN:ribonucleoside diphosphate reductase] [GN:nrdA] [OR:Escherichia coli]
[SR:Escherichia coli K-12 DNA, clone pPS2] [DB:genpept-bct1] [DE:E.coli
ribonucleoside diphosphate reductase operon: nrdA and nrdBgenes encoding subunits
B1 and B2.] [NT:B1 subunit alpha-polypeptide precursor] [LE:3505] [RE:5835]
[DI:direct]

| ORF Name | NT ID | AA ID | NT LN | AA LN | Score | P-value |
|---|---|---|---|---|---|---|
| 32656376_f3_688 | 1109 | 8280 | 816 | 271 | 1132 | 9.2e-115 |

Description gp:[GI:d1041509:g4867932] [LN:AB008676] [AC:AB008676]
[PN:phosphoribosylformimino-5 aminoimidazole] [GN:hisA] [OR:Escherichia coli]
[SR:Escherichia coli (strain:184) DNA, clone:1-4-1] [DB:genpept-bct1]
[DE:Escherichia coli 0157 DNA, map position at 46 min., complete cds.]
[NT:putative] [LE:21064] [RE:21801] [DI:complement]

| ORF Name | NT ID | AA ID | NT LN | AA LN | Score | P-value |
|---|---|---|---|---|---|---|
| 32656631_c1_1000 | 1110 | 8281 | 999 | 332 | 1162 | 6.1e-118 |

Description sp:[LN:C64995] [AC:C64995] [PN:hypothetical protein b2245]
[CL:2,4-dihydroxyhept-2-ene-1,7] [OR:Escherichia coli] [DB:pir2]
>gp:[GI:g1788578] [LN:AE000314] [AC:AE000314:U00096] [PN:orf, hypothetical
protein] [GN:b2245] [FN:orf; Unknown] [OR:Escherichia coli] [DB:genpept-bct2]
[DE:Escherichia coli K-12 MG1655 section 204 of 400 of the completegenome.]
[NT:f267; 45 pct identical (5 gaps) to YHAF_ECOLI] [LE:8493] [RE:9296]
[DI:complement]

| ORF Name | NT ID | AA ID | NT LN | AA LN | Score | P-value |
|---|---|---|---|---|---|---|
| 32675635_f3_673 | 1111 | 8282 | 420 | 139 | 112 | 1.1e-06 |

Description sp:[LN:C55663] [AC:C55663] [PN:oligodendrocyte-specific proline-rich protein 2]
[OR:Homo sapiens] [SR:, man] [DB:pir2] >gp:[GI:d1006205:g1408050] [LN:HUMBP2]
[AC:D28114] [PN:MOBP] [OR:Homo sapiens] [SR:Homo sapiens spinal cord cDNA to
mRNA, clone:hOPRP2] [DB:genpept-pri1] [DE:Human mRNA for MOBP (myelin-associated
oligodendrocytic basicprotein), complete cds, clone hOPRP2.] [LE:9] [RE:560]
[DI:direct]

| ORF Name | NT ID | AA ID | NT LN | AA LN | Score | P-value |
|---|---|---|---|---|---|---|
| 32675786_f3_801 | 1112 | 8283 | 564 | 187 | 126 | 1.2e-05 |

Description gp:[GI:g4455041] [LN:AF116463] [AC:AF116463] [PN:unknown] [OR:Streptomyces
lincolnensis] [DB:genpept-bct2] [DE:Streptomyces lincolnensis putative regulatory
protein WdlA (wdlA)gene, complete cds; and unknown gene.] [LE:1321] [RE:3789]
[DI:direct]

| ORF Name | NT ID | AA ID | NT/LN | AA/LN | Score | P-value |
|---|---|---|---|---|---|---|
| 32680163_c2_1269 | 1113 | 8284 | 810 | 269 | 889 | 5.2e-89 |

Description gp:[GI:d1016815:g1799617] [LN:D90857] [AC:D90857:AB001340] [GN:yfbB]
[OR:Escherichia coli] [SR:Escherichia coli (strain:K12) DNA, clone_lib:Kohara
lambda minise] [DB:genpept-bct1] [DE:E.coli genomic DNA, Kohara clone
380(51.1-51.4 min.).] [NT:similar to [SwissProt Accession Number P37355];]
[LE:9461] [RE:>10273] [DI:complement]

| ORF Name | NT ID | AA ID | NT/LN | AA/LN | Score | P-value |
|---|---|---|---|---|---|---|
| 3307175_c3_1603 | 1114 | 8285 | 1206 | 401 | | |

Description

NO-HIT

| ORF Name | NT ID | AA ID | NT/LN | AA/LN | Score | P-value |
|---|---|---|---|---|---|---|
| 3320443_f3_815 | 1115 | 8286 | 585 | 194 | 793 | 7.7e-79 |

Description sp:[LN:YOHD_ECOLI] [AC:P33366:P76436] [GN:YOHD] [OR:Escherichia coli]
[DE:HYPOTHETICAL 21.4 KD PROTEIN IN PBPG-CDD INTERGENIC REGION]
[SP:P33366:P76436] [DB:swissprot] >gp:[GI:g405866] [LN:ECOHU47] [AC:U00007]
[PN:yohD] [OR:Escherichia coli] [SR:Escherichia coli K12 BHB2600]
[DB:genpept-bct1] [DE:47 to 48 centisome region of E.coli K12 BHB2600.]
[NT:similarity to dedA.] [LE:38571] [RE:39149] [DI:direct]

| ORF Name | NT ID | AA ID | NT/LN | AA/LN | Score | P-value |
|---|---|---|---|---|---|---|
| 33401453_c2_1476 | 1116 | 8287 | 216 | 71 | | |

Description

NO-HIT

| ORF Name | NT ID | AA ID | NT/LN | AA/LN | Score | P-value |
|---|---|---|---|---|---|---|
| 33630211_f2_459 | 1117 | 8288 | 546 | 181 | | |

Description

NO-HIT

| ORF Name | NT ID | AA ID | NT LN | AA LN | Score | P-value |
|---|---|---|---|---|---|---|
| 33706876_c3_1775 | 1118 | 8289 | 357 | 118 | 379 | 5.7e-35 |

Description gp:[GI:d1016580:g1736703] [LN:D90840] [AC:D90840:AB001340] [GN:YHL028W]
[OR:Escherichia coli] [SR:Escherichia coli (strain:K12) DNA, clone_lib:Kohara
lambda minise] [DB:genpept-bct1] [DE:E.coli genomic DNA, Kohara clone
350(44.9-45.2 min.).] [NT:ORF_ID:o350#11; similar to [SwissProt Accession]
[LE:12646] [RE:>12942] [DI:complement] >gp:[GI:d1016588:g1736712] [LN:D90841]
[AC:D90841:AB001340] [GN:YHL028W] [OR:Escherichia coli] [SR:Escherichia coli
(strain:K12) DNA, clone_lib:Kohara lambda minise] [DB:genpept-bct1] [DE:E.coli
genomic DNA, Kohara clone #351(45.1-45.5 min.).] [NT:ORF_ID:o350#11; similar to
[SwissProt Accession] [LE:1604] [RE:>1900] [DI:complement]

| ORF Name | NT ID | AA ID | NT LN | AA LN | Score | P-value |
|---|---|---|---|---|---|---|
| 33711581_c3_1761 | 1119 | 8290 | 1545 | 514 | 2348 | 1.3e-243 |

Description sp:[LN:RFK9_ECOLI] [AC:P37755] [GN:RFBK] [OR:Escherichia coli] [EC:5.4.2.8]
[DE:PHOSPHOMANNOMUTASE, (PMM)] [SP:P37755] [DB:swissprot] >gp:[GI:g441137]
[LN:ECOGNDH] [AC:L27646] [PN:phosphomannomutase] [GN:rfbK1] [OR:Escherichia coli]
[SR:Escherichia coli (strain 09:K30:H12) DNA] [DB:genpept-bct1] [DE:E. coli
phosphogluconate dehydrogenase, GDP-mannosepyrophosphorylase and
phosphomannomutase (gnd, rfbM1 and rfbK1)genes, complete cds.] [LE:3911]
[RE:5281] [DI:direct]

| ORF Name | NT ID | AA ID | NT LN | AA LN | Score | P-value |
|---|---|---|---|---|---|---|
| 33855018_c3_1776 | 1120 | 8291 | 1224 | 407 | | |

Description

NO-HIT

| ORF Name | NT ID | AA ID | NT LN | AA LN | Score | P-value |
|---|---|---|---|---|---|---|
| 33864583_c1_1100 | 1121 | 8292 | 783 | 260 | 738 | 5.2e-73 |

Description sp:[LN:ARBG_ERWCH] [AC:P26211] [GN:ARBG] [OR:Erwinia chrysanthemi]
[DE:BETA-GLUCOSIDE OPERON ANTITERMINATOR] [SP:P26211] [DB:swissprot]
>sp:[LN:A42603] [AC:A42603] [PN:arbG protein] [GN:arbG] [CL:Bacillus subtilis
transcription antiterminator licT] [OR:Erwinia chrysanthemi] [DB:pir2]
>gp:[GI:g148386] [LN:ERWBGPA] [AC:M81772] [GN:arbG] [OR:Erwinia chrysanthemi]
[SR:Erwinia chrysanthemi (strain 3665) DNA] [DB:genpept-bct1] [DE:Erwinia
chrysanthemi putative antiterminator (argG) gene, completecds; beta-glucoside
permease (arbF) gene, complete cds; phospho-beta-glucosidase (arbB) gene,
complete cds; unidentified openreading frame, 5' end.] [NT:putative product
antiterminator; putative] [LE:201] [RE:1052] [DI:direct]

435

| ORF Name | NT ID | AA ID | NT LN | AA LN | Score | P-value |
|---|---|---|---|---|---|---|
| 34116562_c2_1287 | 1122 | 8293 | 1374 | 457 | 2279 | 2.6e-236 |

Description sp:[LN:GLPT_ECOLI] [AC:P08194] [GN:GLPT] [OR:Escherichia coli] [DE:PERMEASE)]
[SP:P08194] [DB:swissprot] >sp:[LN:JNECGT] [AC:S00868:F64994]
[PN:glycerol-3-phosphate transport protein:glycerol-3-phosphate permease]
[GN:glpT] [CL:hexose phosphate transport protein uhpT] [OR:Escherichia coli]
[DB:pir1] [MP:49 min] >gp:[GI:d1016787:g1799587] [LN:D90855] [AC:D90855:AB001340]
[PN:glycerol-3-phosphate transport protein] [GN:glpT] [OR:Escherichia coli]
[SR:Escherichia coli (strain:K12) DNA, clone_lib:Kohara lambda minise]
[DB:genpept-bct1] [DE:E.coli genomic DNA, Kohara clone #377(50.5-50.9 min.).]
[NT:similar to [PIR Accession Number S00868]] [LE:11300] [RE:12658]
[DI:complement] >gp:[GI:g41587] [LN:ECGLPT] [AC:Y00536] [OR:Escherichia coli]
[DB:genpept-bct1] [DE:E. coli genes glpT and glpQ (partial).]
[NT:glycerol-3-phosphatase transporter (AA 1 - 452,] [SP:P08194] [LE:170]
[RE:1528] [DI:direct] >gp:[GI:g1788573] [LN:AE000314] [AC:AE000314:U00096]
[PN:sn-glycerol-3-phosphate permease] [GN:glpT] [FN:transport; Transport of small
molecules:] [OR:Escherichia coli] [DB:genpept-bct2] [DE:Escherichia coli K-12
MG1655 section 204 of 400 of the completegenome.] [NT:f452; 100 pct identical to
GLPT_ECOLI SW: P08194] [LE:1467] [RE:2825] [DI:complement]

| ORF Name | NT ID | AA ID | NT LN | AA LN | Score | P-value |
|---|---|---|---|---|---|---|
| 3417013_c3_1650 | 1123 | 8294 | 1026 | 341 | 1608 | 3.3e-165 |

Description sp:[LN:MGLC_ECOLI] [AC:P23200] [GN:MGLC] [OR:Escherichia coli] [DE:GALACTOSIDE
TRANSPORT SYSTEM PERMEASE PROTEIN MGLC] [SP:P23200] [DB:swissprot]
>sp:[LN:C37277] [AC:C37277:C64983] [PN:transmembrane pore-generating protein
mglC] [GN:mglC] [CL:l-arabinose transport system permease araH] [OR:Escherichia
coli] [DB:pir2] >gp:[GI:g146855] [LN:ECOMGLABCO] [AC:M59444] [GN:mglC]
[OR:Escherichia coli] [SR:E.coli (strain K-12), DNA] [DB:genpept-bct1]
[DE:Escherichia coli mglB, mglA,and mglC genes, complete cds.] [LE:2958]
[RE:3968] [DI:direct] >gp:[GI:g1788471] [LN:AE000304] [AC:AE000304:U00096]
[PN:methyl-galactoside transport and galactose] [GN:mglC] [FN:transport;
Transport of small molecules:] [OR:Escherichia coli] [DB:genpept-bct2]
[DE:Escherichia coli K-12 MG1655 section 194 of 400 of the completegenome.]
[NT:f336; 100 pct identical to MGLC_ECOLI SW: P23200] [LE:152] [RE:1162]
[DI:complement]

| ORF Name | NT ID | AA ID | NT LN | AA LN | Score | P-value |
|---|---|---|---|---|---|---|
| 34180343_c1_1048 | 1124 | 8295 | 900 | 299 | 164 | 6.7e-10 |

Description sp:[LN:YBBS_ECOLI] [AC:P77702] [GN:YBBS:GLXA1] [OR:Escherichia coli]
[DE:HYPOTHETICAL TRANSCRIPTIONAL REGULATOR IN RHSD-GCL INTERGENIC REGION]
[SP:P77702] [DB:swissprot] >sp:[LN:G64781] [AC:G64781] [PN:probable transcription
regulator ybbS] [GN:ybbS] [CL:probable transcription regulator ybbS]
[OR:Escherichia coli] [DB:pir1] >gp:[GI:g1773185] [LN:ECU82664] [AC:U82664]
[OR:Escherichia coli] [DB:genpept-bct1] [DE:Escherichia coli minutes 9 to 11
genomic sequence.] [NT:similar to E. coli ydhB] [LE:110743] [RE:111669]
[DI:complement] >gp:[GI:g1786713] [LN:AE000156] [AC:AE000156:U00096] [PN:putative
transcriptional regulator LYSR-type] [GN:ybbS] [FN:putative regulator; Not
classified] [OR:Escherichia coli] [DB:genpept-bct2] [DE:Escherichia coli K-12
MG1655 section 46 of 400 of the completegenome.] [NT:f308; 30 pct identical (1
gap) to 275 residues of] [LE:8280] [RE:9206] [DI:complement] >gp:[GI:g2735226]
[LN:ECU89024] [AC:U89024] [PN:hypothetical transcriptional regulator] [GN:glxA1]
[OR:Escherichia coli] [DB:genpept-bct2] [DE:Escherichia coli hypothetical
transcriptional regulator (glxA1),glyoxylate induced protein (glxA2) and
glyoxylate regulatoryprotein (glxA3) genes, complete cds.] [LE:23] [RE:949]
[DI:complement]

| ORF Name | NT ID | AA ID | NT LN | AA LN | Score | P-value |
|---|---|---|---|---|---|---|
| 34244517_c1_1151 | 1125 | 8296 | 1059 | 352 | 685 | 2.1e-67 |

Description sp:[LN:YDDR_ECOLI] [AC:P77308] [GN:YDDR] [OR:Escherichia coli] [DE:HYPOTHETICAL
ABC TRANSPORTER PERMEASE PROTEIN YDDR] [SP:P77308] [DB:swissprot] >sp:[LN:A64902]
[AC:A64902] [PN:peptide transport system permease protein b1486]
[CL:transmembrane protein dppB] [OR:Escherichia coli] [DB:pir2]
>gp:[GI:d1015860:g1742426] [LN:D90789] [AC:D90789:AB001340] [PN:Dipeptide
transport system permease protein] [OR:Escherichia coli] [SR:Escherichia coli
(strain:K12) DNA, clone_lib:Kohara lambda minise] [DB:genpept-bct1] [DE:E.coli
genomic DNA, Kohara clone #278(33.3-33.7 min.).] [NT:ORF_ID:o279#4; similar to
[SwissProt Accession] [LE:14087] [RE:15109] [DI:complement]
>gp:[GI:d1015870:g1742437] [LN:D90790] [AC:D90790:AB001340] [PN:Dipeptide
transport system permease protein] [OR:Escherichia coli] [SR:Escherichia coli
(strain:K12) DNA, clone_lib:Kohara lambda minise] [DB:genpept-bct1] [DE:E.coli
genomic DNA, Kohara clone #279(33.5-33.9 min.).] [NT:ORF_ID:o279#4; similar to
[SwissProt Accession] [LE:6190] [RE:7212] [DI:complement] >gp:[GI:g1787761]
[LN:AE000245] [AC:AE000245:U00096] [PN:putative transport system permease
protein] [GN:b1486] [FN:putative transport; Not classified] [OR:Escherichia coli]
[DB:genpept-bct2] [DE:Escherichia coli K-12 MG1655 section 135 of 400 of the
completegenome.] [NT:f340; This 340 aa ORF is 47 pct identical (7 gaps)]
[LE:7143] [RE:8165] [DI:complement]

| ORF Name | NT ID | AA ID | NT LN | AA LN | Score | P-value |
|---|---|---|---|---|---|---|
| 34475760_f2_378 | 1126 | 8297 | 222 | 73 | | |

Description

NO-HIT

| ORF Name | NT ID | AA ID | NT LN | AA LN | Score | P-value |
|---|---|---|---|---|---|---|
| 34549068_c3_1690 | 1127 | 8298 | 828 | 275 | 915 | 9.1e-92 |

Description sp:[LN:THIM_ECOLI] [AC:P76423] [GN:THIM] [OR:Escherichia coli] [EC:2.7.1.50]
[DE:HYDROXYETHYLTHIAZOLE KINASE) (THZ KINASE) (TH KINASE)] [SP:P76423]
[DB:swissprot] >sp:[LN:G64977] [AC:G64977] [PN:hydroxyethylthiazole
kinase,;hypothetical protein b2104] [CL:hydroxyethylthiazole
kinase:hydroxyethylthiazole kinase homology] [OR:Escherichia coli] [EC:2.7.1.50]
[DB:pir1] >gp:[GI:d1016697:g1736828] [LN:D90848] [AC:D90848:AB001340] [PN:Thi4
protein] [OR:Escherichia coli] [SR:Escherichia coli (strain:K12) DNA,
clone_lib:Kohara lambda minise] [DB:genpept-bct1] [DE:E.coli genomic DNA, Kohara
clone #359(46.8-47.2 min.).] [NT:ORF_ID:o359#16; similar to [PIR Accession
Number] [LE:12434] [RE:13222] [DI:complement] >gp:[GI:g1788421] [LN:AE000299]
[AC:AE000299:U00096] [PN:hydoxyethylthiazole kinase] [GN:thiM] [FN:enzyme;
Biosynthesis of cofactors, carriers:] [OR:Escherichia coli] [DB:genpept-bct2]
[DE:Escherichia coli K-12 MG1655 section 189 of 400 of the completegenome.]
[NT:f262; This 262 aa ORF is 40 pct identical (6 gaps)] [LE:7182] [RE:7970]
[DI:complement]

| ORF Name | NT ID | AA ID | NT LN | AA LN | Score | P-value |
|---|---|---|---|---|---|---|
| 34569766_c3_1742 | 1128 | 8299 | 654 | 217 | 950 | 1.8e-95 |

Description sp:[LN:DCD_ECOLI] [AC:P28248] [GN:DCD:DUS:PAXA] [OR:Escherichia coli]
[EC:3.5.4.13] [DE:DEAMINASE)] [SP:P28248] [DB:swissprot] >sp:[LN:A42940]
[AC:A42940:H64972] [PN:dCTP deaminase,:dut (dUTPase) mutation suppressor]
[GN:dcd] [CL:dCTP deaminase] [OR:Escherichia coli] [EC:3.5.4.13] [DB:pir1]
>gp:[GI:d1016642:g1736769] [LN:D90844] [AC:D90844:AB001340] [PN:Deoxycytidine
triphosphate deaminase (EC] [GN:dcd, dus, paxA] [OR:Escherichia coli]
[SR:Escherichia coli (strain:K12) DNA, clone_lib:Kohara lambda minise]
[DB:genpept-bct1] [DE:E.coli genomic DNA, Kohara clone #355(45.9-46.2 min.).]
[NT:ORF_ID:o355#4; similar to [SwissProt Accession] [LE:8258] [RE:8839]
[DI:complement] >gp:[GI:d1016647:g1736775] [LN:D90845] [AC:D90845:AB001340]
[PN:Deoxycytidine triphosphate deaminase (EC] [GN:dcd, dus, paxA] [OR:Escherichia
coli] [SR:Escherichia coli (strain:K12) DNA, clone_lib:Kohara lambda minise]
[DB:genpept-bct1] [DE:E.coli genomic DNA, Kohara clone #356(46.1-46.5 min.).]
[NT:ORF_ID:o355#4; similar to [SwissProt Accession] [LE:355] [RE:936]
[DI:complement] >gp:[GI:g145716] [LN:ECODCDA] [AC:M90069] [PN:deoxycytidine
triphosphate deaminase] [GN:dcd] [OR:Escherichia coli] [SR:Escherichia coli
(strain K-12) DNA] [DB:genpept-bct1] [EC:3.5.4.13] [DE:E.coli deoxycytidine
triphosphate deaminase (dcd) gene, completecds and ORF, 5' end.] [LE:94] [RE:675]
[DI:direct] >gp:[GI:g1788379] [LN:AE000296] [AC:AE000296:U00096]
[PN:2'-deoxycytidine 5'-triphosphate deaminase] [GN:dcd] [FN:enzyme;
2'-Deoxyribonucleotide metabolism] [OR:Escherichia coli] [DB:genpept-bct2]
[EC:3.5.4.13] [DE:Escherichia coli K-12 MG1655 section 186 of 400 of the
completegenome.] [NT:f193; 100 pct identical to DCD_ECOLI SW: P28248; CG]
[LE:8221] [RE:8802] [DI:complement]

| ORF Name | NT ID | AA ID | NT LN | AA LN | Score | P-value |
|---|---|---|---|---|---|---|
| 34582125_f3_753 | 1129 | 8300 | 738 | 245 | 1160 | 9.9e-118 |

Description sp:[LN:BAER_ECOLI] [AC:P30846] [GN:BAER] [OR:Escherichia coli]
[DE:TRANSCRIPTIONAL REGULATORY PROTEIN BAER] [SP:P30846] [DB:swissprot]
>sp:[LN:JX0283] [AC:JX0283:F64974] [PN:response-regulator BaeR protein:signal
transduction protein:transcription regulatory protein BaeR] [GN:baeR] [CL:ompR
protein:response regulator homology] [OR:Escherichia coli] [DB:pir1]
>gp:[GI:d1016659:g1736788] [LN:D90846] [AC:D90846:AB001340]
[PN:Response-regulator BaeR protein] [GN:baeR] [OR:Escherichia coli]
[SR:Escherichia coli (strain:K12) DNA, clone_lib:Kohara lambda minise]
[DB:genpept-bct1] [DE:E.coli genomic DNA, Kohara clone #357(46.5-46.8 min.).]
[NT:ORF_ID:o357#4; similar to [PIR Accession Number] [LE:7028] [RE:7750]
[DI:direct] >gp:[GI:d1016670:g1736800] [LN:D90847] [AC:D90847:AB001340]
[PN:Response-regulator BaeR protein] [GN:baeR] [OR:Escherichia coli]
[SR:Escherichia coli (strain:K12) DNA, clone_lib:Kohara lambda minise]
[DB:genpept-bct1] [DE:E.coli genomic DNA, Kohara clone #358(46.6-46.9 min.).]
[NT:ORF_ID:o357#4; similar to [PIR Accession Number] [LE:1673] [RE:2395]
[DI:direct] >gp:[GI:d1003647:g216533] [LN:ECOBAESR] [AC:D14054] [PN:BaeR]
[GN:baeR] [OR:Escherichia coli] [SR:Escherichia coli (strain:K-12) DNA]
[DB:genpept-bct1] [DE:E.coli gene for BaeR and BaeS, complete cds.] [LE:1671]
[RE:2393] [DI:direct] >gp:[GI:g1788394] [LN:AE000297] [AC:AE000297:U00096]
[PN:transcriptional response regulatory protein] [GN:baeR] [FN:regulator; RNA
synthesis, modification, DNA] [OR:Escherichia coli] [DB:genpept-bct2]
[DE:Escherichia coli K-12 MG1655 section 187 of 400 of the completegenome.]
[NT:o240; 100 pct identical to BAER_ECOLI SW: P30846;] [LE:17669] [RE:18391]
[DI:direct]

| ORF Name | NT ID | AA ID | NT LN | AA LN | Score | P-value |
|---|---|---|---|---|---|---|
| 34586692_c2_1259 | 1130 | 8301 | 549 | 182 | 234 | 1.3e-19 |

Description gp:[GI:g4581166] [LN:ATAC006220] [AC:AC006220] [GN:T20G20.7] [OR:Arabidopsis
thaliana] [SR:thale cress] [DB:genpept-pln2] [DE:Arabidopsis thaliana chromosome
II BAC T20G20 genomic sequence,complete sequence.] [NT:hypothetical protein]
[LE:40666:41555] [RE:41477:41651] [DI:complementJoin]

| ORF Name | NT ID | AA ID | NT LN | AA LN | Score | P-value |
|---|---|---|---|---|---|---|
| 34656333_c3_1629 | 1131 | 8302 | 273 | 90 | | |

Description

NO-HIT

| ORF Name | NT ID | AA ID | NT/LN | AA/LN | Score | P-value |
|---|---|---|---|---|---|---|
| 34663155_f2_464 | 1132 | 8303 | 1362 | 453 | 770 | 2.1e-76 |

Description sp:[LN:YICO_ECOLI] [AC:P31440:P76726] [GN:YICO] [OR:Escherichia coli]
[DE:HYPOTHETICAL 49.9 KD PROTEIN IN NLPA-UHPT INTERGENIC REGION]
[SP:P31440:P76726] [DB:swissprot] >sp:[LN:A65168] [AC:A65168] [PN:hypothetical
49.9 kD protein in nlpa-uhpt intergenic region] [GN:yicO] [CL:conserved
hypothetical protein HI0125] [OR:Escherichia coli] [DB:pir2] >gp:[GI:g1790097]
[LN:AE000444] [AC:AE000444:U00096] [PN:orf, hypothetical protein] [GN:yicO]
[FN:orf; Unknown] [OR:Escherichia coli] [DB:genpept-bct2] [DE:Escherichia coli
K-12 MG1655 section 334 of 400 of the completegenome.] [NT:f470; 100 pct
identical amino acid sequence and] [LE:2269] [RE:3681] [DI:complement]

| ORF Name | NT ID | AA ID | NT/LN | AA/LN | Score | P-value |
|---|---|---|---|---|---|---|
| 35194511_f2_362 | 1133 | 8304 | 408 | 135 | 164 | 3.5e-12 |

Description gp:[GI:d1020420:g1944169] [LN:AB002668] [AC:AB002668] [OR:Actinobacillus
actinomycetemcomitans] [SR:Actinobacillus actinomycetemcomitans (strain:Y4) DNA]
[DB:genpept-bct1] [DE:Actinobacillus actinomycetemcomitans DNA for
glycosyltransferase,lytic transglycosylase, dTDP-4-rhamnose reductase, complete
cds.] [NT:unnamed protein product] [LE:17293] [RE:17661] [DI:direct]

| ORF Name | NT ID | AA ID | NT/LN | AA/LN | Score | P-value |
|---|---|---|---|---|---|---|
| 35254516_f3_660 | 1134 | 8305 | 369 | 122 | 110 | 2.2e-05 |

Description gp:[GI:g3044086] [LN:AF055904] [AC:AF055904] [PN:unknown] [OR:Myxococcus xanthus]
[DB:genpept-bct2] [DE:Myxococcus xanthus acetylornithine deacetylase (argE)
gene,complete cds; and unknown gene.] [NT:ORF2; no developmental phenotype]
[LE:10] [RE:1638] [DI:complement]

| ORF Name | NT ID | AA ID | NT/LN | AA/LN | Score | P-value |
|---|---|---|---|---|---|---|
| 35650802_c3_1600 | 1135 | 8306 | 1038 | 345 | 1578 | 5.0e-162 |

Description sp:[LN:A64988] [AC:A64988] [PN:hypothetical 37.8 kD protein in rplY-proL
intergenic region] [GN:yejK] [OR:Escherichia coli] [DB:pir2] >gp:[GI:g405914]
[LN:ECOHU49] [AC:U00008] [PN:yejK] [OR:Escherichia coli] [SR:Escherichia coli K12
BHB2600] [DB:genpept-bct1] [DE:centisome 49 region of E.coli K12 BHB2600.]
[LE:9993] [RE:11000] [DI:complement] >gp:[GI:g1788513] [LN:AE000308]
[AC:AE000308:U00096] [PN:orf, hypothetical protein] [GN:yejK] [FN:orf; Unknown]
[OR:Escherichia coli] [DB:genpept-bct2] [DE:Escherichia coli K-12 MG1655 section
198 of 400 of the completegenome.] [NT:f335; 100 pct identical to YEJK_ECOLI SW:
P33920] [LE:4567] [RE:5574] [DI:complement]

| ORF_Name | NT ID | AA ID | NT/LN | AA/LN | Score | P-value |
|---|---|---|---|---|---|---|
| 35675266_f1_32 | 1136 | 8307 | 1227 | 408 | 395 | 1.5e-36 |

Description sp:[LN:YHA2_EIKCO] [AC:P35649] [OR:Eikenella corrodens] [DE:HYPOTHETICAL 66.3 KD PROTEIN IN HAG2 5'REGION] [SP:P35649] [DB:swissprot] >sp:[LN:S23847] [AC:S23847] [PN:hypothetical protein] [CL:Eikenella corrodens hypothetical protein] [OR:Eikenella corrodens] [DB:pir2] >gp:[GI:g41654] [LN:ECHAGTUF] [AC:Z12610] [PN:hypothetical 66.3 KD protein in HAG2 5'region] [GN:fus] [OR:Eikenella corrodens] [DB:genpept-bct1] [DE:E.corrodens hag2, tufA, fus, rpsG and rpsL genes encodinghemagglutinin protein, elongation factor Tu, elongation factor G,ribosomal protein S7, and ribosomal protein S12.] [SP:P35649] [LE:310] [RE:2046] [DI:direct]

| ORF_Name | NT ID | AA ID | NT/LN | AA/LN | Score | P-value |
|---|---|---|---|---|---|---|
| 35718763_f3_731 | 1137 | 8308 | 231 | 76 | | |

Description

NO-HIT

| ORF_Name | NT ID | AA ID | NT/LN | AA/LN | Score | P-value |
|---|---|---|---|---|---|---|
| 35785328_f2_342 | 1138 | 8309 | 354 | 117 | 108 | 3.0e-06 |

Description sp:[LN:A72622] [AC:A72622] [PN:hypothetical protein APE1434] [GN:APE1434] [OR:Aeropyrum pernix] [DB:pir2] >gp:[GI:d1044217:g5105117] [LN:AP000061] [AC:AP000061] [PN:109aa long hypothetical protein] [GN:APE1434] [OR:Aeropyrum pernix] [SR:Aeropyrum pernix (strain:K1) DNA] [DB:genpept-bct1] [DE:Aeropyrum pernix genomic DNA, section 4/7.] [LE:193912] [RE:194241] [DI:direct]

| ORF_Name | NT ID | AA ID | NT/LN | AA/LN | Score | P-value |
|---|---|---|---|---|---|---|
| 35792206_f2_477 | 1139 | 8310 | 261 | 86 | 137 | 1.1e-08 |

Description gp:[GI:g2429362] [LN:AF020261] [AC:AF020261] [PN:proline rich protein] [OR:Santalum album] [SR:white sandalwood] [DB:genpept-pln2] [DE:Santalum album proline rich protein mRNA, complete cds.] [LE:277] [RE:1257] [DI:direct]

| ORF Name | NT ID | AA ID | NT LN | AA LN | Score | P-value |
|---|---|---|---|---|---|---|
| 35831943_f3_741 | 1140 | 8311 | 423 | 140 | 127 | 1.1e-07 |

Description sp:[LN:PRP3_MOUSE] [AC:P05143] [GN:PRP] [OR:Mus musculus] [SR:,Mouse]
[DE:PROLINE-RICH PROTEIN MP-3 (FRAGMENT)] [SP:P05143] [DB:swissprot]
>gp:[GI:g200549] [LN:MUSPRPMPC] [AC:M12100] [OR:Mus musculus] [SR:Mouse (strain
CD-1) DNA, library of O.Smithies, clone pUMP-3 HB] [DB:genpept-rod] [DE:Mouse PRP
gene encoding proline-rich protein MP-3, exon 2.] [NT:proline-rich protein MP-3]
[LE:<1] [RE:893] [DI:direct]

| ORF Name | NT ID | AA ID | NT LN | AA LN | Score | P-value |
|---|---|---|---|---|---|---|
| 36023465_f2_385 | 1141 | 8312 | 213 | 70 | | |

Description

NO-HIT

| ORF Name | NT ID | AA ID | NT LN | AA LN | Score | P-value |
|---|---|---|---|---|---|---|
| 36031417_c3_1784 | 1142 | 8313 | 513 | 170 | 525 | 1.9e-50 |

Description sp:[LN:YEEF_ECOLI] [AC:P33016] [GN:YEEF] [OR:Escherichia coli] [DE:HYPOTHETICAL
49.8 KD TRANSPORT PROTEIN IN SBCB-HISL INTERGENIC REGION] [SP:P33016]
[DB:swissprot] >sp:[LN:E64966] [AC:E64966] [PN:probable amino acid permease yeeF]
[GN:yeeF] [OR:Escherichia coli] [DB:pir2] >gp:[GI:d1016566:g1736688] [LN:D90839]
[AC:D90839:AB001340] [PN:Proline transport protein] [GN:yeeF] [OR:Escherichia
coli] [SR:Escherichia coli (strain:K12) DNA, clone_lib:Kohara lambda minise]
[DB:genpept-bct1] [DE:E.coli genomic DNA, Kohara clone #349(44.6-45.0 min.).]
[NT:ORF_ID:o349#5; similar to [PIR Accession Number] [LE:14356] [RE:15720]
[DI:complement] >gp:[GI:d1016571:g1736694] [LN:D90840] [AC:D90840:AB001340]
[PN:Proline transport protein] [GN:yeeF] [OR:Escherichia coli] [SR:Escherichia
coli (strain:K12) DNA, clone_lib:Kohara lambda minise] [DB:genpept-bct1]
[DE:E.coli genomic DNA, Kohara clone #350(44.9-45.2 min.).] [NT:ORF_ID:o349#5;
similar to [PIR Accession Number] [LE:3047] [RE:4411] [DI:complement]
>gp:[GI:g405957] [LN:ECOHU43] [AC:U00009] [PN:yeeF] [OR:Escherichia coli]
[SR:Escherichia coli K12 BHB2600] [DB:genpept-bct1] [DE:sbcB region of E.coli K12
BHB2600.] [NT:probable permease, perhaps of amino acids.] [LE:5561] [RE:6925]
[DI:complement] >gp:[GI:g1788325] [LN:AE000293] [AC:AE000293:U00096] [PN:putative
amino acid/amine transport protein] [GN:yeeF] [FN:putative transport; Not
classified] [OR:Escherichia coli] [DB:genpept-bct2] [DE:Escherichia coli K-12
MG1655 section 183 of 400 of the completegenome.] [NT:f454; 100 pct identical to
YEEF_ECOLI SW: P33016] [LE:120] [RE:1484] [DI:complement]

| ORF Name | NT ID | AA ID | NT/LN | AA/LN | Score | P-value |
|---|---|---|---|---|---|---|
| 36042082_c3_1649 | 1143 | 8314 | 1539 | 512 | 2429 | 3.3e-252 |

Description sp:[LN:MGLA_ECOLI] [AC:P23199:P76442] [GN:MGLA] [OR:Escherichia coli]
[DE:GALACTOSIDE TRANSPORT ATP-BINDING PROTEIN MGLA] [SP:P23199:P76442]
[DB:swissprot] >sp:[LN:D64983] [AC:D64983:B37277] [PN:galactoside transport
ATP-binding protein mglA] [GN:mglA] [CL:unassigned ATP-binding cassette
proteins:ATP-binding cassette homology] [OR:Escherichia coli] [DB:pir2]
>gp:[GI:g1788472] [LN:AE000304] [AC:AE000304:U00096] [PN:ATP-binding component of
methyl-galactoside] [GN:mglA] [FN:transport; Transport of small molecules:]
[OR:Escherichia coli] [DB:genpept-bct2] [DE:Escherichia coli K-12 MG1655 section
194 of 400 of the completegenome.] [NT:f506; 99 pct identical to MGLA_ECOLI SW:
P23199] [LE:1178] [RE:2698] [DI:complement]

| ORF Name | NT ID | AA ID | NT/LN | AA/LN | Score | P-value |
|---|---|---|---|---|---|---|
| 36070833_f3_744 | 1144 | 8315 | 429 | 142 | 115 | 2.1e-06 |

Description gp:[GI:g152683] [LN:SERCP450A] [AC:M83110] [OR:Saccharopolyspora erythraea]
[SR:Saccharopolyspora erythraea (library: NRRL 2338) DNA] [DB:genpept-bct1]
[DE:Saccharopolyspora erythraea ORF 1 gene, partial cds; cytochromeP-450 gene,
complete cds; ORF 2 gene, partial cds.] [NT:ORF homologous to Escherichia coli
and Salmonella] [LE:<1] [RE:859] [DI:direct]

| ORF Name | NT ID | AA ID | NT/LN | AA/LN | Score | P-value |
|---|---|---|---|---|---|---|
| 36071037_c1_1089 | 1145 | 8316 | 1173 | 390 | 1630 | 1.6e-167 |

Description sp:[LN:YEIB_ECOLI] [AC:P25747] [GN:YEIB] [OR:Escherichia coli] [DE:HYPOTHETICAL
43.4 KD PROTEIN IN GALS-FOLE INTERGENIC REGION] [SP:P25747] [DB:swissprot]
>sp:[LN:G64983] [AC:G64983:S28963:S19934] [PN:hypothetical 43.4 kD protein in
galS-folE intergenic region] [GN:yeiB] [OR:Escherichia coli] [DB:pir2]
>gp:[GI:g405874] [LN:ECOHU47] [AC:U00007] [PN:yeiB] [OR:Escherichia coli]
[SR:Escherichia coli K12 BHB2600] [DB:genpept-bct1] [DE:47 to 48 centisome region
of E.coli K12 BHB2600.] [NT:similar to membrane protein from Bacillus.]
[LE:49555] [RE:50712] [DI:complement] >gp:[GI:g1788475] [LN:AE000304]
[AC:AE000304:U00096] [PN:orf, hypothetical protein] [GN:yeiB] [FN:orf; Unknown]
[OR:Escherichia coli] [DB:genpept-bct2] [DE:Escherichia coli K-12 MG1655 section
194 of 400 of the completegenome.] [NT:f385; 100 pct identical to YEIB_ECOLI SW:
P25747] [LE:5219] [RE:6376] [DI:complement]

| ORF_Name | NT_ID | AA_ID | NT LN | AA LN | Score | P-value |
|---|---|---|---|---|---|---|
| 36117068_f1_210 | 1146 | 8317 | 594 | 197 | 831 | 7.3e-83 |

Description sp:[LN:SPR_ECOLI] [AC:P77685:O08016] [GN:SPR] [OR:Escherichia coli]
[DE:LIPOPROTEIN SPR PRECURSOR] [SP:P77685:O08016] [DB:swissprot] >sp:[LN:F64986]
[AC:F64986] [PN:hypothetical protein b2175] [CL:conserved hypothetical protein
HI1314] [OR:Escherichia coli] [DB:pir1] >gp:[GI:d1013827:g1498150] [LN:D86610]
[AC:D86610] [PN:Spr] [GN:spr] [OR:Escherichia coli
(strain:W3110) DNA] [DB:genpept-bct1] [DE:Escherichia coli DNA for Spr, complete
cds.] [NT:similar to new lipoprotein C (NlpC,Swiss Prot] [LE:379] [RE:945]
[DI:direct] >gp:[GI:d1016708:g1736840] [LN:D90849] [AC:D90849:AB001340]
[PN:Probable lipoprotein NlpC homolog precursor.] [OR:Escherichia coli]
[SR:Escherichia coli (strain:K12) DNA, clone_lib:Kohara lambda minise]
[DB:genpept-bct1] [DE:E.coli genomic DNA, Kohara clone #369(48.6-49.0 min.).]
[NT:ORF_ID:o369#8; similar to [SwissProt Accession] [LE:9663] [RE:10229]
[DI:direct] >gp:[GI:g1788501] [LN:AE000307] [AC:AE000307:U00096] [PN:putative
lipoprotein] [GN:spr] [FN:putative membrane; Not classified] [OR:Escherichia
coli] [DB:genpept-bct2] [DE:Escherichia coli K-12 MG1655 section 197 of 400 of
the completegenome.] [NT:o188; This 188 aa ORF is 57 pct identical (3 gaps)]
[LE:2239] [RE:2805] [DI:direct]

| ORF_Name | NT_ID | AA_ID | NT LN | AA LN | Score | P-value |
|---|---|---|---|---|---|---|
| 36349156_c3_1744 | 1147 | 8318 | 240 | 79 | 60 | 0.020 |

Description gp:[GI:e1393548:g4490584] [LN:RSP010302]
[AC:AJ010302:AJ001690:S55638:S79406:X63320:X68795:X82458] [PN:putative
isopentenyl diphosphate isomerase] [OR:Rhodobacter sphaeroides] [DB:genpept-bct1]
[DE:Rhodobacter sphaeroides photosynthetic gene cluster.] [NT:ORF177] [LE:19304]
[RE:19837] [DI:direct]

| ORF_Name | NT_ID | AA_ID | NT LN | AA LN | Score | P-value |
|---|---|---|---|---|---|---|
| 36377307_f3_862 | 1148 | 8319 | 1482 | 493 | 2002 | 5.9e-207 |

Description sp:[LN:YEIQ_ECOLI] [AC:P33029:P94760] [GN:YEIQ] [OR:Escherichia coli]
[DE:HYPOTHETICAL 54.0 KD PROTEIN IN FRUB-RTN INTERGENIC REGION]
[SP:P33029:P94760] [DB:swissprot] >sp:[LN:C64986] [AC:C64986] [PN:probable
fructuronate reductase, yeiQ:D-mannonate oxidoreductase] [GN:yeiQ] [CL:conserved
hypothetical protein YEL070w] [OR:Escherichia coli] [EC:1.1.1.57] [DB:pir2]
>gp:[GI:g405888] [LN:ECOHU47] [AC:U00007] [PN:yeiQ] [OR:Escherichia coli]
[SR:Escherichia coli K12 BHB2600] [DB:genpept-bct1] [DE:47 to 48 centisome region
of E.coli K12 BHB2600.] [NT:strong match to mannitol dehydrogenase (mtlD).]
[LE:73989] [RE:75455] [DI:direct] >gp:[GI:g1788497] [LN:AE000306]
[AC:AE000306:U00096] [PN:putative oxidoreductase] [GN:yeiQ] [FN:putative enzyme;
Not classified] [OR:Escherichia coli] [DB:genpept-bct2] [DE:Escherichia coli K-12
MG1655 section 196 of 400 of the completegenome.] [NT:o488; 100 pct identical to
YEIQ_ECOLI SW: P33029] [LE:8893] [RE:10359] [DI:direct]

| ORF_Name | NT ID | AA ID | NT LN | AA LN | Score | P-value |
|---|---|---|---|---|---|---|
| 36523415_f2_589 | 1149 | 8320 | 912 | 303 | 243 | 1.3e-19 |

Description gp:[GI:e137039:g1226023] [LN:MSGYRAB] [AC:X84077] [GN:ORF617] [OR:Mycobacterium smegmatis] [DB:genpept-bct1] [DE:M.smegmatis gyrB and gyrA genes.] [NT:val start codon] [LE:3075] [RE:4925] [DI:complement]

| ORF_Name | NT ID | AA ID | NT LN | AA LN | Score | P-value |
|---|---|---|---|---|---|---|
| 36585766_c3_1743 | 1150 | 8321 | 1875 | 624 | 2062 | 2.6e-213 |

Description sp:[LN:ASMA_ECOLI] [AC:P28249:P76390] [GN:ASMA] [OR:Escherichia coli] [DE:ASMA PROTEIN PRECURSOR] [SP:P28249:P76390] [DB:swissprot] >sp:[LN:G64972] [AC:G64972:B42940:S77641] [PN:yegA protein precursor] [GN:yegA:asmA] [OR:Escherichia coli] [DB:pir2] >gp:[GI:d1016641.g1736768] [LN:D90844] [AC:D90844:AB001340] [GN:yegA] [OR:Escherichia coli] [SR:Escherichia coli (strain:K12) DNA, clone_lib:Kohara lambda minise] [DB:genpept-bct1] [DE:E.coli genomic DNA, Kohara clone #355(45.9-46.2 min.).] [NT:ORF_ID:o355#3; similar to [SwissProt Accession] [LE:6383] [RE:8236] [DI:complement] >gp:[GI:g1788378] [LN:AE000296] [AC:AE000296:U00096] [PN:suppressor of ompF assembly mutants] [GN:asmA] [FN:phenotype; Outer membrane constituents] [OR:Escherichia coli] [DB:genpept-bct2] [DE:Escherichia coli K-12 MG1655 section 186 of 400 of the completegenome.] [NT:f617; formerly designated yegA] [LE:6346] [RE:8199] [DI:complement]

| ORF_Name | NT ID | AA ID | NT LN | AA LN | Score | P-value |
|---|---|---|---|---|---|---|
| 36600627_c3_1668 | 1151 | 8322 | 471 | 156 | 132 | 4.4e-08 |

Description sp:[LN:CSP_PLAKU] [AC:P04922] [OR:Plasmodium knowlesi] [SR:,strain nuri] [DE:CIRCUMSPOROZOITE PROTEIN PRECURSOR (CS)] [SP:P04922] [DB:swissprot] >sp:[LN:OZZQKU] [AC:A26253] [PN:circumsporozoite protein precursor:sporozoite surface protein] [CL:circumsporozoite protein:thrombospondin type 1 repeat homology] [OR:Plasmodium knowlesi] [DB:pir1] >gp:[GI:g160198] [LN:PFACSNURI] [AC:M11031] [PN:circumsporozoite protein] [GN:CS] [OR:Plasmodium knowlesi] [SR:P.knowlesi (strain Nuri) blood form DNA, from infected rhesu] [DB:genpept-inv1] [DE:Plasmodium knowlesi circumsporozoite antigen (CS) gene, completecds.] [NT:precursor] [LE:270] [RE:1325] [DI:direct]

| ORF_Name | NT ID | AA ID | NT LN | AA LN | Score | P-value |
|---|---|---|---|---|---|---|
| 3942265_c3_1752 | 1152 | 8323 | 1149 | 382 | 1851 | 5.9e-191 |

Description gp:[GI:g4512005] [LN:AF104912] [AC:AF104912] [PN:putative outer membrane lipoprotein Wza] [GN:wza] [OR:Escherichia coli] [DB:genpept-bct2] [DE:Escherichia coli K30 capsule biosynthesis cluster, partialsequence.] [NT:OMA protein family homologue] [LE:2332] [RE:3471] [DI:direct]

| ORF_Name | NT ID | AA ID | NT/LN | AA/LN | Score | P-value |
|---|---|---|---|---|---|---|
| 3944077_c1_1191 | 1153 | 8324 | 1161 | 386 | 214 | 2.2e-15 |

Description sp:[LN:S22619] [AC:S22619] [PN:hypothetical protein] [OR:Salmonella choleraesuis] [DB:pir2] >gp:[GI:g47011] [LN:SERFBC2] [AC:X61917] [PN:second mannosyl transferase] [OR:Salmonella enterica] [DB:genpept-bct1] [DE:S.enterica rfbJ gene cluster.] [NT:wbaW; Referred to as orf17.9 in reference [2]] [LE:6313] [RE:7323] [DI:direct]

| ORF_Name | NT ID | AA ID | NT/LN | AA/LN | Score | P-value |
|---|---|---|---|---|---|---|
| 4025463_c1_1143 | 1154 | 8325 | 1473 | 490 | 2558 | 7.2e-266 |

Description gp:[GI:g2905647] [LN:AF045245] [AC:AF045245:U97126] [PN:D-arabinitol kinase] [GN:dalK] [OR:Klebsiella pneumoniae] [DB:genpept-bct2] [DE:Klebsiella pneumoniae D-arabinitol transporter (dalT), D-arabinitolkinase (dalK), D-arabinitol dehydrogenase (dalD), and repressor(dalR) genes, complete cds.] [LE:1769] [RE:3232] [DI:complement]

| ORF_Name | NT ID | AA ID | NT/LN | AA/LN | Score | P-value |
|---|---|---|---|---|---|---|
| 4035918_f2_510 | 1155 | 8326 | 894 | 297 | 1243 | 1.6e-126 |

Description sp:[LN:CDD_ECOLI] [AC:P13652] [GN:CDD] [OR:Escherichia coli] [EC:3.5.4.5] [DE:CYTIDINE DEAMINASE, (CYTIDINE AMINOHYDROLASE) (CDA)] [SP:P13652] [DB:swissprot] >sp:[LN:F64982] [AC:F64982:S18177:A40239:S09599:S72654] [PN:cytidine deaminase,] [GN:cdd] [CL:cdd protein] [OR:Escherichia coli] [EC:3.5.4.5] [DB:pir2] >gp:[GI:g145470] [LN:ECOCDDA] [AC:M60916] [PN:cytidine deaminase] [GN:cdd] [OR:Escherichia coli] [SR:Escherichia coli (strain K-12) DNA] [DB:genpept-bct1] [EC:3.5.4.5] [DE:Escherichia coli cytidine deaminase (cdd) gene, complete cds.] [NT:putative] [LE:92] [RE:976] [DI:direct] >gp:[GI:g453291] [LN:ECOHU47] [AC:U00007] [PN:cytidine deaminase] [OR:Escherichia coli] [SR:Escherichia coli K12 BHB2600] [DB:genpept-bct1] [DE:47 to 48 centisome region of E.coli K12 BHB2600.] [NT:cytidine deaminase.] [LE:44615] [RE:45499] [DI:direct] >gp:[GI:g1788465] [LN:AE000303] [AC:AE000303:U00096] [PN:cytidine/deoxycytidine deaminase] [GN:cdd] [FN:enzyme; Salvage of nucleosides and nucleotides] [OR:Escherichia coli] [DB:genpept-bct2] [EC:3.5.4.5] [DE:Escherichia coli K-12 MG1655 section 193 of 400 of the completegenome.] [NT:o294; 100 pct identical to CDD_ECOLI SW: P13652; CG] [LE:6913] [RE:7797] [DI:direct]

| ORF Name | NT ID | AA ID | NT LN | AA LN | Score | P-value |
|---|---|---|---|---|---|---|
| 4144012_f1_188 | 1156 | 8327 | 885 | 294 | 1275 | 6.5e-130 |

Description sp:[LN:YEIG_ECOLI] [AC:P33018] [GN:YEIG] [OR:Escherichia coli] [DE:HYPOTHETICAL
31.3 KD PROTEIN IN FOLE-CIRA INTERGENIC REGION] [SP:P33018] [DB:swissprot]
>sp:[LN:A64984] [AC:A64984] [PN:hypothetical 31.3 kD protein in folE-cirA
intergenic region] [GN:yeiG] [CL:conserved hypothetical protein YJL068c]
[OR:Escherichia coli] [DB:pir2] >gp:[GI:g405878] [LN:ECOHU47] [AC:U00007]
[PN:yeiG] [OR:Escherichia coli] [SR:Escherichia coli K12 BHB2600]
[DB:genpept-bct1] [DE:47 to 48 centisome region of E.coli K12 BHB2600.]
[NT:probable esterase (strong match to human esterase] [LE:51655] [RE:52491]
[DI:direct] >gp:[GI:g1788477] [LN:AE000304] [AC:AE000304:U00096] [PN:putative
esterase (EC 3.1.1.-).] [GN:yeiG] [FN:orf; Not classified] [OR:Escherichia coli]
[DB:genpept-bct2] [DE:Escherichia coli K-12 MG1655 section 194 of 400 of the
completegenome.] [NT:o278; 100 pct identical to YEIG_ECOLI SW: P33018] [LE:7319]
[RE:8155] [DI:direct]

| ORF Name | NT ID | AA ID | NT LN | AA LN | Score | P-value |
|---|---|---|---|---|---|---|
| 4145252_c1_1230 | 1157 | 8328 | 519 | 172 | 549 | 5.5e-53 |

Description sp:[LN:GYRI_ECOLI] [AC:P33012] [GN:GYRI:SBMC] [OR:Escherichia coli] [DE:DNA
GYRASE INHIBITORY PROTEIN (SBMC PROTEIN)] [SP:P33012] [DB:swissprot]
>sp:[LN:H64965] [AC:H64965:S70239:S78746] [PN:DNA gyrase inhibitory protein:sbmc
protein] [GN:sbmC:gyrI:yeeB] [OR:Escherichia coli] [DB:pir2] [MP:44 min]
>gp:[GI:d1016554:g1736675] [LN:D90838] [AC:D90838:AB001340] [PN:SbmC protein.]
[GN:sbmC] [OR:Escherichia coli] [SR:Escherichia coli (strain:K12) DNA,
clone_lib:Kohara lambda minise] [DB:genpept-bct1] [DE:E.coli genomic DNA, Kohara
clone #348(44.5-44.9 min.).] [NT:ORF_ID:o348#21; similar to [SwissProt Accession]
[LE:16355] [RE:16828] [DI:complement] >gp:[GI:d1016561:g1736683] [LN:D90839]
[AC:D90839:AB001340] [PN:SbmC protein.] [GN:sbmC] [OR:Escherichia coli]
[SR:Escherichia coli (strain:K12) DNA, clone_lib:Kohara lambda minise]
[DB:genpept-bct1] [DE:E.coli genomic DNA, Kohara clone #349(44.6-45.0 min.).]
[NT:ORF_ID:o348#21; similar to [SwissProt Accession] [LE:9441] [RE:9914]
[DI:complement] >gp:[GI:g405952] [LN:ECOHU43] [AC:U00009] [PN:yeeB]
[OR:Escherichia coli] [SR:Escherichia coli K12 BHB2600] [DB:genpept-bct1]
[DE:sbcB region of E.coli K12 BHB2600.] [LE:646] [RE:1119] [DI:complement]
>gp:[GI:e139821:g1129137] [LN:ECSBMC] [AC:X84885] [GN:sbmC] [OR:Escherichia coli]
[DB:genpept-bct1] [DE:E.coli sbmC gene.] [SP:P33012] [LE:127] [RE:600]
[DI:direct] >gp:[GI:g1788319] [LN:AE000292] [AC:AE000292:U00096] [PN:SbmC
protein] [GN:sbmC] [FN:orf; Unknown function] [OR:Escherichia coli]
[DB:genpept-bct2] [DE:Escherichia coli K-12 MG1655 section 182 of 400 of the
completegenome.] [NT:f157; 100 pct identical YEEB_ECOLI SW: P33012] [LE:6104]
[RE:6577] [DI:complement]

| ORF_Name | NT ID | AA ID | NT/LN | AA/LN | Score | P-value |
|---|---|---|---|---|---|---|
| 4181500_c3_1768 | 1158 | 8329 | 783 | 260 | 1339 | 1.1e-136 |

Description sp:[LN:RFA1_KLEPN] [AC:Q48475] [GN:RFBA] [OR:Klebsiella pneumoniae] [DE:O-ANTIGEN EXPORT SYSTEM PERMEASE PROTEIN RFBA] [SP:Q48475] [DB:swissprot] >sp:[LN:S60882] [AC:S60882] [PN:integral membrane O-antigen translocator protein rfbA] [GN:rfbA] [CL:integral membrane O-antigen translocator protein rfbA] [OR:Klebsiella pneumoniae] [DB:pir2] >gp:[GI:g567182] [LN:KPNRFBA] [AC:L31775] [PN:integral membrane O-antigen translocator] [GN:wzm] [OR:Klebsiella pneumoniae] [DB:genpept-bct2] [DE:Klebsiella pneumoniae integral membrane O-antigen translocatorprotein (wzm) and ATP-binding protein (wzt) genes, complete cds;and WbbM (wbbM) gene, partial cds.] [NT:similar to kpsM (E. coli), bexA (H. influenzae),] [LE:324] [RE:1103] [DI:direct]

| ORF_Name | NT ID | AA ID | NT/LN | AA/LN | Score | P-value |
|---|---|---|---|---|---|---|
| 4307783_f1_180 | 1159 | 8330 | 726 | 241 | 1146 | 3.0e-116 |

Description sp:[LN:SANA_ECOLI] [AC:P33017:P76438] [GN:SANA] [OR:Escherichia coli] [DE:SANA PROTEIN] [SP:P33017:P76438] [DB:swissprot] >sp:[LN:G64982] [AC:G64982] [PN:sanA protein] [GN:sanA] [CL:conserved hypothetical protein HI1262] [OR:Escherichia coli] [DB:pir1] >gp:[GI:g1788466] [LN:AE000303] [AC:AE000303:U00096] [PN:vancomycin sensitivity] [GN:sanA] [FN:transport; Drug/analog sensitivity] [OR:Escherichia coli] [DB:genpept-bct2] [DE:Escherichia coli K-12 MG1655 section 193 of 400 of the completegenome.] [NT:o239; 100 pct identical to fragment YEIF_ECOLI] [LE:7947] [RE:8666] [DI:direct]

| ORF_Name | NT ID | AA ID | NT/LN | AA/LN | Score | P-value |
|---|---|---|---|---|---|---|
| 4314062_c3_1606 | 1160 | 8331 | 729 | 242 | 1069 | 4.4e-108 |

Description sp:[LN:RSUA_ECOLI] [AC:P33918] [GN:RSUA] [OR:Escherichia coli] [EC:4.2.1.70] [DE:HYDROLYASE)] [SP:P33918] [DB:swissprot] >sp:[LN:F64987] [AC:F64987] [PN:hypothetical 25.9 kD protein in bcr-rplY intergenic region] [GN:yejD] [CL:conserved hypothetical protein HI1243] [OR:Escherichia coli] [DB:pir2] >gp:[GI:g405907] [LN:ECOHU49] [AC:U00008] [PN:yejD] [OR:Escherichia coli] [SR:Escherichia coli K12 BHB2600] [DB:genpept-bct1] [DE:centisome 49 region of E.coli K12 BHB2600.] [NT:match to ORF from B.subtilis; weaker match to ORF] [LE:6841] [RE:7536] [DI:complement] >gp:[GI:g1788510] [LN:AE000308] [AC:AE000308:U00096] [PN:16S pseudouridylate 516 synthase] [GN:rsuA] [FN:enzyme; RNA synthesis, modification, DNA] [OR:Escherichia coli] [DB:genpept-bct2] [DE:Escherichia coli K-12 MG1655 section 198 of 400 of the completegenome.] [NT:f231; formerly designated yejD] [LE:1415] [RE:2110] [DI:complement]

| ORF Name | NT ID | AA ID | NT LN | AA LN | Score | P-value |
|---|---|---|---|---|---|---|
| 4314587_f1_15 | 1161 | 8332 | 1371 | 456 | 1900 | 3.8e-196 |

Description sp:[LN:SHIA_ECOLI] [AC:P76350] [GN:SHIA] [OR:Escherichia coli] [DE:SHIKIMATE TRANSPORTER] [SP:P76350] [DB:swissprot] >sp:[LN:G64962] [AC:G64962:S78630] [PN:shikimate transport protein shiA] [GN:shiA] [CL:citrate utilization determinant] [OR:Escherichia coli] [DB:pir2] >gp:[GI:d1016525:g1736645] [LN:D90837] [AC:D90837:AB001340] [PN:Proline/betaine transporter (Proline porter II)] [OR:Escherichia coli] [SR:Escherichia coli (strain:K12) DNA, clone_lib:Kohara lambda minise] [DB:genpept-bct1] [DE:E.coli genomic DNA, Kohara clone #347(44.2-44.5 min.).] [NT:ORF_ID:o347#2; similar to [SwissProt Accession] [LE:2431] [RE:3747] [DI:direct] >gp:[GI:g1788292] [LN:AE000290] [AC:AE000290:U00096] [PN:putative transport protein, shikimate] [GN:shiA] [FN:putative transport; Not classified] [OR:Escherichia coli] [DB:genpept-bct2] [DE:Escherichia coli K-12 MG1655 section 180 of 400 of the completegenome.] [NT:o438; This 438 aa ORF is 36 pct identical (10 gaps)] [LE:1528] [RE:2844] [DI:direct] >gp:[GI:g1850982] [LN:ECU88529] [AC:U88529] [PN:shikimate transport protein] [GN:shiA] [OR:Escherichia coli] [DB:genpept-bct2] [DE:Escherichia coli shikimate transport protein (shiA) gene, completecds, and AMP nucleosidase (amn) gene, partial cds.] [LE:373] [RE:1689] [DI:direct]

| ORF Name | NT ID | AA ID | NT LN | AA LN | Score | P-value |
|---|---|---|---|---|---|---|
| 4316712_c3_1676 | 1162 | 8333 | 480 | 159 | 599 | 2.8e-58 |

Description sp:[LN:YEHS_ECOLI] [AC:P33355] [GN:YEHS] [OR:Escherichia coli] [DE:HYPOTHETICAL 18.0 KD PROTEIN IN MOLR-BGLX INTERGENIC REGION] [SP:P33355] [DB:swissprot] >sp:[LN:C64980] [AC:C64980] [PN:hypothetical 18.0 kD protein in molR-bglX intergenic region] [GN:yehS] [OR:Escherichia coli] [DB:pir2] >gp:[GI:g405855] [LN:ECOHU47] [AC:U00007] [PN:yehS] [OR:Escherichia coli] [SR:Escherichia coli K12 BHB2600] [DB:genpept-bct1] [DE:47 to 48 centisome region of E.coli K12 BHB2600.] [LE:24495] [RE:24965] [DI:complement] >gp:[GI:g1788443] [LN:AE000301] [AC:AE000301:U00096] [PN:orf, hypothetical protein] [GN:yehS] [FN:orf; Unknown] [OR:Escherichia coli] [DB:genpept-bct2] [DE:Escherichia coli K-12 MG1655 section 191 of 400 of the completegenome.] [NT:f156; 100 pct identical to YEHS_ECOLI SW: P33355] [LE:7536] [RE:8006] [DI:complement]

| ORF Name | NT ID | AA ID | NT/LN | AA/LN | Score | P-value |
|---|---|---|---|---|---|---|
| 4329158_f1_198 | 1163 | 8334 | 903 | 300 | 1303 | 7.0e-133 |

Description sp:[LN:END4_ECOLI] [AC:P12638:P78086] [GN:NFO] [OR:Escherichia coli]
[EC:3.1.21.2] [DE:ENDONUCLEASE IV, (ENDODEOXYRIBONUCLEASE IV)] [SP:P12638:P78086]
[DB:swissprot] >sp:[LN:NDEC4] [AC:F64984:A30194] [PN:deoxyribonuclease IV
(phage-T4-induced),:endodeoxyribonuclease IV:Escherichia coli endonuclease IV]
[GN:nfo] [CL:deoxyribonuclease IV (phage T4-induced)] [OR:Escherichia coli]
[EC:3.1.21.2] [DB:pir1] >gp:[GI:g1788483] [LN:AE000305] [AC:AE000305:U00096]
[PN:endonuclease IV] [GN:nfo] [FN:enzyme; Degradation of DNA] [OR:Escherichia
coli] [DB:genpept-bct2] [EC:3.1.21.2] [DE:Escherichia coli K-12 MG1655 section
195 of 400 of the completegenome.] [NT:o285; 99 pct identical to END4_ECOLI SW:
P12638] [LE:3954] [RE:4811] [DI:direct]

| ORF Name | NT ID | AA ID | NT/LN | AA/LN | Score | P-value |
|---|---|---|---|---|---|---|
| 4333318_c1_1225 | 1164 | 8335 | 2112 | 703 | 2557 | 9.1e-266 |

Description sp:[LN:EFG_THICU] [AC:O50565] [GN:FUS] [OR:Thiobacillus cuprinus] [DE:ELONGATION
FACTOR G (EF-G)] [SP:O50565] [DB:swissprot] >gp:[GI:g2654448] [LN:TCU78300]
[AC:U78300] [PN:elongation factor G] [GN:fus] [OR:Thiomonas cuprina]
[DB:genpept-bct2] [DE:Thiobacillus cuprinus complete streptomycin operon,
ribosomalprotein S12 (rpsL), ribosomal protein S7 (rpsG), elongation factorG
(fus) and elongation factor Tu (tuf) genes, complete cds.] [NT:EF-G] [LE:1506]
[RE:3614] [DI:direct]

| ORF Name | NT ID | AA ID | NT/LN | AA/LN | Score | P-value |
|---|---|---|---|---|---|---|
| 4335293_c2_1532 | 1165 | 8336 | 342 | 113 | 415 | 8.8e-39 |

Description sp:[LN:YEAR_ECOLI] [AC:P76248] [GN:YEAR] [OR:Escherichia coli] [DE:HYPOTHETICAL
13.6 KD PROTEIN IN GAPA-RND INTERGENIC REGION] [SP:P76248] [DB:swissprot]
>sp:[LN:E64940] [AC:E64940] [PN:hypothetical protein b1797] [OR:Escherichia coli]
[DB:pir2] >gp:[GI:g1788098] [LN:AE000274] [AC:AE000274:U00096] [PN:orf,
hypothetical protein] [GN:yeaR] [FN:orf; Unknown] [OR:Escherichia coli]
[DB:genpept-bct2] [DE:Escherichia coli K-12 MG1655 section 164 of 400 of the
completegenome.] [NT:f119; This 119 aa ORF is 22 pct identical (4 gaps)]
[LE:5328] [RE:5687] [DI:complement]

| ORF Name | NT ID | AA ID | NT/LN | AA/LN | Score | P-value |
|---|---|---|---|---|---|---|
| 4344808_f1_78 | 1166 | 8337 | 210 | 69 | | |

Description

NO-HIT

450

| ORF Name | NT ID | AA ID | NT/LN | AA/LN | Score | P-value |
|---|---|---|---|---|---|---|
| 4355430_c3_1734 | 1167 | 8338 | 1290 | 429 | 697 | 1.2e-68 |

Description sp:[LN:C69771] [AC:C69771] [PN:C4-dicarboxylate transport protein homolog ydbH] [GN:ydbH] [CL:C4-dicarboxylate carrier protein] [OR:Bacillus subtilis] [DB:pir2] >gp:[GI:d1020037:g1881257] [LN:AB001488] [AC:AB001488] [GN:ydbH] [OR:Bacillus subtilis] [SR:Bacillus subtilis (strain:168) DNA] [DB:genpept-bct1] [DE:Bacillus subtilis genome sequence, 148 kb sequence of the regionbetween 35 and 47 degree.] [NT:PROBABLE C4-DICARBOXYLATE TRANSPORT PROTEIN.] [LE:33229] [RE:34494] [DI:direct] >gp:[GI:e1182413:g2632747] [LN:BSUB0003] [AC:Z99106:AL009126] [GN:ydbH] [FN:unknown] [OR:Bacillus subtilis] [DB:genpept-bct1] [DE:Bacillus subtilis complete genome (section 3 of 21): from 402751 to611850.] [NT:similar to C4-dicarboxylate transport protein] [LE:96973] [RE:98238] [DI:direct]

| ORF Name | NT ID | AA ID | NT/LN | AA/LN | Score | P-value |
|---|---|---|---|---|---|---|
| 4382957_c3_1551 | 1168 | 8339 | 978 | 325 | 1328 | 1.6e-135 |

Description gp:[GI:d1016813:g1799615] [LN:D90857] [AC:D90857:AB001340] [PN:O-SUCCINYLBENZOATE-COA SYNTHASE (OSB SYNTHASE)] [GN:menC] [OR:Escherichia coli] [SR:Escherichia coli (strain:K12) DNA, clone_lib:Kohara lambda minise] [DB:genpept-bct1] [DE:E.coli genomic DNA, Kohara clone #380(51.1-51.4 min.).] [NT:similar to [SwissProt Accession Number P29208];] [LE:7627] [RE:>8616] [DI:complement]

| ORF Name | NT ID | AA ID | NT/LN | AA/LN | Score | P-value |
|---|---|---|---|---|---|---|
| 4392068_f2_553 | 1169 | 8340 | 1104 | 367 | 1701 | 4.7e-175 |

Description sp:[LN:YEJB_ECOLI] [AC:P33914:P76448] [GN:YEJB] [OR:Escherichia coli] [DE:HYPOTHETICAL ABC TRANSPORTER PERMEASE PROTEIN YEJB] [SP:P33914:P76448] [DB:swissprot] >sp:[LN:A64987] [AC:A64987] [PN:hypothetical 40.4 kD protein in bcr 5' region] [GN:yejB] [CL:oligopeptide permease protein oppB] [OR:Escherichia coli] [DB:pir2] >gp:[GI:d1016711:g1736843] [LN:D90849] [AC:D90849:AB001340] [PN:Oligopeptide transport system permease protein] [GN:yejB] [OR:Escherichia coli] [SR:Escherichia coli (strain:K12) DNA, clone_lib:Kohara lambda minise] [DB:genpept-bct1] [DE:E.coli genomic DNA, Kohara clone #369(48.6-49.0 min.).] [NT:ORF_ID:o369#13; similar to [SwissProt Accession] [LE:13862] [RE:14956] [DI:direct] >gp:[GI:g1788504] [LN:AE000307] [AC:AE000307:U00096] [PN:putative transport system permease protein] [GN:yejB] [FN:putative transport; Not classified] [OR:Escherichia coli] [DB:genpept-bct2] [DE:Escherichia coli K-12 MG1655 section 197 of 400 of the completegenome.] [NT:o364; 99 pct identical to YEJB_ECOLI SW: P33914] [LE:6439] [RE:7533] [DI:direct]

| ORF Name | NT ID | AA ID | NT LN | AA LN | Score | P-value |
|---|---|---|---|---|---|---|
| 4402158_f2_347 | 1170 | 8341 | 219 | 72 | | |

Description

NO-HIT

| ORF Name | NT ID | AA ID | NT LN | AA LN | Score | P-value |
|---|---|---|---|---|---|---|
| 4428750_f1_8 | 1171 | 8342 | 945 | 314 | 448 | 2.8e-42 |

Description sp:[LN:GCVA_ECOLI] [AC:P32064] [GN:GCVA] [OR:Escherichia coli] [DE:ACTIVATOR)]
[SP:P32064] [DB:swissprot] >sp:[LN:I41065] [AC:I41065:I41229:D65063:S34371]
[PN:glycine cleavage system transcription activator] [GN:gcvA] [CL:regulatory
protein ampR] [OR:Escherichia coli] [DB:pir2] >gp:[GI:g312766] [LN:ECGCVA]
[AC:X73413] [PN:glycine cleavage activator protein] [GN:gcvA] [OR:Escherichia
coli] [DB:genpept-bct1] [DE:E.coli gene for glycine cleavage activator protein
and orf 2 and 3.] [SP:P32064] [LE:43] [RE:960] [DI:direct] >gp:[GI:g882703]
[LN:ECU29581] [AC:U29581] [GN:gcvA] [PN:regulatory protein for glycine cleavage]
[OR:Escherichia coli] [DB:genpept-bct1] [DE:Escherichia coli K-12 genome;
approximately 63 to 64 minutes.] [NT:CG Site No. 28676] [LE:23205] [RE:24122]
[DI:complement] >gp:[GI:g1789173] [LN:AE000364] [AC:AE000364:U00096] [PN:positive
regulator of gcv operon] [GN:gcvA] [FN:regulator; Central intermediary
metabolism;] [OR:Escherichia coli] [DB:genpept-bct2] [DE:Escherichia coli K-12
MG1655 section 254 of 400 of the completegenome.] [NT:f305; 100 pct identical to
GCVA_ECOLI SW: P32064;] [LE:7719] [RE:8636] [DI:complement] >gp:[GI:g523331]
[LN:ECOGCVA] [AC:U01030] [PN:GcvA] [FN:regulatory protein for glycine cleavage
enzyme] [OR:Escherichia coli] [DB:genpept-bct2] [DE:Escherichia coli K12 glycine
cleavage activator protein (gcvA)gene, complete cds.] [LE:304] [RE:1221]
[DI:direct]

| ORF Name | NT ID | AA ID | NT LN | AA LN | Score | P-value |
|---|---|---|---|---|---|---|
| 4470011_c3_1639 | 1172 | 8343 | 1479 | 492 | 2409 | 4.4e-250 |

Description sp:[LN:C64984] [AC:C64984:A41871:S24560] [PN:lysine-specific permease:lysine
transport protein] [GN:lysP] [CL:arginine permease] [OR:Escherichia coli]
[DB:pir1] >gp:[GI:g466778] [LN:ECOLYSP] [AC:M89774:X65029] [PN:lysine specific
permease] [GN:lysP] [FN:lysine transport] [OR:Escherichia coli] [SR:Escherichia
coli DNA] [DB:genpept-bct1] [DE:Escherichia coli lysine specific permease (lysP)
gene, completecds.] [NT:resistant to lysine analogue thiosine] [LE:1517]
[RE:2986] [DI:direct] >gp:[GI:g1788480] [LN:AE000305] [AC:AE000305:U00096]
[PN:lysine-specific permease] [GN:lysP] [FN:transport; Transport of small
molecules: Amino] [OR:Escherichia coli] [DB:genpept-bct2] [DE:Escherichia coli
K-12 MG1655 section 195 of 400 of the completegenome.] [NT:f489; 100 pct
identical to LYSP_ECOLI SW: P25737;] [LE:177] [RE:1646] [DI:complement]

| ORF Name | NT ID | AA ID | NT LN | AA LN | Score | P-value |
|---|---|---|---|---|---|---|
| 4485958_f2_427 | 1173 | 8344 | 1425 | 474 | 2034 | 2.4e-210 |

Description sp:[LN:YEGB_ECOLI] [AC:P36554:P76400] [GN:YEGB] [OR:Escherichia coli]
[DE:HYPOTHETICAL 50.9 KD PROTEIN IN ALKA-BAES INTERGENIC REGION]
[SP:P36554:P76400] [DB:swissprot] >sp:[LN:D64974] [AC:D64974] [PN:hypothetical
protein b2077] [CL:multidrug-efflux transporter] [OR:Escherichia coli] [DB:pir2]
>gp:[GI:d1016657:g1736786] [LN:D90846] [AC:D90846:AB001340] [PN:Methylenomycin A
resistance protein (MMR) [GN:yegB] [OR:Escherichia coli] [SR:Escherichia coli
(strain:K12) DNA, clone_lib:Kohara lambda minise] [DB:genpept-bct1] [DE:E.coli
genomic DNA, Kohara clone #357(46.5-46.8 min.).] [NT:ORF_ID:o357#2; similar to
SwissProt Accession] [LE:4216] [RE:5631] [DI:direct] >gp:[GI:g1788392]
[LN:AE000297] [AC:AE000297:U00096] [PN:putative transport protein] [GN:yegB]
[FN:putative transport; Not classified] [OR:Escherichia coli] [DB:genpept-bct2]
[DE:Escherichia coli K-12 MG1655 section 187 of 400 of the completegenome.]
[NT:o471; This 471 aa ORF is 46 pct identical (11 gaps)] [LE:14857] [RE:16272]
[DI:direct]

| ORF Name | NT ID | AA ID | NT LN | AA LN | Score | P-value |
|---|---|---|---|---|---|---|
| 4539193_f2_326 | 1174 | 8345 | 750 | 249 | 257 | 4.9e-22 |

Description sp:[LN:YAC8_ALCEU] [AC:P27750] [OR:Alcaligenes eutrophus] [DE:HYPOTHETICAL
PROTEIN IN ACOC 3'REGION (ORF 8) (FRAGMENT)] [SP:P27750] [DB:swissprot]
>gp:[GI:g141898] [LN:AFAACOXABC] [AC:M66060] [OR:Ralstonia eutropha]
[SR:A.eutrophus (strain H16) DNA] [DB:genpept-bct1] [DE:A.eutrophus protein X
(acoX), acetoin:DCPIP oxidoreductase-alpha(acoA), acetoin:DCPIP
oxidoreductase-beta (acoB), FMP (acoC), andORF 7 genes, complete cds, and ORF 8,
5' end.] [NT:ORF 8] [LE:4842] [RE:5279] [DI:direct]

| ORF Name | NT ID | AA ID | NT LN | AA LN | Score | P-value |
|---|---|---|---|---|---|---|
| 4572693_c3_1711 | 1175 | 8346 | 1164 | 387 | 281 | 1.4e-24 |

Description sp:[LN:C69512] [AC:C69512] [PN:muconate cycloisomerase II (clcB) homolog]
[CL:muconate cycloisomerase] [OR:Archaeoglobus fulgidus] [DB:pir1]
>gp:[GI:g2648434] [LN:AE000959] [AC:AE000959:AE000782] [PN:muconate
cycloisomerase II (clcB)] [GN:AF2099] [OR:Archaeoglobus fulgidus]
[DB:genpept-bct2] [DE:Archaeoglobus fulgidus section 148 of 172 of the complete
genome.] [NT:similar to GB:M16964 PID:141917 percent identity:] [LE:14960]
[RE:16087] [DI:complement]

| ORF Name | NT ID | AA ID | NT LN | AA LN | Score | P-value |
|---|---|---|---|---|---|---|
| 4572951_c2_1319 | 1176 | 8347 | 690 | 229 | 482 | 7.0e-46 |

Description gp:[GI:e1541791:g5824089] [LN:SCF85] [AC:AL110470] [PN:hypothetical protein SCF85.08c] [GN:SCF85.08c] [OR:Streptomyces coelicolor A3(2)] [DB:genpept-bct1] [DE:Streptomyces coelicolor cosmid F85.] [NT:SCF85.08c, unknown, len: 233 aa. Weakly similar to] [LE:7930] [RE:8631] [DI:complement]

| ORF Name | NT ID | AA ID | NT LN | AA LN | Score | P-value |
|---|---|---|---|---|---|---|
| 4695467_f2_634 | 1177 | 8348 | 609 | 203 | 148 | 1.7e-10 |

Description sp:[LN:YKU2_YEAST] [AC:P36042] [GN:YKL202W] [OR:Saccharomyces cerevisiae] [SR:,Baker's yeast] [DE:HYPOTHETICAL 21.2 KD PROTEIN IN TOR2-MNN4 INTERGENIC REGION] [SP:P36042] [DB:swissprot] >sp:[LN:S38039] [AC:S38039] [PN:hypothetical protein YKL202w] [OR:Saccharomyces cerevisiae] [DB:pir2] [MP:11L] >gp:[GI:g486358] [LN:SCYKL202W] [AC:Z28201:Y13137] [OR:Saccharomyces cerevisiae] [SR:baker's yeast] [DB:genpept-pln1] [DE:S.cerevisiae chromosome XI reading frame ORF YKL202w.] [NT:ORF YKL202w] [SP:P36042] [LE:462] [RE:1043] [DI:direct]

| ORF Name | NT ID | AA ID | NT LN | AA LN | Score | P-value |
|---|---|---|---|---|---|---|
| 4713343_f1_216 | 1178 | 8349 | 1035 | 344 | 1551 | 3.7e-159 |

Description sp:[LN:YEJE_ECOLI] [AC:P33915] [GN:YEJE] [OR:Escherichia coli] [DE:HYPOTHETICAL ABC TRANSPORTER PERMEASE PROTEIN YEJE] [SP:P33915] [DB:swissprot] >sp:[LN:B64987] [AC:B64987] [PN:hypothetical 38.1 kD protein in bcr 5' region] [GN:yejE] [OR:Escherichia coli] [DB:pir2] >gp:[GI:d1016712:g1736844] [LN:D90849] [AC:D90849:AB001340] [PN:DciAC protein] [GN:yejE] [OR:Escherichia coli] [SR:Escherichia coli (strain:K12) DNA, clone_lib:Kohara lambda minise] [DB:genpept-bct1] [DE:E.coli genomic DNA, Kohara clone #369(48.6-49.0 min.).] [NT:ORF_ID:o369#14; similar to [PIR Accession Number] [LE:14956] [RE:15981] [DI:direct] >gp:[GI:g405908] [LN:ECOHU49] [AC:U00008] [PN:yejE] [GN:probable transport operon; yejA-yejB/C-yejE-yejF.] [OR:Escherichia coli] [SR:Escherichia coli K12 BHB2600] [DB:genpept-bct1] [DE:centisome 49 region of E.coli K12 BHB2600.] [NT:Probable membrane-bound component of transport] [LE:2326] [RE:3351] [DI:direct] >gp:[GI:g1788505] [LN:AE000307] [AC:AE000307:U00096] [PN:putative transport system permease protein] [GN:yejE] [FN:putative transport; Not classified] [OR:Escherichia coli] [DB:genpept-bct2] [DE:Escherichia coli K-12 MG1655 section 197 of 400 of the completegenome.] [NT:o341; 100 pct identical to YEJE_ECOLI SW: P33915] [LE:7533] [RE:8558] [DI:direct]

| ORF Name | NT ID | AA ID | NT LN | AA LN | Score | P-value |
|---|---|---|---|---|---|---|
| 4723383_c3_1757 | 1179 | 8350 | 1473 | 490 | 2353 | 3.8e-244 |

Description gp:[GI:d1029261:g3142208] [LN:AB010150] [AC:AB010150] [PN:gluconate-6-phosphate dehydrogenase] [GN:gnd] [OR:Escherichia coli] [SR:Escherichia coli (strain:F492) DNA, clone_lib:31 clone:pTSO8] [DB:genpept-bct1] [EC:1.1.1.44] [DE:Escherichia coli O8 wb gene cluster, complete cds.] [NT:putative] [LE:146] [RE:1552] [DI:direct]

| ORF Name | NT ID | AA ID | NT LN | AA LN | Score | P-value |
|---|---|---|---|---|---|---|
| 472761_f2_456 | 1180 | 8351 | 1365 | 454 | 2207 | 1.1e-228 |

Description sp:[LN:S78599] [AC:S78599] [PN:probable D-ribulose transporter:ribitol transporter] [GN:rbtT] [OR:Klebsiella pneumoniae] [DB:pir2] >gp:[GI:g2735583] [LN:AF045244] [AC:AF045244:U97127] [PN:ribitol transporter] [GN:rbtT] [OR:Klebsiella pneumoniae] [DB:genpept-bct2] [DE:Klebsiella pneumoniae ribitol kinase (rbtK) and ribitol transporter(rbtT) genes, complete cds.] [NT:RbtT] [LE:1820] [RE:3103] [DI:direct]

| ORF Name | NT ID | AA ID | NT LN | AA LN | Score | P-value |
|---|---|---|---|---|---|---|
| 4735391_c3_1648 | 1181 | 8352 | 1053 | 350 | 1471 | 1.1e-150 |

Description sp:[LN:GALS_ECOLI] [AC:P25748] [GN:GALS] [OR:Escherichia coli] [DE:MGL REPRESSOR AND GALACTOSE ULTRAINDUCTION FACTOR] [SP:P25748] [DB:swissprot] >sp:[LN:F64983] [AC:F64983:S28962:S19935] [PN:isorepressor galS] [GN:galS] [CL:lac repressor] [OR:Escherichia coli] [DB:pir2] >gp:[GI:g405897] [LN:ECOHU47] [AC:U00007] [PN:galS] [OR:Escherichia coli] [SR:Escherichia coli K12 BHB2600] [DB:genpept-bct1] [DE:47 to 48 centisome region of E.coli K12 BHB2600.] [LE:48373] [RE:49413] [DI:complement] >gp:[GI:g1788474] [LN:AE000304] [AC:AE000304:U00096] [PN:mgl repressor, galactose operon inducer] [GN:galS] [FN:regulator; Degradation of small molecules:] [OR:Escherichia coli] [DB:genpept-bct2] [DE:Escherichia coli K-12 MG1655 section 194 of 400 of the completegenome.] [NT:f346; 99 pct identical to GALS_ECOLI SW: P25748] [LE:4037] [RE:5077] [DI:complement]

| ORF Name | NT ID | AA ID | NT/LN | AA/LN | Score | P-value |
|---|---|---|---|---|---|---|
| 4742943_c3_1584 | 1182 | 8353 | 663 | 220 | 919 | 3.4e-92 |

Description sp:[LN:ALKB_ECOLI] [AC:P05050] [GN:ALKB:AIDD] [OR:Escherichia coli] [DE:ALKB PROTEIN] [SP:P05050] [DB:swissprot] >sp:[LN:BVECKB] [AC:A24605:B64991] [PN:alkB protein] [GN:alkB] [CL:alkB protein] [OR:Escherichia coli] [DB:pir1] [MP:48 min] >gp:[GI:d1016720:g1736853] [LN:D90850] [AC:D90850:AB001340] [PN:AlkB protein.] [GN:alkB, aidD] [OR:Escherichia coli] [SR:Escherichia coli (strain:K12) DNA, clone_lib:Kohara lambda minise] [DB:genpept-bct1] [DE:E.coli genomic DNA, Kohara clone #373(49.5-49.9 min.).] [NT:ORF_ID:o373#1; similar to [SwissProt Accession] [LE:8209] [RE:8859] [DI:complement] >gp:[GI:g145195] [LN:ECOADAB] [AC:J02607] [OR:Escherichia coli] [SR:E.coli (strain K-12) DNA] [DB:genpept-bct1] [DE:E.coli alkB gene encoding the AlkB protein, complete cds, and adagene encoding 0-6-methylguanine-DNA methyltransferase, partial cds.] [NT:AlkB protein (alkB)] [LE:207] [RE:857] [DI:direct] >gp:[GI:g405945] [LN:ECOHU49] [PN:alkB] [OR:Escherichia coli] [SR:Escherichia coli K12 BHB2600] [DB:genpept-bct1] [DE:centisome 49 region of E.coli K12 BHB2600.] [LE:35742] [RE:36392] [DI:complement] >gp:[GI:g1788541] [LN:AE000310] [AC:AE000310:U00096] [PN:DNA repair system specific for alkylated DNA] [GN:alkB] [FN:putative enzyme; DNA - replication, repair,] [OR:Escherichia coli] [DB:genpept-bct2] [DE:Escherichia coli K-12 MG1655 section 200 of 400 of the completegenome.] [NT:f216; 100 pct identical to ALKB_ECOLI SW: P05050] [LE:5011] [RE:5661] [DI:complement]

| ORF Name | NT ID | AA ID | NT/LN | AA/LN | Score | P-value |
|---|---|---|---|---|---|---|
| 4767287_c3_1632 | 1183 | 8354 | 1161 | 386 | 1614 | 7.7e-166 |

Description sp:[LN:PTFA_SALTY] [AC:P17127] [GN:FRUB:FRUF:FPR] [OR:Salmonella typhimurium] [EC:2.7.1.69] [DE:HPR) (EIII-FRU) (FRUCTOSE PTS DIPHOSPHORYL TRANSFER PROTEIN)] [SP:P17127] [DB:swissprot] >sp:[LN:JE0023] [AC:JE0023] [PN:fructose phosphotransferase protein:FPr protein:phosphoenolpyruvate--fructose phosphotransferase system, 39K protein] [GN:fruF] [CL:fructose phosphotransferase protein:phosphotransferase system mannitol-specific enzyme II factor III homology:phosphotransferase system phosphohistidine-containing protein homology] [OR:Salmonella typhimurium] [DB:pir1] >gp:[GI:g47689] [LN:STFRUF] [AC:X14243] [OR:Salmonella typhimurium] [DB:genpept-bct1] [DE:Salmonella typhimurium fruF gene for FPr protein with enzyme III(fru) and pseudo-HPr activity.] [NT:FPr protein (AA 1 - 376)] [SP:P17127] [LE:435] [RE:1565] [DI:direct]

456

| ORF Name | NT ID | AA ID | NT/LN | AA/LN | Score | P-value |
|---|---|---|---|---|---|---|
| 4876507_f1_51 | 1184 | 8355 | 1146 | 381 | 825 | 3.1e-82 |

Description sp:[LN:YKOT_BACSU] [AC:O34755] [GN:YKOT] [OR:Bacillus subtilis] [DE:HYPOTHETICAL 38.5 KD PROTEIN IN TNRA-SSPD INTERGENIC REGION] [SP:O34755] [DB:swissprot] >sp:[LN:F69860] [AC:F69860] [PN:dolichol phosphate mannose synthase homolog ykoT] [GN:ykoT] [CL:stress response protein csbB] [OR:Bacillus subtilis] [DB:pir2] >gp:[GI:e1183359:g2633693] [LN:BSUB0007] [AC:Z99110:AL009126] [GN:ykoT] [FN:unknown] [OR:Bacillus subtilis] [DB:genpept-bct1] [DE:Bacillus subtilis complete genome (section 7 of 21): from 1194391to 1411140.] [NT:similar to dolichol phosphate mannose synthase] [SP:O34755] [LE:208555] [RE:209568] [DI:direct] >gp:[GI:e1184929:g2633710] [LN:BSUB0008] [AC:Z99111:AL009126] [GN:ykoT] [FN:unknown] [OR:Bacillus subtilis] [DB:genpept-bct1] [DE:Bacillus subtilis complete genome (section 8 of 21): from 1394791to 1603020.] [NT:similar to dolichol phosphate mannose synthase] [SP:O34755] [LE:8155] [RE:9168] [DI:direct]

| ORF Name | NT ID | AA ID | NT/LN | AA/LN | Score | P-value |
|---|---|---|---|---|---|---|
| 4882266_c2_1382 | 1185 | 8356 | 978 | 325 | 1345 | 2.5e-137 |

Description sp:[LN:PBP7_ECOLI] [AC:P33364] [GN:PBPG] [OR:Escherichia coli] [EC:3.4.99.-] [DE:ENDOPEPTIDASE), (DD-ENDOPEPTIDASE)] [SP:P33364] [DB:swissprot] >sp:[LN:E64981] [AC:E64981:I41049] [PN:penicillin-binding protein 7 precursor] [GN:pbpG] [OR:Escherichia coli] [DB:pir2] [MP:47 min] >gp:[GI:g405864] [LN:ECOHU47] [AC:U00007] [PN:yohB] [OR:Escherichia coli] [SR:Escherichia coli K12 BHB2600] [DB:genpept-bct1] [DE:47 to 48 centisome region of E.coli K12 BHB2600.] [NT:similar to carboxypeptidases and penicillin binding] [LE:36708] [RE:37649] [DI:complement] >gp:[GI:g1788455] [LN:AE000302] [AC:AE000302:U00096] [PN:penicillin-binding protein 7] [GN:pbpG] [FN:putative enzyme; Murein sacculus,] [OR:Escherichia coli] [DB:genpept-bct2] [DE:Escherichia coli K-12 MG1655 section 192 of 400 of the completegenome.] [NT:f313; 100 pct identical to PBP7_ECOLI SW: P33364;] [LE:9213] [RE:10154] [DI:complement]

| ORF Name | NT ID | AA ID | NT/LN | AA/LN | Score | P-value |
|---|---|---|---|---|---|---|
| 4882827_c2_1482 | 1186 | 8357 | 1017 | 338 | 140 | 1.0e-06 |

Description gp:[GI:g4512013] [LN:AF104912] [AC:AF104912] [OR:Escherichia coli] [DB:genpept-bct2] [DE:Escherichia coli K30 capsule biosynthesis cluster, partialsequence.] [NT:OrfZ] [LE:11401] [RE:12546] [DI:direct]

| ORF Name | NT ID | AA ID | NT LN | AA LN | Score | P-value |
|---|---|---|---|---|---|---|
| 4901550_c2_1485 | 1187 | 8358 | 1431 | 476 | 2438 | 3.7e-253 |

Description sp:[LN:I57096] [AC:I57096] [PN:mannose-1-phosphate guanylyltransferase,]
[CL:Helicobacter mannose-6-phosphate isomerase] [OR:Escherichia coli]
[EC:2.7.7.13] [DB:pir2] >gp:[GI:d1008330:g598465] [LN:ECORFBM] [AC:D43637:D13231]
[PN:GDP-mannose pyrophosphorylase] [GN:rfbM] [OR:Escherichia coli]
[SR:Escherichia coli (isolate:F719) DNA, clone:pNKB26] [DB:genpept-bct1]
[EC:2.7.7.22] [DE:Escherichia coli rfb gene cluster encoding
phosphomannomutase,GDP-mannose pyrophosphorylase, mannosyltransferase, etc.]
[LE:317] [RE:1732] [DI:direct]

| ORF Name | NT ID | AA ID | NT LN | AA LN | Score | P-value |
|---|---|---|---|---|---|---|
| 4945393_c3_1709 | 1188 | 8359 | 672 | 223 | 287 | 3.2e-25 |

Description sp:[LN:YNIC_ECOLI] [AC:P77247] [GN:YNIC] [OR:Escherichia coli] [DE:HYPOTHETICAL
24.3 KD PROTEIN IN PFKB-CEDA INTERGENIC REGION] [SP:P77247] [DB:swissprot]
>sp:[LN:G64931] [AC:G64931] [PN:yniC protein] [GN:yniC] [CL:hypothetical protein
b2690] [OR:Escherichia coli] [DB:pir2] >gp:[GI:d1016230:g1742822] [LN:D90815]
[AC:D90815:AB001340] [PN:Phosphoglycolate phosphatase (EC 3.1.3.18).]
[OR:Escherichia coli] [SR:Escherichia coli (strain:K12) DNA, clone_lib:Kohara
lambda minise] [DB:genpept-bct1] [DE:E.coli genomic DNA, Kohara clone
324(38.8-39.1 min.).] [NT:ORF_ID:o324#7; similar to [SwissProt Accession]
[LE:8910] [RE:9578] [DI:direct] >gp:[GI:d1016234:g1742827] [LN:D90816]
[AC:D90816:AB001340] [PN:Phosphoglycolate phosphatase (EC 3.1.3.18).]
[OR:Escherichia coli] [SR:Escherichia coli (strain:K12) DNA, clone_lib:Kohara
lambda minise] [DB:genpept-bct1] [DE:E.coli genomic DNA, Kohara clone
325(38.9-39.2 min.).] [NT:ORF_ID:o324#7; similar to [SwissProt Accession]
[LE:1969] [RE:2637] [DI:direct] >gp:[GI:g1788021] [LN:AE000267]
[AC:AE000267:U00096] [PN:putative phosphatase] [GN:yniC] [FN:putative enzyme; Not
classified] [OR:Escherichia coli] [DB:genpept-bct2] [DE:Escherichia coli K-12
MG1655 section 157 of 400 of the completegenome.] [NT:o222; This 222 aa ORF is 31
pct identical (15 gaps)] [LE:9363] [RE:10031] [DI:direct]

| ORF Name | NT ID | AA ID | NT LN | AA LN | Score | P-value |
|---|---|---|---|---|---|---|
| 4978590_f1_10 | 1189 | 8360 | 252 | 83 | | |

Description

NO-HIT

| ORF Name | NT ID | AA ID | NT LN | AA LN | Score | P-value |
|---|---|---|---|---|---|---|
| 511066_c1_1193 | 1190 | 8361 | 1239 | 412 | 129 | 2.2e-05 |

Description sp:[LN:F22845] [AC:F22845] [PN:hypothetical protein 6] [OR:mitochondrion
Trypanosoma brucei] [DB:pir2]

458

| ORF Name | NT ID | AA ID | NT/LN | AA/LN | Score | P-value |
|---|---|---|---|---|---|---|
| 5117208_c2_1275 | 1191 | 8362 | 759 | 252 | 764 | 9.1e-76 |

Description sp:[LN:YFCI_ECOLI] [AC:P77768] [GN:YFCI] [OR:Escherichia coli] [DE:HYPOTHETICAL 34.2 KD PROTEIN IN FOLX-HISP INTERGENIC REGION] [SP:P77768] [DB:swissprot] >sp:[LN:G65002] [AC:G65002] [PN:hypothetical protein b2305] [OR:Escherichia coli] [DB:pir2] >gp:[GI:d1016870:g1799676] [LN:D90861] [AC:D90861:AB001340] [GN:yhgA] [OR:Escherichia coli] [SR:Escherichia coli (strain:K12) DNA, clone_lib:Kohara lambda minise] [DB:genpept-bct1] [DE:E.coli genomic DNA, Kohara clone #405(52.0-52.3 min.).] [NT:similar to [SwissProt Accession Number P31667]] [LE:12638] [RE:13528] [DI:complement] >gp:[GI:d1016879:g1799686] [LN:D90862] [AC:D90862:AB001340] [GN:yhgA] [OR:Escherichia coli] [SR:Escherichia coli (strain:K12) DNA, clone_lib:Kohara lambda minise] [DB:genpept-bct1] [DE:E.coli genomic DNA, Kohara clone #406(52.2-52.5 min.).] [NT:similar to [SwissProt Accession Number P31667]] [LE:6226] [RE:7116] [DI:complement] >gp:[GI:g1788643] [LN:AE000319] [AC:AE000319:U00096] [PN:orf, hypothetical protein] [GN:yfcI] [FN:orf; Unknown] [OR:Escherichia coli] [DB:genpept-bct2] [DE:Escherichia coli K-12 MG1655 section 209 of 400 of the completegenome.] [NT:f296; This 296 aa ORF is 66 pct identical (4 gaps)] [LE:7970] [RE:8860] [DI:complement]

| ORF Name | NT ID | AA ID | NT/LN | AA/LN | Score | P-value |
|---|---|---|---|---|---|---|
| 5126713_f2_455 | 1192 | 8363 | 1617 | 538 | 2745 | 1.1e-285 |

Description sp:[LN:S78598] [AC:S78598:S08571] [PN:D-ribulokinase,] [GN:rbtK] [OR:Klebsiella pneumoniae] [EC:2.7.1.47] [DB:pir2] >gp:[GI:g2905643] [LN:AF045244] [AC:AF045244:U97127] [PN:ribitol kinase] [GN:rbtK] [OR:Klebsiella pneumoniae] [DB:genpept-bct2] [DE:Klebsiella pneumoniae ribitol kinase (rbtK) and ribitol transporter(rbtT) genes, complete cds.] [NT:RbtK] [LE:131] [RE:1738] [DI:direct]

| ORF Name | NT ID | AA ID | NT/LN | AA/LN | Score | P-value |
|---|---|---|---|---|---|---|
| 5129687_f2_505 | 1193 | 8364 | 384 | 127 | 100 | 2.1e-05 |

Description gp:[GI:g1769460] [LN:RCU49506] [AC:U49506] [PN:DorB] [GN:dorB] [OR:Rhodobacter capsulatus] [DB:genpept-bct2] [DE:Rhodobacter capsulatus DorR response regulator (dorR) gene,complete cds; DMSO reductase operon, complete sequence.] [LE:5299] [RE:5637] [DI:direct]

| ORF Name | NT ID | AA ID | NT LN | AA LN | Score | P-value |
|---|---|---|---|---|---|---|
| 5213568_c2_1288 | 1194 | 8365 | 1080 | 359 | 1555 | 1.4e-159 |

Description sp:[LN:GLPQ_ECOLI] [AC:P09394] [GN:GLPQ] [OR:Escherichia coli] [EC:3.1.4.46]
[DE:(EC 3.1.4.46) (GLYCEROPHOSPHODIESTER PHOSPHODIESTERASE)] [SP:P09394]
[DB:swissprot] >sp:[LN:S15945] [AC:S15945:S00871:E64994:S72653:S14522]
[PN:glycerophosphodiester phosphodiesterase, precursor, periplasmic] [GN:glpQ]
[OR:Escherichia coli] [EC:3.1.4.46] [DB:pir2] >gp:[GI:d1016786:g1799586]
[LN:D90855] [AC:D90855:AB001340] [PN:glycerophosphodiester phosphodiesterase (EC]
[GN:glpQ] [OR:Escherichia coli] [SR:Escherichia coli (strain:K12) DNA,
clone_lib:Kohara lambda minise] [DB:genpept-bct1] [DE:E.coli genomic DNA, Kohara
clone #377(50.5-50.9 min.).] [NT:similar to [PIR Accession Number S15945]]
[LE:10219] [RE:11295] [DI:complement] >gp:[GI:g41581] [LN:ECGLPQ] [AC:X56907]
[PN:glycerophosphocholine phosphodiesterase] [GN:glpQ] [OR:Escherichia coli]
[DB:genpept-bct1] [EC:3.1.4.2] [DE:E. coli glpQ gene for glycerophosphoryl
diester phosphodiesterase(periplasmic).] [SP:P09394] [LE:31] [RE:1107]
[DI:direct] >gp:[GI:g1788572] [LN:AE000314] [AC:AE000314:U00096]
[PN:glycerophosphodiester phosphodiesterase,] [GN:glpQ] [FN:enzyme; Central
intermediary metabolism: Pool,] [OR:Escherichia coli] [DB:genpept-bct2]
[DE:Escherichia coli K-12 MG1655 section 204 of 400 of the completegenome.]
[NT:f358; 100 pct identical to GLPQ_ECOLI SW: P09394] [LE:386] [RE:1462]
[DI:complement]

| ORF Name | NT ID | AA ID | NT LN | AA LN | Score | P-value |
|---|---|---|---|---|---|---|
| 522337_f3_913 | 1195 | 8366 | 666 | 221 | 1043 | 2.5e-105 |

Description sp:[LN:RCSB_SALTI] [AC:Q56127] [GN:RCSB] [OR:Salmonella typhi] [DE:CAPSULAR
SYNTHESIS REGULATOR COMPONENT B] [SP:Q56127] [DB:swissprot]
>gp:[GI:d1019912:g1813333] [LN:AB000683] [AC:AB000683] [PN:RcsB] [GN:rcsB]
[OR:Salmonella typhi] [SR:Salmonella typhi (strain:GIFU10007) DNA]
[DB:genpept-bct1] [DE:Salmonella typhi DNA for RcsB, complete cds.] [LE:535]
[RE:1185] [DI:direct] >gp:[GI:e183906:g1237096] [LN:STRCSBCGN] [AC:X87830]
[PN:RcsB protein] [GN:rcsB] [OR:Salmonella typhi] [DB:genpept-bct1] [DE:S.typhi
rcsB & rcsC genes.] [SP:Q56127] [LE:166] [RE:816] [DI:direct]

| ORF Name | NT ID | AA ID | NT/LN | AA/LN | Score | P-value |
|---|---|---|---|---|---|---|
| 5272167_c2_1368 | 1196 | 8367 | 1068 | 355 | 1404 | 1.4e-143 |

Description sp:[LN:YOHI_ECOLI] [AC:P33371] [GN:YOHI] [OR:Escherichia coli] [DE:HYPOTHETICAL 35.2 KD PROTEIN IN PBPG-CDD INTERGENIC REGION] [SP:P33371] [DB:swissprot] >sp:[LN:C64982] [AC:C64982] [PN:hypothetical 35.2 kD protein in pbpG-cdd intergenic region] [GN:yohI] [CL:conserved hypothetical protein HI0979] [OR:Escherichia coli] [DB:pir2] >gp:[GI:g405871] [LN:ECOHU47] [AC:U00007] [PN:yohI] [OR:Escherichia coli] [SR:Escherichia coli K12 BHB2600] [DB:genpept-bct1] [DE:47 to 48 centisome region of E.coli K12 BHB2600.] [NT:similar to yhdG and an ORF from Rhodobacter.] [LE:42208] [RE:43155] [DI:complement] >gp:[GI:g1788462] [LN:AE000303] [AC:AE000303:U00096] [PN:putative regulator protein] [GN:yohI] [FN:putative regulator; Not classified] [OR:Escherichia coli] [DB:genpept-bct2] [DE:Escherichia coli K-12 MG1655 section 193 of 400 of the completegenome.] [NT:f315; 100 pct identical to YOHI_ECOLI SW: P33371] [LE:4507] [RE:5454] [DI:complement]

| ORF Name | NT ID | AA ID | NT/LN | AA/LN | Score | P-value |
|---|---|---|---|---|---|---|
| 5292958_c3_1805 | 1197 | 8368 | 192 | 63 | | |

Description

NO-HIT

| ORF Name | NT ID | AA ID | NT/LN | AA/LN | Score | P-value |
|---|---|---|---|---|---|---|
| 5339010_c2_1351 | 1198 | 8369 | 957 | 318 | 1235 | 1.1e-125 |

Description sp:[LN:YEIE_ECOLI] [AC:P32484] [GN:YEIE] [OR:Escherichia coli] [DE:HYPOTHETICAL TRANSCRIPTIONAL REGULATOR IN LYSP-NFO INTERGENIC REGION] [SP:P32484] [DB:swissprot] >sp:[LN:D64984] [AC:D64984] [PN:hypothetical transcription regulator lysP-nfo intergenic region] [GN:yeiE] [CL:transcription activator LysR-type] [OR:Escherichia coli] [DB:pir2] >gp:[GI:g405876] [LN:ECOHU47] [AC:U00007] [PN:yeiE] [OR:Escherichia coli] [SR:Escherichia coli K12 BHB2600] [DB:genpept-bct1] [DE:47 to 48 centisome region of E.coli K12 BHB2600.] [NT:member of lysR family.] [LE:56482] [RE:57363] [DI:complement] >gp:[GI:g466777] [LN:ECOLYSP] [AC:M89774:X65029] [OR:Escherichia coli] [SR:Escherichia coli DNA] [DB:genpept-bct1] [DE:Escherichia coli lysine specific permease (lysP) gene, completecds.] [NT:ORF 1 function unknown; lysR homolog] [LE:431] [RE:1312] [DI:direct] >gp:[GI:g1788481] [LN:AE000305] [AC:AE000305:U00096] [PN:putative transcriptional regulator LYSR-type] [GN:yeiE] [FN:putative regulator; Not classified] [OR:Escherichia coli] [DB:genpept-bct2] [DE:Escherichia coli K-12 MG1655 section 195 of 400 of the completegenome.] [NT:f293; 100 pct identical to YEIE_ECOLI SW: P32484] [LE:1851] [RE:2732] [DI:complement]

| ORF Name | NT ID | AA ID | NT/LN | AA/LN | Score | P-value |
|---|---|---|---|---|---|---|
| 5364806_f1_187 | 1199 | 8370 | 792 | 263 | 157 | 4.0e-10 |

Description gp:[GI:g1399846] [LN:SPU59236] [AC:U59236] [PN:unknown] [OR:Synechococcus PCC7942] [DB:genpept-bct2] [DE:Synechococcus PCC7942 ribosomal protein S1 of 30S ribosome (rps1),ORF271, ORF231, ORF341, carboxyltransferase alpha subunit (accA),ORF245, ORF227, and GTP cyclohydrolase I (folE) genes, completecds, and ORF205 gene, partial cds.] [NT:ORF227] [LE:5538] [RE:6221] [DI:complement]

| ORF Name | NT ID | AA ID | NT/LN | AA/LN | Score | P-value |
|---|---|---|---|---|---|---|
| 5870828_f3_971 | 1200 | 8371 | 507 | 169 | 240 | 1.3e-19 |

Description sp:[LN:S22697] [AC:S22697:S21006] [PN:extensin] [OR:Volvox carteri] [DB:pir2]

| ORF Name | NT ID | AA ID | NT/LN | AA/LN | Score | P-value |
|---|---|---|---|---|---|---|
| 5955208_f1_179 | 1201 | 8372 | 258 | 85 | 80 | 0.013 |

Description sp:[LN:D70912] [AC:D70912] [PN:probable monooxygenase] [GN:Rv0044c] [OR:Mycobacterium tuberculosis] [DB:pir2] >gp:[GI:e268457:g1568583] [LN:MTCY21D4] [AC:Z80775:AL123456] [PN:hypothetical protein Rv0044c] [GN:Rv0044c] [OR:Mycobacterium tuberculosis] [DB:genpept-bct1] [DE:Mycobacterium tuberculosis H37Rv complete genome; segment 3/262.] [NT:Rv0044c, (MTCY21D4.07c), len: 264, possible] [LE:5871] [RE:6665] [DI:complement]

| ORF Name | NT ID | AA ID | NT/LN | AA/LN | Score | P-value |
|---|---|---|---|---|---|---|
| 5974033_c2_1341 | 1202 | 8373 | 1284 | 427 | 1602 | 1.4e-164 |

Description sp:[LN:UXUA_ECOLI] [AC:P24215] [GN:UXUA] [OR:Escherichia coli] [EC:4.2.1.8] [DE:MANNONATE DEHYDRATASE, (D-MANNONATE HYDROLASE)] [SP:P24215] [DB:swissprot] >sp:[LN:S56547] [AC:S56547:D65246] [PN:mannonate dehydratase,:D-mannonate hydrolase] [GN:uxuA] [OR:Escherichia coli] [EC:4.2.1.8] [DB:pir2] >gp:[GI:d1003094:g1841884] [LN:D13329] [AC:D13329] [PN:Mannonate dehydratase] [GN:uxuA] [OR:Escherichia coli] [SR:Escherichia coli (strain:K12) cell_line:W3110 DNA] [DB:genpept-bct1] [EC:4.2.1.8] [DE:Escherichia coli uxuA, uxuB and uxuR genes for mannonatedehydratase, mannonate oxidoreductase and uxu regulon repressor,complete cds.] [LE:580] [RE:1764] [DI:direct] >gp:[GI:g537163] [LN:ECOUW93] [AC:U14003] [PN:D-mannonate hydrolase] [GN:uxuA] [OR:Escherichia coli] [DB:genpept-bct1] [EC:4.2.1.8] [DE:Escherichia coli K-12 chromosomal region from 92.8 to 00.1 minutes.] [NT:CG Site No. 14] [LE:242468] [RE:243652] [DI:direct] >gp:[GI:g1790778] [LN:AE000503] [AC:AE000503:U00096] [PN:mannonate hydrolase] [GN:uxuA] [FN:enzyme; Degradation of small molecules: Carbon] [OR:Escherichia coli] [DB:genpept-bct2] [EC:4.2.1.8] [DE:Escherichia coli K-12 MG1655 section 393 of 400 of the completegenome.] [NT:o394; 100 pct identical to UXUA_ECOLI SW: P24215;] [LE:176] [RE:1360] [DI:direct]

| ORF Name | NT ID | AA ID | NT/LN | AA/LN | Score | P-value |
|---|---|---|---|---|---|---|
| 5976465_f3_730 | 1203 | 8374 | 789 | 262 | 260 | 2.3e-22 |

Description sp:[LN:PHOP_SALTY] [AC:P14146] [GN:PHOP] [OR:Salmonella typhimurium]
[DE:VIRULENCE TRANSCRIPTIONAL REGULATORY PROTEIN PHOP] [SP:P14146] [DB:swissprot]
>sp:[LN:RGEBFT] [AC:A32932:A37132] [PN:transcription regulator phoP] [GN:phoP]
[CL:ompR protein:response regulator homology] [OR:Salmonella typhimurium]
[DB:pir1] [MP:25 min] >gp:[GI:g154264] [LN:STYPHOPA] [AC:M25241] [OR:Salmonella
typhimurium] [SR:S.typhimurium (strain 14028s) DNA, clone pEG5381]
[DB:genpept-bct1] [DE:S.typhimurium phoP gene encoding PhoP virulence protein,
completecds.] [NT:PhoP protein] [LE:151] [RE:825] [DI:direct] >gp:[GI:g154266]
[LN:STYPHOPQ] [AC:M24424] [OR:Salmonella typhimurium] [SR:S.typhimurium (strain
LT2) DNA] [DB:genpept-bct1] [DE:S.typhimurium phoP protein and membrane protein
phoQ genes,complete cds.] [NT:phoP protein] [LE:141] [RE:815] [DI:direct]

| ORF Name | NT ID | AA ID | NT/LN | AA/LN | Score | P-value |
|---|---|---|---|---|---|---|
| 5995791_c3_1674 | 1204 | 8375 | 711 | 236 | 666 | 2.2e-65 |

Description sp:[LN:YEHT_ECOLI] [AC:P33356:P76433:P76432] [GN:YEHT] [OR:Escherichia coli]
[DE:HYPOTHETICAL 27.9 KD PROTEIN IN MOLR-BGLX INTERGENIC REGION]
[SP:P33356:P76433:P76432] [DB:swissprot] >sp:[LN:D64980] [AC:D64980] [PN:yehT
protein] [GN:yehT] [CL:yehT protein:response regulator homology] [OR:Escherichia
coli] [DB:pir2] >gp:[GI:g405856] [LN:ECOHU47] [AC:U00007] [PN:yehT]
[OR:Escherichia coli] [SR:Escherichia coli K12 BHB2600] [DB:genpept-bct1] [DE:47
to 48 centisome region of E.coli K12 BHB2600.] [NT:belongs to uhpA family of
transcriptional] [LE:25012] [RE:25746] [DI:complement] >gp:[GI:g2367130]
[LN:AE000301] [AC:AE000301:U00096] [PN:orf, hypothetical protein] [GN:yehT]
[FN:orf; Unknown] [OR:Escherichia coli] [DB:genpept-bct2] [DE:Escherichia coli
K-12 MG1655 section 191 of 400 of the completegenome.] [NT:f244; 100 pct
identical to YEHT_ECOLI SW:] [LE:8053] [RE:8787] [DI:complement]

| ORF Name | NT ID | AA ID | NT/LN | AA/LN | Score | P-value |
|---|---|---|---|---|---|---|
| 6019012_f2_377 | 1205 | 8376 | 324 | 107 | 83 | 0.0089 |

Description sp:[LN:S04682] [AC:S04682] [PN:ribosomal protein var1] [GN:var1]
[CL:Saccharomyces cerevisiae ribosomal protein var1] [OR:mitochondrion Candida
glabrata] [DB:pir2]

463

| ORF_Name | NT_ID | AA_ID | NT/LN | AA/LN | Score | P-value |
|---|---|---|---|---|---|---|
| 6502083_c3_1793 | 1206 | 8377 | 1173 | 390 | 1439 | 2.7e-147 |

Description sp:[LN:YEEA_ECOLI] [AC:P33011:P76368] [GN:YEEA] [OR:Escherichia coli]
[DE:HYPOTHETICAL 40.0 KD PROTEIN IN COBU-SBMC INTERGENIC REGION]
[SP:P33011:P76368] [DB:swissprot] >sp:[LN:G64965] [AC:G64965] [PN:membrane
protein yeeA] [GN:yeeA] [OR:Escherichia coli] [DB:pir2]
>gp:[GI:d1016553:g1736674] [LN:D90838] [AC:D90838:AB001340] [GN:yeeA]
[OR:Escherichia coli] [SR:Escherichia coli (strain:K12) DNA, clone_lib:Kohara
lambda minise] [DB:genpept-bct1] [DE:E.coli genomic DNA, Kohara clone
348(44.5-44.9 min.).] [NT:ORF_ID:o348#20; similar to [SwissProt Accession]
[LE:15099] [RE:16157] [DI:complement] >gp:[GI:d1016560:g1736682] [LN:D90839]
[AC:D90839:AB001340] [GN:yeeA] [OR:Escherichia coli] [SR:Escherichia coli
(strain:K12) DNA, clone_lib:Kohara lambda minise] [DB:genpept-bct1] [DE:E.coli
genomic DNA, Kohara clone #349(44.6-45.0 min.).] [NT:ORF_ID:o348#20; similar to
[SwissProt Accession] [LE:8185] [RE:9243] [DI:complement] >gp:[GI:g1788318]
[LN:AE000292] [AC:AE000292:U00096] [PN:orf, hypothetical protein] [GN:yeeA]
[FN:orf; Unknown] [OR:Escherichia coli] [DB:genpept-bct2] [DE:Escherichia coli
K-12 MG1655 section 182 of 400 of the completegenome.] [NT:f352; 100 pct
identical to fragment YEEA_ECOLI] [LE:4848] [RE:5906] [DI:complement]

| ORF_Name | NT_ID | AA_ID | NT/LN | AA/LN | Score | P-value |
|---|---|---|---|---|---|---|
| 6531318_c3_1643 | 1207 | 8378 | 186 | 61 | | |

Description

NO-HIT

| ORF_Name | NT_ID | AA_ID | NT/LN | AA/LN | Score | P-value |
|---|---|---|---|---|---|---|
| 6536541_c1_1233 | 1208 | 8379 | 873 | 290 | 914 | 1.2e-91 |

Description sp:[LN:COBS_SALTY] [AC:Q05602] [GN:COBS] [OR:Salmonella typhimurium]
[DE:COBALAMIN [5'-PHOSPHATE] SYNTHASE] [SP:Q05602] [DB:swissprot]
>gp:[GI:g154438] [LN:STYVB12AA] [AC:L12006] [PN:cobalamin synthase] [GN:cobS]
[OR:Salmonella typhimurium] [SR:Salmonella typhimurium (strain LT2) DNA]
[DB:genpept-bct1] [DE:Salmonella typhimurium vitamin B12/cobalamin biosynthetic
(cob)operon 5' end including: (cbiA, cbiB, cbiC, cbiD, cbiE, cbiT, cbiF,cbiG,
cbiH, cbiJ, cbiK, cbiL, cbiM, cbiN, cbiQ, cbiO, cbiP, cobU,cobS, cobT) genes and
regulatory protein (PocR).] [NT:putative] [LE:15946] [RE:16689] [DI:direct]

| ORF Name | NT ID | AA ID | NT/LN | AA/LN | Score | P-value |
|---|---|---|---|---|---|---|
| 6750305_c1_1142 | 1209 | 8380 | 1407 | 468 | 2379 | 6.6e-247 |

Description gp:[GI:g2905646] [LN:AF045245] [AC:AF045245:U97126] [PN:D-arabinitol dehydrogenase] [GN:dalD] [OR:Klebsiella pneumoniae] [DB:genpept-bct2] [DE:Klebsiella pneumoniae D-arabinitol transporter (dalT), D-arabinitolkinase (dalK), D-arabinitol dehydrogenase (dalD), and repressor(dalR) genes, complete cds.] [LE:3242] [RE:4609] [DI:complement]

| ORF Name | NT ID | AA ID | NT/LN | AA/LN | Score | P-value |
|---|---|---|---|---|---|---|
| 7037500_f2_555 | 1210 | 8381 | 1644 | 547 | 2105 | 7.2e-218 |

Description sp:[LN:YEJF_ECOLI] [AC:P33916] [GN:YEJF] [OR:Escherichia coli] [DE:HYPOTHETICAL ABC TRANSPORTER ATP-BINDING PROTEIN YEJF] [SP:P33916] [DB:swissprot] >sp:[LN:C64987] [AC:C64987] [PN:probable oligopeptide transport protein yejF] [GN:yejF] [CL:unassigned ATP-binding cassette proteins:ATP-binding cassette homology] [OR:Escherichia coli] [DB:pir2] >gp:[GI:g405909] [LN:ECOHU49] [AC:U00008] [PN:yejF] [GN:probable transport operon; yejA-yejB/C-yejE-yejF.] [OR:Escherichia coli] [SR:Escherichia coli K12 BHB2600] [DB:genpept-bct1] [DE:centisome 49 region of E.coli K12 BHB2600.] [NT:ABC-type ATP-dependent transport protein, perhaps] [LE:3353] [RE:4942] [DI:direct] >gp:[GI:g1788506] [LN:AE000307] [AC:AE000307:U00096] [PN:putative ATP-binding component of a transport] [GN:yejF] [FN:putative transport; Not classified] [OR:Escherichia coli] [DB:genpept-bct2] [DE:Escherichia coli K-12 MG1655 section 197 of 400 of the completegenome.] [NT:o529; 100 pct identical to YEJF_ECOLI SW: P33916] [LE:8560] [RE:10149] [DI:direct]

| ORF Name | NT ID | AA ID | NT/LN | AA/LN | Score | P-value |
|---|---|---|---|---|---|---|
| 7079158_c1_1118 | 1211 | 8382 | 429 | 142 | 142 | 1.0e-08 |

Description sp:[LN:EBN1_EBV] [AC:P03211] [GN:BKRF1] [OR:Epstein-barr virus] [SR:,strain B95-8:Human herpesvirus 4] [DE:EBNA-1 NUCLEAR PROTEIN] [SP:P03211] [DB:swissprot] >sp:[LN:QQBE31] [AC:C43043:A03773:S33021] [PN:probable nuclear antigen] [CL:Epstein-Barr virus nuclear antigen] [OR:human herpesvirus 4:Epstein-Barr virus] [DB:pir1] >gp:[GI:g1334880] [LN:EBV] [AC:V01555:J02070:K01729:K01730:V01554:X00498:X00499:X00784] [OR:Human herpesvirus 4] [SR:Epstein-Barr virus] [DB:genpept-vrl] [DE:Epstein-Barr virus (EBV) genome, strain B95-8.] [NT:BKRF1 encodes EBNA-1 protein, latent cycle gene.] [SP:P03211] [LE:107950] [RE:109875] [DI:direct]

| ORF Name | NT ID | AA ID | $\frac{NT}{LN}$ | $\frac{AA}{LN}$ | Score | P-value |
|---|---|---|---|---|---|---|
| 7120258_c2_1412 | 1212 | 8383 | 1140 | 379 | 1738 | 5.6e-179 |

Description sp:[LN:H64976] [AC:H64976] [PN:hypothetical protein b2097] [OR:Escherichia coli]
[DB:pir2] >gp:[GI:g1788414] [LN:AE000299] [AC:AE000299:U00096] [PN:orf,
hypothetical protein] [GN:b2097] [FN:orf; Unknown] [OR:Escherichia coli]
[DB:genpept-bct2] [DE:Escherichia coli K-12 MG1655 section 189 of 400 of the
completegenome.] [NT:f374; This 374 aa ORF is 30 pct identical (9 gaps)] [LE:181]
[RE:1305] [DI:complement]

| ORF Name | NT ID | AA ID | $\frac{NT}{LN}$ | $\frac{AA}{LN}$ | Score | P-value |
|---|---|---|---|---|---|---|
| 7142167_f1_266 | 1213 | 8384 | 801 | 266 | 1150 | 1.1e-116 |

Description sp:[LN:UBIG_ECOLI] [AC:P17993:P76924] [GN:UBIG:PUFX] [OR:Escherichia coli]
[EC:2.1.1.64] [DE:METHYLTRANSFERASE)] [SP:P17993:P76924] [DB:swissprot]
>sp:[LN:A47682] [AC:A47682:S03757:F64993] [PN:3-demethylubiquinone-9
3-O-methyltransferase,:2-octaprenyl-3-methyl-5-hydroxy-6-methoxy-1,
4-benzoquinone methyltransferase:ubiG protein] [GN:ubiG]
[CL:3-demethylubiquinone-9 3-O-methyltransferase:bioC homology] [OR:Escherichia
coli] [EC:2.1.1.64] [DB:pir1] >gp:[GI:d1016777:g1799576] [LN:D90854]
[AC:D90854:AB001340] [PN:2-octaprenyl-3-methyl-5-hydroxy-6-methoxy-1,]
[OR:Escherichia coli] [SR:Escherichia coli (strain:K12) DNA, clone_lib:Kohara
lambda minise] [DB:genpept-bct1] [DE:E.coli genomic DNA, Kohara clone
376(50.2-50.6 min.).] [NT:similar to [PIR Accession Number A47682]] [LE:12808]
[RE:13530] [DI:direct] >gp:[GI:g41638] [LN:ECGYRAAM] [AC:Y00544] [PN:PufX
protein] [GN:pufX] [OR:Escherichia coli] [DB:genpept-bct1] [DE:Escherichia coli
gyrA, pufX & pufy' genes.] [SP:P17993] [LE:345] [RE:1067] [DI:complement]
>gp:[GI:g148104] [LN:ECOUBIG] [AC:M87509] [PN:ubiquinone synthesis-related
protein] [GN:ubiG] [OR:Escherichia coli] [SR:Escherichia coli (strain K-12) DNA]
[DB:genpept-bct1] [DE:Escherichia coli
S-adenosyl-L-methionine:2-octaprenyl-3-methyl-5-hydroxy-6-methoxy-1
,4-benzoquinone (ubiG)gene, complete cds.] [LE:155] [RE:877] [DI:direct]
>gp:[GI:g1788564] [LN:AE000313] [AC:AE000313:U00096] [PN:3-demethylubiquinone-9
3-methyltransferase and] [GN:ubiG] [FN:enzyme; Biosynthesis of cofactors,
carriers;] [OR:Escherichia coli] [DB:genpept-bct2] [EC:2.1.1.64] [DE:Escherichia
coli K-12 MG1655 section 203 of 400 of the completegenome.] [NT:o240; 100 pct
identical to UBIG_ECOLI SW: P17993] [LE:104] [RE:826] [DI:direct]

| ORF Name | NT ID | AA ID | $\frac{NT}{LN}$ | $\frac{AA}{LN}$ | Score | P-value |
|---|---|---|---|---|---|---|
| 7145841_c2_1371 | 1214 | 8385 | 189 | 62 | 286 | 4.1e-25 |

Description gp:[GI:g1432152] [LN:KOU61727] [AC:U61727] [PN:PTS antiterminator] [GN:casR]
[OR:Klebsiella oxytoca] [DB:genpept-bct1] [DE:Klebsiella oxytoca PTS
antiterminator (casR) gene, partial cds,cellobiose-specific PTS permease (casA)
and phospho-cellobiase(casB) genes, complete cds.] [NT:regulatory protein]
[LE:<1] [RE:291] [DI:direct]

| ORF_Name | NT_ID | AA_ID | NT/LN | AA/LN | Score | P-value |
|---|---|---|---|---|---|---|
| 7161628_c3_1617 | 1215 | 8386 | 1278 | 425 | | |

Description

NO-HIT

| ORF_Name | NT_ID | AA_ID | NT/LN | AA/LN | Score | P-value |
|---|---|---|---|---|---|---|
| 7225308_f2_434 | 1216 | 8387 | 978 | 325 | 1154 | 4.3e-117 |

Description sp:[LN:YEGS_ECOLI] [AC:P76407:O08008:O08011] [GN:YEGS] [OR:Escherichia coli]
[DE:HYPOTHETICAL 32.0 KD PROTEIN IN OGRK-GATR INTERGENIC REGION]
[SP:P76407:O08008:O08011] [DB:swissprot] >sp:[LN:E64975] [AC:E64975]
[PN:hypothetical protein b2086] [OR:Escherichia coli] [DB:pir2]
>gp:[GI:d1016663:g1736792] [LN:D90846] [AC:D90846:AB001340] [PN:BmrU protein.]
[OR:Escherichia coli] [SR:Escherichia coli (strain:K12) DNA, clone_lib:Kohara
lambda minise] [DB:genpept-bct1] [DE:E.coli genomic DNA, Kohara clone
357(46.5-46.8 min.).] [NT:ORF_ID:o357#9; similar to [SwissProt Accession]
[LE:11464] [RE:12363] [DI:direct] >gp:[GI:d1016674:g1736804] [LN:D90847]
[AC:D90847:AB001340] [PN:BmrU protein.] [OR:Escherichia coli] [SR:Escherichia
coli (strain:K12) DNA, clone_lib:Kohara lambda minise] [DB:genpept-bct1]
[DE:E.coli genomic DNA, Kohara clone #358(46.6-46.9 min.).] [NT:ORF_ID:o357#9;
similar to [SwissProt Accession] [LE:6109] [RE:7008] [DI:direct]
>gp:[GI:g1788402] [LN:AE000298] [AC:AE000298:U00096] [PN:orf, hypothetical
protein] [GN:b2086] [FN:orf; Unknown] [OR:Escherichia coli] [DB:genpept-bct2]
[DE:Escherichia coli K-12 MG1655 section 188 of 400 of the completegenome.]
[NT:o299; This 299 aa ORF is 29 pct identical (17 gaps)] [LE:3668] [RE:4567]
[DI:direct]

| ORF_Name | NT_ID | AA_ID | NT/LN | AA/LN | Score | P-value |
|---|---|---|---|---|---|---|
| 7304700_f1_90 | 1217 | 8388 | 1944 | 647 | 294 | 1.1e-22 |

Description gp:[GI:g1401270] [LN:FDU59741] [AC:U59741] [PN:RcaE] [GN:rcaE] [FN:putative
regulation of complementary chromatic] [OR:Fremyella diplosiphon]
[DB:genpept-bct1] [DE:Fremyella diplosiphon putative chromatic adaptation sensor
receptor(rcaE) gene, complete cds.] [NT:histidine kinase/phytochrome/ethylene
receptor] [LE:1] [RE:1968] [DI:direct]

| ORF_Name | NT_ID | AA_ID | NT/LN | AA/LN | Score | P-value |
|---|---|---|---|---|---|---|
| 85882_c1_1190 | 1218 | 8389 | 1122 | 373 | | |

Description

NO-HIT

| ORF_Name | NT ID | AA ID | NT LN | AA LN | Score | P-value |
|---|---|---|---|---|---|---|
| 892200_c2_1525 | 1219 | 8390 | 990 | 329 | 354 | 2.6e-32 |

Description sp:[LN:S77111] [AC:S77111] [PN:transcription regulator slr1871:protein slr1871:protein slr1871] [CL:conserved hypothetical protein HI1364] [OR:Synechocystis sp.] [SR:PCC 6803, , PCC 6803] [SR:PCC 6803, ] [DB:pir2] >gp:[GI:d1018402:g1652750] [LN:D90908] [AC:D90908:AB001339] [PN:transcriptional regulator] [OR:Synechocystis sp.] [SR:Synechocystis sp. (strain:PCC6803) DNA] [DB:genpept-bct1] [DE:Synechocystis sp. PCC6803 complete genome, 10/27, 1188886-1311234.] [NT:ORF_ID:slr1871] [LE:27396] [RE:28283] [DI:direct]

| ORF_Name | NT ID | AA ID | NT LN | AA LN | Score | P-value |
|---|---|---|---|---|---|---|
| 917502_f2_442 | 1220 | 8391 | 204 | 67 | | |

Description

NO-HIT

| ORF_Name | NT ID | AA ID | NT LN | AA LN | Score | P-value |
|---|---|---|---|---|---|---|
| 959761_c1_1186 | 1221 | 8392 | 945 | 314 | 1507 | 1.7e-154 |

Description sp:[LN:GALF_KLEPN] [AC:Q48447] [GN:GALF] [OR:Klebsiella pneumoniae] [EC:2.7.7.9] [DE:URIDYLYLTRANSFERASE) (URIDINE DIPHOSPHOGLUCOSE PYROPHOSPHORYLASE)] [SP:Q48447] [DB:swissprot] >gp:[GI:d1005305:g747657] [LN:KPNCPS] [AC:D21242] [PN:ORF1] [OR:Klebsiella pneumoniae] [SR:Klebsiella pneumoniae (strain:Chedid) DNA] [DB:genpept-bct1] [DE:Klebsiella pneumoniae cps gene cluster for ORFs.] [LE:2273] [RE:3169] [DI:direct]

| ORF_Name | NT ID | AA ID | NT LN | AA LN | Score | P-value |
|---|---|---|---|---|---|---|
| 9769512_f1_20 | 1222 | 8393 | 1164 | 387 | 486 | 2.6e-46 |

Description sp:[LN:SAHH_METJA] [AC:Q58783] [GN:AHCY:MJ1388] [OR:Methanococcus jannaschii] [EC:3.3.1.1] [DE:HYDROLASE) (ADOHCYASE)] [SP:Q58783] [DB:swissprot] >sp:[LN:C64473] [AC:C64473] [PN:adenosylhomocysteinase,:S-adenosyl-L-homocysteine hydrolase] [CL:adenosylhomocysteinase] [OR:Methanococcus jannaschii] [EC:3.3.1.1] [DB:pir1] [MP:FOR1335810-1337057] >gp:[GI:g1592034] [LN:U67578] [AC:U67578:L77117] [PN:adenosylhomocysteinase (ahcY)] [GN:MJ1388] [OR:Methanococcus jannaschii] [DB:genpept-bct2] [DE:Methanococcus jannaschii section 120 of 150 of the complete genome.] [NT:similar to PID:927551 SP:P50252 percent identity:] [LE:7408] [RE:8655] [DI:direct]

| ORF Name | NT ID | AA ID | NT LN | AA LN | Score | P-value |
|---|---|---|---|---|---|---|
| 978175_f3_837 | 1223 | 8394 | 270 | 89 | | |

Description

NO-HIT

| ORF Name | NT ID | AA ID | NT LN | AA LN | Score | P-value |
|---|---|---|---|---|---|---|
| 986406_f2_558 | 1224 | 8395 | 1770 | 589 | 2846 | 2.2e-296 |

Description sp:[LN:YEJH_ECOLI] [AC:P33919:P36926:P36927:P76449] [GN:YEJH] [OR:Escherichia coli] [DE:HYPOTHETICAL 66.4 KD PROTEIN IN RSUA-RPLY INTERGENIC REGION] [SP:P33919:P36926:P36927:P76449] [DB:swissprot] >sp:[LN:G64987] [AC:G64987] [PN:yejH protein] [GN:yejH] [CL:unassigned DEAD/H box helicases:DEAD/H box helicase homology] [OR:Escherichia coli] [DB:pir2] >gp:[GI:g1788511] [LN:AE000308] [AC:AE000308:U00096] [PN:putative ATP-dependent helicase] [GN:yejH] [FN:putative enzyme; Not classified] [OR:Escherichia coli] [DB:genpept-bct2] [DE:Escherichia coli K-12 MG1655 section 198 of 400 of the completegenome.] [NT:o586; residues 1-396 are 100 pct identical to 396] [LE:2259] [RE:4019] [DI:direct]

| ORF Name | NT ID | AA ID | NT LN | AA LN | Score | P-value |
|---|---|---|---|---|---|---|
| 9932650_c1_994 | 1225 | 8396 | 813 | 270 | 1120 | 1.7e-113 |

Description sp:[LN:YFAX_ECOLI] [AC:P77732] [GN:YFAX] [OR:Escherichia coli] [DE:HYPOTHETICAL TRANSCRIPTIONAL REGULATOR IN GLPC-AIS INTEREGENIC REGION] [SP:P77732] [DB:swissprot] >sp:[LN:F64995] [AC:F64995] [PN:hypothetical protein b2248] [CL:acetate operon repressor] [OR:Escherichia coli] [DB:pir2] >gp:[GI:d1016800:g1799601] [LN:D90856] [AC:D90856:AB001340] [GN:yjhI] [OR:Escherichia coli] [SR:Escherichia coli (strain:K12) DNA, clone_lib:Kohara lambda minise] [DB:genpept-bct1] [DE:E.coli genomic DNA, Kohara clone #379(50.8-51.2 min.).] [NT:similar to [SwissProt Accession Number P39360]] [LE:4822] [RE:5604] [DI:complement] >gp:[GI:g1788581] [LN:AE000314] [AC:AE000314:U00096] [PN:putative regulator] [GN:b2248] [FN:putative regulator; Not classified] [OR:Escherichia coli] [DB:genpept-bct2] [DE:Escherichia coli K-12 MG1655 section 204 of 400 of the completegenome.] [NT:f260; residues 71-246 are 30 pct identical to] [LE:11880] [RE:12662] [DI:complement]

| ORF Name | NT ID | AA ID | NT LN | AA LN | Score | P-value |
|---|---|---|---|---|---|---|
| 10564811_c3_1263 | 1226 | 8397 | 726 | 241 | 361 | 4.6e-33 |

Description sp:[LN:YWBG_BACSU] [AC:P39590] [GN:YWBG:IPA-22R] [OR:Bacillus subtilis]
[DE:HYPOTHETICAL 25.8 KD PROTEIN IN EPR-GALK INTERGENIC REGION] [SP:P39590]
[DB:swissprot] >sp:[LN:S39677] [AC:S39677:E70051] [PN:conserved hypothetical
protein ywbG] [GN:ywbG] [CL:yohK protein] [OR:Bacillus subtilis] [DB:pir1]
>gp:[GI:g580868] [LN:BSGENR] [AC:X73124] [GN:ipa-22r] [OR:Bacillus subtilis]
[DB:genpept-bct1] [DE:B.subtilis genomic region (325 to 333).] [SP:P39590]
[LE:23261] [RE:23986] [DI:complement] >gp:[GI:e1186332:g2636368] [LN:BSUB0020]
[AC:Z99123:AL009126] [GN:ywbG] [FN:unknown] [OR:Bacillus subtilis]
[DB:genpept-bct1] [DE:Bacillus subtilis complete genome (section 20 of 21): from
3798401to 4010550.] [NT:alternate gene name: ipa-22r; similar to] [SP:P39590]
[LE:133973] [RE:134698] [DI:direct]

| ORF Name | NT ID | AA ID | NT LN | AA LN | Score | P-value |
|---|---|---|---|---|---|---|
| 10626301_f3_505 | 1227 | 8398 | 1131 | 376 | 1616 | 4.7e-166 |

Description sp:[LN:YJEQ_ECOLI] [AC:P39286] [GN:YJEQ] [OR:Escherichia coli] [DE:HYPOTHETICAL
39.2 KD PROTEIN IN PSD-AMIB INTERGENIC REGION] [SP:P39286] [DB:swissprot]

| ORF Name | NT ID | AA ID | NT LN | AA LN | Score | P-value |
|---|---|---|---|---|---|---|
| 10645631_f1_58 | 1228 | 8399 | 1905 | 634 | 1767 | 1.6e-240 |

Description sp:[LN:S56364] [AC:S56364:I41028:I41037:S42064:F65223:S57220:S47295] [PN:inner
membrane copper tolerance protein cycZ:thiol:disulfide interchange protein dsbd]
[GN:dsbD:cycZ:CutA2:dipZ] [OR:Escherichia coli] [DB:pir2] >gp:[GI:g536980]
[LN:ECOUW93] [AC:U14003] [GN:cycZ] [FN:involved in biogenesis of C-type
cytochromes] [OR:Escherichia coli] [DB:genpept-bct1] [DE:Escherichia coli K-12
chromosomal region from 92.8 to 00.1 minutes.] [LE:54173] [RE:55870]
[DI:complement] >gp:[GI:g1790578] [LN:AE000486] [AC:AE000486:U00096]
[PN:thiol:disulfide interchange protein; copper] [GN:dsbD] [FN:putative enzyme;
Central intermediary] [OR:Escherichia coli] [DB:genpept-bct2] [DE:Escherichia
coli K-12 MG1655 section 376 of 400 of the completegenome.] [NT:f565; 100 pct
identical to 488 amino acids] [LE:4718] [RE:6415] [DI:complement]

| ORF Name | NT ID | AA ID | NT LN | AA LN | Score | P-value |
|---|---|---|---|---|---|---|
| 10802328_f2_289 | 1229 | 8400 | 2136 | 711 | 2114 | 8.0e-219 |

Description gp:[GI:g1197460] [LN:ECU47048] [AC:U47048] [PN:MtfB] [GN:mtfB] [FN:mirocin 24
transport (ABC transporter)] [OR:Escherichia coli] [DB:genpept-bct1]
[DE:Escherichia coli microcin 24 region, DNA binding protein (mdbA),immunity
protein (mtfI), microcin 24 (mtfS), and microcin transportprotein (mtfA, mtfB)
genes, complete cds.] [LE:3107] [RE:5230] [DI:direct]

| ORF Name | NT ID | AA ID | NT LN | AA LN | Score | P-value |
|---|---|---|---|---|---|---|
| 10939405_f2_281 | 1230 | 8401 | 396 | 131 | 569 | 4.2e-55 |

Description sp:[LN:FRDD_ECOLI] [AC:P03806] [GN:FRDD] [OR:Escherichia coli] [DE:FUMARATE
REDUCTASE 13 KD HYDROPHOBIC PROTEIN] [SP:P03806] [DB:swissprot] >sp:[LN:WMEC13]
[AC:A04431;S56379;B21197;I41130;E65225] [PN:fumarate reductase, 13K membrane
anchor protein] [GN:frdD] [CL:fumarate reductase 13K protein] [OR:Escherichia
coli] [EC:1.3.99.1] [DB:pir1] [MP:94 min] >gp:[GI:g41484] [LN:ECFRDB] [AC:V00277]
[OR:Escherichia coli] [DB:genpept-bct1] [DE:Fragments of the E. coli genes frdB
and ampC. frd is the gene forfumarate reductase and ampC codes for a
beta-lactamase (E.coliK-12). Two unknown reading frames are also found.]
[NT:unknown gene] [SP:P03806] [LE:448] [RE:807] [DI:direct] >gp:[GI:g145266]
[LN:ECOAMPCFR] [AC:J01611;J01583] [OR:Escherichia coli] [SR:Escherichia coli
(strain K-12) DNA] [DB:genpept-bct1] [DE:E.coli frd operon, fumarate reductase
(flavoprotein subunit frdAand iron/sulfur subunit frdB), and beta-lactamase
(ampC) genes,complete cds.] [NT:g13 protein] [LE:3734] [RE:4093] [DI:direct]
>gp:[GI:g536995] [LN:ECOUW93] [AC:U14003] [PN:fumarate reductase, membrane anchor
polypeptide] [GN:frdD] [OR:Escherichia coli] [DB:genpept-bct1] [EC:1.3.99.1]
[DE:Escherichia coli K-12 chromosomal region from 92.8 to 00.1 minutes.] [NT:CG
Site No. 739] [LE:69835] [RE:70194] [DI:complement] >gp:[GI:g1790594]
[LN:AE000487] [AC:AE000487:U00096] [PN:fumarate reductase, anaerobic, membrane
anchor] [GN:frdD] [FN:enzyme; Energy metabolism, carbon: Anaerobic]
[OR:Escherichia coli] [DB:genpept-bct2] [EC:1.3.99.1] [DE:Escherichia coli K-12
MG1655 section 377 of 400 of the completegenome.] [NT:f119; 100 pct identical to
FRDD_ECOLI SW: P03806;] [LE:10497] [RE:10856] [DI:complement]

| ORF Name | NT ID | AA ID | NT LN | AA LN | Score | P-value |
|---|---|---|---|---|---|---|
| 11073293_c1_912 | 1231 | 8402 | 1548 | 515 | 2064 | 1.6e-213 |

Description sp:[LN:YJEM_ECOLI] [AC:P39282] [GN:YJEM] [OR:Escherichia coli] [DE:HYPOTHETICAL
56.3 KD PROTEIN IN GENX-PSD INTERGENIC REGION (O514)] [SP:P39282] [DB:swissprot]
>sp:[LN:S56384] [AC:S56384;B65226] [PN:hypothetical 56.3K protein (genX-psd
intergenic region):hypothetical protein o514] [GN:yjeM] [OR:Escherichia coli]
[DB:pir2] >gp:[GI:g537000] [LN:ECOUW93] [AC:U14003] [OR:Escherichia coli]
[DB:genpept-bct1] [DE:Escherichia coli K-12 chromosomal region from 92.8 to 00.1
minutes.] [NT:ORF_o514] [LE:74625] [RE:76169] [DI:direct] >gp:[GI:g1790600]
[LN:AE000488] [AC:AE000488:U00096] [PN:putative transport] [GN:yjeM] [FN:putative
transport; Not classified] [OR:Escherichia coli] [DB:genpept-bct2]
[DE:Escherichia coli K-12 MG1655 section 378 of 400 of the completegenome.]
[NT:o514; 100 pct identical amino acid sequence and] [LE:1456] [RE:3000]
[DI:direct]

| ORF Name | NT ID | AA ID | NT LN | AA LN | Score | P-value |
|---|---|---|---|---|---|---|
| 11756955_c2_992 | 1232 | 8403 | 567 | 188 | 599 | 2.8e-58 |

Description sp:[LN:YJBQ_ECOLI] [AC:P32698] [GN:YJBQ] [OR:Escherichia coli] [DE:HYPOTHETICAL 15.7 KD PROTEIN IN APHA-UVRA INTERGENIC REGION (O138)] [SP:P32698] [DB:swissprot] >sp:[LN:G65213] [AC:G65213] [PN:hypothetical 15.7 kD protein in tyrB-uvrA intergenic region] [GN:yjbQ] [CL:hypothetical protein MJ1081] [OR:Escherichia coli] [DB:pir1] >gp:[GI:g1790491] [LN:AE000479] [AC:AE000479:U00096] [PN:orf, hypothetical protein] [GN:yjbQ] [FN:orf; Unknown] [OR:Escherichia coli] [DB:genpept-bct2] [DE:Escherichia coli K-12 MG1655 section 369 of 400 of the completegenome.] [NT:o138; 100 pct identical amino acid sequence and] [LE:1217] [RE:1633] [DI:direct] >gp:[GI:g396391] [LN:ECOUW89] [AC:U00006] [OR:Escherichia coli] [SR:Escherichia coli (sub_strain MG1655, strain K-12) (library: lambda] [DB:genpept-bct2] [DE:E. coli chromosomal region from 89.2 to 92.8 minutes.] [LE:135478] [RE:135894] [DI:direct]

| ORF Name | NT ID | AA ID | NT LN | AA LN | Score | P-value |
|---|---|---|---|---|---|---|
| 11766458_c3_1253 | 1233 | 8404 | 714 | 237 | 292 | 9.5e-26 |

Description sp:[LN:YIV8_YEAST] [AC:P40582] [GN:YIR038C] [OR:Saccharomyces cerevisiae] [SR:,Baker's yeast] [DE:HYPOTHETICAL 26.8 KD PROTEIN IN HYR1 3'REGION] [SP:P40582] [DB:swissprot] >sp:[LN:S48500] [AC:S48500] [PN:hypothetical protein YIR038c] [OR:Saccharomyces cerevisiae] [DB:pir2] [MP:9R] >gp:[GI:g557844] [LN:SC9168] [AC:Z38061:Z47047] [OR:Saccharomyces cerevisiae] [SR:baker's yeast] [DB:genpept-pln1] [DE:S.cerevisiae chromosome IX cosmid 9168.] [NT:orf, len: 234, CAI: 0.26] [SP:P40582] [LE:35660] [RE:36364] [DI:complement]

| ORF Name | NT ID | AA ID | NT LN | AA LN | Score | P-value |
|---|---|---|---|---|---|---|
| 11813953_c1_759 | 1234 | 8405 | 645 | 214 | 769 | 2.7e-76 |

Description sp:[LN:S25660] [AC:S25660:A42956:S24360:I70800:F65211] [PN:4-hydroxybenzoate synthetase:chorismate lyase:chorismate pyruvate-lyase] [GN:ubiC] [OR:Escherichia coli] [DB:pir2] >gp:[GI:g43234] [LN:ECUBIAC] [AC:X57434] [PN:4-hydroxybenzoate synthetase] [GN:ubiC] [OR:Escherichia coli] [DB:genpept-bct1] [DE:E.coli ubiC and ubiA genes for chorismate lyase and4-hydroxybenzoate octaprenyltransferase.] [SP:P26602] [LE:291] [RE:899] [DI:direct] >gp:[GI:g1790472] [LN:AE000477] [AC:AE000477:U00096] [PN:chorismate lyase] [GN:ubiC] [FN:enzyme; Biosynthesis of cofactors, carriers:] [OR:Escherichia coli] [DB:genpept-bct2] [DE:Escherichia coli K-12 MG1655 section 367 of 400 of the completegenome.] [NT:o202a; CG Site No. 48] [LE:4490] [RE:5098] [DI:direct] >gp:[GI:g396374] [LN:ECOUW89] [AC:U00006] [PN:chorismate lyase] [GN:ubiC] [OR:Escherichia coli] [SR:Escherichia coli (sub_strain MG1655, strain K-12) (library: lambda] [DB:genpept-bct2] [DE:E. coli chromosomal region from 89.2 to 92.8 minutes.] [NT:CG Site No. 48] [LE:117637] [RE:118245] [DI:direct]

| ORF Name | NT ID | AA ID | NT LN | AA LN | Score | P-value |
|---|---|---|---|---|---|---|
| 11908558_f1_185 | 1235 | 8406 | 306 | 101 | 111 | 8.2e-06 |

Description gp:[GI:g4884836] [LN:AF131877] [AC:AF131877] [PN:NapG oxidoreductase] [GN:napG]
[OR:Streptomyces collinus] [DB:genpept-bct2] [DE:Streptomyces collinus putative
naphthomycin AHBA biosynthetic genecluster, complete sequence.] [LE:4666]
[RE:5691] [DI:direct]

| ORF Name | NT ID | AA ID | NT LN | AA LN | Score | P-value |
|---|---|---|---|---|---|---|
| 12150342_f2_453 | 1236 | 8407 | 1557 | 518 | 2565 | 1.3e-266 |

Description sp:[LN:MALF_ENTAE] [AC:P18812] [GN:MALF] [OR:Enterobacter aerogenes]
[SR:,Aerobacter aerogenes] [DE:MALTOSE TRANSPORT SYSTEM PERMEASE PROTEIN MALF]
[SP:P18812] [DB:swissprot] >sp:[LN:S05332] [AC:S05332] [PN:inner membrane protein
malF] [GN:malF] [CL:inner membrane protein malF] [OR:Enterobacter aerogenes]
[DB:pir2]

| ORF Name | NT ID | AA ID | NT LN | AA LN | Score | P-value |
|---|---|---|---|---|---|---|
| 12283343_c3_1286 | 1237 | 8408 | 396 | 131 | 232 | 2.2e-19 |

Description sp:[LN:D35720] [AC:D35720] [PN:hypothetical 13.7K protein:hypothetical protein
126] [CL:Escherichia coli hypothetical 13.7K protein] [OR:Escherichia coli]
[DB:pir2] >gp:[GI:g455184] [LN:ECOPHNAQ] [AC:J05260] [OR:Escherichia coli]
[SR:E.coli (strain B) DNA] [DB:genpept-bct1] [DE:E.coli psiD locus containing
alkylphosphonate uptake (phn) genes Athrough Q, complete cds.] [NT:ORF126]
[LE:14380] [RE:14760] [DI:complement]

| ORF Name | NT ID | AA ID | NT LN | AA LN | Score | P-value |
|---|---|---|---|---|---|---|
| 12286691_f1_17 | 1238 | 8409 | 765 | 254 | 601 | 1.7e-58 |

Description sp:[LN:ARTJ_ECOLI] [AC:P30860:P77547] [GN:ARTJ] [OR:Escherichia coli]
[DE:ARGININE-BINDING PERIPLASMIC PROTEIN 2 PRECURSOR] [SP:P30860:P77547]
[DB:swissprot] >sp:[LN:D64824] [AC:D64824:I40995:S70066:S31731:S52334:S54112]
[PN:arginine-binding periplasmic protein 2 precursor] [GN:artJ]
[CL:lysine-arginine-ornithine-binding protein] [OR:Escherichia coli] [DB:pir2]
>gp:[GI:d1036560:g1651393] [LN:D90724] [AC:D90724:AB001340] [PN:Arginine-binding
protein ArtJ.] [GN:artJ] [OR:Escherichia coli] [SR:Escherichia coli(strain:K12)
DNA, clone:Kohara clone #211] [DB:genpept-bct1] [DE:Escherichia coli genomic DNA.
(19.4 - 19.8 min).] [NT:ORF_ID:o211#3; similar to PIR Accession Number] [LE:2123]
[RE:2854] [DI:complement] >gp:[GI:g1787085] [LN:AE000188] [AC:AE000188:U00096]
[PN:arginine 3rd transport system periplasmic] [GN:artJ] [FN:transport; Transport
of small molecules: Amino] [OR:Escherichia coli] [DB:genpept-bct2]
[DE:Escherichia coli K-12 MG1655 section 78 of 400 of the completegenome.]
[NT:f243; 99 pct identical to ARTJ_ECOLI SW: P30860] [LE:130] [RE:861]
[DI:complement]

| ORF Name | NT ID | AA ID | NT/LN | AA/LN | Score | P-value |
|---|---|---|---|---|---|---|
| 12370207_c3_1334 | 1239 | 8410 | 507 | 168 | 747 | 5.8e-74 |

Description sp:[LN:FXSA_ECOLI] [AC:P37147] [GN:FXSA] [OR:Escherichia coli] [DE:FXSA PROTEIN]
[SP:P37147] [DB:swissprot] >gp:[GI:g1685073] [LN:ECU78484] [AC:U78484] [PN:FxsA]
[GN:fxsA] [FN:integral cytoplasmic membrane protein] [OR:Escherichia coli]
[DB:genpept-bct1] [DE:Escherichia coli integral cytoplasmic membrane protein
(fxsA) gene, complete cds.] [NT:similar to hypothetical protein yjeg, Swiss-Prot]
[LE:243] [RE:719] [DI:direct]

| ORF Name | NT ID | AA ID | NT/LN | AA/LN | Score | P-value |
|---|---|---|---|---|---|---|
| 12551691_f3_635 | 1240 | 8411 | 1029 | 342 | 358 | 9.6e-33 |

Description gp:[GI:e1391764:g4468692] [LN:SCC54] [AC:AL035591] [PN:putative transcriptional
regulator (lacI) [GN:SCC54.16] [OR:Streptomyces coelicolor] [DB:genpept-bct1]
[DE:Streptomyces coelicolor cosmid C54.] [NT:SCC54.16, probable transcriptional
regulator (lacI) [LE:17175] [RE:18281] [DI:direct]

| ORF Name | NT ID | AA ID | NT/LN | AA/LN | Score | P-value |
|---|---|---|---|---|---|---|
| 12593912_f1_183 | 1241 | 8412 | 798 | 265 | 261 | 1.8e-22 |

Description sp:[LN:HOBH_ECOLI] [AC:P36558] [GN:HOBH] [OR:Escherichia coli] [DE:VERY
HYPOTHETICAL HOBH PROTEIN] [SP:P36558] [DB:swissprot]

| ORF Name | NT ID | AA ID | NT/LN | AA/LN | Score | P-value |
|---|---|---|---|---|---|---|
| 12605010_f2_345 | 1242 | 8413 | 207 | 68 | 130 | 1.9e-08 |

Description gp:[GI:g5734705] [LN:F24J5] [AC:AC008075] [PN:F24J5.4] [GN:F24J5.4]
[OR:Arabidopsis thaliana] [SR:thale cress] [DB:genpept-pln2] [DE:Arabidopsis
thaliana chromosome 1 BAC F24J5 sequence, completesequence.] [LE:19258]
[RE:19926] [DI:complement]

| ORF Name | NT ID | AA ID | NT LN | AA LN | Score | P-value |
|---|---|---|---|---|---|---|
| 1273877_I3_602 | 1243 | 8414 | 1698 | 565 | 2560 | 4.4e-266 |

Description sp:[LN:YJCG_ECOLI] [AC:P32705] [GN:YJCG] [OR:Escherichia coli] [DE:HYPOTHETICAL 59.2 KD PROTEIN IN SOXR-ACS INTERGENIC REGION (F549)] [SP:P32705] [DB:swissprot] >sp:[LN:B65215] [AC:B65215] [PN:hypothetical 59.2 kD protein in soxR-acs intergenic region] [GN:yjcG] [CL:proline carrier protein] [OR:Escherichia coli] [DB:pir2] >gp:[GI:g1790503] [LN:AE000480] [AC:AE000480:U00096] [PN:putative transport protein] [GN:yjcG] [FN:putative transport; Not classified] [OR:Escherichia coli] [DB:genpept-bct2] [DE:Escherichia coli K-12 MG1655 section 370 of 400 of the completegenome.] [NT:f549; 100 pct identical to YJCG_ECOLI SW:] [LE:3356] [RE:5005] [DI:complement] >gp:[GI:g396402] [LN:ECOUW89] [AC:U00006] [OR:Escherichia coli] [SR:Escherichia coli (sub_strain MG1655, strain K-12) (library: lambda)] [DB:genpept-bct2] [DE:E. coli chromosomal region from 89.2 to 92.8 minutes.] [NT:similar to Salmonella proline permease; (PutP) 5'] [LE:148493] [RE:150142] [DI:complement]

| ORF Name | NT ID | AA ID | NT LN | AA LN | Score | P-value |
|---|---|---|---|---|---|---|
| 12755062_f2_460 | 1244 | 8415 | 1446 | 481 | | |

Description

NO-HIT

| ORF Name | NT ID | AA ID | NT LN | AA LN | Score | P-value |
|---|---|---|---|---|---|---|
| 12895840_c3_1350 | 1245 | 8416 | 285 | 94 | 216 | 1.1e-17 |

Description sp:[LN:ECNB_ECOLI] [AC:P56549] [GN:ECNB] [OR:Escherichia coli] [DE:ENTERICIDIN B PRECURSOR] [SP:P56549] [DB:swissprot] >gp:[GI:g3132842] [LN:ECU21726] [AC:U21726] [PN:entericidin B precursor] [GN:ecnB] [OR:Escherichia coli] [DB:genpept-bct2] [DE:Escherichia coli lipocalin precursor (blc), SugE (sugE),entericidin B precursor (ecnB), and entericidin A precursor (ecnA)genes, complete cds.] [LE:1082] [RE:1228] [DI:complement]

| ORF Name | NT ID | AA ID | NT LN | AA LN | Score | P-value |
|---|---|---|---|---|---|---|
| 12944687_f1_42 | 1246 | 8417 | 1212 | 403 | 138 | 1.7e-06 |

Description sp:[LN:MRKD_KLEPN] [AC:P21648] [GN:MRKD] [OR:Klebsiella pneumoniae] [DE:FIMBRIA ADHESIN PROTEIN PRECURSOR] [SP:P21648] [DB:swissprot] >sp:[LN:B32801] [AC:B32801:E39142] [PN:fimbrial adhesin precursor, type 3] [OR:Klebsiella pneumoniae] [DB:pir2] >gp:[GI:g149239] [LN:KPNMRKAA] [AC:M55912] [GN:mrkD] [OR:Klebsiella pneumoniae] [SR:K.pneumoniae (strain IA565) DNA] [DB:genpept-bct1] [DE:K.pneumoniae mrk[A-E] genes, complete cds.] [LE:4970] [RE:5935] [DI:direct] >gp:[GI:g511858] [LN:KPNMRKD] [AC:M24536] [PN:fimbrial adhesin] [GN:mrkD] [OR:Klebsiella pneumoniae] [SR:Klebsiella pneumoniae DNA] [DB:genpept-bct1] [DE:Klebsiella pneumoniae type 3 fimbrial adhesin (mrkD) gene, completecds.] [LE:397] [RE:1362] [DI:direct]

| ORF_Name | NT_ID | AA_ID | NT/LN | AA/LN | Score | P-value |
|---|---|---|---|---|---|---|
| 1301885_c2_1044 | 1247 | 8418 | 1419 | 472 | 2021 | 5.7e-209 |

Description sp:[LN:GLTP_ECOLI] [AC:P21345] [GN:GLTP] [OR:Escherichia coli] [DE:PROTEIN)]
[SP:P21345] [DB:swissprot] >sp:[LN:A42384] [AC:A42384:D65216:JV0092]
[PN:glutamate-aspartate carrier protein:proton glutamate symport protein]
[GN:gltP] [CL:C4-dicarboxylate carrier protein] [OR:Escherichia coli] [DB:pir2]
>gp:[GI:g147160] [LN:ECOPG] [AC:M84805] [PN:proton-glutamate] [GN:gltP]
[OR:Escherichia coli] [SR:Escherichia coli (strain K-12) DNA] [DB:genpept-bct1]
[DE:Escerichia coli proton glutamate (gltP) protein, complete cds.] [LE:151]
[RE:1464] [DI:direct] >gp:[GI:g1790514] [LN:AE000481] [AC:AE000481:U00096]
[PN:glutamate-aspartate symport protein] [GN:gltP] [FN:transport; Transport of
small molecules: Amino] [OR:Escherichia coli] [DB:genpept-bct2] [DE:Escherichia
coli K-12 MG1655 section 371 of 400 of the completegenome.] [NT:o437; 100 pct
identical amino acid sequence and] [LE:3039] [RE:4352] [DI:direct]
>gp:[GI:g396412] [LN:ECOUW89] [AC:U00006] [GN:gltP] [FN:glutamate and aspartate
carrier] [OR:Escherichia coli] [SR:Escherichia coli (sub_strain MG1655, strain
K-12) (library: lambda) [DB:genpept-bct2] [DE:E. coli chromosomal region from
89.2 to 92.8 minutes.] [LE:159721] [RE:161034] [DI:direct]

| ORF_Name | NT_ID | AA_ID | NT/LN | AA/LN | Score | P-value |
|---|---|---|---|---|---|---|
| 13159831_f3_524 | 1248 | 8419 | 1371 | 456 | 93 | 0.0011 |

Description gp:[GI:g3064178] [LN:AF036425] [AC:AF036425] [PN:mucin-like protein]
[GN:EMUCe-3113] [OR:Trypanosoma cruzi] [DB:genpept-inv1] [DE:Trypanosoma cruzi
mucin-like protein (EMUCe-3113) mRNA, completecds.] [LE:19] [RE:402] [DI:direct]

| ORF_Name | NT_ID | AA_ID | NT/LN | AA/LN | Score | P-value |
|---|---|---|---|---|---|---|
| 1365937_c1_862 | 1249 | 8420 | 894 | 297 | 427 | 4.7e-40 |

Description gp:[GI:g4959518] [LN:AF130422] [AC:AF130422] [PN:BcfH] [GN:bcfH] [OR:Salmonella
typhimurium] [DB:genpept-bct2] [DE:Salmonella typhimurium bovine colonization
factor operon, completesequence.] [NT:similar to Coxiella burnetii 27kDa outer
membrane] [LE:8120] [RE:8929] [DI:direct]

| ORF Name | NT ID | AA ID | NT/LN | AA/LN | Score | P-value |
|---|---|---|---|---|---|---|
| 13785877_c2_1098 | 1250 | 8421 | 369 | 122 | 127 | 2.9e-08 |

Description sp:[LN:PERC_ECOLI] [AC:P43475] [GN:PERC:BFPW] [OR:Escherichia coli] [DE:PERC
PROTEIN (BFPW PROTEIN)] [SP:P43475] [DB:swissprot] >sp:[LN:I69150] [AC:I69150]
[PN:perC protein] [OR:Escherichia coli] [DB:pir2] >gp:[GI:g6009402] [LN:AB024946]
[AC:AB024946] [PN:BfpW] [GN:bfpW] [FN:transcriptional regulator] [OR:Escherichia
coli] [SR:Escherichia coli (sub_species:enteropathogenic, strain:B171]
[DB:genpept-bct1] [DE:Escherichia coli plasmid pB171 genomic DNA, complete
sequence.] [LE:22068] [RE:22337] [DI:direct] >gp:[GI:g1463019] [LN:ECOBFPT]
[AC:L42638] [PN:bfpW] [FN:positive regulatory protein of bfpA, the gene]
[OR:Escherichia coli] [DB:genpept-bct1] [DE:Escherichia coli bfpT, bfpV, bfpW and
transposase genes, completecds.] [LE:1505] [RE:1774] [DI:direct] >gp:[GI:g695511]
[LN:ECPERABCD] [AC:Z48561] [PN:PerC] [GN:perC] [FN:transcriptional activator]
[OR:Escherichia coli] [DB:genpept-bct1] [DE:E.coli perA, perB, perC and perD
genes.] [NT:third ORF of four ORFs that together increase eaeA] [SP:P43475]
[LE:1367] [RE:1636] [DI:direct]

| ORF Name | NT ID | AA ID | NT/LN | AA/LN | Score | P-value |
|---|---|---|---|---|---|---|
| 13835915_f1_69 | 1251 | 8422 | 2043 | 680 | 2050 | 4.9e-212 |

Description gp:[GI:e1331963:g4106594] [LN:YP102KB] [AC:AL031866] [GN:hmsF] [OR:Yersinia
pestis] [DB:genpept-bct1] [DE:Yersinia pestis 102 kbases unstable region: from 1
to 119443.] [NT:ORF26, len: 673 aa, hmsF, 96,9% identity with hmsF] [LE:31579]
[RE:33600] [DI:complement]

| ORF Name | NT ID | AA ID | NT/LN | AA/LN | Score | P-value |
|---|---|---|---|---|---|---|
| 13964691_f3_573 | 1252 | 8423 | 1191 | 396 | 1673 | 4.3e-172 |

Description gp:[GI:g147209] [LN:ECOPHNAQ] [AC:J05260] [OR:Escherichia coli] [SR:E.coli
(strain B) DNA] [DB:genpept-bct1] [DE:E.coli psiD locus containing
alkylphosphonate uptake (phn) genes Athrough Q, complete cds.] [NT:HisM-like
integral membrane protein (phnM)] [LE:12282] [RE:13418] [DI:direct]

| ORF Name | NT ID | AA ID | NT/LN | AA/LN | Score | P-value |
|---|---|---|---|---|---|---|
| 14144661_c1_845 | 1253 | 8424 | 207 | 68 | 303 | 6.5e-27 |

Description sp:[LN:B35720] [AC:B35720] [PN:hypothetical 28.6K protein:hypothetical protein
269] [OR:Escherichia coli] [DB:pir2] >gp:[GI:g455182] [LN:ECOPHNAQ] [AC:J05260]
[OR:Escherichia coli] [SR:E.coli (strain B) DNA] [DB:genpept-bct1] [DE:E.coli
psiD locus containing alkylphosphonate uptake (phn) genes Athrough Q, complete
cds.] [NT:ORF269] [LE:8489] [RE:9298] [DI:complement]

| ORF Name | NT ID | AA ID | NT/LN | AA/LN | Score | P-value |
|---|---|---|---|---|---|---|
| 14197062_c3_1342 | 1254 | 8425 | 225 | 74 | | |

Description

NO-HIT

| ORF Name | NT ID | AA ID | NT/LN | AA/LN | Score | P-value |
|---|---|---|---|---|---|---|
| 14531281_f3_621 | 1255 | 8426 | 234 | 77 | | |

Description

NO-HIT

| ORF Name | NT ID | AA ID | NT/LN | AA/LN | Score | P-value |
|---|---|---|---|---|---|---|
| 1453205_c3_1333 | 1256 | 8427 | 306 | 101 | 125 | 1.9e-07 |

Description sp:[LN:E72566] [AC:E72566] [PN:hypothetical protein APE1815] [GN:APE1815]
[OR:Aeropyrum pernix] [DB:pir2] >gp:[GI:d1044604:g5105505] [LN:AP000062]
[AC:AP000062] [PN:301aa long hypothetical protein] [GN:APE1815] [OR:Aeropyrum
pernix] [SR:Aeropyrum pernix (strain:K1) DNA] [DB:genpept-bct1] [DE:Aeropyrum
pernix genomic DNA, section 5/7.] [NT:motif=prokaryotic membrane lipoprotein
lipid] [LE:159132] [RE:160037] [DI:complement]

| ORF Name | NT ID | AA ID | NT/LN | AA/LN | Score | P-value |
|---|---|---|---|---|---|---|
| 1455418_c1_839 | 1257 | 8428 | 645 | 214 | 211 | 3.6e-17 |

Description sp:[LN:C35720] [AC:C35720] [PN:hypothetical 12.4K protein:hypothetical protein
114] [CL:Escherichia coli hypothetical 12.4K protein] [OR:Escherichia coli]
[DB:pir2] >gp:[GI:g455183] [LN:ECOPHNAQ] [AC:J05260] [OR:Escherichia coli]
[SR:E.coli (strain B) DNA] [DB:genpept-bct1] [DE:E.coli psiD locus containing
alkylphosphonate uptake (phn) genes Athrough Q, complete cds.] [NT:ORF114]
[LE:11920] [RE:12264] [DI:complement]

| ORF Name | NT ID | AA ID | NT/LN | AA/LN | Score | P-value |
|---|---|---|---|---|---|---|
| 14587755_c2_1053 | 1258 | 8429 | 762 | 253 | 193 | 2.9e-15 |

Description gp:[GI:g5738282] [LN:AF034855] [AC:AF034855] [OR:Agrobacterium tumefaciens]
[DB:genpept-bct2] [DE:Agrobacterium tumefaciens plasmid pTiA6NC hypothetical
proteingenes, complete cds.] [NT:ORF21] [LE:22769] [RE:>23146] [DI:complement]

| ORF_Name | NT_ID | AA_ID | NT/LN | AA/LN | Score | P-value |
|---|---|---|---|---|---|---|
| 14589668_f1_112 | 1259 | 8430 | 1011 | 336 | 663 | 4.6e-65 |

Description sp:[LN:B69690] [AC:B69690:I40466:S42714] [PN:ribose ABC transporter (permease) rbsC] [GN:rbsC] [CL:l-arabinose transport system permease araH] [OR:Bacillus subtilis] [DB:pir2] >gp:[GI:e1184501:g2636120] [LN:BSUB0019] [AC:Z99122:AL009126] [PN:ribose ABC transporter (permease)] [GN:rbsC] [FN:ribose transport] [OR:Bacillus subtilis] [DB:genpept-bct1] [DE:Bacillus subtilis complete genome (section 19 of 21): from 3597091to 3809700.] [LE:107132] [RE:108100] [DI:direct] >gp:[GI:e308082:g1894758] [LN:BSZ92953] [AC:Z92953] [PN:membrane transport protein] [GN:rbsC] [OR:Bacillus subtilis] [DB:genpept-bct1] [DE:B.subtilis yws[A,B,C] genes and rbs[A,C,D,K,R] genes.] [NT:part of the ribose transport operon] [LE:1918] [RE:2886] [DI:complement]

| ORF_Name | NT_ID | AA_ID | NT/LN | AA/LN | Score | P-value |
|---|---|---|---|---|---|---|
| 14646090_c3_1371 | 1260 | 8431 | 615 | 204 | 982 | 7.2e-99 |

Description sp:[LN:S56390] [AC:S56390:H65226] [PN:hypothetical 23.5K protein (psd-amiB intergenic region):hypothetical protein o204a] [GN:yjeR] [OR:Escherichia coli] [DB:pir2] >gp:[GI:g537006] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_o204a] [LE:82363] [RE:82977] [DI:direct] >gp:[GI:g1790606] [LN:AE000488] [AC:AE000488:U00096] [PN:orf, hypothetical protein] [GN:yjeR] [FN:orf; Unknown] [OR:Escherichia coli] [DB:genpept-bct2] [DE:Escherichia coli K-12 MG1655 section 378 of 400 of the completegenome.] [NT:o204a; 100 pct identical amino acid sequence and] [LE:9194] [RE:9808] [DI:direct]

| ORF_Name | NT_ID | AA_ID | NT/LN | AA/LN | Score | P-value |
|---|---|---|---|---|---|---|
| 14884418_f3_566 | 1261 | 8432 | 738 | 245 | 1055 | 1.3e-106 |

Description sp:[LN:PHNF_ECOLI] [AC:P16684] [GN:PHNF] [OR:Escherichia coli] [DE:PHNF PROTEIN] [SP:P16684] [DB:swissprot] >sp:[LN:G35718] [AC:G35718:S56330:B42732:E65219] [PN:phnF protein] [GN:phnF] [OR:Escherichia coli] [DB:pir2] >gp:[GI:d1014971:g216595] [LN:ECOPHN] [AC:D90227] [GN:phnF] [OR:Escherichia coli] [SR:Escherichia coli (strain:K-12, sub_strain:W3110) DNA] [DB:genpept-bct1] [DE:Escherichia coli phn operon genes.] [LE:2842] [RE:3567] [DI:direct] >gp:[GI:g147200] [LN:ECOPHNAQ] [AC:J05260] [OR:Escherichia coli] [SR:E.coli (strain B) DNA] [DB:genpept-bct1] [DE:E.coli psiD locus containing alkylphosphonate uptake (phn) genes Athrough Q, complete cds.] [NT:phnF protein] [LE:7078] [RE:7803] [DI:direct] >gp:[GI:g536946] [LN:ECOUW93] [AC:U14003] [GN:phnF] [OR:Escherichia coli] [DB:genpept-bct1] [DE:Escherichia coli K-12 chromosomal region from 92.8 to 00.1 minutes.] [LE:12625] [RE:13350] [DI:complement] >gp:[GI:g1790540] [LN:AE000482] [AC:AE000482:U00096] [PN:putative transcriptional regulator] [GN:phnF] [FN:putative regulator; Not classified] [OR:Escherichia coli] [DB:genpept-bct2] [DE:Escherichia coli K-12 MG1655 section 372 of 400 of the completegenome.] [NT:f241; 100 pct identical amino acid sequence and] [LE:17344] [RE:18069] [DI:complement]

| ORF Name | NT ID | AA ID | NT/LN | AA/LN | Score | P-value |
|---|---|---|---|---|---|---|
| 14901955_f1_163 | 1262 | 8433 | 288 | 95 | 129 | 1.8e-08 |

Description sp:[LN:G72510] [AC:G72510] [PN:hypothetical protein APE2061] [GN:APE2061]
[OR:Aeropyrum pernix] [DB:pir2] >gp:[GI:d1044857;g5105759] [LN:AP000063]
[AC:AP000063] [PN:114aa long hypothetical protein] [GN:APE2061] [OR:Aeropyrum
pernix] [SR:Aeropyrum pernix (strain:K1) DNA] [DB:genpept-bct1] [DE:Aeropyrum
pernix genomic DNA, section 6/7.] [NT:similar to OWL:AP00000656 percent
identity:52.747] [LE:58153] [RE:58497] [DI:direct]

| ORF Name | NT ID | AA ID | NT/LN | AA/LN | Score | P-value |
|---|---|---|---|---|---|---|
| 15039077_f3_518 | 1263 | 8434 | 564 | 187 | 164 | 3.5e-12 |

Description sp:[LN:FM3_KLEPN] [AC:P12267] [GN:MRKA] [OR:Klebsiella pneumoniae] [DE:FIMBRIAL
SUBUNIT TYPE 3 PRECURSOR] [SP:P12267] [DB:swissprot] >sp:[LN:A31095]
[AC:A31095;B39142] [PN:type 3 fimbrial protein mrkA precursor] [OR:Klebsiella
pneumoniae] [DB:pir2] >gp:[GI:g149188] [LN:KPNFIMMRK] [AC:M20720] [OR:Klebsiella
pneumoniae] [SR:K.pneumoniae (strain IA565) DNA, clone pFK12] [DB:genpept-bct1]
[DE:K.pneumoniae fimbrial type 3 (mrkA) protein gene, complete cds.] [NT:fimbrial
protein precursor] [LE:730] [RE:1338] [DI:direct] >gp:[GI:g149236] [LN:KPNMRKAA]
[AC:M55912] [GN:mrkA] [OR:Klebsiella pneumoniae] [SR:K.pneumoniae (strain IA565)
DNA] [DB:genpept-bct1] [DE:K.pneumoniae mrk[A-E] genes, complete cds.] [LE:968]
[RE:1576] [DI:direct]

| ORF Name | NT ID | AA ID | NT/LN | AA/LN | Score | P-value |
|---|---|---|---|---|---|---|
| 15642187_f1_33 | 1264 | 8435 | 600 | 199 | 714 | 1.8e-70 |

Description sp:[LN:BLC_CITFR] [AC:Q46036] [OR:Citrobacter freundii] [DE:OUTER MEMBRANE
LIPOPROTEIN BLC PRECURSOR] [SP:Q46036] [DB:swissprot] >sp:[LN:I40710] [AC:I40710]
[PN:outer membrane lipoprotein] [CL:lipocalin:lipocalin homology] [OR:Citrobacter
freundii] [DB:pir2] >gp:[GI:g717136] [LN:CFU21727] [AC:U21727] [PN:lipocalin
precursor] [GN:blc] [OR:Citrobacter freundii] [DB:genpept-bct2] [DE:Citrobacter
freundii lipocalin precursor (blc), SugE homolog(sugE), entericidin R (ecnR),
entericidin B precursor (ecnB), andentericidin A precursor (ecnA) genes, complete
cds; and elongationfactor-P homolog gene, partial cds.] [NT:Blc] [LE:58] [RE:591]
[DI:direct]

| ORF Name | NT ID | AA ID | NT/LN | AA/LN | Score | P-value |
|---|---|---|---|---|---|---|
| 15661466_f3_698 | 1265 | 8436 | 396 | 131 | | |

Description

NO-HIT

| ORF_Name | NT_ID | AA_ID | NT/LN | AA/LN | Score | P-value |
|---|---|---|---|---|---|---|
| 15676327_f2_337 | 1266 | 8437 | 1065 | 354 | 1569 | 4.5e-161 |

Description gp:[GI:g147204] [LN:ECOPHNAQ] [AC:J05260] [OR:Escherichia coli] [SR:E.coli (strain B) DNA] [DB:genpept-bct1] [DE:E.coli psiD locus containing alkylphosphonate uptake (phn) genes Athrough Q, complete cds.] [NT:phnI protein] [LE:8837] [RE:9901] [DI:direct]

| ORF_Name | NT_ID | AA_ID | NT/LN | AA/LN | Score | P-value |
|---|---|---|---|---|---|---|
| 15681258_f3_515 | 1267 | 8438 | 279 | 92 | | |

Description

NO-HIT

| ORF_Name | NT_ID | AA_ID | NT/LN | AA/LN | Score | P-value |
|---|---|---|---|---|---|---|
| 15750831_c1_799 | 1268 | 8439 | 1278 | 425 | 137 | 3.8e-06 |

Description sp:[LN:B72204] [AC:B72204] [PN:maltose ABC transporter, periplasmic maltose-binding protein] [GN:TM1839] [CL:maltose-binding protein] [OR:Thermotoga maritima] [DB:pir2] >gp:[GI:g4982422] [LN:AE001821] [AC:AE001821:AE000512] [PN:maltose ABC transporter, periplasmic] [GN:TM1839] [OR:Thermotoga maritima] [DB:genpept-bct2] [DE:Thermotoga maritima section 133 of 136 of the complete genome.] [NT:similar to PID:1850900 GB:AE000512 percent] [LE:86] [RE:1267] [DI:complement]

| ORF_Name | NT_ID | AA_ID | NT/LN | AA/LN | Score | P-value |
|---|---|---|---|---|---|---|
| 15781905_c1_855 | 1269 | 8440 | 1509 | 502 | 2412 | 2.1e-250 |

Description sp:[LN:MELB_KLEPN] [AC:Q02581] [GN:MELB] [OR:Klebsiella pneumoniae] [DE:TRANSPORTER)] [SP:Q02581] [DB:swissprot] >sp:[LN:B44166] [AC:B44166] [PN:melibiose carrier] [CL:melibiose carrier protein] [OR:Klebsiella pneumoniae] [DB:pir2] >gp:[GI:g149193] [LN:KPNGALMEL] [AC:M97257] [PN:melibiose carrier] [GN:melB] [FN:cation-galactoside cotransport] [OR:Klebsiella pneumoniae] [SR:Klebsiella pneumoniae (individual_isolate 2002) DNA] [DB:genpept-bct1] [DE:Klebsiella pneumoniae alpha galactosidase (melA) gene, 3' end andmelibiose carrier (melB) gene, complete cds.] [LE:200] [RE:1615] [DI:direct]

| ORF_Name | NT_ID | AA_ID | NT/LN | AA/LN | Score | P-value |
|---|---|---|---|---|---|---|
| 15807042_f1_64 | 1270 | 8441 | 189 | 62 | | |

Description

NO-HIT

| ORF Name | NT ID | AA ID | NT LN | AA LN | Score | P-value |
|---|---|---|---|---|---|---|
| 15817840_c3_1303 | 1271 | 8442 | 969 | 322 | 861 | 4.8e-86 |

Description sp:[LN:STBA_ECOLI] [AC:P11904:P10028] [GN:STBA] [OR:Escherichia coli] [DE:PROTEIN STBA (PARA LOCUS 36 KD PROTEIN)] [SP:P11904:P10028] [DB:swissprot] >sp:[LN:S01774] [AC:S01774] [PN:stable inheritance 36K protein] [GN:stbA] [OR:plasmid NR1] [DB:pir2] >gp:[GI:d1042588:g5103177] [LN:AP000342] [AC:AP000342] [PN:plasmid stable inheritance protein] [GN:stbA] [OR:Plasmid R100] [SR:Plasmid R100 (specific_host:Shigella flexneri 2b strain 222] [DB:genpept-bct1] [DE:Plasmid R100 genomic DNA.] [NT:100% identical to sp:STBA_ECOLI[StbB of plasmid] [LE:24545] [RE:25507] [DI:complement] >gp:[GI:g452844] [LN:ECR1PARA] [AC:X04268] [OR:Escherichia coli] [DB:genpept-bct1] [DE:Plasmid R1 stability locus parA+.] [NT:36K protein (aa 1-320)] [SP:P11904] [LE:183] [RE:1145] [DI:direct] >gp:[GI:g43002] [LN:ECSTBABC] [AC:X12777] [PN:stbA protein] [OR:Escherichia coli] [DB:genpept-bct1] [DE:E. coli IncFII plasmid NR1 stability locus with genes stbA, stbB,stbC and ORF1 and ORF2.] [SP:P11904] [LE:214] [RE:1176] [DI:direct]

| ORF Name | NT ID | AA ID | NT LN | AA LN | Score | P-value |
|---|---|---|---|---|---|---|
| 15915781_f1_36 | 1272 | 8443 | 207 | 68 | | |

Description

NO-HIT

| ORF Name | NT ID | AA ID | NT LN | AA LN | Score | P-value |
|---|---|---|---|---|---|---|
| 16125806_c3_1321 | 1273 | 8444 | 258 | 85 | | |

Description

NO-HIT

| ORF Name | NT ID | AA ID | NT LN | AA LN | Score | P-value |
|---|---|---|---|---|---|---|
| 16192656_f2_425 | 1274 | 8445 | 1185 | 394 | 469 | 1.7e-44 |

Description gp:[GI:g1545863] [LN:PAU50396] [AC:U50396] [PN:WbpN] [GN:wbpN] [OR:Pseudomonas aeruginosa] [DB:genpept-bct2] [DE:Pseudomonas aeruginosa Wzz (Rol) (wzz (rol)) gene, partial cds,WbpA (wbpB), WbpB (wbpB), WbpC (wbpC), WbpD (wbpD), WbpE (wbpE),Wzy (Rfc) (wzy (rfc)), Wzx (wzx), HisH (hisH), HisF (hisF), WbpG(wbpG), WbpH (wbpH), WbpI (wbpI), WbpJ (wbpJ), WbpK (wbpK), WbpL(wbpL), WbpM (wbpM) and WbpN (wbpN) genes, complete cds, and UvrB(uvrB) gene, partial cds.] [LE:22303] [RE:23694] [DI:direct]

| ORF Name | NT ID | AA ID | NT LN | AA LN | Score | P-value |
|---|---|---|---|---|---|---|
| 16203342_c1_743 | 1275 | 8446 | 225 | 74 | | |

Description

NO-HIT

| ORF Name | NT ID | AA ID | NT LN | AA LN | Score | P-value |
|---|---|---|---|---|---|---|
| 16203562_f3_538 | 1276 | 8447 | 591 | 196 | | |

Description

NO-HIT

| ORF Name | NT ID | AA ID | NT LN | AA LN | Score | P-value |
|---|---|---|---|---|---|---|
| 16292038_f1_155 | 1277 | 8448 | 354 | 117 | 350 | 6.8e-32 |

Description sp:[LN:C65214] [AC:C65214] [PN:hypothetical 13.0 kD protein in ssb-soxs intergenic region] [GN:yjcB] [OR:Escherichia coli] [DB:pir2] >gp:[GI:g1790495] [LN:AE000479] [AC:AE000479:U00096] [PN:orf, hypothetical protein] [GN:yjcB] [FN:orf; Unknown] [OR:Escherichia coli] [DB:genpept-bct2] [DE:Escherichia coli K-12 MG1655 section 369 of 400 of the completegenome.] [NT:f116; 100 pct identical amino acid sequence and] [LE:5739] [RE:6089] [DI:complement] >gp:[GI:g409801] [LN:ECOUW89] [AC:U00006] [OR:Escherichia coli] [SR:Escherichia coli (sub_strain MG1655, strain K-12) (library: lambda] [DB:genpept-bct2] [DE:E. coli chromosomal region from 89.2 to 92.8 minutes.] [LE:140000] [RE:140350] [DI:complement]

| ORF Name | NT ID | AA ID | NT LN | AA LN | Score | P-value |
|---|---|---|---|---|---|---|
| 16300900_f1_166 | 1278 | 8449 | 804 | 267 | 359 | 7.5e-33 |

Description sp:[LN:SUHB_ECOLI] [AC:P22783:P77511] [GN:SUHB:SSYA] [OR:Escherichia coli]
[DE:EXTRAGENIC SUPPRESSOR PROTEIN SUHB] [SP:P22783:P77511] [DB:swissprot]
>sp:[LN:D65030] [AC:D65030:A35158] [PN:suppressor protein suhB] [GN:suhB]
[CL:suppressor protein suhB] [OR:Escherichia coli] [DB:pir1]
>gp:[GI:d1017157:g1799941] [LN:D90883] [AC:D90883:AB001340] [PN:EXTRAGENIC
SUPPRESSOR PROTEIN SUHB.] [GN:ssyA] [OR:Escherichia coli] [SR:Escherichia coli
(strain:K12) DNA, clone_lib:Kohara lambda minise] [DB:genpept-bct1] [DE:E.coli
genomic DNA, Kohara clone #430(57.2-57.5 min.).] [NT:similar to [SwissProt
Accession Number P22783]] [LE:7205] [RE:8008] [DI:direct]
>gp:[GI:d1017165:g1799950] [LN:D90884] [AC:D90884:AB001340] [PN:EXTRAGENIC
SUPPRESSOR PROTEIN SUHB.] [GN:ssyA] [OR:Escherichia coli] [SR:Escherichia coli
(strain:K12) DNA, clone_lib:Kohara lambda minise] [DB:genpept-bct1] [DE:E.coli
genomic DNA, Kohara clone #431(57.3-57.7 min.).] [NT:similar to [SwissProt
Accession Number P22783]] [LE:666] [RE:1469] [DI:direct] >gp:[GI:g1788882]
[LN:AE000339] [AC:AE000339:U00096] [PN:enhances synthesis of sigma32 in mutant;]
[GN:suhB] [FN:phenotype; Global regulatory functions] [OR:Escherichia coli]
[DB:genpept-bct2] [DE:Escherichia coli K-12 MG1655 section 229 of 400 of the
completegenome.] [NT:o267; 99 pct identical to SUHB_ECOLI SW: P22783] [LE:9724]
[RE:10527] [DI:direct]

| ORF Name | NT ID | AA ID | NT LN | AA LN | Score | P-value |
|---|---|---|---|---|---|---|
| 16489781_c2_977 | 1279 | 8450 | 375 | 124 | 350 | 6.8e-32 |

Description sp:[LN:YJBJ_ECOLI] [AC:P32691] [GN:YJBJ] [OR:Escherichia coli] [DE:8.3 KD PROTEIN
IN DINF-QOR INTERGENIC REGION (O69)] [SP:P32691] [DB:swissprot] >sp:[LN:D65212]
[AC:D65212] [PN:hypothetical protein b4045] [OR:Escherichia coli] [DB:pir2]
>gp:[GI:g1790479] [LN:AE000478] [AC:AE000478:U00096] [PN:orf, hypothetical
protein] [GN:yjbJ] [FN:orf; Unknown] [OR:Escherichia coli] [DB:genpept-bct2]
[DE:Escherichia coli K-12 MG1655 section 368 of 400 of the completegenome.]
[NT:o69] [LE:76] [RE:285] [DI:direct] >gp:[GI:g396380] [LN:ECOUW89] [AC:U00006]
[OR:Escherichia coli] [SR:Escherichia coli (sub_strain MG1655, strain K-12)
(library: lambda] [DB:genpept-bct2] [DE:E. coli chromosomal region from 89.2 to
92.8 minutes.] [LE:124479] [RE:124688] [DI:direct]

| ORF Name | NT ID | AA ID | NT LN | AA LN | Score | P-value |
|---|---|---|---|---|---|---|
| 16501942_f3_650 | 1280 | 8451 | 510 | 169 | 100 | 2.1e-05 |

Description sp:[LN:T05261] [AC:T05261] [PN:cold-regulated protein] [OR:Hordeum vulgare] [SR:,
barley] [DB:pir2]

| ORF Name | NT ID | AA ID | NT LN | AA LN | Score | P-value |
|---|---|---|---|---|---|---|
| 16511461_f2_338 | 1281 | 8452 | 828 | 275 | 1195 | 1.9e-121 |

Description sp:[LN:PHNK_ECOLI] [AC:P16678] [GN:PHNK] [OR:Escherichia coli] [DE:PHOSPHONATES TRANSPORT ATP-BINDING PROTEIN PHNK] [SP:P16678] [DB:swissprot] >gp:[GI:d1014976:g216600] [LN:ECOPHN] [AC:D90227] [PN:ATP-binding protein] [GN:phnK] [OR:Escherichia coli] [SR:Escherichia coli (strain:K-12, sub_strain:W3110) DNA] [DB:genpept-bct1] [DE:Escherichia coli phn operon genes.] [LE:6500] [RE:7258] [DI:direct] >gp:[GI:g147206] [LN:ECOPHNAQ] [AC:J05260] [OR:Escherichia coli] [SR:E.coli (strain B) DNA] [DB:genpept-bct1] [DE:E.coli psiD locus containing alkylphosphonate uptake (phn) genes Athrough Q, complete cds.] [NT:HisP-like nucleotide binding protein (phnK)] [LE:10736] [RE:11494] [DI:direct]

| ORF Name | NT ID | AA ID | NT LN | AA LN | Score | P-value |
|---|---|---|---|---|---|---|
| 16603402_c3_1248 | 1282 | 8453 | 861 | 286 | 274 | 7.7e-24 |

Description gp:[GI:e213832:g1122243] [LN:BLLAMLCHA] [AC:X94148] [PN:putative inner membrane protein] [GN:lam] [OR:Bacillus licheniformis] [DB:genpept-bct1] [DE:B.licheniformis lam and lchAA1 genes.] [LE:568] [RE:1380] [DI:direct]

| ORF Name | NT ID | AA ID | NT LN | AA LN | Score | P-value |
|---|---|---|---|---|---|---|
| 16688427_f3_593 | 1283 | 8454 | 438 | 145 | 721 | 3.3e-71 |

Description gp:[GI:g5081725] [LN:AF146729] [AC:AF146729] [PN:formate dehydrogenase H] [GN:fdhF] [OR:Salmonella typhimurium] [DB:genpept-bct2] [DE:Salmonella typhimurium formate dehydrogenase H (fdhF) gene, partialcds.] [NT:FdhF; selenocysteine] [LE:190] [RE:>795] [DI:direct]

| ORF Name | NT ID | AA ID | NT LN | AA LN | Score | P-value |
|---|---|---|---|---|---|---|
| 167168_c3_1235 | 1284 | 8455 | 2337 | 778 | 2850 | 8.2e-297 |

Description sp:[LN:FEPA_ECOLI] [AC:P05825:P75722:P76821:P77093] [GN:FEPA:FEP:FEUB]
[OR:Escherichia coli] [DE:RECEPTOR)] [SP:P05825:P75722:P76821:P77093]
[DB:swissprot] >sp:[LN:QRECFC] [AC:F64791:A25953:S06980] [PN:ferrienterochelin
receptor precursor] [GN:fepA:fep] [CL:ferrienterochelin receptor:tonB-dependent
receptor amino-terminal homology:tonB-dependent receptor carboxyl-terminal
homology] [OR:Escherichia coli] [DB:pir1] [MP:14 min] >gp:[GI:d1036211:g4062212]
[LN:D90700] [AC:D90700:AB001340] [PN:Ferrienterochelin receptor precursor]
[GN:fep] [OR:Escherichia coli] [SR:Escherichia coli(strain:K12) DNA, clone:Kohara
clone #163] [DB:genpept-bct1] [DE:Escherichia coli genomic DNA. (12.8 - 13.2
min).] [NT:ORF_ID:o164#7; similar to PIR Accession Number] [LE:15592] [RE:17832]
[DI:complement] >gp:[GI:g1786798] [LN:AE000163] [AC:AE000163:U00096] [PN:outer
membrane receptor for ferric enterobactin] [GN:fepA] [FN:membrane; Transport of
small molecules:] [OR:Escherichia coli] [DB:genpept-bct2] [DE:Escherichia coli
K-12 MG1655 section 53 of 400 of the completegenome.] [NT:f746; 99 pct identical
(1 gap) to FEPA_ECOLI] [LE:6909] [RE:9149] [DI:complement]

| ORF Name | NT ID | AA ID | NT LN | AA LN | Score | P-value |
|---|---|---|---|---|---|---|
| 16822708_f2_262 | 1285 | 8456 | 1305 | 434 | 1790 | 1.7e-184 |

Description sp:[LN:YJES_ECOLI] [AC:P39288] [GN:YJES] [OR:Escherichia coli] [DE:HYPOTHETICAL
43.1 KD PROTEIN IN PSD-AMIB INTERGENIC REGION (F379)] [SP:P39288] [DB:swissprot]
>sp:[LN:S56391] [AC:S56391:A65227] [PN:hypothetical 43.1K protein (psd-amiB
intergenic region):hypothetical protein f379] [GN:yjeS] [OR:Escherichia coli]
[DB:pir2] >gp:[GI:g537007] [LN:ECOUW93] [AC:U14003] [OR:Escherichia coli]
[DB:genpept-bct1] [DE:Escherichia coli K-12 chromosomal region from 92.8 to 00.1
minutes.] [NT:ORF_f379] [LE:83756] [RE:84895] [DI:complement] >gp:[GI:g1790608]
[LN:AE000489] [AC:AE000489:U00096] [PN:orf, hypothetical protein] [GN:yjeS]
[FN:orf; Unknown] [OR:Escherichia coli] [DB:genpept-bct2] [DE:Escherichia coli
K-12 MG1655 section 379 of 400 of the completegenome.] [NT:f379; 100 pct
identical amino acid sequence and] [LE:642] [RE:1781] [DI:complement]

| ORF Name | NT ID | AA ID | NT LN | AA LN | Score | P-value |
|---|---|---|---|---|---|---|
| 16837683_f2_306 | 1286 | 8457 | 1242 | 413 | | |

Description

NO-HIT

| ORF_Name | NT ID | AA ID | $\frac{NT}{LN}$ | $\frac{AA}{LN}$ | Score | P-value |
|---|---|---|---|---|---|---|
| 16895782_c2_943 | 1287 | 8458 | 213 | 70 | 141 | 2.9e-08 |

Description gp:[GI:g581135] [LN:ECMTHM] [AC:X16584] [OR:Escherichia coli] [DB:genpept-bct1]
[DE:E. coli metH gene for 5-Methyltetrahydrofolate-homocysteine(vitamin B12)
methyltransferase (E.C. 2.1.1.13).] [NT:5-methyltetrahydrofolate- homocysteine
transferase] [SP:P13009] [LE:223] [RE:3825] [DI:direct]

| ORF_Name | NT ID | AA ID | $\frac{NT}{LN}$ | $\frac{AA}{LN}$ | Score | P-value |
|---|---|---|---|---|---|---|
| 20034405_c3_1183 | 1288 | 8459 | 1356 | 451 | 2144 | 5.3e-222 |

Description sp:[LN:ACEA_ECOLI] [AC:P05313] [GN:ACEA:ICL] [OR:Escherichia coli] [EC:4.1.3.1]
[DE:ISOCITRATE LYASE, (ISOCITRASE) (ISOCITRATASE) (ICL)] [SP:P05313]
[DB:swissprot] >sp:[LN:WZECIC] [AC:S05692:S05691:A31837:S00931:A32016:F65208]
[PN:isocitrate lyase,:isocitrase:isocitratase:isocitritase] [GN:aceA]
[CL:isocitrate lyase] [OR:Escherichia coli] [EC:4.1.3.1] [DB:pir1] [MP:91 min]
>gp:[GI:g40888] [LN:ECACEB] [AC:X12431:M36854] [OR:Escherichia coli]
[DB:genpept-bct1] [DE:E. coli genes aceB and aceA for for malate synthase (EC
4.1.3.2)and isocitrate lyase (EC 4.1.3.1).] [NT:isocitrate lyase] [SP:P05313]
[LE:2212] [RE:3516] [DI:direct] >gp:[GI:g1790445] [LN:AE000474]
[AC:AE000474:U00096] [PN:isocitrate lyase] [GN:aceA] [FN:enzyme; Central
intermediary metabolism:] [OR:Escherichia coli] [DB:genpept-bct2] [EC:4.1.3.1]
[DE:Escherichia coli K-12 MG1655 section 364 of 400 of the completegenome.]
[NT:o434; 100 pct identical to ACEA_ECOLI SW: P05313;] [LE:9240] [RE:10544]
[DI:direct] >gp:[GI:g396350] [LN:ECOUW89] [AC:U00006] [PN:isocitrate lyase]
[GN:aceA] [OR:Escherichia coli] [SR:Escherichia coli (sub_strain MG1655, strain
K-12) (library: lambda) [DB:genpept-bct2] [EC:4.1.3.1] [DE:E. coli chromosomal
region from 89.2 to 92.8 minutes.] [NT:CG Site No. 1052] [LE:82351] [RE:83655]
[DI:direct]

| ORF_Name | NT ID | AA ID | NT LN | AA LN | Score | P-value |
|---|---|---|---|---|---|---|
| 2056416_c2_976 | 1289 | 8460 | 1386 | 461 | 1940 | 2.2e-200 |

Description sp:[LN:DINF_ECOLI] [AC:P28303] [GN:DINF] [OR:Escherichia coli]
[DE:DNA-DAMAGE-INDUCIBLE PROTEIN F] [SP:P28303] [DB:swissprot] >sp:[LN:C65212]
[AC:C65212] [PN:DNA-damage-inducible protein f] [GN:dinF] [OR:Escherichia coli]
[DB:pir2] >gp:[GI:g146611] [LN:ECOLEXDIN] [AC:L02362] [PN:DNA-damage-inducible
protein] [GN:dinF] [OR:Escherichia coli] [SR:Escherichia coli (strain K-12) DNA]
[DB:genpept-bct1] [DE:Escherichia coli repressor protein (lexA) gene 3'
end;DNA-damage-inducible protein (dinF) gene, complete cds.] [LE:48] [RE:1427]
[DI:direct] >gp:[GI:g1790477] [LN:AE000477] [AC:AE000477;U00096]
[PN:DNA-damage-inducible protein F] [GN:dinF] [FN:factor; DNA - replication,
repair,] [OR:Escherichia coli] [DB:genpept-bct2] [DE:Escherichia coli K-12 MG1655
section 367 of 400 of the completegenome.] [NT:o459; 100 pct identical to
DINF_ECOLI SW: P28303;] [LE:9837] [RE:11216] [DI:direct] >gp:[GI:g396379]
[LN:ECOUW89] [AC:U00006] [GN:dinF] [FN:DNA-damage-inducible protein F]
[OR:Escherichia coli] [SR:Escherichia coli (sub_strain MG1655, strain K-12)
(library: lambda] [DB:genpept-bct2] [DE:E. coli chromosomal region from 89.2 to
92.8 minutes.] [NT:CG Site No. 854] [LE:122984] [RE:124363] [DI:direct]

| ORF_Name | NT ID | AA ID | NT LN | AA LN | Score | P-value |
|---|---|---|---|---|---|---|
| 209700_c1_775 | 1290 | 8461 | 735 | 244 | 1027 | 1.2e-103 |

Description sp:[LN:APHA_ECOLI] [AC:P32697;Q57085;P76787] [GN:APHA;NAPA] [OR:Escherichia coli]
[EC:3.1.3.2] [DE:CLASS B ACID PHOSPHATASE PRECURSOR,] [SP:P32697;Q57085;P76787]
[DB:swissprot] >sp:[LN:S54790] [AC:S54790;F65213] [PN:acid
phosphatase:hypothetical 26.1K protein (tyrB-uvrA intergenic region)] [GN:yjbP]
[OR:Escherichia coli] [DB:pir2] >gp:[GI:g806548] [LN:ECNAPA] [AC:X86971] [PN:acid
phosphatase] [GN:aphA] [OR:Escherichia coli] [DB:genpept-bct1] [DE:E.coli aphA
gene.] [SP:P32697] [LE:1] [RE:714] [DI:direct] >gp:[GI:g1256442] [LN:ECU51210]
[AC:U51210] [PN:acid phosphatase] [OR:Escherichia coli] [SR:Escherichia coli
strain=W3110] [DB:genpept-bct1] [DE:Escherichia coli acid phosphatase gene,
complete cds.] [LE:1] [RE:714] [DI:direct] >gp:[GI:g2367341] [LN:AE000479]
[AC:AE000479;U00096] [PN:diadenosine tetraphosphatase] [GN:aphA] [FN:enzyme;
Central intermediary metabolism;] [OR:Escherichia coli] [DB:genpept-bct2]
[DE:Escherichia coli K-12 MG1655 section 369 of 400 of the completegenome.]
[NT:o237; sequence change joins two ORFs relative to] [LE:393] [RE:1106]
[DI:direct]

| ORF Name | NT ID | AA ID | NT/LN | AA/LN | Score | P-value |
|---|---|---|---|---|---|---|
| 2132686_f1_113 | 1291 | 8462 | 972 | 323 | 371 | 4.0e-34 |

Description sp:[LN:RBSB_BACSU] [AC:P36949:P96730] [GN:RBSB] [OR:Bacillus subtilis]
[DE:D-RIBOSE-BINDING PROTEIN PRECURSOR] [SP:P36949:P96730] [DB:swissprot]
>sp:[LN:A69690] [AC:A69690:I40467:S42715] [PN:ribose ABC transporter
(ribose-binding protein) rbsB:periplasmic ribose-binding protein rbsB] [GN:rbsB]
[CL:lac repressor] [OR:Bacillus subtilis] [DB:pir2] >gp:[GI:e1184502:g2636121]
[LN:BSUB0019] [AC:Z99122:AL009126] [PN:ribose ABC transporter (ribose-binding
protein)] [GN:rbsB] [FN:ribose transport] [OR:Bacillus subtilis]
[DB:genpept-bct1] [DE:Bacillus subtilis complete genome (section 19 of 21): from
3597091to 3809700.] [SP:P36949] [LE:108112] [RE:109029] [DI:direct]
>gp:[GI:e308081:g1894757] [LN:BSZ92953] [AC:Z92953] [PN:periplasmic
substrate-binding protein] [GN:rbsB] [OR:Bacillus subtilis] [DB:genpept-bct1]
[DE:B.subtilis yws[A,B,C] genes and rbs[A,C,D,K,R] genes.] [NT:part of the ribose
transport operon] [LE:989] [RE:1906] [DI:complement]

| ORF Name | NT ID | AA ID | NT/LN | AA/LN | Score | P-value |
|---|---|---|---|---|---|---|
| 21579678_c1_915 | 1292 | 8463 | 270 | 89 | 125 | 8.7e-07 |

Description gp:[GI:g5918469] [LN:SCD25] [AC:AL118514] [PN:DNA polymerase III subunit gamma]
[GN:dnaZ] [OR:Streptomyces coelicolor A3(2)] [DB:genpept-bct1] [DE:Streptomyces
coelicolor cosmid D25.] [NT:SCD25.03, DNA polymerase III subunit gamma, len:]
[LE:1826] [RE:4180] [DI:direct]

| ORF Name | NT ID | AA ID | NT/LN | AA/LN | Score | P-value |
|---|---|---|---|---|---|---|
| 21692711_c2_1156 | 1293 | 8464 | 1317 | 438 | 124 | 5.8e-05 |

Description sp:[LN:T08176] [AC:T08176] [PN:glucose-1-phosphate adenylyltransferase, large
chain, precursor] [GN:sta6] [OR:Chlamydomonas reinhardtii] [EC:2.7.7.27]
[DB:pir2] >gp:[GI:e201253:g1149717] [LN:CRSTA6GEN] [AC:X91736]
[PN:glucose-1-phosphate adenylyltransferase] [GN:sta6] [OR:Chlamydomonas
reinhardtii] [DB:genpept-pln1] [EC:2.7.7.27] [DE:C.reinhardtii mRNA for
ADP-glucose pyrophosphorylase.] [NT:ADP-glucose pyrophosphorylase; large subunit]
[LE:15] [RE:884] [DI:direct]

| ORF Name | NT ID | AA ID | NT LN | AA LN | Score | P-value |
|---|---|---|---|---|---|---|
| 21760458_f3_534 | 1294 | 8465 | 678 | 225 | 824 | 4.0e-82 |

Description sp:[LN:S56363] [AC:S56363:S47296:E65223:S61863:I41039] [PN:divalent cation tolerance protein cutA3, inner membrane:hypothetical protein 191:yjdC protein] [GN:yjdC:cutA3] [OR:Escherichia coli] [DB:pir2] >gp:[GI:g581056] [LN:ECCUTA123] [AC:Z36905:L35947] [PN:199 residue polypeptide] [GN:CutA3] [OR:Escherichia coli] [DB:genpept-bct1] [DE:E.coli CutA1, CutA2, and CutA3 genes.] [SP:P36656] [LE:2390] [RE:2989] [DI:direct] >gp:[GI:g536979] [LN:ECOUW93] [AC:U14003] [GN:yjdC] [OR:Escherichia coli] [DB:genpept-bct1] [DE:Escherichia coli K-12 chromosomal region from 92.8 to 00.1 minutes.] [LE:53561] [RE:54160] [DI:complement] >gp:[GI:g1790577] [LN:AE000486] [AC:AE000486:U00096] [PN:orf, hypothetical protein] [GN:yjdC] [FN:orf; Unknown] [OR:Escherichia coli] [DB:genpept-bct2] [DE:Escherichia coli K-12 MG1655 section 376 of 400 of the completegenome.] [NT:f199; This 199 aa ORF is 100 pct identical to] [LE:4106] [RE:4705] [DI:complement]

| ORF Name | NT ID | AA ID | NT LN | AA LN | Score | P-value |
|---|---|---|---|---|---|---|
| 21875032_c1_800 | 1295 | 8466 | 894 | 297 | 229 | 4.5e-19 |

Description gp:[GI:g1381802] [LN:ATU60011] [AC:U60011] [PN:MotC] [GN:motC] [OR:Agrobacterium tumefaciens] [DB:genpept-bct2] [DE:Agrobacterium tumefaciens plasmid pTi15955 OccR (occR) gene,partial cds; mcl pseudogene, complete sequence; traR-like regulator(trlR), MotD (motD), MotC (motC), MotB (motB), and MotA (motA)genes, complete cds; and unknown genes.] [NT:Description: a gene encoding a putative inner] [LE:2460] [RE:3344] [DI:complement]

| ORF Name | NT ID | AA ID | NT LN | AA LN | Score | P-value |
|---|---|---|---|---|---|---|
| 21968916_f2_416 | 1296 | 8467 | 204 | 67 | | |

Description

NO-HIT

| ORF Name | NT ID | AA ID | NT LN | AA LN | Score | P-value |
|---|---|---|---|---|---|---|
| 21970168_c3_1355 | 1297 | 8468 | 732 | 243 | | |

Description

NO-HIT

| ORF_Name | NT_ID | AA_ID | NT LN | AA LN | Score | P-value |
|---|---|---|---|---|---|---|
| 22132633_c3_1239 | 1298 | 8469 | 2478 | 825 | 2680 | 8.4e-279 |

Description sp:[LN:UP05_ECOLI] [AC:P39170:P39181:P77465] [GN:YAET] [OR:Escherichia coli]
[DE:UNKNOWN PROTEIN FROM 2D-PAGE SPOTS M62/M63/O3/O9/T35 PRECURSOR]
[SP:P39170:P39181:P77465] [DB:swissprot] >sp:[LN:A64742] [AC:A64742]
[PN:hypothetical protein b0177] [CL:protective surface antigen D-15]
[OR:Escherichia coli] [DB:pir2] >gp:[GI:g1552754] [LN:ECU70214] [AC:U70214]
[OR:Escherichia coli] [DB:genpept-bct1] [DE:Escherichia coli chromosome minutes
4-6.] [NT:hypothetical protein] [LE:29003] [RE:31435] [DI:direct]
>gp:[GI:g1786374] [LN:AE000127] [AC:AE000127:U00096] [PN:orf, hypothetical
protein] [GN:yaeT] [FN:orf; Unknown] [OR:Escherichia coli] [DB:genpept-bct2]
[DE:Escherichia coli K-12 MG1655 section 17 of 400 of the completegenome.]
[NT:o810; 45 pct identical (29 gaps) to 808 residues of] [LE:3148] [RE:5580]
[DI:direct] >gp:[GI:g4567046] [LN:AF120927] [AC:AF120927] [PN:outer membrane
antigen Oma90] [GN:oma90] [OR:Shigella flexneri] [DB:genpept-bct2] [DE:Shigella
flexneri outer membrane antigen Oma90 (oma90) gene,complete cds.] [NT:similar to
Escherichia coli hypothetical YaeT, 90] [LE:1] [RE:2433] [DI:direct]

| ORF_Name | NT_ID | AA_ID | NT LN | AA LN | Score | P-value |
|---|---|---|---|---|---|---|
| 2220950_c2_933 | 1299 | 8470 | 1686 | 561 | 2508 | 1.4e-260 |

Description sp:[LN:MASY_ECOLI] [AC:P08997] [GN:ACEB:MAS] [OR:Escherichia coli] [EC:4.1.3.2]
[DE:MALATE SYNTHASE A, (MSA)] [SP:P08997] [DB:swissprot] >sp:[LN:SYECMA]
[AC:A32649:A30378:E65208:Q00592] [PN:malate synthase, A] [GN:aceB] [CL:malate
synthase] [OR:Escherichia coli] [EC:4.1.3.2] [DB:pir1]
>gp:[GI:g40887] [LN:ECACEB] [AC:X12431:M36854] [OR:Escherichia coli]
[DB:genpept-bct1] [DE:E. coli genes aceB and aceA for for malate synthase (EC
4.1.3.2)and isocitrate lyase (EC 4.1.3.1).] [NT:malate synthase] [SP:P08997]
[LE:581] [RE:2182] [DI:direct] >gp:[GI:e283783:g1926481] [LN:A31765] [AC:A31765]
[GN:aceB] [OR:synthetic construct] [DB:genpept-pat] [DE:DNA expression cassette
MTAceB2 with bacterial aceB gene frompatent WO9218635.] [LE:882] [RE:2483]
[DI:direct] >gp:[GI:e283785:g1926484] [LN:A31767] [AC:A31767] [GN:aceB]
[OR:synthetic construct] [DB:genpept-pat] [DE:DNA exprtession cassette MTAceAB1
with bacterial genes aceA andaceB from patent WO9218635.] [LE:4037] [RE:5638]
[DI:direct] >gp:[GI:g1790444] [LN:AE000474] [AC:AE000474:U00096] [PN:malate
synthase A] [GN:aceB] [FN:enzyme; Central intermediary metabolism:]
[OR:Escherichia coli] [DB:genpept-bct2] [EC:4.1.3.2] [DE:Escherichia coli K-12
MG1655 section 364 of 400 of the completegenome.] [NT:o533; 100 pct identical to
MASY_ECOLI SW: P08997;] [LE:7609] [RE:9210] [DI:direct] >gp:[GI:g396349]
[LN:ECOUW89] [AC:U00006] [PN:malate synthase A] [GN:aceB] [OR:Escherichia coli]
[SR:Escherichia coli (sub_strain MG1655, strain K-12) (library: lambda)
[DB:genpept-bct2] [EC:4.1.3.2] [DE:E. coli chromosomal region from 89.2 to 92.8
minutes.] [NT:CG Site No. 1051; alternate gene name mas] [LE:80720] [RE:82321]
[DI:direct]

| ORF Name | NT ID | AA ID | NT LN | AA LN | Score | P-value |
|---|---|---|---|---|---|---|
| 22298201_c2_975 | 1300 | 8471 | 633 | 210 | 970 | 1.4e-97 |

Description sp:[LN:LEXA_ECOLI] [AC:P03033] [GN:LEXA:EXRA:SPR:TSL:UMUA] [OR:Escherichia coli]
[EC:3.4.21.88] [DE:LEXA REPRESSOR,] [SP:P03033] [DB:swissprot] >sp:[LN:ILEC]
[AC:A90808:A93734:S11945:B65212:A03569] [PN:lexA repressor] [GN:lexA] [CL:lexA
repressor] [OR:Escherichia coli] [DB:pir1] [MP:92 min] >gp:[GI:g146608]
[LN:ECOLEXA] [AC:J01643:V00299:V00300] [OR:Escherichia coli] [SR:Escherichia coli
DNA] [DB:genpept-bct1] [DE:E.coli lexA gene coding for SOS function regulatory
protein.] [NT:SOS function regulatory protein (lexA)] [LE:102] [RE:710]
[DI:direct] >gp:[GI:g1790476] [LN:AE000477] [AC:AE000477:U00096] [PN:regulator
for SOS(lexA) regulon] [GN:lexA] [FN:regulator; Global regulatory functions]
[OR:Escherichia coli] [DB:genpept-bct2] [DE:Escherichia coli K-12 MG1655 section
367 of 400 of the completegenome.] [NT:o202b; CG Site No. 558] [LE:9210]
[RE:9818] [DI:direct] >gp:[GI:g396378] [LN:ECOUW89] [AC:U00006] [GN:lexA]
[FN:regulatory gene for SOS regulon] [OR:Escherichia coli] [SR:Escherichia coli
(sub_strain MG1655, strain K-12) (library: lambda] [DB:genpept-bct2] [DE:E. coli
chromosomal region from 89.2 to 92.8 minutes.] [NT:CG Site No. 558] [LE:122357]
[RE:122965] [DI:direct]

| ORF Name | NT ID | AA ID | NT LN | AA LN | Score | P-value |
|---|---|---|---|---|---|---|
| 22767905_c3_1225 | 1301 | 8472 | 1338 | 445 | 1993 | 5.3e-206 |

Description gp:[GI:g3309659] [LN:AF074934] [AC:AF074934] [PN:tyrosine aminotransferase]
[GN:tyrB] [OR:Klebsiella pneumoniae] [DB:genpept-bct2] [EC:2.6.1.5]
[DE:Klebsiella pneumoniae tyrosine aminotransferase (tyrB) gene,complete cds.]
[LE:1] [RE:1194] [DI:direct]

| ORF Name | NT ID | AA ID | NT LN | AA LN | Score | P-value |
|---|---|---|---|---|---|---|
| 22831376_c3_1267 | 1302 | 8473 | 645 | 214 | 166 | 2.1e-12 |

Description sp:[LN:FIMF_ECOLI] [AC:P08189] [GN:FIMF] [OR:Escherichia coli] [DE:FIMF PROTEIN
PRECURSOR] [SP:P08189] [DB:swissprot] >sp:[LN:S56543] [AC:S56543:H65245:S07321]
[PN:fimbrial protein fimF precursor, type 1] [GN:fimF] [CL:type 1 fimbrial
protein] [OR:Escherichia coli] [DB:pir2] >gp:[GI:g537159] [LN:ECOUW93]
[AC:U14003] [GN:fimF] [FN:involved in regulation of length and mediation]
[OR:Escherichia coli] [DB:genpept-bct1] [DE:Escherichia coli K-12 chromosomal
region from 92.8 to 00.1 minutes.] [NT:CG Site No. 18343] [LE:238575] [RE:239105]
[DI:direct] >gp:[GI:g1790773] [LN:AE000502] [AC:AE000502:U00096] [PN:fimbrial
morphology] [GN:fimF] [FN:structural component; Surface structures]
[OR:Escherichia coli] [DB:genpept-bct2] [DE:Escherichia coli K-12 MG1655 section
392 of 400 of the completegenome.] [NT:o176; 100 pct identical to FIMF_ECOLI SW:
P08189;] [LE:7537] [RE:8067] [DI:direct]

| ORF Name | NT ID | AA ID | NT LN | AA LN | Score | P-value |
|---|---|---|---|---|---|---|
| 22892002_f3_527 | 1303 | 8474 | 1467 | 488 | 2291 | 1.4e-237 |

Description gp:[GI:g536983] [LN:ECOUW93] [AC:U14003] [PN:aspartase] [GN:aspA] [OR:Escherichia coli] [DB:genpept-bct1] [EC:4.3.1.1] [DE:Escherichia coli K-12 chromosomal region from 92.8 to 00.1 minutes.] [NT:CG Site No. 991] [LE:57719] [RE:59200] [DI:complement] >gp:[GI:g1790581] [LN:AE000486] [AC:AE000486:U00096] [PN:aspartate ammonia-lyase (aspartase)] [GN:aspA] [FN:enzyme; Central intermediary metabolism: Pool,] [OR:Escherichia coli] [DB:genpept-bct2] [EC:4.3.1.1] [DE:Escherichia coli K-12 MG1655 section 376 of 400 of the completegenome.] [NT:f493; 100 pct identical to 478 amino acids] [LE:8264] [RE:9745] [DI:complement]

| ORF Name | NT ID | AA ID | NT LN | AA LN | Score | P-value |
|---|---|---|---|---|---|---|
| 22944805_f2_344 | 1304 | 8475 | 348 | 115 | 139 | 2.5e-09 |

Description gp:[GI:d1045488:g5139695] [LN:AB029147] [AC:AB029147] [OR:Cucumis sativus] [SR:Cucumis sativus cDNA to mRNA] [DB:genpept-pln1] [DE:Cucumis sativus mRNA expressed in cucumber hypocotyls, completecds.] [NT:expressed in cucumber hypocotyls] [LE:21] [RE:752] [DI:direct]

| ORF Name | NT ID | AA ID | NT LN | AA LN | Score | P-value |
|---|---|---|---|---|---|---|
| 23478407_c3_1376 | 1305 | 8476 | 465 | 154 | 730 | 3.7e-72 |

Description sp:[LN:YJEE_ECOLI] [AC:P31805] [GN:YJEE] [OR:Escherichia coli] [DE:(URF2)] [SP:P31805] [DB:swissprot] >sp:[LN:S56393] [AC:S56393:C65227:S40054:S41740] [PN:hypothetical 16.9K protein (psd-amiB intergenic region):hypothetical protein o153a] [GN:yjeE] [CL:hypothetical protein HI0065] [OR:Escherichia coli] [DB:pir2] >gp:[GI:g304913] [LN:ECOMUTL] [AC:L19346] [FN:unknown] [OR:Escherichia coli] [SR:Escherichia coli (strain K-12) (library: Clarke-Carbon) DNA] [DB:genpept-bct1] [DE:Escherichia coli N-acetylmuramoyl-L-alanine amidase (amiB) gene,complete cds, DNA repair protein (mutL) gene, partial cds, and twounidentified cds's.] [NT:possibly observed in minicells (Citation 3);] [LE:1106] [RE:1567] [DI:direct] >gp:[GI:g537009] [LN:ECOUW93] [AC:U14003] [GN:yjeE] [OR:Escherichia coli] [DB:genpept-bct1] [DE:Escherichia coli K-12 chromosomal region from 92.8 to 00.1 minutes.] [NT:urf2 of GenBank Accession Number L19346] [LE:86413] [RE:86874] [DI:direct] >gp:[GI:g1790610] [LN:AE000489] [AC:AE000489:U00096] [PN:orf, hypothetical protein] [GN:yjeE] [FN:orf; Unknown] [OR:Escherichia coli] [DB:genpept-bct2] [DE:Escherichia coli K-12 MG1655 section 379 of 400 of the completegenome.] [NT:o153a; 100 pct identical amino acid sequence and] [LE:3299] [RE:3760] [DI:direct]

| ORF Name | NT ID | AA ID | NT LN | AA LN | Score | P-value |
|---|---|---|---|---|---|---|
| 23567037_f1_32 | 1306 | 8477 | 417 | 138 | 613 | 9.2e-60 |

Description sp:[LN:FRDC_ECOLI] [AC:P03805] [GN:FRDC] [OR:Escherichia coli] [DE:FUMARATE
REDUCTASE 15 KD HYDROPHOBIC PROTEIN] [SP:P03805] [DB:swissprot] >sp:[LN:S56380]
[AC:S56380:F65225] [PN:succinate dehydrogenase, frdC:fumarate reductase, membrane
anchor polypeptide] [GN:frdC] [CL:fumarate reductase 15K protein] [OR:Escherichia
coli] [EC:1.3.99.1] [DB:pir2] >gp:[GI:g41483] [LN:ECFRDB] [AC:V00277]
[OR:Escherichia coli] [DB:genpept-bct1] [DE:Fragments of the E. coli genes frdB
and ampC. frd is the gene forfumarate reductase and ampC codes for a
beta-lactamase (E.coliK-12). Two unknown reading frames are also found.]
[NT:unknown gene] [SP:P03805] [LE:42] [RE:437] [DI:direct] >gp:[GI:g145265]
[LN:ECOAMPCFR] [AC:J01611:J01583] [OR:Escherichia coli] [SR:Escherichia coli
(strain K-12) DNA] [DB:genpept-bct1] [DE:E.coli frd operon, fumarate reductase
(flavoprotein subunit frdAand iron/sulfur subunit frdB), and beta-lactamase
(ampC) genes,complete cds.] [NT:g15 protein] [LE:3328] [RE:3723] [DI:direct]
>gp:[GI:g536996] [LN:ECOUW93] [AC:U14003] [PN:fumarate reductase, membrane anchor
polypeptide] [GN:frdC] [OR:Escherichia coli] [DB:genpept-bct1] [EC:1.3.99.1]
[DE:Escherichia coli K-12 chromosomal region from 92.8 to 00.1 minutes.] [NT:CG
Site No. 740] [LE:70205] [RE:70600] [DI:complement] >gp:[GI:g1790595]
[LN:AE000487] [AC:AE000487:U00096] [PN:fumarate reductase, anaerobic, membrane
anchor] [GN:frdC] [FN:enzyme; Energy metabolism, carbon: Anaerobic]
[OR:Escherichia coli] [DB:genpept-bct2] [EC:1.3.99.1] [DE:Escherichia coli K-12
MG1655 section 377 of 400 of the completegenome.] [NT:f131; 100 pct identical to
FRDC_ECOLI SW: P03805;] [LE:10867] [RE:11262] [DI:complement]

| ORF Name | NT ID | AA ID | NT LN | AA LN | Score | P-value |
|---|---|---|---|---|---|---|
| 23634711_f3_678 | 1307 | 8478 | 744 | 247 | 247 | 5.6e-21 |

Description sp:[LN:YGAZ_ECOLI] [AC:P76630] [GN:YGAZ] [OR:Escherichia coli] [DE:HYPOTHETICAL
26.1 KD PROTEIN IN PROX-MPRA INTERGENIC REGION] [SP:P76630] [DB:swissprot]
>sp:[LN:C65048] [AC:C65048] [PN:hypothetical protein b2682] [CL:hypothetical
protein b2682] [OR:Escherichia coli] [DB:pir1] >gp:[GI:g1789038] [LN:AE000353]
[AC:AE000353:U00096] [PN:orf, hypothetical protein] [GN:b2682] [FN:orf; Unknown]
[OR:Escherichia coli] [DB:genpept-bct2] [DE:Escherichia coli K-12 MG1655 section
243 of 400 of the completegenome.] [NT:o245; This 245 aa ORF is 25 pct identical
(8 gaps)] [LE:92] [RE:829] [DI:direct]

| ORF Name | NT ID | AA ID | NT LN | AA LN | Score | P-value |
|---|---|---|---|---|---|---|
| 23876302_c2_1043 | 1308 | 8479 | 273 | 90 | | |

Description

NO-HIT

| ORF Name | NT ID | AA ID | NT LN | AA LN | Score | P-value |
|---|---|---|---|---|---|---|
| 24005301_f2_285 | 1309 | 8480 | 1041 | 346 | 1557 | 8.5e-160 |

Description sp:[LN:YJEK_ECOLI] [AC:P39280] [GN:YJEK] [OR:Escherichia coli] [DE:HYPOTHETICAL
38.7 KD PROTEIN IN MOPA-EFP INTERGENIC REGION] [SP:P39280] [DB:swissprot]
>sp:[LN:S56374] [AC:S56374:H65224] [PN:hypothetical 38.7K protein (mopa-efp
intergenic region):hypothetical protein f342] [GN:yjeK] [CL:conserved
hypothetical protein yod0] [OR:Escherichia coli] [DB:pir1] >gp:[GI:g536990]
[LN:ECOUW93] [AC:U14003] [OR:Escherichia coli] [DB:genpept-bct1] [DE:Escherichia
coli K-12 chromosomal region from 92.8 to 00.1 minutes.] [NT:ORF_f342] [LE:65457]
[RE:66485] [DI:complement] >gp:[GI:g1790589] [LN:AE000487] [AC:AE000487:U00096]
[PN:orf, hypothetical protein] [GN:yjeK] [FN:orf; Unknown] [OR:Escherichia coli]
[DB:genpept-bct2] [DE:Escherichia coli K-12 MG1655 section 377 of 400 of the
completegenome.] [NT:f342; 100 pct identical amino acid sequence and] [LE:6119]
[RE:7147] [DI:complement]

| ORF Name | NT ID | AA ID | NT LN | AA LN | Score | P-value |
|---|---|---|---|---|---|---|
| 24027005_f3_655 | 1310 | 8481 | 1008 | 335 | 1469 | 1.8e-150 |

Description sp:[LN:QOR_ECOLI] [AC:P28304] [GN:QOR:HCZ] [OR:Escherichia coli] [EC:1.6.5.5]
[DE:CRYSTALLIN HOMOLOG PROTEIN)] [SP:P28304] [DB:swissprot] >sp:[LN:S45529]
[AC:S45529:B65213] [PN:quinone oxidoreductase,] [GN:qor] [CL:alcohol
dehydrogenase:long-chain alcohol dehydrogenase homology] [OR:Escherichia coli]
[EC:1.6.5.5] [DB:pir1] >gp:[GI:g145766] [LN:ECODNABA] [AC:L02312] [PN:quinone
oxidoreductase] [GN:qor] [OR:Escherichia coli] [SR:Escherichia coli (strain K-12)
DNA] [DB:genpept-bct1] [DE:Escherichia coli helicase (dnaB) gene, 5' end, and
quinoneoxidoreductase (qor) gene, complete cds.] [LE:553] [RE:1536] [DI:direct]
>gp:[GI:g1790485] [LN:AE000478] [AC:AE000478:U00096] [PN:quinone oxidoreductase]
[GN:qor] [FN:enzyme; Energy metabolism, carbon: Electron] [OR:Escherichia coli]
[DB:genpept-bct2] [EC:1.6.5.5] [DE:Escherichia coli K-12 MG1655 section 368 of
400 of the completegenome.] [NT:f327; 100 pct identical amino acid sequence and]
[LE:4087] [RE:5070] [DI:complement] >gp:[GI:g396386] [LN:ECOUW89] [AC:U00006]
[PN:quinone oxidoreductase] [GN:qor] [OR:Escherichia coli] [SR:Escherichia coli
(sub_strain MG1655, strain K-12) (library: lambda] [DB:genpept-bct2] [DE:E. coli
chromosomal region from 89.2 to 92.8 minutes.] [LE:128492] [RE:129475]
[DI:complement]

| ORF Name | NT ID | AA ID | NT LN | AA LN | Score | P-value |
|---|---|---|---|---|---|---|
| 24066662_f3_570 | 1311 | 8482 | 873 | 290 | 1390 | 4.2e-142 |

Description gp:[GI:g147205] [LN:ECOPHNAQ] [AC:J05260] [OR:Escherichia coli] [SR:E.coli
(strain B) DNA] [DB:genpept-bct1] [DE:E.coli psiD locus containing
alkylphosphonate uptake (phn) genes Athrough Q, complete cds.] [NT:phnJ protein]
[LE:9894] [RE:10739] [DI:direct]

| ORF Name | NT ID | AA ID | NT/LN | AA/LN | Score | P-value |
|---|---|---|---|---|---|---|
| 242067_c1_900 | 1312 | 8483 | 183 | 60 | | |

Description

NO-HIT

| ORF Name | NT ID | AA ID | NT/LN | AA/LN | Score | P-value |
|---|---|---|---|---|---|---|
| 24253502_c2_1015 | 1313 | 8484 | 1161 | 386 | 635 | 4.3e-62 |

Description sp:[LN:H72555] [AC:H72555] [PN:probable transporter ATP-binding protein APE1732]
[GN:APE1732] [OR:Aeropyrum pernix] [DB:pir2] >gp:[GI:d1044519:g5105420]
[LN:AP000062] [AC:AP000062] [PN:358aa long hypothetical transporter ATP-binding]
[GN:APE1732] [OR:Aeropyrum pernix] [SR:Aeropyrum pernix (strain:K1) DNA]
[DB:genpept-bct1] [DE:Aeropyrum pernix genomic DNA, section 5/7.] [NT:similar to
OWL:AB00946517 percent identity:65.106] [LE:111530] [RE:112606] [DI:direct]

| ORF Name | NT ID | AA ID | NT/LN | AA/LN | Score | P-value |
|---|---|---|---|---|---|---|
| 24276626_c2_1023 | 1314 | 8485 | 477 | 158 | 713 | 2.3e-70 |

Description sp:[LN:SOXR_ECOLI] [AC:P22538] [GN:SOXR:MARC] [OR:Escherichia coli] [DE:SOXR
PROTEIN] [SP:P22538] [DB:swissprot] >sp:[LN:JS0577]
[AC:JS0577:S48067:I69432:F65214:S22302] [PN:soxR protein] [GN:soxR]
[OR:Escherichia coli] [DB:pir2] [MP:92.2 min] >gp:[GI:g147849] [LN:ECOSOXRS]
[AC:M60111] [GN:soxR] [OR:Escherichia coli] [SR:E.coli (strain K-12) DNA]
[DB:genpept-bct1] [DE:E.coli SoxR and SoxS protein (soxR, soxS) genes, complete
cds.] [NT:putative] [LE:573] [RE:1037] [DI:direct] >gp:[GI:g42976] [LN:ECSOXSR]
[AC:X59593] [GN:soxR] [OR:Escherichia coli] [DB:genpept-bct1] [DE:E.coli soxS and
soxR regulatory genes for superoxide strengthresponse.] [SP:P22538] [LE:750]
[RE:1214] [DI:direct] >gp:[GI:g1790498] [LN:AE000479] [AC:AE000479:U00096]
[PN:redox-sensing activator of soxS] [GN:soxR] [FN:regulator; Global regulatory
functions] [OR:Escherichia coli] [DB:genpept-bct2] [DE:Escherichia coli K-12
MG1655 section 369 of 400 of the completegenome.] [NT:o154; 100 pct identical
amino acid sequence and] [LE:8448] [RE:8912] [DI:direct] >gp:[GI:g396398]
[LN:ECOUW89] [AC:U00006] [GN:soxR] [FN:involved in regulation of superoxide
response] [OR:Escherichia coli] [SR:Escherichia coli (sub_strain MG1655, strain
K-12) (library: lambda] [DB:genpept-bct2] [DE:E. coli chromosomal region from
89.2 to 92.8 minutes.] [LE:142709] [RE:143173] [DI:direct]

| ORF Name | NT ID | AA ID | NT/LN | AA/LN | Score | P-value |
|---|---|---|---|---|---|---|
| 24297082_c1_825 | 1315 | 8486 | 942 | 313 | 592 | 1.5e-57 |

Description gp:[GI:g5738281] [LN:AF034855] [AC:AF034855] [OR:Agrobacterium tumefaciens]
[DB:genpept-bct2] [DE:Agrobacterium tumefaciens plasmid pTiA6NC hypothetical
proteingenes, complete cds.] [NT:ORF20] [LE:21844] [RE:22779] [DI:complement]

| ORF Name | NT ID | AA ID | NT/LN | AA/LN | Score | P-value |
|---|---|---|---|---|---|---|
| 24307332_f2_313 | 1316 | 8487 | 1431 | 476 | 1749 | 3.8e-180 |

Description gp:[GI:g1185391] [LN:YPU22837] [AC:U22837] [PN:HmsR] [GN:hmsR] [FN:involved the regulation of the hms locus hemin] [OR:Yersinia pestis] [DB:genpept-bct2] [DE:Yersinia pestis HmsH (hmsH), HmsF (hmsF), HmsR (hmsR), and HmsS(hmsS) genes, complete cds.] [NT:possible integral inner membrane protein; 52 kDa,] [LE:5712] [RE:7085] [DI:direct]

| ORF Name | NT ID | AA ID | NT/LN | AA/LN | Score | P-value |
|---|---|---|---|---|---|---|
| 2439512_f1_19 | 1317 | 8488 | 1035 | 344 | 1505 | 2.7e-154 |

Description sp:[LN:DPSD_ECOLI] [AC:P10740] [GN:PSD] [OR:Escherichia coli] [EC:4.1.1.65] [DE:PHOSPHATIDYLSERINE DECARBOXYLASE PROENZYME,] [SP:P10740] [DB:swissprot] >sp:[LN:A29234] [AC:A29234:S56388:F65226] [PN:phosphatidylserine decarboxylase, precursor] [GN:psd] [OR:Escherichia coli] [EC:4.1.1.65] [DB:pir2] [MP:95 min] >gp:[GI:g551827] [LN:ECOPSD] [AC:J03916] [PN:phosphatidylserine decarboxylase] [OR:Escherichia coli] [SR:Escherichia coli (sub_strain CS520, strain K-12) (clone: pLC8-47.] [DB:genpept-bct1] [DE:E.coli psd gene encoding phosphatidylserine decarboxylase, completecds.] [NT:precursor] [LE:280] [RE:1248] [DI:direct] >gp:[GI:g537004] [LN:ECOUW93] [AC:U14003] [PN:phosphatidylserine decarboxylase] [GN:psd] [OR:Escherichia coli] [DB:genpept-bct1] [DE:Escherichia coli K-12 chromosomal region from 92.8 to 00.1 minutes.] [NT:CG Site No. 356; TTG start codon] [LE:80220] [RE:81188] [DI:complement] >gp:[GI:g1790604] [LN:AE000488] [AC:AE000488:U00096] [PN:phosphatidylserine decarboxylase; phospholipid] [GN:psd] [FN:enzyme; Macromolecule synthesis, modification:] [OR:Escherichia coli] [DB:genpept-bct2] [EC:4.1.1.65] [DE:Escherichia coli K-12 MG1655 section 378 of 400 of the completegenome.] [NT:f322; 100 pct identical to DPSD_ECOLI SW: P10740;] [LE:7051] [RE:8019] [DI:complement]

| ORF Name | NT ID | AA ID | NT/LN | AA/LN | Score | P-value |
|---|---|---|---|---|---|---|
| 24417836_c1_852 | 1318 | 8489 | 1515 | 504 | 2383 | 2.5e-247 |

Description gp:[GI:g1661219] [LN:ECU75904] [AC:U75904] [PN:ProP] [GN:proP] [FN:compatible solute transporter] [OR:Escherichia coli] [DB:genpept-bct2] [DE:Escherichia coli compatible solute transporter ProP (proP) gene,complete cds.] [LE:283] [RE:1785] [DI:direct]

| ORF Name | NT ID | AA ID | NT LN | AA LN | Score | P-value |
|---|---|---|---|---|---|---|
| 24429838_cl_760 | 1319 | 8490 | 879 | 292 | 1351 | 5.7e-138 |

Description sp:[LN:UBIA_ECOLI] [AC:P26601] [GN:UBIA:CYR] [OR:Escherichia coli] [EC:2.5.1.-]
[DE:POLYPRENYLTRANSFERASE)] [SP:P26601] [DB:swissprot] >sp:[LN:JC2316]
[AC:JC2316:S24361:B42956:S25661:S31432:PC1295:I70801;] [PN:4-hydroxybenzoate
octaprenyltransferase,] [GN:ubiA:cyr] [OR:Escherichia coli] [EC:2.5.1.-]
[DB:pir2] [MP:92 min] >gp:[GI:g41181] [LN:ECCY] [AC:X69522] [GN:cyr]
[OR:Escherichia coli] [DB:genpept-bct1] [DE:E.coli cyr gene.] [SP:P26601]
[LE:134] [RE:1006] [DI:direct] >gp:[GI:g148101] [LN:ECOUBICA] [AC:M93136]
[PN:4-hydroxybenzoate-octaprenyl transferase] [GN:ubiA] [FN:enzymatic -
3-octaprenyl-4-hydroxybenzoate] [OR:Escherichia coli] [SR:Escherichia coli
(sub_strain W3110, strain K-12} (library: Kohar] [DB:genpept-bct1]
[DE:Escherichia coli chorismate lyase (ubiC), 4-hydroxybenzoateoctaprenyl
transferase (ubiA) genes, complete cds, andsn-glycerol-3-phosphate
acyltransferase (plsB) genes, 3' end.] [LE:890] [RE:1762] [DI:direct]
>gp:[GI:g148108] [LN:ECOUBIPLS] [AC:M93413] [PN:4-hydroxybenzoate-octaprenyl
transferase] [GN:ubiA] [FN:enzymatic - 3-octaprenyl-4-hydroxybenzoate]
[OR:Escherichia coli] [SR:Escherichia coli (sub_strain W3110, strain K-12)
(library: Kohar] [DB:genpept-bct1] [DE:Escherichia coli 4-hydroxybenzoate
octaprenyl transferase (ubiA)gene complete cds, chorismate lyase (ubiC) gene
complete cds,sn-glycerol-3-phosphate acyltransferase (plsB) gene, 3' end.]
[LE:890] [RE:1762] [DI:direct] >gp:[GI:g43232] [LN:ECUBI] [AC:X66619:S41687]
[PN:4-hydroxybenzoate-octaprenyl transferase] [GN:ubiA] [OR:Escherichia coli]
[DB:genpept-bct1] [DE:E.coli genes ubiC and ubiA.] [SP:P26601] [LE:1080]
[RE:1952] [DI:direct] >gp:[GI:g43235] [LN:ECUBIAC] [AC:X57434]
[PN:4-hydroxybenzoate octaprenyltransferase] [GN:ubiA] [OR:Escherichia coli]
[DB:genpept-bct1] [DE:E.coli ubiC and ubiA genes for chorismate lyase
and4-hydroxybenzoate octaprenyltransferase.] [SP:P26601] [LE:912] [RE:1784]
[DI:direct] >gp:[GI:g1790473] [LN:AE000477] [AC:AE000477:U00096]
[PN:4-hydroxybenzoate-octaprenyltransferase] [GN:ubiA] [FN:enzyme; Biosynthesis
of cofactors, carriers:] [OR:Escherichia coli] [DB:genpept-bct2] [EC:2.5.1.-]
[DE:Escherichia coli K-12 MG1655 section 367 of 400 of the completegenome.]
[NT:o290b; 99 pct identical amino acid sequence and] [LE:5111] [RE:5983]
[DI:direct]

| ORF Name | NT ID | AA ID | NT LN | AA LN | Score | P-value |
|---|---|---|---|---|---|---|
| 24486313_f2_486 | 1320 | 8491 | 483 | 160 | 626 | 3.8e-61 |

Description sp:[LN:YJAB_ECOLI] [AC:P09163] [GN:YJAB] [OR:Escherichia coli] [DE:HYPOTHETICAL
16.4 KD PROTEIN IN RRFE-META INTERGENIC REGION (F147)] [SP:P09163] [DB:swissprot]
>sp:[LN:Q3ECE6] [AC:B24340:C65208] [PN:hypothetical 16.4K protein (rrfE-metA
intergenic region)] [GN:yjaB] [CL:Escherichia coli hypothetical 16.4K protein
(rrfE-metA intergenic region)] [OR:Escherichia coli] [DB:pir1] [MP:90 min]
>gp:[GI:g42884] [LN:ECRRNE1] [AC:X02800] [OR:Escherichia coli] [DB:genpept-bct1]
[DE:E. coli 5' end of rrnE operon for 5S rRNA and downstream region.]
[NT:unidentified reading frame (pot. aa 1-147)] [SP:P09163] [LE:641] [RE:1084]
[DI:complement] >gp:[GI:g1790442] [LN:AE000474] [AC:AE000474:U00096] [PN:orf,
hypothetical protein] [GN:yjaB] [FN:orf; Unknown] [OR:Escherichia coli]
[DB:genpept-bct2] [DE:Escherichia coli K-12 MG1655 section 364 of 400 of the
completegenome.] [NT:f147; 100 pct identical amino acid sequence and] [LE:5811]
[RE:6254] [DI:complement] >gp:[GI:g396347] [LN:ECOUW89] [AC:U00006]
[OR:Escherichia coli] [SR:Escherichia coli (sub_strain MG1655, strain K-12)
(library: lambda) [DB:genpept-bct2] [DE:E. coli chromosomal region from 89.2 to
92.8 minutes.] [NT:alternate name yjaB] [LE:78922] [RE:79365] [DI:complement]

| ORF Name | NT ID | AA ID | NT LN | AA LN | Score | P-value |
|---|---|---|---|---|---|---|
| 24614591_c1_824 | 1321 | 8492 | 825 | 274 | 429 | 2.9e-40 |

Description sp:[LN:S28674] [AC:S28674] [PN:hypothetical protein 2] [CL:ompR protein:response
regulator homology] [OR:Rhizobium sp.] [DB:pir1] >gp:[GI:g152259] [LN:RHMLCRATOE]
[AC:M38698] [GN:lcrB] [OR:Rhizobium sp.] [SR:Rhizobium sp (strain IC 3342)
(clone: pMNU4) (clone library: cosmi) [DB:genpept-bct1] [DE:Rhizobium sp.
lcrABCDE genes, complete cds's.] [LE:929] [RE:1645] [DI:direct]

| ORF Name | NT ID | AA ID | NT LN | AA LN | Score | P-value |
|---|---|---|---|---|---|---|
| 24640902_f1_215 | 1322 | 8493 | 1284 | 427 | 599 | 2.8e-58 |

Description sp:[LN:YHAM_ECOLI] [AC:P42626] [GN:YHAM] [OR:Escherichia coli] [DE:HYPOTHETICAL
19.4 KD PROTEIN IN EXUR-TDCC INTERGENIC REGION (F188)] [SP:P42626] [DB:swissprot]
>sp:[LN:A65100] [AC:A65100] [PN:hypothetical 19.4 kD protein in exuR-tdcC
intergenic region] [GN:yhaM] [OR:Escherichia coli] [DB:pir2] >gp:[GI:g1789495]
[LN:AE000392] [AC:AE000392:U00096] [PN:orf, hypothetical protein] [GN:yhaM]
[FN:orf; Unknown] [OR:Escherichia coli] [DB:genpept-bct2] [DE:Escherichia coli
K-12 MG1655 section 282 of 400 of the completegenome.] [NT:f188; 100 pct
identical amino acid sequence and] [LE:6483] [RE:7049] [DI:complement]
>gp:[GI:g606049] [LN:ECOUW67] [AC:U18997] [OR:Escherichia coli] [DB:genpept-bct2]
[DE:Escherichia coli K-12 chromosomal region from 67.4 to 76.0 minutes.]
[NT:ORF_f188] [LE:36094] [RE:36660] [DI:complement]

| ORF Name | NT ID | AA ID | NT/LN | AA/LN | Score | P-value |
|---|---|---|---|---|---|---|
| 24648302_f3_597 | 1323 | 8494 | 693 | 230 | 782 | 1.1e-77 |

Description sp:[LN:YJCO_ECOLI] [AC:P32713] [GN:YJCO] [OR:Escherichia coli] [DE:(F229)]
[SP:P32713] [DB:swissprot] >sp:[LN:E65216] [AC:E65216] [PN:hypothetical 25.1 kD
protein in gltp-fdhf intergenic region] [GN:yjcO] [OR:Escherichia coli] [DB:pir2]
>gp:[GI:g1790515] [LN:AE000481] [AC:AE000481:U00096] [PN:orf, hypothetical
protein] [GN:yjcO] [FN:orf; Unknown] [OR:Escherichia coli] [DB:genpept-bct2]
[DE:Escherichia coli K-12 MG1655 section 371 of 400 of the completegenome.]
[NT:f229b; 100 pct identical amino acid sequence and] [LE:4994] [RE:5683]
[DI:complement] >gp:[GI:g396413] [LN:ECOUW89] [AC:U00006] [OR:Escherichia coli]
[SR:Escherichia coli (sub_strain MG1655, strain K-12) (library: lambda]
[DB:genpept-bct2] [DE:E. coli chromosomal region from 89.2 to 92.8 minutes.]
[LE:161676] [RE:162365] [DI:complement]

| ORF Name | NT ID | AA ID | NT/LN | AA/LN | Score | P-value |
|---|---|---|---|---|---|---|
| 24650442_c2_1021 | 1324 | 8495 | 246 | 81 | | |

Description

NO-HIT

| ORF Name | NT ID | AA ID | NT/LN | AA/LN | Score | P-value |
|---|---|---|---|---|---|---|
| 24824066_c2_968 | 1325 | 8496 | 1125 | 374 | 1804 | 5.7e-186 |

Description gp:[GI:e313836:g2052275] [LN:STMAL] [AC:X54292] [GN:malK] [OR:Salmonella
typhimurium] [DB:genpept-bct1] [DE:S.typhimurium malM, malL(LamB), malK, malE,
malF & malG genes.] [LE:3086] [RE:4195] [DI:complement]

| ORF Name | NT ID | AA ID | NT/LN | AA/LN | Score | P-value |
|---|---|---|---|---|---|---|
| 24878186_f3_564 | 1326 | 8497 | 960 | 319 | 1343 | 4.0e-137 |

Description sp:[LN:MELR_ECOLI] [AC:P10411] [GN:MELR] [OR:Escherichia coli] [DE:MELIBIOSE
OPERON REGULATORY PROTEIN] [SP:P10411] [DB:swissprot] >sp:[LN:RGECMB]
[AC:A29625:S56347:E65221] [PN:melibiose operon regulatory protein] [GN:melR]
[CL:arabinose operon regulatory protein] [OR:Escherichia coli] [DB:pir1] [MP:93
min] >gp:[GI:g536963] [LN:ECOUW93] [AC:U14003] [GN:melR] [FN:regulatory gene]
[OR:Escherichia coli] [DB:genpept-bct1] [DE:Escherichia coli K-12 chromosomal
region from 92.8 to 00.1 minutes.] [NT:CG Site No. 18166] [LE:31548] [RE:32456]
[DI:complement] >gp:[GI:g1790559] [LN:AE000484] [AC:AE000484:U00096]
[PN:regulator of melibiose operon] [GN:melR] [FN:regulator; Degradation of small
molecules:] [OR:Escherichia coli] [DB:genpept-bct2] [DE:Escherichia coli K-12
MG1655 section 374 of 400 of the completegenome.] [NT:f302; CG Site No. 18166]
[LE:5093] [RE:6001] [DI:complement]

| ORF_Name | NT_ID | AA_ID | NT/LN | AA/LN | Score | P-value |
|---|---|---|---|---|---|---|
| 24882187_f1_57 | 1327 | 8498 | 1320 | 439 | 1542 | 3.3e-158 |

Description sp:[LN:DCUA_WOLSU] [AC:O34245:Q56744] [GN:DCUA] [OR:Wolinella succinogenes]
[DE:ANAEROBIC C4-DICARBOXYLATE TRANSPORTER DCUA] [SP:O34245:Q56744]
[DB:swissprot] >gp:[GI:e1186590:g2644960] [LN:WSAJ2933] [AC:AJ002933]
[PN:C4-dicarboxylate membrane transporter] [GN:dcuA] [OR:Wolinella succinogenes]
[DB:genpept-bct1] [DE:Wolinella succinogenes aspA, dcuA genes and partial ansA
gene.] [SP:O34245] [LE:1828] [RE:3129] [DI:direct]

| ORF_Name | NT_ID | AA_ID | NT/LN | AA/LN | Score | P-value |
|---|---|---|---|---|---|---|
| 24886287_f2_280 | 1328 | 8499 | 1806 | 601 | 2989 | 0.0 |

Description sp:[LN:RDECFF] [AC:A00376:S56382:H65225] [PN:fumarate reductase, flavoprotein]
[GN:frdA] [CL:fumarate reductase flavoprotein:3-oxosteroid 1-dehydrogenase
homology:fumarate reductase flavoprotein homology] [OR:Escherichia coli]
[EC:1.3.99.1] [DB:pir1] [MP:94 min] >gp:[GI:g536998] [LN:ECOUW93] [AC:U14003]
[PN:fumarate reductase, flavoprotein subunit] [GN:frdA] [OR:Escherichia coli]
[DB:genpept-bct1] [EC:1.3.99.1] [DE:Escherichia coli K-12 chromosomal region from
92.8 to 00.1 minutes.] [NT:CG Site No. 742] [LE:71338] [RE:73146] [DI:complement]
>gp:[GI:g1790597] [LN:AE000487] [AC:AE000487:U00096] [PN:fumarate reductase,
anaerobic, flavoprotein] [GN:frdA] [FN:enzyme; Energy metabolism, carbon:
Anaerobic] [OR:Escherichia coli] [DB:genpept-bct2] [EC:1.3.99.1] [DE:Escherichia
coli K-12 MG1655 section 377 of 400 of the completegenome.] [NT:f602; 100 pct
identical to FRDA_ECOLI SW: P00363;] [LE:12000] [RE:13808] [DI:complement]

| ORF_Name | NT_ID | AA_ID | NT/LN | AA/LN | Score | P-value |
|---|---|---|---|---|---|---|
| 2515903_f2_309 | 1329 | 8500 | 2562 | 853 | 1746 | 8.0e-180 |

Description gp:[GI:e1331964:g4106595] [LN:YP102KB] [AC:AL031866] [GN:hmsH] [OR:Yersinia
pestis] [DB:genpept-bct1] [DE:Yersinia pestis 102 kbases unstable region: from 1
to 119443.] [NT:ORF27, len=822 aa, hmsH, 100% identity in 822 aa] [LE:33613]
[RE:36081] [DI:complement] >gp:[GI:g727399] [LN:YPU22837] [AC:U22837] [PN:HmsH]
[GN:hmsH] [FN:involved in hemin binding and] [OR:Yersinia pestis]
[DB:genpept-bct2] [DE:Yersinia pestis HmsH (hmsH), HmsF (hmsF), HmsR (hmsR), and
HmsS(hmsS) genes, complete cds.] [NT:outer membrane protein; 93.4/89.5 kDa, pI
5.18,] [LE:1259] [RE:3727] [DI:direct]

| ORF_Name | NT_ID | AA_ID | NT/LN | AA/LN | Score | P-value |
|---|---|---|---|---|---|---|
| 25489126_f1_221 | 1330 | 8501 | 270 | 89 | | |

Description

NO-HIT

| ORF Name | NT ID | AA ID | NT LN | AA LN | Score | P-value |
|---|---|---|---|---|---|---|
| 25523568_c2_945 | 1331 | 8502 | 1647 | 548 | 2413 | 1.7e-250 |

Description sp:[LN:YJBB_ECOLI] [AC:P32683] [GN:YJBB] [OR:Escherichia coli] [DE:HYPOTHETICAL
59.5 KD PROTEIN IN METH-PEPE INTERGENIC REGION] [SP:P32683] [DB:swissprot]
>sp:[LN:C65209] [AC:C65209] [PN:hypothetical 59.5 kD protein in meth-pepe
intergenic region] [GN:yjbB] [OR:Escherichia coli] [DB:pir2] >gp:[GI:g1790451]
[LN:AE000475] [AC:AE000475:U00096] [PN:putative alpha helix protein] [GN:yjbB]
[FN:phenotype; Not classified] [OR:Escherichia coli] [DB:genpept-bct2]
[DE:Escherichia coli K-12 MG1655 section 365 of 400 of the completegenome.]
[NT:o543; 100 pct identical amino acid sequence and] [LE:5087] [RE:6718]
[DI:direct] >gp:[GI:g409795] [LN:ECOUW89] [AC:U00006] [OR:Escherichia coli]
[SR:Escherichia coli (sub_strain MG1655, strain K-12) (library: lambda)]
[DB:genpept-bct2] [DE:E. coli chromosomal region from 89.2 to 92.8 minutes.]
[LE:92973] [RE:94604] [DI:direct]

| ORF Name | NT ID | AA ID | NT LN | AA LN | Score | P-value |
|---|---|---|---|---|---|---|
| 25587837_c1_929 | 1332 | 8503 | 954 | 317 | 1486 | 2.8e-152 |

Description sp:[LN:MIAA_ECOLI] [AC:P16384] [GN:MIAA:TRPX] [OR:Escherichia coli:and Shigella
flexneri] [EC:2.5.1.8] [DE:(IPP TRANSFERASE)] [SP:P16384] [DB:swissprot]
>sp:[LN:B37318] [AC:B37318:S56396:PS0377:S33987:S26833:PV0008:F65227]
[PN:delta(2)-isopentenylpyrophosphate transferase,] [GN:miaA]
[CL:delta(2)-isopentenylpyrophosphate transferase] [OR:Escherichia coli]
[EC:2.5.1.-] [DB:pir2] [MP:95 min] >gp:[GI:d1023495:g2506034] [LN:AB000785]
[AC:AB000785] [PN:tRNA delta 2-isopentenylpyrophosphate] [GN:miaA] [OR:Shigella
flexneri] [SR:Shigella flexneri (strain:2a, isolate:YSH6000) DNA]
[DB:genpept-bct1] [DE:Shigella flexneri gene for tRNA delta
2-isopentenylpyrophosphatetransferase, complete cds.] [LE:56] [RE:1006]
[DI:direct] >gp:[GI:g146860] [LN:ECOMIAA] [AC:M63655:M26956:M37459]
[PN:delta-2-isopentenyl pyrophosphate transferase] [GN:miaA] [OR:Escherichia
coli] [SR:E.coli K-12 DNA, clone pNU127] [DB:genpept-bct1] [DE:E.coli
(delta)2-isopentenyl pyrophosphate transferase (miaA) gene,complete cds, and
mutator protein (mutL) gene, 3' end.] [LE:56] [RE:1006] [DI:direct]
>gp:[GI:g537012] [LN:ECOUW93] [AC:U14003] [PN:tRNA
delta-2-isopentenylpyrophosphate (IPP)] [GN:miaA] [OR:Escherichia coli]
[DB:genpept-bct1] [DE:Escherichia coli K-12 chromosomal region from 92.8 to 00.1
minutes.] [NT:CG Site No. 18160; alternate gene name trpX] [LE:90080] [RE:91030]
[DI:direct] >gp:[GI:g1790613] [LN:AE000489] [AC:AE000489:U00096]
[PN:delta(2)-isopentenylpyrophosphate tRNA-adenosine] [GN:miaA] [FN:enzyme;
Aminoacyl tRNA synthetases, tRNA] [OR:Escherichia coli] [DB:genpept-bct2]
[EC:2.5.1.-] [DE:Escherichia coli K-12 MG1655 section 379 of 400 of the
completegenome.] [NT:o316; 100 pct identical to MIAA_ECOLI SW: P16384;] [LE:6966]
[RE:7916] [DI:direct]

| ORF_Name | NT ID | AA ID | NT/LN | AA/LN | Score | P-value |
|---|---|---|---|---|---|---|
| 25627_c1_831 | 1333 | 8504 | 720 | 239 | 122 | 2.2e-07 |

Description sp:[LN:G72493] [AC:G72493] [PN:hypothetical protein APE2590] [GN:APE2590]
[OR:Aeropyrum pernix] [DB:pir2] >gp:[GI:d1045393:g5106296] [LN:AP000064]
[AC:AP000064] [PN:115aa long hypothetical protein] [GN:APE2590] [OR:Aeropyrum
pernix] [SR:Aeropyrum pernix (strain:K1) DNA] [DB:genpept-bct1] [DE:Aeropyrum
pernix genomic DNA, section 7/7.] [LE:225821] [RE:226168] [DI:direct]

| ORF_Name | NT ID | AA ID | NT/LN | AA/LN | Score | P-value |
|---|---|---|---|---|---|---|
| 25679682_f2_342 | 1334 | 8505 | 774 | 257 | 1059 | 5.0e-107 |

Description sp:[LN:PHNP_ECOLI] [AC:P16692] [GN:PHNP] [OR:Escherichia coli] [DE:PHNP PROTEIN]
[SP:P16692] [DB:swissprot] >sp:[LN:H35719] [AC:H35719:S56320:C65218] [PN:phnP
protein] [GN:phnP] [OR:Escherichia coli] [DB:pir2] >gp:[GI:d1014981:g216605]
[LN:ECOPHN] [AC:D90227] [GN:phnP] [OR:Escherichia coli] [SR:Escherichia coli
(strain:K-12, sub_strain:W3110) DNA] [DB:genpept-bct1] [DE:Escherichia coli phn
operon genes.] [LE:10162] [RE:10920] [DI:direct] >gp:[GI:g147213] [LN:ECOPHNAQ]
[AC:J05260] [OR:Escherichia coli] [SR:E.coli (strain B) DNA] [DB:genpept-bct1]
[DE:E.coli psiD locus containing alkylphosphonate uptake (phn) genes Athrough Q,
complete cds.] [NT:phnP protein] [LE:14398] [RE:15156] [DI:direct]
>gp:[GI:g536936] [LN:ECOUW93] [AC:U14003] [GN:phnP] [OR:Escherichia coli]
[DB:genpept-bct1] [DE:Escherichia coli K-12 chromosomal region from 92.8 to 00.1
minutes.] [LE:5272] [RE:6030] [DI:complement] >gp:[GI:g1790530] [LN:AE000482]
[AC:AE000482:U00096] [PN:phosphonate metabolism] [GN:phnP] [FN:phenotype; Central
intermediary metabolism:] [OR:Escherichia coli] [DB:genpept-bct2] [DE:Escherichia
coli K-12 MG1655 section 372 of 400 of the completegenome.] [NT:f252; 100 pct
identical amino acid sequence and] [LE:9991] [RE:10749] [DI:complement]

| ORF_Name | NT ID | AA ID | NT/LN | AA/LN | Score | P-value |
|---|---|---|---|---|---|---|
| 25785827_f3_567 | 1335 | 8506 | 453 | 150 | 583 | 1.4e-56 |

Description gp:[GI:g147201] [LN:ECOPHNAQ] [AC:J05260] [OR:Escherichia coli] [SR:E.coli
(strain B) DNA] [DB:genpept-bct1] [DE:E.coli psiD locus containing
alkylphosphonate uptake (phn) genes Athrough Q, complete cds.] [NT:phnG protein]
[LE:7804] [RE:8256] [DI:direct]

| ORF_Name | NT ID | AA ID | NT/LN | AA/LN | Score | P-value |
|---|---|---|---|---|---|---|
| 25861666_c1_921 | 1336 | 8507 | 279 | 92 | | |

Description

NO-HIT

| ORF Name | NT ID | AA ID | NT/LN | AA/LN | Score | P-value |
|---|---|---|---|---|---|---|
| 2609381_c1_926 | 1337 | 8508 | 1380 | 459 | 1752 | 1.8e-180 |

Description sp:[LN:AMIB_ECOLI] [AC:P26365] [GN:AMIB] [OR:Escherichia coli] [EC:3.5.1.28]
[DE:N-ACETYLMURAMOYL-L-ALANINE AMIDASE AMIB PRECURSOR,] [SP:P26365]
[DB:swissprot] >sp:[LN:S41741] [AC:S41741:S40055:S56394:PS0376:D65227:S23012]
[PN:N-acetylmuramoyl-L-alanine amidase, precursor] [GN:amiB] [OR:Escherichia
coli] [EC:3.5.1.28] [DB:pir2] >gp:[GI:g304914] [LN:ECOMUTL] [AC:L19346]
[PN:N-acetylmuramoyl-L-alanine amidase] [GN:amiB] [FN:cell wall hydrolase]
[OR:Escherichia coli] [SR:Escherichia coli (strain K-12) (library: Clarke-Carbon)
DNA] [DB:genpept-bct1] [EC:3.5.1.28] [DE:Escherichia coli
N-acetylmuramoyl-L-alanine amidase (amiB) gene,complete cds, DNA repair protein
(mutL) gene, partial cds, and twounidentified cds's.] [NT:gene product detected
in minicells; transcribed in] [LE:1586] [RE:2923] [DI:direct] >gp:[GI:g537010]
[LN:ECOUW93] [AC:U14003] [PN:N-acetylmuramoyl-L-alanine amidase] [GN:amiB]
[OR:Escherichia coli] [DB:genpept-bct1] [EC:3.5.1.28] [DE:Escherichia coli K-12
chromosomal region from 92.8 to 00.1 minutes.] [LE:86893] [RE:88230] [DI:direct]
>gp:[GI:g1790611] [LN:AE000489] [AC:AE000489:U00096]
[PN:N-acetylmuramoyl-l-alanine amidase II; a murein] [GN:amiB] [FN:enzyme; Murein
sacculus, peptidoglycan] [OR:Escherichia coli] [DB:genpept-bct2] [EC:3.5.1.28]
[DE:Escherichia coli K-12 MG1655 section 379 of 400 of the completegenome.]
[NT:o445; 100 pct identical amino acid sequence and] [LE:3779] [RE:5116]
[DI:direct]

| ORF Name | NT ID | AA ID | NT/LN | AA/LN | Score | P-value |
|---|---|---|---|---|---|---|
| 26210952_f1_164 | 1338 | 8509 | 771 | 256 | 159 | 4.8e-10 |

Description gp:[GI:e1517630:g5531357] [LN:SCE19A] [AC:AL096852] [PN:hypothetical protein]
[GN:SCE19A.08c] [OR:Streptomyces coelicolor A3(2)] [DB:genpept-bct1]
[DE:Streptomyces coelicolor cosmid E19A.] [NT:SCE19A.08c, conserved hypothetical
protein, len:] [LE:5527] [RE:6279] [DI:complement]

| ORF Name | NT ID | AA ID | NT/LN | AA/LN | Score | P-value |
|---|---|---|---|---|---|---|
| 26250307_c2_1142 | 1339 | 8510 | 585 | 194 | 967 | 2.8e-97 |

Description sp:[LN:S34443] [AC:S34443:S56375:A65225] [PN:translation elongation factor EF-P]
[GN:efp] [CL:translation elongation factor EF-P] [OR:Escherichia coli] [DB:pir2]
>gp:[GI:g433670] [LN:ECEFPG] [AC:X61676:S67027] [PN:elongation factor P]
[OR:Escherichia coli] [DB:genpept-bct1] [DE:E.coli gene for elongation factor P
(EF-P).] [SP:P33398] [LE:253] [RE:819] [DI:direct] >gp:[GI:g536991] [LN:ECOUW93]
[AC:U14003] [PN:elongation factor P] [GN:efp] [OR:Escherichia coli]
[DB:genpept-bct1] [DE:Escherichia coli K-12 chromosomal region from 92.8 to 00.1
minutes.] [LE:66527] [RE:67093] [DI:direct] >gp:[GI:g1790590] [LN:AE000487]
[AC:AE000487:U00096] [PN:elongation factor P (EF-P)] [GN:efp] [FN:factor;
Proteins - translation and] [OR:Escherichia coli] [DB:genpept-bct2]
[DE:Escherichia coli K-12 MG1655 section 377 of 400 of the completegenome.]
[NT:o188; 100 pct identical amino acid sequence and] [LE:7189] [RE:7755]
[DI:direct]

| ORF Name | NT ID | AA ID | NT LN | AA LN | Score | P-value |
|---|---|---|---|---|---|---|
| 26277036_c2_1072 | 1340 | 8511 | 534 | 177 | 373 | 2.5e-34 |

Description sp:[LN:A35720] [AC:A35720] [PN:hypothetical 16.1K protein (phnQ 3' region):hypothetical protein 146] [OR:Escherichia coli] [DB:pir2] >gp:[GI:g455181] [LN:ECOPHNAQ] [AC:J05260] [OR:Escherichia coli] [SR:E.coli (strain B) DNA] [DB:genpept-bct1] [DE:E.coli psiD locus containing alkylphosphonate uptake (phn) genes Athrough Q, complete cds.] [NT:ORF146] [LE:7030] [RE:7470] [DI:complement]

| ORF Name | NT ID | AA ID | NT LN | AA LN | Score | P-value |
|---|---|---|---|---|---|---|
| 26365943_c2_1127 | 1341 | 8512 | 1125 | 374 | 1768 | 3.7e-182 |

Description gp:[GI:d1026153:g2980926] [LN:AB008146] [AC:AB008146] [FN:stress protein] [OR:Klebsiella pneumoniae] [SR:Klebsiella pneumoniae (strain:JCM 1662) DNA] [DB:genpept-bct1] [DE:Klebsiella pneumoniae gene for GroES protein homologue, GroELprotein homologue, partial cds.] [NT:similar to GroEL protein] [LE:306] [RE:>1927] [DI:direct]

| ORF Name | NT ID | AA ID | NT LN | AA LN | Score | P-value |
|---|---|---|---|---|---|---|
| 26454756_c1_854 | 1342 | 8513 | 1371 | 456 | 2160 | 1.1e-223 |

Description sp:[LN:AGAL_ECOLI] [AC:P06720] [GN:MELA:MEL-7] [OR:Escherichia coli] [EC:3.2.1.22] [DE:ALPHA-GALACTOSIDASE, (MELIBIASE)] [SP:P06720] [DB:swissprot] >sp:[LN:GBECAG] [AC:A26571:S56348:F65221:I52201] [PN:alpha-galactosidase,, melibiose-specific:alpha-D-galactoside galactohydrolase:melibiase] [GN:melA] [CL:melibiose-specific alpha-galactosidase] [OR:Escherichia coli] [EC:3.2.1.22] [DB:pir1] [MP:93 min] >gp:[GI:g41991] [LN:ECMELA] [AC:X04894] [OR:Escherichia coli] [DB:genpept-bct1] [DE:E. coli melA gene for alpha-galactosidase.] [NT:alpha-galactosidase (AA 1-451)] [SP:P06720] [LE:288] [RE:1643] [DI:direct] >gp:[GI:g536964] [LN:ECOUW93] [AC:U14003] [PN:alpha-galactosidase] [GN:melA] [OR:Escherichia coli] [DB:genpept-bct1] [EC:3.2.1.22] [DE:Escherichia coli K-12 chromosomal region from 92.8 to 00.1 minutes.] [NT:CG Site No. 522; alternate gene name mel-7] [LE:32739] [RE:34094] [DI:direct] >gp:[GI:g1790560] [LN:AE000484] [AC:AE000484:U00096] [PN:alpha-galactosidase] [GN:melA] [FN:enzyme; Degradation of small molecules: Carbon] [OR:Escherichia coli] [DB:genpept-bct2] [EC:3.2.1.22] [DE:Escherichia coli K-12 MG1655 section 374 of 400 of the completegenome.] [NT:o451; 100 pct identical to AGAL_ECOLI SW: P06720;] [LE:6284] [RE:7639] [DI:direct]

| ORF Name | NT ID | AA ID | NT/LN | AA/LN | Score | P-value |
|---|---|---|---|---|---|---|
| 26616701_c1_807 | 1343 | 8514 | 1413 | 470 | 2111 | 1.7e-218 |

Description sp:[LN:YJCD_ECOLI] [AC:P32702] [GN:YJCD] [OR:Escherichia coli] [DE:HYPOTHETICAL
45.7 KD PROTEIN IN SOXR-ACS INTERGENIC REGION (O449)] [SP:P32702] [DB:swissprot]
>sp:[LN:G65214] [AC:G65214] [PN:hypothetical 45.7 kD protein in soxR-acs
intergenic region] [GN:yjcD] [CL:conserved hypothetical protein HI0125]
[OR:Escherichia coli] [DB:pir2] >gp:[GI:g1790499] [LN:AE000479]
[AC:AE000479:U00096] [PN:orf, hypothetical protein] [GN:yjcD] [FN:orf; Unknown]
[OR:Escherichia coli] [DB:genpept-bct2] [DE:Escherichia coli K-12 MG1655 section
369 of 400 of the completegenome.] [NT:o449; 100 pct identical to YJCD_ECOLI SW:]
[LE:9458] [RE:10807] [DI:direct] >gp:[GI:g396399] [LN:ECOUW89] [AC:U00006]
[OR:Escherichia coli] [SR:Escherichia coli (sub_strain MG1655, strain K-12)
(library: lambda] [DB:genpept-bct2] [DE:E. coli chromosomal region from 89.2 to
92.8 minutes.] [NT:matches PS00017: ATP/GTP-binding site motif A;] [LE:143719]
[RE:145068] [DI:direct]

| ORF Name | NT ID | AA ID | NT/LN | AA/LN | Score | P-value |
|---|---|---|---|---|---|---|
| 26750925_c2_1170 | 1344 | 8515 | 477 | 158 | 677 | 1.5e-66 |

Description sp:[LN:MUTL_ECOLI] [AC:P23367] [GN:MUTL] [OR:Escherichia coli] [DE:DNA MISMATCH
REPAIR PROTEIN MUTL] [SP:P23367] [DB:swissprot] >sp:[LN:PH0853]
[AC:PH0853:S56395:A37318:S40056:E65227:S23011] [PN:methyl-directed mismatch
repair protein mutL] [GN:mutL] [CL:mismatch repair protein hexB] [OR:Escherichia
coli] [DB:pir2] [MP:95 min] >gp:[GI:g42067] [LN:ECMUTLG] [AC:Z11831] [PN:MutL
Protein] [GN:mutL] [FN:Required for Methyl-directed DNA Mismatch] [OR:Escherichia
coli] [DB:genpept-bct1] [DE:E.coli mutL and miaA genes for MutL protein
anddelta2-isopentenylpyrophosphate tRNA transferase (partial).] [SP:P23367]
[LE:267] [RE:2114] [DI:direct] >gp:[GI:g537011] [LN:ECOUW93] [AC:U14003]
[GN:mutL] [FN:methyl directed mismatch repair] [OR:Escherichia coli]
[DB:genpept-bct1] [DE:Escherichia coli K-12 chromosomal region from 92.8 to 00.1
minutes.] [NT:CG Site No. 470; alternate gene name mut-25] [LE:88240] [RE:90087]
[DI:direct] >gp:[GI:g1790612] [LN:AE000489] [AC:AE000489:U00096] [PN:enzyme in
methyl-directed mismatch repair] [GN:mutL] [FN:enzyme; DNA - replication,
repair,] [OR:Escherichia coli] [DB:genpept-bct2] [DE:Escherichia coli K-12 MG1655
section 379 of 400 of the completegenome.] [NT:o615; 100 pct identical to
MUTL_ECOLI SW: P23367;] [LE:5126] [RE:6973] [DI:direct]

| ORF Name | NT ID | AA ID | NT LN | AA LN | Score | P-value |
|---|---|---|---|---|---|---|
| 26853413_f2_319 | 1345 | 8516 | 324 | 107 | 371 | 4.0e-34 |

Description sp:[LN:YCCD_ECOLI] [AC:P36660] [GN:YCCD] [OR:Escherichia coli] [DE:HYPOTHETICAL 11.5 PROTEIN IN TORD-CBPA INTERGENIC REGION (ORF-2)] [SP:P36660] [DB:swissprot] >sp:[LN:E64841] [AC:E64841] [PN:yccD protein] [GN:yccD] [CL:Escherichia coli yccD protein] [OR:Escherichia coli] [DB:pir2] >gp:[GI:d1037127:g4062712] [LN:D90736] [AC:D90736:AB001340] [PN:Hypothetical 11.5 protein in torD-cbpA] [GN:yccD] [OR:Escherichia coli] [SR:Escherichia coli(strain:K12) DNA, clone:Kohara clone #226] [DB:genpept-bct1] [DE:Escherichia coli genomic DNA. (22.6 - 23.0 min).] [NT:ORF_ID:o227#6; similar to SwissProt Accession] [LE:17045] [RE:17350] [DI:complement] >gp:[GI:d1036752:g4062555] [LN:D90737] [AC:D90737:AB001340] [PN:Hypothetical 11.5 protein in torD-cbpA] [GN:yccD] [OR:Escherichia coli] [SR:Escherichia coli(strain:K12) DNA, clone:Kohara clone #227] [DB:genpept-bct1] [DE:Escherichia coli genomic DNA. (22.8 - 23.1 min).] [NT:ORF_ID:o227#6; similar to SwissProt Accession] [LE:8047] [RE:8352] [DI:complement] >gp:[GI:g1787234] [LN:AE000202] [AC:AE000202:U00096] [PN:orf, hypothetical protein] [GN:yccD] [FN:orf; Unknown] [OR:Escherichia coli] [DB:genpept-bct2] [DE:Escherichia coli K-12 MG1655 section 92 of 400 of the completegenome.] [NT:f101; 100 pct identical to YCCD_ECOLI SW: P36660] [LE:106] [RE:411] [DI:complement]

| ORF Name | NT ID | AA ID | NT LN | AA LN | Score | P-value |
|---|---|---|---|---|---|---|
| 27074053_f1_130 | 1346 | 8517 | 495 | 164 | 418 | 4.2e-39 |

Description sp:[LN:YJCH_ECOLI] [AC:P32706] [GN:YJCH] [OR:Escherichia coli] [DE:HYPOTHETICAL 11.7 KD PROTEIN IN SOXR-ACS INTERGENIC REGION (F104)] [SP:P32706] [DB:swissprot] >sp:[LN:C65215] [AC:C65215] [PN:hypothetical 11.7 kD protein in soxr-acs intergenic region] [GN:yjcH] [OR:Escherichia coli] [DB:pir2] >gp:[GI:g1790504] [LN:AE000480] [AC:AE000480:U00096] [PN:orf, hypothetical protein] [GN:yjcH] [FN:orf; Unknown] [OR:Escherichia coli] [DB:genpept-bct2] [DE:Escherichia coli K-12 MG1655 section 370 of 400 of the completegenome.] [NT:f104; 100 pct identical amino acid sequence and] [LE:5002] [RE:5316] [DI:complement] >gp:[GI:g396403] [LN:ECOUW89] [AC:U00006] [OR:Escherichia coli] [SR:Escherichia coli (sub_strain MG1655, strain K-12) (library: lambda] [DB:genpept-bct2] [DE:E. coli chromosomal region from 89.2 to 92.8 minutes.] [LE:150139] [RE:150453] [DI:complement]

| ORF Name | NT ID | AA ID | NT LN | AA LN | Score | P-value |
|---|---|---|---|---|---|---|
| 2765943_f3_625 | 1347 | 8518 | 387 | 128 | 511 | 5.9e-49 |

Description gp:[GI:g1421771] [LN:STU61147] [AC:U61147] [PN:SoxS] [GN:soxS] [OR:Salmonella typhimurium] [DB:genpept-bct1] [DE:Salmonella typhimurium oxidative stress regulon, SoxS (soxS) andSoxR (soxR) genes, complete cds.] [LE:314] [RE:637] [DI:complement]

| ORF Name | NT ID | AA ID | NT LN | AA LN | Score | P-value |
|---|---|---|---|---|---|---|
| 287793_f3_640 | 1348 | 8519 | 1815 | 604 | 159 | 1.2e-14 |

Description sp:[LN:JC5087] [AC:JC5087:PC4226] [PN:tannase, precursor:tannin acyl hydrolase]
[OR:Aspergillus oryzae] [EC:3.1.1.20] [DB:pir2] >gp:[GI:d1010301:g1753191]
[LN:D63338] [AC:D63338] [PN:tannase] [OR:Aspergillus oryzae] [SR:Aspergillus
oryzae DNA] [DB:genpept-pln1] [EC:3.1.1.20] [DE:Aspergillus oryzae DNA for
tannase, complete cds.] [LE:1321] [RE:3087] [DI:direct]

| ORF Name | NT ID | AA ID | NT LN | AA LN | Score | P-value |
|---|---|---|---|---|---|---|
| 2933437_f1_210 | 1349 | 8520 | 558 | 185 | 696 | 1.5e-68 |

Description sp:[LN:MALE_ECOLI] [AC:P02928] [GN:MALE] [OR:Escherichia coli] [DE:PROTEIN)
(MMBP)] [SP:P02928] [DB:swissprot] >sp:[LN:JGECM]
[AC:A03428:I54874:A65211:I54911] [PN:periplasmic maltose-binding protein
precursor:maltose binding protein 16-1] [GN:malE] [CL:maltose-binding protein]
[OR:Escherichia coli] [DB:pir1] [MP:92 min] >gp:[GI:g1790466] [LN:AE000476]
[AC:AE000476:U00096] [PN:periplasmic maltose-binding protein; substrate]
[GN:malE] [FN:transport; Transport of small molecules:] [OR:Escherichia coli]
[DB:genpept-bct2] [DE:Escherichia coli K-12 MG1655 section 366 of 400 of the
completegenome.] [NT:f396; CG Site No. 532] [LE:11940] [RE:13130] [DI:complement]
>gp:[GI:g457109] [LN:ECOMALB] [AC:J01648:J01639:K02117:M24344:M24345]
[PN:periplasmic maltose-binding protein] [GN:malE] [OR:Escherichia coli]
[SR:E.coli K12: clone pHC1; strains SE2078; MC4100, clones pLG1 an]
[DB:genpept-bct2] [DE:E.coli malB region promoter, malK-lamB and malEFG
operons:including malE, malF, malG, malK, lamB, and molA genes coding formaltose
binding and maltose uptake proteins and the lambda receptorprotein.] [LE:1726]
[RE:2916] [DI:complement] >gp:[GI:g396369] [LN:ECOUW89] [AC:U00006]
[PN:periplasmic maltose-binding protein] [GN:malE] [OR:Escherichia coli]
[SR:Escherichia coli (sub_strain MG1655, strain K-12) (library: lambda]
[DB:genpept-bct2] [DE:E. coli chromosomal region from 89.2 to 92.8 minutes.]
[NT:CG Site No. 532] [LE:110471] [RE:111661] [DI:complement]

| ORF Name | NT ID | AA ID | NT LN | AA LN | Score | P-value |
|---|---|---|---|---|---|---|
| 29722158_c3_1189 | 1350 | 8521 | 189 | 62 | 107 | 0.00012 |

Description gp:[GI:g581135] [LN:ECMTHM] [AC:X16584] [OR:Escherichia coli] [DB:genpept-bct1]
[DE:E. coli metH gene for 5-Methyltetrahydrofolate-homocysteine(vitamin B12)
methyltransferase (E.C. 2.1.1.13).] [NT:5-methyltetrahydrofolate- homocysteine
transferase] [SP:P13009] [LE:223] [RE:3825] [DI:direct]

| ORF_Name | NT ID | AA ID | NT/LN | AA/LN | Score | P-value |
|---|---|---|---|---|---|---|
| 29929833_c3_1193 | 1351 | 8522 | 984 | 327 | 1378 | 7.9e-141 |

Description sp:[LN:YJBC_ECOLI] [AC:P32684] [GN:YJBC] [OR:Escherichia coli] [DE:HYPOTHETICAL 32.5 KD PROTEIN IN PEPE-LYSC INTERGENIC REGION] [SP:P32684] [DB:swissprot] >sp:[LN:E65209] [AC:E65209] [PN:hypothetical 32.5 kD protein in pepe-lysc intergenic region] [GN:yjbC] [OR:Escherichia coli] [DB:pir2] >gp:[GI:g1790453] [LN:AE000475] [AC:AE000475:U00096] [PN:orf, hypothetical protein] [GN:yjbC] [FN:orf; Unknown] [OR:Escherichia coli] [DB:genpept-bct2] [DE:Escherichia coli K-12 MG1655 section 365 of 400 of the completegenome.] [NT:o290a; 100 pct identical amino acid sequence and] [LE:7710] [RE:8582] [DI:direct] >gp:[GI:g396357] [LN:ECOUW89] [AC:U00006] [OR:Escherichia coli] [SR:Escherichia coli (sub_strain MG1655, strain K-12) (library: lambda] [DB:genpept-bct2] [DE:E. coli chromosomal region from 89.2 to 92.8 minutes.] [LE:95596] [RE:96468] [DI:direct]

| ORF_Name | NT ID | AA ID | NT/LN | AA/LN | Score | P-value |
|---|---|---|---|---|---|---|
| 29932668_c3_1382 | 1352 | 8523 | 261 | 86 | 283 | 1.1e-24 |

Description sp:[LN:HFLX_ECOLI] [AC:P25519] [GN:HFLX] [OR:Escherichia coli] [DE:GTP-BINDING PROTEIN HFLX] [SP:P25519] [DB:swissprot] >sp:[LN:S56398] [AC:S56398:A43653:S26834:H65227] [PN:probable GTP-binding protein hflX] [GN:hflX] [CL:GTP-binding protein hflX:translation elongation factor Tu homology] [OR:Escherichia coli] [DB:pir2] >gp:[GI:g537014] [LN:ECOUW93] [AC:U14003] [GN:hflX] [OR:Escherichia coli] [DB:genpept-bct1] [DE:Escherichia coli K-12 chromosomal region from 92.8 to 00.1 minutes.] [NT:putative GTPase required for high frequency] [LE:91500] [RE:92780] [DI:direct] >gp:[GI:g1790615] [LN:AE000489] [AC:AE000489:U00096] [PN:GTP - binding subunit of protease specific for] [GN:hflX] [FN:enzyme; Degradation of proteins, peptides,] [OR:Escherichia coli] [DB:genpept-bct2] [DE:Escherichia coli K-12 MG1655 section 379 of 400 of the completegenome.] [NT:o426; 100 pct identical to HFLX_ECOLI SW:] [LE:8386] [RE:9666] [DI:direct] >gp:[GI:g436156] [LN:ECOHFLA] [AC:U00005] [GN:hflX] [OR:Escherichia coli] [SR:Escherichia coli K12] [DB:genpept-bct2] [DE:E. coli hflA locus encoding the hflX, hflK and hflC genes, hfqgene, complete cds; miaA gene, partial cds.] [NT:putative GTPase required for high frequency] [LE:1122] [RE:2402] [DI:direct]

| ORF_Name | NT ID | AA ID | NT/LN | AA/LN | Score | P-value |
|---|---|---|---|---|---|---|
| 30339715_f1_216 | 1353 | 8524 | 336 | 111 | | |

Description

NO-HIT

| ORF_Name | NT_ID | AA_ID | NT LN | AA LN | Score | P-value |
|---|---|---|---|---|---|---|
| 30570827_f3_540 | 1354 | 8525 | 438 | 145 | | |

Description

NO-HIT

| ORF_Name | NT_ID | AA_ID | NT LN | AA LN | Score | P-value |
|---|---|---|---|---|---|---|
| 30601627_f3_604 | 1355 | 8526 | 249 | 82 | | |

Description

NO-HIT

| ORF_Name | NT_ID | AA_ID | NT LN | AA LN | Score | P-value |
|---|---|---|---|---|---|---|
| 3140836_c3_1282 | 1356 | 8527 | 1317 | 438 | | |

Description

NO-HIT

| ORF_Name | NT_ID | AA_ID | NT LN | AA LN | Score | P-value |
|---|---|---|---|---|---|---|
| 31539063_f1_73 | 1357 | 8528 | 612 | 203 | 234 | 1.3e-19 |

Description gp:[GI:e1331961:g4106592] [LN:YP102KB] [AC:AL031866] [GN:hmsS] [OR:Yersinia pestis] [DB:genpept-bct1] [DE:Yersinia pestis 102 kbases unstable region: from 1 to 119443.] [NT:ORF24, len: 155 aa, hmsS, 100% identity with] [LE:29791] [RE:30258] [DI:complement] >gp:[GI:g1508787] [LN:YPU22837] [AC:U22837] [PN:HmsS] [GN:hmsS] [OR:Yersinia pestis] [DB:genpept-bct2] [DE:Yersinia pestis HmsH (hmsH), HmsF (hmsF), HmsR (hmsR), and HmsS(hmsS) genes, complete cds.] [NT:hypothetical and essential protein; pI 6.68; 17.5] [LE:7082] [RE:7549] [DI:direct]

| ORF_Name | NT_ID | AA_ID | NT LN | AA LN | Score | P-value |
|---|---|---|---|---|---|---|
| 31647932_f2_465 | 1358 | 8529 | 792 | 263 | 1053 | 2.2e-106 |

Description sp:[LN:PEPE_ECOLI] [AC:P32666] [GN:PEPE] [OR:Escherichia coli] [EC:3.4.-.-] [DE:PEPTIDASE E, (ALPHA-ASPARTYL DIPEPTIDASE)] [SP:P32666] [DB:swissprot] >sp:[LN:D65209] [AC:D65209] [PN:peptidase E] [GN:pepE] [CL:alpha-aspartyl dipeptidase] [OR:Escherichia coli] [DB:pir2] >gp:[GI:g1790452] [LN:AE000475] [AC:AE000475:U00096] [PN:peptidase E, a dipeptidase where amino-terminal] [GN:pepE] [FN:enzyme; Degradation of proteins, peptides,] [OR:Escherichia coli] [DB:genpept-bct2] [DE:Escherichia coli K-12 MG1655 section 365 of 400 of the completegenome.] [NT:f229a] [LE:6809] [RE:7498] [DI:complement] >gp:[GI:g396356] [LN:ECOUW89] [AC:U00006] [PN:peptidase E] [GN:pepE] [OR:Escherichia coli] [SR:Escherichia coli (sub_strain MG1655, strain K-12) (library: lambda] [DB:genpept-bct2] [DE:E. coli chromosomal region from 89.2 to 92.8 minutes.] [LE:94695] [RE:95384] [DI:complement]

| ORF Name | NT ID | AA ID | NT LN | AA LN | Score | P-value |
|---|---|---|---|---|---|---|
| 31675003_c2_1099 | 1359 | 8530 | 225 | 74 | | |

Description

NO-HIT

| ORF Name | NT ID | AA ID | NT LN | AA LN | Score | P-value |
|---|---|---|---|---|---|---|
| 31698908_f1_2 | 1360 | 8531 | 189 | 62 | | |

Description

NO-HIT

| ORF Name | NT ID | AA ID | NT LN | AA LN | Score | P-value |
|---|---|---|---|---|---|---|
| 31750205_f2_452 | 1361 | 8532 | 804 | 267 | 1313 | 6.1e-134 |

Description sp:[LN:MALE_ENTAE] [AC:P18815] [GN:MALE] [OR:Enterobacter aerogenes]
[SR:,Aerobacter aerogenes] [DE:PROTEIN) (MMBP)] [SP:P18815] [DB:swissprot]
>sp:[LN:S05330] [AC:S05330] [PN:maltose-binding protein precursor] [GN:malE]
[CL:maltose-binding protein] [OR:Enterobacter aerogenes] [DB:pir2]

| ORF Name | NT ID | AA ID | NT LN | AA LN | Score | P-value |
|---|---|---|---|---|---|---|
| 31759642_f1_194 | 1362 | 8533 | 606 | 201 | 794 | 6.1e-79 |

Description sp:[LN:E65212] [AC:E65212] [PN:hypothetical 21.7 kD protein in dinF-qor
intergenic region] [GN:yjbK] [OR:Escherichia coli] [DB:pir2] >gp:[GI:g1790480]
[LN:AE000478] [AC:AE000478:U00096] [PN:putative regulator] [GN:yjbK] [FN:putative
regulator; Not classified] [OR:Escherichia coli] [DB:genpept-bct2]
[DE:Escherichia coli K-12 MG1655 section 368 of 400 of the completegenome.]
[NT:f191; 100 pct identical to YJBK_ECOLI SW:] [LE:327] [RE:902] [DI:complement]

| ORF Name | NT ID | AA ID | NT LN | AA LN | Score | P-value |
|---|---|---|---|---|---|---|
| 31828552_c2_1060 | 1363 | 8534 | 2370 | 789 | 692 | 1.6e-70 |

Description gp:[GI:g5052340] [LN:AF133262] [AC:AF133262] [PN:histidine protein
kinase-response regulator] [GN:cvgSY] [FN:regulation of chemotaxis virulence and
growth] [OR:Pseudomonas syringae pv. syringae] [DB:genpept-bct2] [DE:Pseudomonas
syringae pv. syringae DNA binding protein HpkR (hpkR)gene, partial cds; histidine
protein kinase-response regulatorhybrid protein CvgSY (cvgSY) and ankyrin AnkB
(ankB) genes,complete cds; and catalase isozyme catalytic subunit precursor
CatB(catB) gene, partial cds.] [NT:similar to Pseudomonas syringae strain 61
CvgSY] [LE:642] [RE:2657] [DI:direct]

| ORF Name | NT ID | AA ID | NT/LN | AA/LN | Score | P-value |
|---|---|---|---|---|---|---|
| 31834717_f3_680 | 1364 | 8535 | 393 | 130 | 474 | 4.9e-45 |

Description sp:[LN:YJGF_ECOLI] [AC:P39330:P76806] [GN:YJGF] [OR:Escherichia coli] [DE:13.5 KD PROTEIN IN MGTA-PYRI INTERGENIC REGION] [SP:P39330:P76806] [DB:swissprot]

| ORF Name | NT ID | AA ID | NT/LN | AA/LN | Score | P-value |
|---|---|---|---|---|---|---|
| 32131942_f3_513 | 1365 | 8536 | 810 | 269 | 1251 | 2.3e-127 |

Description sp:[LN:RDECFS] [AC:A00377:S56381:G65225] [PN:fumarate reductase, iron-sulfur protein] [GN:frdB] [CL:fumarate reductase iron-sulfur protein:ferredoxin 2[4Fe-4S] homology:ferredoxin [2Fe-2S] homology] [OR:Escherichia coli] [EC:1.3.99.1] [DB:pir1] [MP:94 min] >gp:[GI:g145264] [LN:ECOAMPCFR] [AC:J01611:J01583] [PN:fumarate reductase iron-sulfur subunit] [GN:frdB] [OR:Escherichia coli] [SR:Escherichia coli (strain K-12) DNA] [DB:genpept-bct1] [DE:E.coli frd operon, fumarate reductase (flavoprotein subunit frdAand iron/sulfur subunit frdB), and beta-lactamase (ampC) genes,complete cds.] [LE:2583] [RE:3317] [DI:direct] >gp:[GI:g536997] [LN:ECOUW93] [AC:U14003] [PN:fumarate reductase, iron-sulfur protein] [GN:frdB] [OR:Escherichia coli] [DB:genpept-bct1] [EC:1.3.99.1] [DE:Escherichia coli K-12 chromosomal region from 92.8 to 00.1 minutes.] [NT:CG Site No. 741] [LE:70611] [RE:71345] [DI:complement] >gp:[GI:g1790596] [LN:AE000487] [AC:AE000487:U00096] [PN:fumarate reductase, anaerobic, iron-sulfur] [GN:frdB] [FN:enzyme; Energy metabolism, carbon: Anaerobic] [OR:Escherichia coli] [DB:genpept-bct2] [EC:1.3.99.1] [DE:Escherichia coli K-12 MG1655 section 377 of 400 of the completegenome.] [NT:f244; 100 pct identical to FRDB_ECOLI SW: P00364;] [LE:11273] [RE:12007] [DI:complement]

| ORF Name | NT ID | AA ID | NT/LN | AA/LN | Score | P-value |
|---|---|---|---|---|---|---|
| 32463876_c3_1292 | 1366 | 8537 | 939 | 312 | 403 | 1.6e-37 |

Description sp:[LN:B35720] [AC:B35720] [PN:hypothetical 28.6K protein:hypothetical protein 269] [OR:Escherichia coli] [DB:pir2] >gp:[GI:g455182] [LN:ECOPHNAQ] [AC:J05260] [OR:Escherichia coli] [SR:E.coli (strain B) DNA] [DB:genpept-bct1] [DE:E.coli psiD locus containing alkylphosphonate uptake (phn) genes Athrough Q, complete cds.] [NT:ORF269] [LE:8489] [RE:9298] [DI:complement]

| ORF Name | NT ID | AA ID | NT/LN | AA/LN | Score | P-value |
|---|---|---|---|---|---|---|
| 32595091_f1_95 | 1367 | 8538 | 501 | 166 | 151 | 8.3e-11 |

Description gp:[GI:e1370577:g4158178] [LN:SC1A6] [AC:AL023496] [PN:hypothetical protein] [OR:Streptomyces coelicolor] [DB:genpept-bct1] [DE:Streptomyces coelicolor cosmid 1A6.] [NT:Protein sequence is in conflict with the conceptual] [LE:<1] [RE:574] [DI:direct]

| ORF Name | NT ID | AA ID | NT/LN | AA/LN | Score | P-value |
|---|---|---|---|---|---|---|
| 32601392_f1_116 | 1368 | 8539 | 606 | 201 | 150 | 1.1e-10 |

Description sp:[LN:S28675] [AC:S28675] [PN:hypothetical protein 5] [OR:Rhizobium sp.]
[DB:pir2] >gp:[GI:g152260] [LN:RHMLCRATOE] [AC:M38698] [GN:lcrC] [OR:Rhizobium
sp.] [SR:Rhizobium sp (strain IC 3342) (clone: pMNU4) (clone library: cosmi]
[DB:genpept-bct1] [DE:Rhizobium sp. lcrABCDE genes, complete cds's.] [LE:1049]
[RE:1675] [DI:complement]

| ORF Name | NT ID | AA ID | NT/LN | AA/LN | Score | P-value |
|---|---|---|---|---|---|---|
| 32601662_c1_889 | 1369 | 8540 | 1170 | 389 | 280 | 1.8e-24 |

Description gp:[GI:g41005] [LN:ECASPA] [AC:X02307] [OR:Escherichia coli] [DB:genpept-bct1]
[DE:E. coli aspA gene for aspartase (L-aspartate ammonia-lyase) (EC4.3.1.1).]
[NT:URF 3] [LE:2104] [RE:2802] [DI:complement]

| ORF Name | NT ID | AA ID | NT/LN | AA/LN | Score | P-value |
|---|---|---|---|---|---|---|
| 32619843_c2_981 | 1370 | 8541 | 1086 | 361 | 1601 | 1.8e-164 |

Description sp:[LN:YJBN_ECOLI] [AC:P32695:P76786] [GN:YJBN] [OR:Escherichia coli]
[DE:HYPOTHETICAL 36.8 KD PROTEIN IN DINF-QOR INTERGENIC REGION]
[SP:P32695:P76786] [DB:swissprot]

| ORF Name | NT ID | AA ID | NT LN | AA LN | Score | P-value |
|---|---|---|---|---|---|---|
| 32676407_f1_98 | 1371 | 8542 | 1035 | 344 | 986 | 2.7e-99 |

Description sp:[LN:PHNL_ECOLI] [AC:P16679] [GN:PHNL] [OR:Escherichia coli] [DE:PHOSPHONATES TRANSPORT ATP-BINDING PROTEIN PHNL] [SP:P16679] [DB:swissprot] >sp:[LN:D35719] [AC:D35719:S56324:G65218] [PN:hisP-like nucleotide binding protein phnL] [GN:phnL] [CL:ATP-binding cassette homology] [OR:Escherichia coli] [DB:pir2] >gp:[GI:d1014977:g216601] [LN:ECOPHN] [AC:D90227] [PN:ATP-binding protein] [GN:phnL] [OR:Escherichia coli] [SR:Escherichia coli (strain:K-12, sub_strain:W3110) DNA] [DB:genpept-bct1] [DE:Escherichia coli phn operon genes.] [LE:7369] [RE:8049] [DI:direct] >gp:[GI:g147207] [LN:ECOPHNAQ] [AC:J05260] [OR:Escherichia coli] [SR:E.coli (strain B) DNA] [DB:genpept-bct1] [DE:E.coli psiD locus containing alkylphosphonate uptake (phn) genes Athrough Q, complete cds.] [NT:HisP-like nucleotide binding protein (phnL)] [LE:11605] [RE:12285] [DI:direct] >gp:[GI:g536940] [LN:ECOUW93] [AC:U14003] [GN:phnL] [OR:Escherichia coli] [DB:genpept-bct1] [DE:Escherichia coli K-12 chromosomal region from 92.8 to 00.1 minutes.] [NT:HisP-like nucleotide binding protein (ATP-binding)] [LE:8143] [RE:8823] [DI:complement] >gp:[GI:g1790534] [LN:AE000482] [AC:AE000482:U00096] [PN:ATP-binding component of phosphonate transport] [GN:phnL] [FN:transport; Central intermediary metabolism:] [OR:Escherichia coli] [DB:genpept-bct2] [DE:Escherichia coli K-12 MG1655 section 372 of 400 of the completegenome.] [NT:f226; 100 pct identical amino acid sequence and] [LE:12862] [RE:13542] [DI:complement]

| ORF Name | NT ID | AA ID | NT LN | AA LN | Score | P-value |
|---|---|---|---|---|---|---|
| 32681941_f2_341 | 1372 | 8543 | 675 | 224 | 676 | 1.9e-66 |

Description sp:[LN:PHNN_ECOLI] [AC:P16690] [GN:PHNN] [OR:Escherichia coli] [DE:PHOSPHONATES TRANSPORT ATP-BINDING PROTEIN PHNN] [SP:P16690] [DB:swissprot] >sp:[LN:F35719] [AC:F35719:S56322:E65218] [PN:hisP-like nucleotide binding protein phnN] [GN:phnN] [CL:guanylate kinase:guanylate kinase homology] [OR:Escherichia coli] [DB:pir2] >gp:[GI:d1014979:g216603] [LN:ECOPHN] [AC:D90227] [PN:ATP-binding protein] [GN:phnN] [OR:Escherichia coli] [SR:Escherichia coli (strain:K-12, sub_strain:W3110) DNA] [DB:genpept-bct1] [DE:Escherichia coli phn operon genes.] [LE:9182] [RE:9739] [DI:direct] >gp:[GI:g147210] [LN:ECOPHNAQ] [AC:J05260] [OR:Escherichia coli] [SR:E.coli (strain B) DNA] [DB:genpept-bct1] [DE:E.coli psiD locus containing alkylphosphonate uptake (phn) genes Athrough Q, complete cds.] [NT:HisP-like nucleotide binding protein (phnN)] [LE:13418] [RE:13975] [DI:direct] >gp:[GI:g536938] [LN:ECOUW93] [AC:U14003] [GN:phnN] [OR:Escherichia coli] [DB:genpept-bct1] [DE:Escherichia coli K-12 chromosomal region from 92.8 to 00.1 minutes.] [NT:HisP-like nucleotide binding protein (ATP-binding)] [LE:6453] [RE:7010] [DI:complement] >gp:[GI:g1790532] [LN:AE000482] [AC:AE000482:U00096] [PN:ATP-binding component of phosphonate transport] [GN:phnN] [FN:transport; Central intermediary metabolism:] [OR:Escherichia coli] [DB:genpept-bct2] [DE:Escherichia coli K-12 MG1655 section 372 of 400 of the completegenome.] [NT:f185; 100 pct identical amino acid sequence and] [LE:11172] [RE:11729] [DI:complement]

| ORF Name | NT ID | AA ID | NT LN | AA LN | Score | P-value |
|---|---|---|---|---|---|---|
| 32683292_c3_1379 | 1373 | 8544 | 1458 | 485 | 1888 | 7.1e-195 |

Description sp:[LN:MUTL_ECOLI] [AC:P23367] [GN:MUTL] [OR:Escherichia coli] [DE:DNA MISMATCH REPAIR PROTEIN MUTL] [SP:P23367] [DB:swissprot] >sp:[LN:PH0853] [AC:PH0853:S56395:A37318:S40056:E65227:S23011] [PN:methyl-directed mismatch repair protein mutL] [GN:mutL] [CL:mismatch repair protein hexB] [OR:Escherichia coli] [DB:pir2] [MP:95 min] >gp:[GI:g42067] [LN:ECMUTLG] [AC:Z11831] [PN:MutL Protein] [GN:mutL] [FN:Required for Methyl-directed DNA Mismatch] [OR:Escherichia coli] [DB:genpept-bct1] [DE:E.coli mutL and miaA genes for MutL protein anddelta2-isopentenylpyrophosphate tRNA transferase (partial).] [SP:P23367] [LE:267] [RE:2114] [DI:direct] >gp:[GI:g537011] [LN:ECOUW93] [AC:U14003] [GN:mutL] [FN:methyl directed mismatch repair] [OR:Escherichia coli] [DB:genpept-bct1] [DE:Escherichia coli K-12 chromosomal region from 92.8 to 00.1 minutes.] [NT:CG Site No. 470; alternate gene name mut-25] [LE:88240] [RE:90087] [DI:direct] >gp:[GI:g1790612] [LN:AE000489] [AC:AE000489:U00096] [PN:enzyme in methyl-directed mismatch repair] [GN:mutL] [FN:enzyme; DNA - replication, repair,] [OR:Escherichia coli] [DB:genpept-bct2] [DE:Escherichia coli K-12 MG1655 section 379 of 400 of the completegenome.] [NT:o615; 100 pct identical to MUTL_ECOLI SW: P23367;] [LE:5126] [RE:6973] [DI:direct]

| ORF Name | NT ID | AA ID | NT LN | AA LN | Score | P-value |
|---|---|---|---|---|---|---|
| 32707317_c1_758 | 1374 | 8545 | 1398 | 465 | 1242 | 2.0e-198 |

Description sp:[LN:A60177] [AC:A60177:S20601] [PN:LamB maltoporin protein precursor] [CL:lambda receptor protein] [OR:Salmonella typhimurium] [DB:pir2]

| ORF Name | NT ID | AA ID | NT LN | AA LN | Score | P-value |
|---|---|---|---|---|---|---|
| 33603413_f3_707 | 1375 | 8546 | 930 | 309 | 1310 | 1.3e-133 |

Description sp:[LN:RPECIR] [AC:A65209:A35267:JQ0871] [PN:acetate operon repressor] [GN:iclR] [CL:acetate operon repressor] [OR:Escherichia coli] [DB:pir1] [MP:91 min] >gp:[GI:g146441] [LN:ECOICLRA] [AC:M63914:M34937] [PN:repressor of the aceBAK operon] [GN:iclR] [OR:Escherichia coli] [SR:Escherichia coli (strain K-12) DNA] [DB:genpept-bct1] [DE:E.coli (clone pQN1009) repressor protein for the aceBAK operon(iclR) gene, complete cds.] [LE:181] [RE:1044] [DI:direct] >gp:[GI:g1790449] [LN:AE000475] [AC:AE000475:U00096] [PN:repressor of aceBA operon] [GN:iclR] [FN:regulator; Central intermediary metabolism:] [OR:Escherichia coli] [DB:genpept-bct2] [DE:Escherichia coli K-12 MG1655 section 365 of 400 of the completegenome.] [NT:f287; 100 pct identical to 274 amino acids] [LE:160] [RE:1023] [DI:complement] >gp:[GI:g396353] [LN:ECOUW89] [AC:U00006] [GN:iclR] [FN:regulatory gene for aceBAK operon] [OR:Escherichia coli] [SR:Escherichia coli (sub_strain MG1655, strain K-12) (library: lambda] [DB:genpept-bct2] [DE:E. coli chromosomal region from 89.2 to 92.8 minutes.] [NT:CG Site No. 614] [LE:88046] [RE:88909] [DI:complement]

| ORF_Name | NT_ID | AA_ID | NT/LN | AA/LN | Score | P-value |
|---|---|---|---|---|---|---|
| 33718817_c2_998 | 1376 | 8547 | 384 | 127 | 77 | 0.0057 |

Description gp:[GI:g148162] [LN:ECOUVRA] [AC:J01721] [OR:Escherichia coli] [SR:Escherichia coli, pDR1996 plasmid DNA] [DB:genpept-bct1] [DE:E.coli uvrA gene coding for UV endonuclease, control region.] [NT:single-stranded DNA-binding protein (ssb)] [LE:124] [RE:300] [DI:complement]

| ORF_Name | NT_ID | AA_ID | NT/LN | AA/LN | Score | P-value |
|---|---|---|---|---|---|---|
| 33757075_f3_692 | 1377 | 8548 | 345 | 114 | 392 | 2.4e-36 |

Description sp:[LN:YJBD_ECOLI] [AC:P32685] [GN:YJBD] [OR:Escherichia coli] [DE:HYPOTHETICAL 10.5 KD PROTEIN IN PEPE-LYSC INTERGENIC REGION] [SP:P32685] [DB:swissprot] >sp:[LN:F65209] [AC:F65209] [PN:hypothetical 10.5 kD protein in pepe-lysc intergenic region] [GN:yjbD] [OR:Escherichia coli] [DB:pir2] >gp:[GI:g1790454] [LN:AE000475] [AC:AE000475:U00096] [PN:orf, hypothetical protein] [GN:yjbD] [FN:orf; Unknown] [OR:Escherichia coli] [DB:genpept-bct2] [DE:Escherichia coli K-12 MG1655 section 365 of 400 of the completegenome.] [NT:f90; 100 pct identical amino acid sequence and] [LE:8715] [RE:8987] [DI:complement] >gp:[GI:g396358] [LN:ECOUW89] [AC:U00006] [OR:Escherichia coli] [SR:Escherichia coli (sub_strain MG1655, strain K-12) (library: lambda] [DB:genpept-bct2] [DE:E. coli chromosomal region from 89.2 to 92.8 minutes.] [LE:96601] [RE:96873] [DI:complement]

| ORF_Name | NT_ID | AA_ID | NT/LN | AA/LN | Score | P-value |
|---|---|---|---|---|---|---|
| 33790967_c2_1042 | 1378 | 8549 | 375 | 124 | 110 | 1.8e-06 |

Description sp:[LN:H72610] [AC:H72610] [PN:hypothetical protein APE1348] [GN:APE1348] [OR:Aeropyrum pernix] [DB:pir2] >gp:[GI:d1044128;g5105028] [LN:AP000061] [AC:AP000061] [PN:143aa long hypothetical protein] [GN:APE1348] [OR:Aeropyrum pernix] [SR:Aeropyrum pernix (strain:K1) DNA] [DB:genpept-bct1] [DE:Aeropyrum pernix genomic DNA, section 4/7.] [NT:motif=prokaryotic membrane lipoprotein lipid] [LE:139841] [RE:140272] [DI:direct]

| ORF_Name | NT_ID | AA_ID | NT/LN | AA/LN | Score | P-value |
|---|---|---|---|---|---|---|
| 33799202_c3_1250 | 1379 | 8550 | 1605 | 534 | 1526 | 1.6e-156 |

Description gp:[GI:g396396] [LN:ECOUW89] [AC:U00006] [OR:Escherichia coli] [SR:Escherichia coli (sub_strain MG1655, strain K-12) (library: lambda] [DB:genpept-bct2] [DE:E. coli chromosomal region from 89.2 to 92.8 minutes.] [NT:similar to Azorhizobium caulinodans hypoth.] [LE:140711] [RE:142297] [DI:direct]

| ORF_Name | NT ID | AA ID | NT/LN | AA/LN | Score | P-value |
|---|---|---|---|---|---|---|
| 33863456_c1_813 | 1380 | 8551 | 1281 | 426 | 115 | 7.0e-05 |

Description gp:[GI:g4959516] [LN:AF130422] [AC:AF130422] [PN:fimbrial subunit] [GN:bcfF]
[OR:Salmonella typhimurium] [DB:genpept-bct2] [DE:Salmonella typhimurium bovine
colonization factor operon, completesequence.] [NT:BcfF] [LE:6802] [RE:7320]
[DI:direct]

| ORF_Name | NT ID | AA ID | NT/LN | AA/LN | Score | P-value |
|---|---|---|---|---|---|---|
| 33880268_c3_1284 | 1381 | 8552 | 387 | 128 | 116 | 1.3e-05 |

Description gp:[GI:g1633572] [LN:KSU52064] [AC:U52064] [OR:Kaposi's sarcoma-associated
herpesvirus] [SR:Kaposi's sarcoma-associated herpesvirus - Human herpesvirus 8]
[DB:genpept-vrl] [DE:Kaposi's sarcoma-associated herpes-like virus ORF73 homolog
gene,complete cds.] [NT:Herpesvirus saimiri ORF73 homolog] [LE:1] [RE:3489]
[DI:direct] >gp:[GI:g1718329] [LN:KSU75698] [AC:U75698] [OR:Kaposi's
sarcoma-associated herpesvirus] [SR:Kaposi's sarcoma-associated herpesvirus -
Human herpesvirus 8] [DB:genpept-vrl] [DE:Kaposi's sarcoma-associated herpesvirus
long unique region, 80putative ORF's and kaposin gene, complete cds.] [NT:ORF 73;
extensive acidic domains, potential leucine] [LE:123809] [RE:127297]
[DI:complement]

| ORF_Name | NT ID | AA ID | NT/LN | AA/LN | Score | P-value |
|---|---|---|---|---|---|---|
| 3407032_f3_641 | 1382 | 8553 | 402 | 133 | 205 | 1.6e-16 |

Description sp:[LN:AARP_PROST] [AC:P43463] [GN:AARP] [OR:Providencia stuartii]
[DE:TRANSCRIPTIONAL ACTIVATOR AARP] [SP:P43463] [DB:swissprot] >gp:[GI:g623476]
[LN:PROAARP] [AC:L38718] [PN:transcriptional activator] [GN:aarP] [OR:Providencia
stuartii] [DB:genpept-bct1] [DE:Providencia stuartii (clone pSK.aarP)
transcriptional activator(aarP) gene, complete cds.] [NT:member of the AraC/XylS
family] [LE:352] [RE:759] [DI:direct]

| ORF_Name | NT ID | AA ID | NT/LN | AA/LN | Score | P-value |
|---|---|---|---|---|---|---|
| 34086557_f3_508 | 1383 | 8554 | 3369 | 1122 | 4854 | 0.0 |

Description sp:[LN:YJEP_ECOLI] [AC:P39285:P76798] [GN:YJEP] [OR:Escherichia coli]
[DE:HYPOTHETICAL 123.8 KD PROTEIN IN GENX-PSD INTERGENIC REGION PRECURSOR]
[SP:P39285:P76798] [DB:swissprot] >sp:[LN:E65226] [AC:E65226:S56387]
[PN:hypothetical 123.8 kD protein in genX-psd intergenic region:hypothetical
protein f1107] [GN:yjeP] [OR:Escherichia coli] [DB:pir2] >gp:[GI:g2367355]
[LN:AE000488] [AC:AE000488:U00096] [PN:putative periplasmic binding protein]
[GN:yjeP] [FN:putative transport; Not classified] [OR:Escherichia coli]
[DB:genpept-bct2] [DE:Escherichia coli K-12 MG1655 section 378 of 400 of the
completegenome.] [NT:f1107; 99 pct identical to YJEP_ECOLI SW: P39285] [LE:3706]
[RE:7029] [DI:complement]

| ORF Name | NT ID | AA ID | NT LN | AA LN | Score | P-value |
|---|---|---|---|---|---|---|
| 34114533_f3_558 | 1384 | 8555 | 249 | 82 | 83 | 0.032 |

Description sp:[LN:PAC4_RAT] [AC:Q63415] [GN:PACE4] [OR:Rattus norvegicus] [SR:,Rat]
[EC:3.4.21.-] [DE:SUBTILISIN-LIKE PROTEASE PACE4 PRECURSOR,] [SP:Q63415]
[DB:swissprot] >sp:[LN:I53282] [AC:I53282] [PN:gene PACE4 protein] [GN:PACE4]
[CL:subtilisin-like proteinase PACE4:subtilisin homology] [OR:Rattus norvegicus]
[SR:, Norway rat] [DB:pir2] >gp:[GI:g496222] [LN:RATPACE4A] [AC:L31894]
[GN:PACE4] [OR:Rattus norvegicus] [SR:Rattus norvegicus (strain Sprague-Dawley)
(library: clone 10d] [DB:genpept-rod] [DE:Rattus norvegicus PACE4 mRNA, complete
cds.] [NT:amino acid feature: RGD integrin-binding site, bp] [LE:29] [RE:2842]
[DI:direct]

| ORF Name | NT ID | AA ID | NT LN | AA LN | Score | P-value |
|---|---|---|---|---|---|---|
| 34114533_f3_559 | 1385 | 8556 | 273 | 90 | 70 | 0.00099 |

Description gp:[GI:g2795887] [LN:AF038169] [AC:AF038169] [PN:unknown] [OR:Homo sapiens]
[SR:human] [DB:genpept-pri3] [DE:Homo sapiens clone 23790 unknown protein mRNA,
complete cds.] [LE:406] [RE:1017] [DI:direct]

| ORF Name | NT ID | AA ID | NT LN | AA LN | Score | P-value |
|---|---|---|---|---|---|---|
| 34156686_f1_129 | 1386 | 8557 | 1983 | 660 | 3258 | 0.0 |

Description sp:[LN:ACSA_ECOLI] [AC:P27550] [GN:ACS] [OR:Escherichia coli] [EC:6.2.1.1]
[DE:ACTIVATING ENZYME)] [SP:P27550] [DB:swissprot] >sp:[LN:D65215]
[AC:D65215:B47682] [PN:acetate--CoA ligase,:acetyl-CoA synthetase] [GN:acs]
[CL:acetate--CoA ligase:acetate--CoA ligase homology] [OR:Escherichia coli]
[EC:6.2.1.1] [DB:pir2] >gp:[GI:g1790505] [LN:AE000480] [AC:AE000480:U00096]
[PN:acetyl-CoA synthetase] [GN:acs] [FN:enzyme; Fatty acid and phosphatidic acid]
[OR:Escherichia coli] [DB:genpept-bct2] [EC:6.2.1.1] [DE:Escherichia coli K-12
MG1655 section 370 of 400 of the completegenome.] [NT:f652; 100 pct identical to
ACSA_ECOLI SW:] [LE:5516] [RE:7474] [DI:complement] >gp:[GI:g396404] [LN:ECOUW89]
[AC:U00006] [PN:acetyl-CoA sythetase] [GN:acs] [OR:Escherichia coli]
[SR:Escherichia coli (sub_strain MG1655, strain K-12) (library: lambda]
[DB:genpept-bct2] [DE:E. coli chromosomal region from 89.2 to 92.8 minutes.]
[NT:matches PS00018: EF-hand calcium-binding domain,] [LE:150653] [RE:152611]
[DI:complement]

| ORF Name | NT ID | AA ID | NT/LN | AA/LN | Score | P-value |
|---|---|---|---|---|---|---|
| 34461582_c1_924 | 1387 | 8558 | 1284 | 427 | 1604 | 8.9e-165 |

Description sp:[LN:YJEF_ECOLI] [AC:P31806] [GN:YJEF] [OR:Escherichia coli] [DE:HYPOTHETICAL
54.7 KD PROTEIN IN PSD-AMIB INTERGENIC REGION (URF1)] [SP:P31806] [DB:swissprot]
>sp:[LN:S56392] [AC:S56392:B65227:S41739] [PN:hypothetical 54.7K protein
(psd-amiB intergenic region):hypothetical protein o515] [GN:yjeF] [OR:Escherichia
coli] [DB:pir2] >gp:[GI:g537008] [LN:ECOUW93] [AC:U14003] [GN:yjeF]
[OR:Escherichia coli] [DB:genpept-bct1] [DE:Escherichia coli K-12 chromosomal
region from 92.8 to 00.1 minutes.] [LE:84894] [RE:86441] [DI:direct]
>gp:[GI:g1790609] [LN:AE000489] [AC:AE000489:U00096] [PN:orf, hypothetical
protein] [GN:yjeF] [FN:orf; Unknown] [OR:Escherichia coli] [DB:genpept-bct2]
[DE:Escherichia coli K-12 MG1655 section 379 of 400 of the completegenome.]
[NT:o515; 100 pct identical amino acid sequence and] [LE:1780] [RE:3327]
[DI:direct]

| ORF Name | NT ID | AA ID | NT/LN | AA/LN | Score | P-value |
|---|---|---|---|---|---|---|
| 34505158_f1_79 | 1388 | 8559 | 264 | 87 | 90 | 0.0079 |

Description gp:[GI:d1022502:g2285875] [LN:D85682] [AC:D85682] [PN:synaptojanin] [FN:PIP2
5-phosphatase] [OR:Bos taurus] [SR:Bos taurus brain cDNA to mRNA]
[DB:genpept-mam] [DE:Bos taurus mRNA for synaptojanin, complete cds.] [LE:17]
[RE:3655] [DI:direct]

| ORF Name | NT ID | AA ID | NT/LN | AA/LN | Score | P-value |
|---|---|---|---|---|---|---|
| 34585943_c3_1381 | 1389 | 8560 | 321 | 106 | 470 | 1.3e-44 |

Description sp:[LN:S56397] [AC:S26832:S78010:C37318:S56397:S77719:G65227:S23014] [PN:host
factor I:ndh-binding protein (Nbp)] [GN:hfq] [CL:host factor I] [OR:Escherichia
coli] [DB:pir2] >gp:[GI:d1001102:g216568] [LN:ECOHFQ] [AC:D00743] [OR:Escherichia
coli] [SR:E.coli genomic DNA] [DB:genpept-bct1] [DE:E.coli host factor-I for
bacteriophage Q beta gene (hfq) and its 5'and 3' flanking regions.] [NT:host
factor-I protein] [LE:739] [RE:1047] [DI:direct] >gp:[GI:g537013] [LN:ECOUW93]
[AC:U14003] [PN:Host Factor-I (HF-I)] [GN:hfq] [OR:Escherichia coli]
[DB:genpept-bct1] [DE:Escherichia coli K-12 chromosomal region from 92.8 to 00.1
minutes.] [NT:required for bacteriophage Q Beta RNA-directed] [LE:91116]
[RE:91424] [DI:direct] >gp:[GI:g1790614] [LN:AE000489] [AC:AE000489:U00096]
[PN:host factor I for bacteriophage Q beta] [GN:hfq] [FN:putative factor;
Phage-related functions and] [OR:Escherichia coli] [DB:genpept-bct2]
[DE:Escherichia coli K-12 MG1655 section 379 of 400 of the completegenome.]
[NT:o102; 100 pct identical to HFQ_ECOLI SW:] [LE:8002] [RE:8310] [DI:direct]
>gp:[GI:g436155] [LN:ECOHFLA] [AC:U00005] [PN:Host Factor-I (HF-I)] [GN:hfq]
[OR:Escherichia coli] [SR:Escherichia coli K12] [DB:genpept-bct2] [DE:E. coli
hflA locus encoding the hflX, hflK and hflC genes, hfqgene, complete cds; miaA
gene, partial cds.] [NT:required for bacteriophage Q Beta RNA-directed] [LE:738]
[RE:1046] [DI:direct]

| ORF Name | NT ID | AA ID | NT LN | AA LN | Score | P-value |
|---|---|---|---|---|---|---|
| 34636300_f3_519 | 1390 | 8561 | 2610 | 869 | 1592 | 1.7e-163 |

Description sp:[LN:LPFC_SALTY] [AC:P43662] [GN:LPFC] [OR:Salmonella typhimurium] [DE:OUTER MEMBRANE USHER PROTEIN LPFC PRECURSOR] [SP:P43662] [DB:swissprot] >sp:[LN:C56271] [AC:C56271] [PN:outer membrane usher protein lpfC precursor] [GN:lpfC] [CL:outer membrane usher protein fimD] [OR:Salmonella typhimurium] [DB:pir1] >gp:[GI:g829373] [LN:STU18559] [AC:U18559] [GN:lpfC] [OR:Salmonella typhimurium] [DB:genpept-bct1] [DE:Salmonella typhimurium long polar fimbriae proteins (lpfA, lpfB,lpfC, lpfD, lpfE) genes, complete cds and (orf1, orf2) genes,partial cds.] [LE:1819] [RE:4347] [DI:direct]

| ORF Name | NT ID | AA ID | NT LN | AA LN | Score | P-value |
|---|---|---|---|---|---|---|
| 35257806_c3_1220 | 1391 | 8562 | 375 | 124 | 405 | 1.0e-37 |

Description sp:[LN:A65213] [AC:A65213] [PN:hypothetical 17.4 kD protein in dinF-qor intergenic region] [GN:yjb0] [OR:Escherichia coli] [DB:pir2] >gp:[GI:g1790484] [LN:AE000478] [AC:AE000478:U00096] [PN:orf, hypothetical protein] [GN:yjb0] [FN:orf; Unknown] [OR:Escherichia coli] [DB:genpept-bct2] [DE:Escherichia coli K-12 MG1655 section 368 of 400 of the completegenome.] [NT:o150; 100 pct identical to YJBO_ECOLI SW: P32696] [LE:3469] [RE:3921] [DI:direct] >gp:[GI:g409799] [LN:ECOUW89] [AC:U00006] [SR:Escherichia coli (sub_strain MG1655, strain K-12) (library: lambda] [DB:genpept-bct2] [DE:E. coli chromosomal region from 89.2 to 92.8 minutes.] [LE:127874] [RE:128326] [DI:direct]

| ORF Name | NT ID | AA ID | NT LN | AA LN | Score | P-value |
|---|---|---|---|---|---|---|
| 35360380_c1_833 | 1392 | 8563 | 420 | 139 | 153 | 1.0e-10 |

Description sp:[LN:FBOH_BOMMO] [AC:P05790] [OR:Bombyx mori] [SR:,Silk moth] [DE:FIBROIN HEAVY CHAIN PRECURSOR (FIB-H) (FRAGMENTS)] [SP:P05790] [DB:swissprot]

| ORF Name | NT ID | AA ID | NT LN | AA LN | Score | P-value |
|---|---|---|---|---|---|---|
| 35370251_c2_1121 | 1393 | 8564 | 483 | 160 | 413 | 1.4e-38 |

Description gp:[GI:g41003] [LN:ECASPA] [AC:X02307] [OR:Escherichia coli] [DB:genpept-bct1] [DE:E. coli aspA gene for aspartase (L-aspartate ammonia-lyase) (EC4.3.1.1).] [NT:URF 4] [LE:115] [RE:522] [DI:complement]

| ORF Name | NT ID | AA ID | NT/LN | AA/LN | Score | P-value |
|---|---|---|---|---|---|---|
| 35431527_f2_294 | 1394 | 8565 | 1254 | 417 | 1795 | 5.1e-185 |

Description sp:[LN:YJEH_ECOLI] [AC:P39277] [GN:YJEH] [OR:Escherichia coli] [DE:HYPOTHETICAL 44.8 KD PROTEIN IN ASPA-MOPB INTERGENIC REGION (F418)] [SP:P39277] [DB:swissprot] >sp:[LN:S56369] [AC:S56369:C65224] [PN:hypothetical 44.8K protein (aspa-mopb intergenic region):hypothetical protein f418] [GN:yjeH] [OR:Escherichia coli] [DB:pir2] >gp:[GI:g536985] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_f418] [LE:59984] [RE:61240] [DI:complement] >gp:[GI:g1790584] [LN:AE000487] [AC:AE000487:U00096] [PN:putative transport] [GN:yjeH] [FN:putative transport; Not classified] [OR:Escherichia coli] [DB:genpept-bct2] [DE:Escherichia coli K-12 MG1655 section 377 of 400 of the completegenome.] [NT:f418; 100 pct identical amino acid sequence and] [LE:646] [RE:1902] [DI:complement]

| ORF Name | NT ID | AA ID | NT/LN | AA/LN | Score | P-value |
|---|---|---|---|---|---|---|
| 35557282_c1_895 | 1395 | 8566 | 354 | 117 | 446 | 4.6e-42 |

Description sp:[LN:CH10_ECOLI] [AC:P05380] [GN:GROS:MOPB:GROES] [OR:Escherichia coli] [DE:10 KD CHAPERONIN (PROTEIN CPN10) (PROTEIN GROES)] [SP:P05380] [DB:swissprot] >sp:[LN:BVECGS] [AC:S03931:S19084:A29989:S38971:S56370:D65224] [PN:chaperonin groES:heat shock protein groES] [GN:mopB:groES] [CL:chaperonin groES] [OR:Escherichia coli] [DB:pir1] [MP:94 min] >gp:[GI:g41616] [LN:ECGROESL] [AC:X07850] [OR:Escherichia coli] [DB:genpept-bct1] [DE:E. coli groE operon.] [NT:groES protein (AA 1-97)] [SP:P05380] [DI:direct] >gp:[GI:g536986] [LN:ECOUW93] [AC:U14003] [PN:GroES protein] [GN:mopB] [OR:Escherichia coli] [DB:genpept-bct1] [DE:Escherichia coli K-12 chromosomal region from 92.8 to 00.1 minutes.] [NT:CG Site No. 492; alternate gene names groE, groES,] [LE:61516] [RE:61809] [DI:direct] >gp:[GI:g1790585] [LN:AE000487] [AC:AE000487:U00096] [PN:GroES, 10 Kd chaperone binds to Hsp60 in pres.] [GN:mopB] [FN:factor; Chaperones] [OR:Escherichia coli] [DB:genpept-bct2] [DE:Escherichia coli K-12 MG1655 section 377 of 400 of the completegenome.] [NT:o97; 100 pct identical to CH10_ECOLI SW: P05380; CG] [LE:2178] [RE:2471] [DI:direct]

| ORF Name | NT ID | AA ID | NT/LN | AA/LN | Score | P-value |
|---|---|---|---|---|---|---|
| 35585375_c2_1152 | 1396 | 8567 | 999 | 332 | 1563 | 2.0e-160 |

Description gp:[GI:g3947886] [LN:AF001831] [AC:AF001831] [PN:pyruvate oxidase] [GN:poxR] [OR:Salmonella typhimurium] [DB:genpept-bct2] [DE:Salmonella typhimurium pyruvate oxidase (poxR) gene, complete cds,and YjeM (yjeM) gene, partial cds.] [NT:PoxR; lysyl-tRNA synthetase] [LE:345] [RE:1322] [DI:direct]

521

| ORF Name | NT ID | AA ID | NT/LN | AA/LN | Score | P-value |
|---|---|---|---|---|---|---|
| 35646933_f3_521 | 1397 | 8568 | 975 | 324 | 347 | 1.4e-31 |

Description sp:[LN:YJEJ_ECOLI] [AC:P39279] [GN:YJEJ] [OR:Escherichia coli] [DE:HYPOTHETICAL
32.9 KD PROTEIN IN MOPA-EFP INTERGENIC REGION (F289)] [SP:P39279] [DB:swissprot]
>sp:[LN:S56373] [AC:S56373:G65224] [PN:hypothetical 32.9K protein (mopa-efp
intergenic region):hypothetical protein f289] [GN:yjeJ] [OR:Escherichia coli]
[DB:pir2] >gp:[GI:g536989] [LN:ECOUW93] [AC:U14003] [OR:Escherichia coli]
[DB:genpept-bct1] [DE:Escherichia coli K-12 chromosomal region from 92.8 to 00.1
minutes.] [NT:ORF_f289] [LE:64193] [RE:65062] [DI:complement] >gp:[GI:g1790588]
[LN:AE000487] [AC:AE000487:U00096] [PN:orf, hypothetical protein] [GN:yjeJ]
[FN:orf; Unknown] [OR:Escherichia coli] [DB:genpept-bct2] [DE:Escherichia coli
K-12 MG1655 section 377 of 400 of the completegenome.] [NT:f289; 100 pct
identical amino acid sequence and] [LE:4855] [RE:5724] [DI:complement]

| ORF Name | NT ID | AA ID | NT/LN | AA/LN | Score | P-value |
|---|---|---|---|---|---|---|
| 35677266_c3_1184 | 1398 | 8569 | 1809 | 602 | 2792 | 1.1e-290 |

Description gp:[GI:g1151273] [LN:SEU43345] [AC:U43345] [PN:isocitrate dehydrogenase
kinase/phosphatase] [GN:aceK] [OR:Salmonella enterica] [SR:Salmonella enterica
strain=S3333] [DB:genpept-bct2] [DE:Salmonella enterica isocitrate lyase (aceA)
gene, partial cds,isocitrate dehydrogenase kinase/phosphatase (aceK) gene,
completecds.] [LE:314] [RE:2095] [DI:direct]

| ORF Name | NT ID | AA ID | NT/LN | AA/LN | Score | P-value |
|---|---|---|---|---|---|---|
| 35704806_c2_1068 | 1399 | 8570 | 1578 | 525 | 123 | 4.5e-05 |

Description sp:[LN:C34768] [AC:C34768] [PN:ORF2 protein] [OR:Orf virus] [DB:pir2]
>gp:[GI:g332565] [LN:ORFPRTPS] [AC:M30023:J04371:M37623] [OR:orf virus] [SR:Orf
virus (strain NZ2) DNA] [DB:genpept-vrl] [DE:Orf virus homologue of retroviral
pseudoprotease gene, completecds.] [NT:ORF2] [LE:1220] [RE:1885] [DI:direct]

| ORF Name | NT ID | AA ID | NT/LN | AA/LN | Score | P-value |
|---|---|---|---|---|---|---|
| 35792568_c1_840 | 1400 | 8571 | 369 | 122 | 124 | 6.0e-08 |

Description sp:[LN:G72536] [AC:G72536] [PN:hypothetical protein APE1580] [GN:APE1580]
[OR:Aeropyrum pernix] [DB:pir2] >gp:[GI:d1044366:g5105267] [LN:AP000062]
[AC:AP000062] [PN:114aa long hypothetical protein] [GN:APE1580] [OR:Aeropyrum
pernix] [SR:Aeropyrum pernix (strain:K1) DNA] [DB:genpept-bct1] [DE:Aeropyrum
pernix genomic DNA, section 5/7.] [NT:similar to OWL:AB00946832 percent
identity:37.500] [LE:13911] [RE:14255] [DI:direct]

| ORF Name | NT ID | AA ID | NT LN | AA LN | Score | P-value |
|---|---|---|---|---|---|---|
| 35995750_f1_92 | 1401 | 8572 | 657 | 218 | 526 | 1.5e-50 |

Description sp:[LN:PHNB_ECOLI] [AC:P16681] [GN:PHNB] [OR:Escherichia coli] [DE:PHNB PROTEIN]
[SP:P16681] [DB:swissprot] >sp:[LN:C35718] [AC:C35718:S56335:B65220] [PN:phnB
protein] [GN:phnB] [OR:Escherichia coli] [DB:pir2] >gp:[GI:g147195] [LN:ECOPHNAQ]
[AC:J05260] [OR:Escherichia coli] [SR:E.coli (strain B) DNA] [DB:genpept-bct1]
[DE:E.coli psiD locus containing alkylphosphonate uptake (phn) genes Athrough Q,
complete cds.] [NT:phnB protein] [LE:3767] [RE:4210] [DI:direct] >gp:[GI:g536951]
[LN:ECOUW93] [AC:U14003] [GN:phnB] [OR:Escherichia coli] [DB:genpept-bct1]
[DE:Escherichia coli K-12 chromosomal region from 92.8 to 00.1 minutes.]
[LE:16226] [RE:16669] [DI:complement] >gp:[GI:g1790546] [LN:AE000483]
[AC:AE000483:U00096] [PN:orf, hypothetical protein] [GN:phnB] [FN:orf; Unknown]
[OR:Escherichia coli] [DB:genpept-bct2] [DE:Escherichia coli K-12 MG1655 section
373 of 400 of the completegenome.] [NT:f147; 100 pct identical amino acid
sequence and] [LE:97] [RE:540] [DI:complement]

| ORF Name | NT ID | AA ID | NT LN | AA LN | Score | P-value |
|---|---|---|---|---|---|---|
| 36034507_f2_270 | 1402 | 8573 | 252 | 83 | 107 | 3.8e-06 |

Description gp:[GI:g2911883] [LN:CELW09G12] [AC:AF047663] [GN:W09G12.6] [OR:Caenorhabditis
elegans] [DB:genpept-inv2] [DE:Caenorhabditis elegans cosmid W09G12.] [NT:coded
for by C. elegans cDNA yk189f5.5; coded for] [LE:29076:29515] [RE:29135:29991]
[DI:directJoin]

| ORF Name | NT ID | AA ID | NT LN | AA LN | Score | P-value |
|---|---|---|---|---|---|---|
| 36047041_c1_808 | 1403 | 8574 | 1689 | 562 | 2536 | 1.5e-263 |

Description sp:[LN:YJCE_ECOLI] [AC:P32703] [GN:YJCE] [OR:Escherichia coli] [DE:PUTATIVE
NA(+)/H(+) EXCHANGER YJCE] [SP:P32703] [DB:swissprot] >sp:[LN:H65214] [AC:H65214]
[PN:hypothetical 60.5 kD protein in soxR-acs intergenic region] [GN:yjcE]
[CL:hypothetical protein yvgP] [OR:Escherichia coli] [DB:pir1] >gp:[GI:g1790501]
[LN:AE000480] [AC:AE000480:U00096] [PN:orf, hypothetical protein] [GN:yjcE]
[FN:orf; Unknown] [OR:Escherichia coli] [DB:genpept-bct2] [DE:Escherichia coli
K-12 MG1655 section 370 of 400 of the completegenome.] [NT:o549b; 100 pct
identical to YJCE_ECOLI SW:] [LE:83] [RE:1732] [DI:direct] >gp:[GI:g396400]
[LN:ECOUW89] [AC:U00006] [OR:Escherichia coli] [SR:Escherichia coli (sub_strain
MG1655, strain K-12) (library: lambda] [DB:genpept-bct2] [DE:E. coli chromosomal
region from 89.2 to 92.8 minutes.] [NT:similar to eukaryotic Na+/H+ exchangers]
[LE:145220] [RE:146869] [DI:direct]

| ORF Name | NT ID | AA ID | NT LN | AA LN | Score | P-value |
|---|---|---|---|---|---|---|
| 36056450_f1_59 | 1404 | 8575 | 2106 | 701 | 177 | 2.2e-10 |

Description sp:[LN:YPFG_ECOLI] [AC:P76559] [GN:YPFG] [OR:Escherichia coli] [DE:HYPOTHETICAL
38.7 KD PROTEIN IN TKTB-NARQ INTERGENIC REGION PRECURSOR] [SP:P76559]
[DB:swissprot] >sp:[LN:A65022] [AC:A65022] [PN:hypothetical protein b2466]
[OR:Escherichia coli] [DB:pir2] >gp:[GI:g1788809] [LN:AE000333]
[AC:AE000333:U00096] [PN:orf, hypothetical protein] [GN:b2466] [FN:orf; Unknown]
[OR:Escherichia coli] [DB:genpept-bct2] [DE:Escherichia coli K-12 MG1655 section
223 of 400 of the completegenome.] [NT:f347; This 347 aa ORF is 34 pct identical
(4 gaps)] [LE:5777] [RE:6820] [DI:complement]

| ORF Name | NT ID | AA ID | NT LN | AA LN | Score | P-value |
|---|---|---|---|---|---|---|
| 36072133_c3_1222 | 1405 | 8576 | 1419 | 472 | 2337 | 1.9e-242 |

Description sp:[LN:DNAB_ECOLI] [AC:P03005] [GN:DNAB:GROP:GRPA] [OR:Escherichia coli]
[EC:3.6.1.-] [DE:REPLICATIVE DNA HELICASE,] [SP:P03005] [DB:swissprot]
>sp:[LN:IQECDB] [AC:C65213:S45528:A03535] [PN:replicative DNA helicase,
DnaB:helicase] [GN:dnaB] [CL:phage P22 gene 12 protein] [OR:Escherichia coli]
[EC:3.6.1.-] [DB:pir1] [MP:92 min] >gp:[GI:g145763] [LN:ECODNAB] [AC:K01174]
[OR:Escherichia coli] [SR:Escherichia coli (strain YS1recA) DNA, clone pKA1]
[DB:genpept-bct1] [DE:E.coli dnaB gene coding for a replication protein.]
[NT:DnaB replication protein (dnaB)] [LE:121] [RE:1536] [DI:direct]
>gp:[GI:g1790486] [LN:AE000478] [AC:AE000478:U00096] [PN:replicative DNA
helicase; part of primosome] [GN:dnaB] [FN:factor; DNA - replication, repair,]
[OR:Escherichia coli] [DB:genpept-bct2] [EC:3.6.1.-] [DE:Escherichia coli K-12
MG1655 section 368 of 400 of the completegenome.] [NT:o471; 100 pct identical to
DNAB_ECOLI SW: P03005;] [LE:5153] [RE:6568] [DI:direct] >gp:[GI:g396387]
[LN:ECOUW89] [AC:U00006] [GN:dnaB] [FN:replication protein] [OR:Escherichia coli]
[SR:Escherichia coli (sub_strain MG1655, strain K-12) (library: lambda]
[DB:genpept-bct2] [DE:E. coli chromosomal region from 89.2 to 92.8 minutes.]
[NT:CG Site No. 850] [LE:129558] [RE:130973] [DI:direct]

| ORF Name | NT ID | AA ID | NT LN | AA LN | Score | P-value |
|---|---|---|---|---|---|---|
| 36207175_f1_200 | 1406 | 8577 | 2448 | 815 | 3874 | 0.0 |

Description sp:[LN:XUECAG] [AC:A00565:C42956:H65211] [PN:glycerol-3-phosphate
O-acyltransferase,] [GN:plsB] [CL:glycerol-3-phosphate acyltransferase]
[OR:Escherichia coli] [EC:2.3.1.15] [DB:pir1] [MP:92 min] >gp:[GI:g1790474]
[LN:AE000477] [AC:AE000477:U00096] [PN:glycerol-3-phosphate acyltransferase]
[GN:plsB] [FN:enzyme; Macromolecule synthesis, modification:] [OR:Escherichia
coli] [DB:genpept-bct2] [EC:2.3.1.15] [DE:Escherichia coli K-12 MG1655 section
367 of 400 of the completegenome.] [NT:f827; 99 pct identical amino acid sequence
and] [LE:6138] [RE:8621] [DI:complement]

| ORF Name | NT ID | AA ID | NT LN | AA LN | Score | P-value |
|---|---|---|---|---|---|---|
| 36458587_c2_1167 | 1407 | 8578 | 294 | 97 | 389 | 5.0e-36 |

Description sp:[LN:YJEF_ECOLI] [AC:P31806] [GN:YJEF] [OR:Escherichia coli] [DE:HYPOTHETICAL 54.7 KD PROTEIN IN PSD-AMIB INTERGENIC REGION (URF1)] [SP:P31806] [DB:swissprot] >sp:[LN:S56392] [AC:S56392:B65227:S41739] [PN:hypothetical 54.7K protein (psd-amiB intergenic region):hypothetical protein o515] [GN:yjeF] [OR:Escherichia coli] [DB:pir2] >gp:[GI:g537008] [LN:ECOUW93] [AC:U14003] [GN:yjeF] [OR:Escherichia coli] [DB:genpept-bct1] [DE:Escherichia coli K-12 chromosomal region from 92.8 to 00.1 minutes.] [LE:84894] [RE:86441] [DI:direct] >gp:[GI:g1790609] [LN:AE000489] [AC:AE000489:U00096] [PN:orf, hypothetical protein] [GN:yjeF] [FN:orf; Unknown] [OR:Escherichia coli] [DB:genpept-bct2] [DE:Escherichia coli K-12 MG1655 section 379 of 400 of the completegenome.] [NT:o515; 100 pct identical amino acid sequence and] [LE:1780] [RE:3327] [DI:direct]

| ORF Name | NT ID | AA ID | NT LN | AA LN | Score | P-value |
|---|---|---|---|---|---|---|
| 36521952_c3_1319 | 1408 | 8579 | 597 | 198 | 89 | 0.0036 |

Description gp:[GI:g48715] [LN:ECBET] [AC:X52905:S67313:S67318] [OR:Escherichia coli] [DB:genpept-bct1] [DE:Escherichia coli betT, betI, betB and betA genes.] [NT:run off ORF (AA 1-126)] [SP:P21514] [LE:<1] [RE:379] [DI:complement]

| ORF Name | NT ID | AA ID | NT LN | AA LN | Score | P-value |
|---|---|---|---|---|---|---|
| 36525707_c2_1144 | 1409 | 8580 | 228 | 75 | | |

Description

NO-HIT

| ORF Name | NT ID | AA ID | NT LN | AA LN | Score | P-value |
|---|---|---|---|---|---|---|
| 3916325_c3_1264 | 1410 | 8581 | 570 | 189 | 178 | 1.1e-13 |

Description sp:[LN:YCBQ_ECOLI] [AC:P75855] [GN:YCBQ] [OR:Escherichia coli] [DE:PRECURSOR] [SP:P75855] [DB:swissprot] >sp:[LN:A64834] [AC:A64834] [PN:probable fimbrial protein-like protein ycbQ precursor] [GN:ycbQ] [CL:type 1 fimbrial protein] [OR:Escherichia coli] [DB:pir2] >gp:[GI:d1036679:g4062506] [LN:D90732] [AC:D90732:AB001340] [PN:F17 fimbrial protein precursor] [OR:Escherichia coli] [SR:Escherichia coli(strain:K12) DNA, clone:Kohara clone #221] [DB:genpept-bct1] [DE:Escherichia coli genomic DNA. (21.4 - 21.8 min).] [NT:ORF_ID:o221#6; similar to PIR Accession Number] [LE:5598] [RE:6146] [DI:direct] >gp:[GI:g1787170] [LN:AE000196] [AC:AE000196:U00096] [PN:putative fimbrial-like protein] [GN:ycbQ] [FN:putative structure; Not classified] [OR:Escherichia coli] [DB:genpept-bct2] [DE:Escherichia coli K-12 MG1655 section 86 of 400 of the completegenome.] [NT:o182; This 182 aa ORF is 38 pct identical (5 gaps)] [LE:204] [RE:752] [DI:direct]

| ORF Name | NT ID | AA ID | NT/LN | AA/LN | Score | P-value |
|---|---|---|---|---|---|---|
| 3947175_c1_812 | 1411 | 8582 | 2583 | 860 | 1468 | 2.3e-150 |

Description sp:[LN:FOCD_ECOLI] [AC:P46009] [GN:FOCD] [OR:Escherichia coli] [DE:OUTER MEMBRANE USHER PROTEIN FOCD PRECURSOR] [SP:P46009] [DB:swissprot] >sp:[LN:S49608] [AC:S49608:I41063] [PN:outer membrane usher protein focQ precursor] [GN:focD] [CL:outer membrane usher protein fimD] [OR:Escherichia coli] [DB:pir2] >gp:[GI:g572683] [LN:ECFOCCD] [AC:Z46635] [GN:focD] [OR:Escherichia coli] [DB:genpept-bct1] [DE:E.coli focC and focD genes.] [SP:P46009] [LE:809] [RE:3436] [DI:direct]

| ORF Name | NT ID | AA ID | NT/LN | AA/LN | Score | P-value |
|---|---|---|---|---|---|---|
| 3994818_c3_1304 | 1412 | 8583 | 381 | 126 | 129 | 1.8e-08 |

Description gp:[GI:g6009443] [LN:AB024946] [AC:AB024946] [GN:stbB] [OR:Escherichia coli] [SR:Escherichia coli (sub_species:enteropathogenic, strain:B171] [DB:genpept-bct1] [DE:Escherichia coli plasmid pB171 genomic DNA, complete sequence.] [LE:57097] [RE:57489] [DI:complement]

| ORF Name | NT ID | AA ID | NT/LN | AA/LN | Score | P-value |
|---|---|---|---|---|---|---|
| 4006557_f1_224 | 1413 | 8584 | 1050 | 349 | 678 | 1.2e-66 |

Description sp:[LN:E69902] [AC:E69902] [PN:sodium-dependent transporter homolog yocS] [GN:yocS] [OR:Bacillus subtilis] [DB:pir2] >gp:[GI:e1185407:g2634328] [LN:BSUB0011] [AC:Z99114:AL009126] [GN:yocS] [FN:unknown] [OR:Bacillus subtilis] [DB:genpept-bct1] [DE:Bacillus subtilis complete genome (section 11 of 21): from 2000171to 2207900.] [NT:similar to sodium-dependent transporter] [LE:105575] [RE:106540] [DI:direct] >gp:[GI:g2619019] [LN:AF027868] [AC:AF027868] [PN:putative transporter] [GN:yocS] [OR:Bacillus subtilis] [DB:genpept-bct2] [DE:Bacillus subtilis chromosome region between terC and odhAB.] [NT:similar to B.subtilis 2-keto-3-deoxygluconate] [LE:86484] [RE:87449] [DI:direct]

| ORF_Name | NT ID | AA ID | NT/LN | AA/LN | Score | P-value |
|---|---|---|---|---|---|---|
| 4019143_c2_963 | 1414 | 8585 | 420 | 139 | 570 | 3.3e-55 |

Description sp:[LN:YJBA_ECOLI] [AC:P23896] [GN:YJBA] [OR:Escherichia coli] [DE:HYPOTHETICAL 15.6 KD PROTEIN IN PGI-XYLE INTERGENIC REGION] [SP:P23896] [DB:swissprot] >sp:[LN:E65210] [AC:E65210] [PN:yjbA protein] [GN:yjbA] [CL:Escherichia coli yjbA protein] [OR:Escherichia coli] [DB:pir2] >gp:[GI:g894087] [LN:ECOXYLE] [AC:J02812] [PN:unknown protein] [OR:Escherichia coli] [SR:Escherichia coli (strain K-12) (clone: pEJ3.) DNA] [DB:genpept-bct1] [DE:Escherichia coli xylose-proton symport (xylE) gene, complete cdsand maltose transport (malG) gene, 3' end.] [NT:ORF; putative] [LE:1923] [RE:2333] [DI:complement] >gp:[GI:g1790462] [LN:AE000476] [AC:AE000476:U00096] [PN:orf, hypothetical protein] [GN:yjbA] [FN:orf; Unknown] [OR:Escherichia coli] [DB:genpept-bct2] [DE:Escherichia coli K-12 MG1655 section 366 of 400 of the completegenome.] [NT:o136] [LE:7036] [RE:7446] [DI:direct] >gp:[GI:g396365] [LN:ECOUW89] [AC:U00006] [OR:Escherichia coli] [SR:Escherichia coli (sub_strain MG1655, strain K-12) (library: lambda] [DB:genpept-bct2] [DE:E. coli chromosomal region from 89.2 to 92.8 minutes.] [NT:alternate name yjbA] [LE:105567] [RE:105977] [DI:direct]

| ORF_Name | NT ID | AA ID | NT/LN | AA/LN | Score | P-value |
|---|---|---|---|---|---|---|
| 4085877_c3_1265 | 1415 | 8586 | 699 | 232 | 378 | 7.3e-35 |

Description sp:[LN:LPFB_SALTY] [AC:P43661] [GN:LPFB] [OR:Salmonella typhimurium] [DE:CHAPERONE PROTEIN LPFB PRECURSOR] [SP:P43661] [DB:swissprot] >sp:[LN:B56271] [AC:B56271] [PN:long polar fimbrial chaperone] [GN:lpfB] [CL:chaperone protein papD] [OR:Salmonella typhimurium] [DB:pir1] >gp:[GI:g829372] [LN:STU18559] [AC:U18559] [GN:lpfB] [OR:Salmonella typhimurium] [DB:genpept-bct1] [DE:Salmonella typhimurium long polar fimbriae proteins (lpfA, lpfB,lpfC, lpfD, lpfE) genes, complete cds and (orf1, orf2) genes,partial cds.] [LE:1098] [RE:1796] [DI:direct]

| ORF_Name | NT ID | AA ID | NT/LN | AA/LN | Score | P-value |
|---|---|---|---|---|---|---|
| 4105318_c2_1009 | 1416 | 8587 | 363 | 120 | 175 | 2.4e-13 |

Description sp:[LN:YCGW_ECOLI] [AC:P75987] [GN:YCGW] [OR:Escherichia coli] [DE:HYPOTHETICAL 12.1 KD PROTEIN IN ICDC-MINE INTERGENIC REGION] [SP:P75987] [DB:swissprot] >sp:[LN:E64861] [AC:E64861] [PN:ycgW protein] [GN:ycgW] [CL:Escherichia coli ycgW protein] [OR:Escherichia coli] [DB:pir2] >gp:[GI:g1787407] [LN:AE000215] [AC:AE000215:U00096] [PN:orf, hypothetical protein] [GN:ycgW] [FN:orf; Unknown] [OR:Escherichia coli] [DB:genpept-bct2] [DE:Escherichia coli K-12 MG1655 section 105 of 400 of the completegenome.] [NT:f107; This 107 aa ORF is 29 pct identical (5 gaps)] [LE:1418] [RE:1741] [DI:complement]

| ORF Name | NT ID | AA ID | NT LN | AA LN | Score | P-value |
|---|---|---|---|---|---|---|
| 4312583_c2_1143 | 1417 | 8588 | 357 | 118 | 455 | 5.1e-43 |

Description sp:[LN:SUGE_ECOLI] [AC:P30743] [GN:SUGE] [OR:Escherichia coli] [DE:SUGE PROTEIN]
[SP:P30743] [DB:swissprot] >gp:[GI:g287841] [LN:ECSUGEA] [AC:X69949] [PN:SugES]
[GN:sugE] [OR:Escherichia coli] [DB:genpept-bct1] [DE:E.coli sugE gene.]
[SP:P30743] [LE:412] [RE:729] [DI:direct] >gp:[GI:g3132841] [LN:ECU21726]
[AC:U21726] [PN:SugE] [GN:sugE] [OR:Escherichia coli] [DB:genpept-bct2]
[DE:Escherichia coli lipocalin precursor (blc), SugE (sugE),entericidin B
precursor (ecnB), and entericidin A precursor (ecnA)genes, complete cds.]
[LE:589] [RE:906] [DI:complement]

| ORF Name | NT ID | AA ID | NT LN | AA LN | Score | P-value |
|---|---|---|---|---|---|---|
| 4314432_c1_731 | 1418 | 8589 | 3138 | 1045 | 4823 | 0.0 |

Description sp:[LN:XYECMH] [AC:B65209:JH0096:A32644:B54337:A54337:S06691]
[PN:5-methyltetrahydrofolate--homocysteine S-methyltransferase,:methionine
synthase:tetrahydropteroylglutamate methyltransferase] [GN:metH]
[CL:cobalamin-dependent methionine synthase] [OR:Escherichia coli] [EC:2.1.1.13]
[DB:pir1] [MP:91 min] >gp:[GI:g1790450] [LN:AE000475] [AC:AE000475:U00096]
[PN:B12-dependent] [GN:metH] [FN:enzyme; Amino acid biosynthesis: Methionine]
[OR:Escherichia coli] [DB:genpept-bct2] [EC:2.1.1.13] [DE:Escherichia coli K-12
MG1655 section 365 of 400 of the completegenome.] [NT:o1227; 99 pct identical
amino acid sequence and] [LE:1184] [RE:4867] [DI:direct]

| ORF Name | NT ID | AA ID | NT LN | AA LN | Score | P-value |
|---|---|---|---|---|---|---|
| 4335938_f3_556 | 1419 | 8590 | 927 | 308 | 1330 | 9.6e-136 |

Description sp:[LN:CBPA_ECOLI] [AC:P36659:P77250] [GN:CBPA] [OR:Escherichia coli] [DE:CURVED
DNA-BINDING PROTEIN] [SP:P36659:P77250] [DB:swissprot] >sp:[LN:F64841]
[AC:F64841:S54914:S54915] [PN:curved DNA-binding protein cbpA] [GN:cbpA] [CL:dnaJ
amino-terminal homology] [OR:Escherichia coli] [DB:pir2]
>gp:[GI:d1037128:g1651491] [LN:D90736] [AC:D90736:AB001340] [PN:Curved
DNA-binding protein cbpA] [GN:cbpA] [OR:Escherichia coli] [SR:Escherichia
coli(strain:K12) DNA, clone:Kohara clone #226] [DB:genpept-bct1] [DE:Escherichia
coli genomic DNA. (22.6 - 23.0 min).] [NT:ORF_ID:o227#7; similar to PIR Accession
Number] [LE:17350] [RE:18270] [DI:complement] >gp:[GI:d1036753:g1651497]
[LN:D90737] [AC:D90737:AB001340] [PN:Curved DNA-binding protein cbpA] [GN:cbpA]
[OR:Escherichia coli] [SR:Escherichia coli(strain:K12) DNA, clone:Kohara clone
227] [DB:genpept-bct1] [DE:Escherichia coli genomic DNA. (22.8 - 23.1 min).]
[NT:ORF_ID:o227#7; similar to PIR Accession Number] [LE:8352] [RE:9272]
[DI:complement] >gp:[GI:g1787235] [LN:AE000202] [AC:AE000202:U00096] [PN:curved
DNA-binding protein; functions closely] [GN:cbpA] [FN:factor; Chaperones]
[OR:Escherichia coli] [DB:genpept-bct2] [DE:Escherichia coli K-12 MG1655 section
92 of 400 of the completegenome.] [NT:f306; 100 pct identical to 293 residues]
[LE:411] [RE:1331] [DI:complement]

| ORF Name | NT ID | AA ID | NT LN | AA LN | Score | P-value |
|---|---|---|---|---|---|---|
| 4402186_f1_43 | 1420 | 8591 | 1332 | 443 | 878 | 7.6e-88 |

Description sp:[LN:CVAA_ECOLI] [AC:P22519] [GN:CVAA] [OR:Escherichia coli] [DE:COLICIN V
SECRETION PROTEIN CVAA] [SP:P22519] [DB:swissprot] >sp:[LN:IKEC5A] [AC:S12271]
[PN:colicin V secretion protein cvaA] [GN:cvaA] [CL:hemolysin secretion protein
D:lipoyl/biotin-binding homology] [OR:Escherichia coli] [DB:pir1] >gp:[GI:g41175]
[LN:ECCVAB] [AC:X57524] [PN:cvaA protein] [GN:cvaA] [OR:Escherichia coli]
[DB:genpept-bct1] [DE:E. coli cvaA cvaB operon.] [NT:413 AA] [SP:P22519] [LE:252]
[RE:1493] [DI:direct]

| ORF Name | NT ID | AA ID | NT LN | AA LN | Score | P-value |
|---|---|---|---|---|---|---|
| 4429692_f1_38 | 1421 | 8592 | 696 | 231 | 384 | 1.7e-35 |

Description gp:[GI:g732685] [LN:ECFIMCLUS] [AC:Z37500] [PN:FimC precursor] [FN:Chaperone-like
protein] [OR:Escherichia coli] [DB:genpept-bct1] [DE:E.coli type 1 fimbriae,
genes fimB, fimE, fimA, fimI, fimC.] [SP:P31697] [LE:4177] [RE:4902] [DI:direct]

| ORF Name | NT ID | AA ID | NT LN | AA LN | Score | P-value |
|---|---|---|---|---|---|---|
| 4431916_c3_1213 | 1422 | 8593 | 975 | 324 | 1271 | 1.7e-129 |

Description sp:[LN:MALM_ECOLI] [AC:P03841] [GN:MALM:MOLA] [OR:Escherichia coli] [DE:MALTOSE
OPERON PERIPLASMIC PROTEIN PRECURSOR] [SP:P03841] [DB:swissprot] >sp:[LN:BVECMM]
[AC:A25787:I64879:D65211:A04469] [PN:maltose operon periplasmic protein malM]
[GN:malM:molA] [CL:malM protein] [OR:Escherichia coli] [DB:pir1] [MP:92 min]
>gp:[GI:g41961] [LN:ECMALM] [AC:X04477] [OR:Escherichia coli] [DB:genpept-bct1]
[DE:E.coli malM gene encoding a periplasmic protein.] [NT:periplasmic protein (AA
1-306)] [SP:P03841] [LE:242] [RE:1162] [DI:direct] >gp:[GI:g1790470]
[LN:AE000477] [AC:AE000477:U00096] [PN:periplasmic protein of mal regulon]
[GN:malM] [FN:phenotype; Degradation of small molecules:] [OR:Escherichia coli]
[DB:genpept-bct2] [DE:Escherichia coli K-12 MG1655 section 367 of 400 of the
completegenome.] [NT:o306; CG Site No. 18178; alternate gene name molA] [LE:1649]
[RE:2569] [DI:direct]

| ORF Name | NT ID | AA ID | NT LN | AA LN | Score | P-value |
|---|---|---|---|---|---|---|
| 4453461_c2_1128 | 1423 | 8594 | 405 | 134 | 562 | 2.3e-54 |

Description sp:[LN:YJEI_ECOLI] [AC:P39278] [GN:YJEI] [OR:Escherichia coli] [DE:(O128)]
[SP:P39278] [DB:swissprot] >sp:[LN:S56372] [AC:S56372:F65224] [PN:hypothetical
protein o128:hypothetical protein b4144] [CL:Escherichia coli hypothetical
protein o128] [OR:Escherichia coli] [DB:pir2] >gp:[GI:g536988] [LN:ECOUW93]
[AC:U14003] [OR:Escherichia coli] [DB:genpept-bct1] [DE:Escherichia coli K-12
chromosomal region from 92.8 to 00.1 minutes.] [NT:ORF_o128] [LE:63604]
[RE:63990] [DI:direct] >gp:[GI:g1790587] [LN:AE000487] [AC:AE000487:U00096]
[PN:orf, hypothetical protein] [GN:yjeI] [FN:orf; Unknown] [OR:Escherichia coli]
[DB:genpept-bct2] [DE:Escherichia coli K-12 MG1655 section 377 of 400 of the
completegenome.] [NT:o128] [LE:4266] [RE:4652] [DI:direct]

| ORF Name | NT ID | AA ID | NT LN | AA LN | Score | P-value |
|---|---|---|---|---|---|---|
| 4550760_f2_298 | 1424 | 8595 | 378 | 125 | 489 | 1.3e-46 |

Description sp:[LN:CUTA_ECOLI] [AC:P36654] [GN:CUTA:CYCY:CUTA1] [OR:Escherichia coli]
[DE:BIOGENESIS PROTEIN CYCY)] [SP:P36654] [DB:swissprot] >sp:[LN:I41027]
[AC:I41027:S56365:S61864:G65223:S42063:S47294] [PN:divalent cation tolerance
protein cutA1:cycY protein:hypothetical protein 112] [GN:cutA:cutA1:cycY]
[CL:divalent cation tolerance protein cutA1] [OR:Escherichia coli] [DB:pir2]
>gp:[GI:g535291] [LN:ECCUTA123] [AC:Z36905:L35947] [PN:periplasmic divalent
cation tolerance protein] [GN:CutA1] [OR:Escherichia coli] [DB:genpept-bct1]
[DE:E.coli CutA1, CutA2, and CutA3 genes.] [SP:P36654] [LE:366] [RE:704]
[DI:direct] >gp:[GI:g871028] [LN:ECCYCYZ] [AC:X77707] [GN:orf112] [OR:Escherichia
coli] [DB:genpept-bct1] [DE:E.coli ORF112, DIPZ and ORF191 genes.] [SP:P36654]
[LE:180] [RE:518] [DI:direct] >gp:[GI:g536981] [LN:ECOUW93] [AC:U14003] [GN:cycY]
[FN:involved in biogenesis of C-type cytochromes] [OR:Escherichia coli]
[DB:genpept-bct1] [DE:Escherichia coli K-12 chromosomal region from 92.8 to 00.1
minutes.] [LE:55846] [RE:56184] [DI:complement] >gp:[GI:g1790579] [LN:AE000486]
[AC:AE000486:U00096] [PN:divalent cation tolerance protein; cytochrome c]
[GN:cutA] [FN:phenotype; Adaptations, atypical conditions] [OR:Escherichia coli]
[DB:genpept-bct2] [DE:Escherichia coli K-12 MG1655 section 376 of 400 of the
completegenome.] [NT:f112; 100 pct identical amino acid sequence and] [LE:6391]
[RE:6729] [DI:complement]

| ORF Name | NT ID | AA ID | NT LN | AA LN | Score | P-value |
|---|---|---|---|---|---|---|
| 4806587_c2_993 | 1425 | 8596 | 360 | 119 | 516 | 1.7e-49 |

Description sp:[LN:YJBR_ECOLI] [AC:P32699] [GN:YJBR] [OR:Escherichia coli] [DE:HYPOTHETICAL
13.5 KD PROTEIN IN APHA-UVRA INTERGENIC REGION] [SP:P32699] [DB:swissprot]
>sp:[LN:H65213] [AC:H65213] [PN:hypothetical 13.4 kD protein in tyrB-uvrA
intergenic region] [GN:yjbR] [OR:Escherichia coli] [DB:pir2] >gp:[GI:g2367342]
[LN:AE000479] [AC:AE000479:U00096] [PN:orf, hypothetical protein] [GN:yjbR]
[FN:orf; Unknown] [OR:Escherichia coli] [DB:genpept-bct2] [DE:Escherichia coli
K-12 MG1655 section 369 of 400 of the completegenome.] [NT:o118; 100 pct
identical amino acid sequence and] [LE:1637] [RE:1993] [DI:direct]

| ORF Name | NT ID | AA ID | NT LN | AA LN | Score | P-value |
|---|---|---|---|---|---|---|
| 4859693_c1_773 | 1426 | 8597 | 1089 | 362 | 1673 | 4.3e-172 |

Description sp:[LN:ALR1_ECOLI] [AC:P29743:P78136] [GN:ALR] [OR:Escherichia coli] [EC:5.1.1.1]
[DE:ALANINE RACEMASE, BIOSYNTHETIC,] [SP:P29743:P78136] [DB:swissprot]
>sp:[LN:PC1296] [AC:D65213:PC1296] [PN:alanine racemase,, biosynthetic] [GN:alr]
[CL:alanine racemase] [OR:Escherichia coli] [EC:5.1.1.1] [DB:pir1] [MP:92 min]
>gp:[GI:g1790487] [LN:AE000478] [AC:AE000478:U00096] [PN:alanine racemase 1]
[GN:alr] [FN:enzyme; Amino acid biosynthesis: Alanine] [OR:Escherichia coli]
[DB:genpept-bct2] [EC:5.1.1.1] [DE:Escherichia coli K-12 MG1655 section 368 of
400 of the completegenome.] [NT:o359; ??? pct identical amino acid sequence and]
[LE:6621] [RE:7700] [DI:direct]

| ORF Name | NT ID | AA ID | NT LN | AA LN | Score | P-value |
|---|---|---|---|---|---|---|
| 4891401_c1_816 | 1427 | 8598 | 219 | 72 | | |

Description

NO-HIT

| ORF Name | NT ID | AA ID | NT LN | AA LN | Score | P-value |
|---|---|---|---|---|---|---|
| 4898378_f3_544 | 1428 | 8599 | 213 | 70 | | |

Description

NO-HIT

| ORF Name | NT ID | AA ID | NT LN | AA LN | Score | P-value |
|---|---|---|---|---|---|---|
| 4979505_f1_143 | 1429 | 8600 | 897 | 298 | 560 | 3.8e-54 |

Description sp:[LN:YWBI_BACSU] [AC:P39592] [GN:YWBI:IPA-24D] [OR:Bacillus subtilis]
[DE:HYPOTHETICAL TRANSCRIPTIONAL REGULATOR IN THIK-EPR INTERGENIC REGION]
[SP:P39592] [DB:swissprot] >sp:[LN:S39679] [AC:S39679:G70051] [PN:transcription
regulator homolog ywbI:protein ipa-24d] [GN:ywbI] [CL:probable transcription
regulator lsyR] [OR:Bacillus subtilis] [DB:pir2] >gp:[GI:g413948] [LN:BSGENR]
[AC:X73124] [GN:ipa-24d] [OR:Bacillus subtilis] [DB:genpept-bct1] [DE:B.subtilis
genomic region (325 to 333).] [SP:P39592] [LE:24460] [RE:25365] [DI:direct]
>gp:[GI:e1186330:g2636366] [LN:BSUB0020] [AC:Z99123:AL009126] [GN:ywbI]
[FN:unknown] [OR:Bacillus subtilis] [DB:genpept-bct1] [DE:Bacillus subtilis
complete genome (section 20 of 21): from 3798401to 4010550.] [NT:alternate gene
name: ipa-24d; similar to] [SP:P39592] [LE:132594] [RE:133499] [DI:complement]

| ORF Name | NT ID | AA ID | NT/LN | AA/LN | Score | P-value |
|---|---|---|---|---|---|---|
| 509641_f2_336 | 1430 | 8601 | 588 | 195 | 810 | 1.2e-80 |

Description sp:[LN:PHNH_ECOLI] [AC:P16686] [GN:PHNH] [OR:Escherichia coli] [DE:PHNH PROTEIN] [SP:P16686] [DB:swissprot] >sp:[LN:I35718] [AC:I35718:S56328:C65219] [PN:phnH protein] [GN:phnH] [OR:Escherichia coli] [DB:pir2] >gp:[GI:d1014973:g216597] [LN:ECOPHN] [AC:D90227] [GN:phnH] [OR:Escherichia coli] [SR:Escherichia coli (strain:K-12, sub_strain:W3110) DNA] [DB:genpept-bct1] [DE:Escherichia coli phn operon genes.] [LE:4017] [RE:4601] [DI:direct] >gp:[GI:g147202] [LN:ECOPHNAQ] [AC:J05260] [OR:Escherichia coli] [SR:E.coli (strain B) DNA] [DB:genpept-bct1] [DE:E.coli psiD locus containing alkylphosphonate uptake (phn) genes Athrough Q, complete cds.] [NT:phnH protein] [LE:8253] [RE:8837] [DI:direct] >gp:[GI:g536944] [LN:ECOUW93] [AC:U14003] [GN:phnH] [OR:Escherichia coli] [DB:genpept-bct1] [DE:Escherichia coli K-12 chromosomal region from 92.8 to 00.1 minutes.] [LE:11591] [RE:12175] [DI:complement] >gp:[GI:g1790538] [LN:AE000482] [AC:AE000482:U00096] [PN:phosphonate metabolism] [GN:phnH] [FN:phenotype; Central intermediary metabolism;] [OR:Escherichia coli] [DB:genpept-bct2] [DE:Escherichia coli K-12 MG1655 section 372 of 400 of the completegenome.] [NT:f194] [LE:16310] [RE:16894] [DI:complement]

| ORF Name | NT ID | AA ID | NT/LN | AA/LN | Score | P-value |
|---|---|---|---|---|---|---|
| 5098140_f1_248 | 1431 | 8602 | 183 | 60 | | |

Description

NO-HIT

| ORF Name | NT ID | AA ID | NT/LN | AA/LN | Score | P-value |
|---|---|---|---|---|---|---|
| 519756_f3_665 | 1432 | 8603 | 204 | 67 | | |

Description

NO-HIT

| ORF_Name | NT_ID | AA_ID | NT/LN | AA/LN | Score | P-value |
|---|---|---|---|---|---|---|
| 5197826_f2_343 | 1433 | 8604 | 375 | 124 | 146 | 2.8e-10 |

Description sp:[LN:PHNQ_ECOLI] [AC:P16693] [GN:PHNQ] [OR:Escherichia coli] [DE:VERY HYPOTHETICAL PHNQ PROTEIN] [SP:P16693] [DB:swissprot] >sp:[LN:C42732] [AC:C42732:S56319:B65218] [PN:phnQ protein] [GN:phnQ] [OR:Escherichia coli] [DB:pir2] >gp:[GI:d1014982:g216606] [LN:ECOPHN] [AC:D90227] [GN:phnQ] [OR:Escherichia coli] [SR:Escherichia coli (strain:K-12, sub_strain:W3110) DNA] [DB:genpept-bct1] [DE:Escherichia coli phn operon genes.] [LE:11046] [RE:11453] [DI:direct] >gp:[GI:g536935] [LN:ECOUW93] [AC:U14003] [GN:phnQ] [OR:Escherichia coli] [DB:genpept-bct1] [DE:Escherichia coli K-12 chromosomal region from 92.8 to 00.1 minutes.] [NT:annotated in GenBank Accession Number J05260] [LE:4739] [RE:5146] [DI:complement] >gp:[GI:g1790529] [LN:AE000482] [AC:AE000482:U00096] [PN:orf, hypothetical protein] [GN:phnQ] [FN:orf; Unknown] [OR:Escherichia coli] [DB:genpept-bct2] [DE:Escherichia coli K-12 MG1655 section 372 of 400 of the completegenome.] [NT:f135; annotated in GenBank Accession Number] [LE:9458] [RE:9865] [DI:complement]

| ORF_Name | NT_ID | AA_ID | NT/LN | AA/LN | Score | P-value |
|---|---|---|---|---|---|---|
| 5213580_f2_315 | 1434 | 8605 | 1044 | 347 | 422 | 1.6e-39 |

Description sp:[LN:E69843] [AC:E69843] [PN:conserved hypothetical protein yjbE] [GN:yjbE] [OR:Bacillus subtilis] [DB:pir2] >gp:[GI:e1183171:g2633505] [LN:BSUB0007] [AC:Z99110:AL009126] [GN:yjbE] [FN:unknown] [OR:Bacillus subtilis] [DB:genpept-bct1] [DE:Bacillus subtilis complete genome (section 7 of 21): from 1194391to 1411140.] [NT:similar to hypothetical proteins] [LE:33217] [RE:33873] [DI:complement]

| ORF_Name | NT_ID | AA_ID | NT/LN | AA/LN | Score | P-value |
|---|---|---|---|---|---|---|
| 526081_c2_944 | 1435 | 8606 | 495 | 164 | 808 | 7.8e-80 |

Description sp:[LN:METH_ECOLI] [AC:P13009] [GN:METH] [OR:Escherichia coli] [EC:2.1.1.13] [DE:(METHIONINE SYNTHASE, VITAMIN-B12 DEPENDENT ISOZYME) (MS)] [SP:P13009] [DB:swissprot]

| ORF_Name | NT_ID | AA_ID | NT/LN | AA/LN | Score | P-value |
|---|---|---|---|---|---|---|
| 5267327_f3_646 | 1436 | 8607 | 2826 | 941 | 4761 | 0.0 |

Description sp:[LN:UVRA_SALTY] [AC:P37434] [GN:UVRA] [OR:Salmonella typhimurium] [DE:EXCINUCLEASE ABC SUBUNIT A] [SP:P37434] [DB:swissprot] >gp:[GI:g154417] [LN:STYUVRA] [AC:M93014] [PN:DNA repair enzyme] [GN:uvrA] [OR:Salmonella typhimurium] [SR:Salmonella typhimurium (strain NM522) DNA] [DB:genpept-bct1] [DE:Salmonella typhimurium stranded DNA binding protein (ssb) gene, 5'end; UvrA gene, complete cds.] [NT:amino acid translation shows 98.0% identity to UvrA] [LE:523] [RE:3348] [DI:direct]

| ORF Name | NT ID | AA ID | NT/LN | AA/LN | Score | P-value |
|---|---|---|---|---|---|---|
| 5292800_f1_212 | 1437 | 8608 | 909 | 302 | 1503 | 4.5e-154 |

Description sp:[LN:MALG_ENTAE] [AC:P18814] [GN:MALG] [OR:Enterobacter aerogenes]
[SR:,Aerobacter aerogenes] [DE:MALTOSE TRANSPORT SYSTEM PERMEASE PROTEIN MALG]
[SP:P18814] [DB:swissprot] >sp:[LN:S05333] [AC:S05333] [PN:maltose transport
inner membrane protein malG] [GN:malG] [CL:maltose transport protein malG]
[OR:Enterobacter aerogenes] [DB:pir2]

| ORF Name | NT ID | AA ID | NT/LN | AA/LN | Score | P-value |
|---|---|---|---|---|---|---|
| 5465_c3_1200 | 1438 | 8609 | 1782 | 593 | 2766 | 6.5e-288 |

Description sp:[LN:NUEC] [AC:H65209:JS0142:S04396] [PN:glucose-6-phosphate
isomerase,:phosphoglucose isomerase:phosphohexose isomerase] [GN:pgi]
[CL:glucose-6-phosphate isomerase] [OR:Escherichia coli] [EC:5.3.1.9] [DB:pir1]
[MP:91 min] >gp:[GI:g1790457] [LN:AE000476] [AC:AE000476:U00096]
[PN:glucosephosphate isomerase] [GN:pgi] [FN:enzyme; Energy metabolism, carbon:
Glycolysis] [OR:Escherichia coli] [DB:genpept-bct2] [EC:5.3.1.9] [DE:Escherichia
coli K-12 MG1655 section 366 of 400 of the completegenome.] [NT:o549a; 99 pct
identical amino acid sequence and] [LE:469] [RE:2118] [DI:direct]
>gp:[GI:g396360] [LN:ECOUW89] [AC:U00006] [PN:glucose-6-phosphate isomerase]
[GN:pgi] [OR:Escherichia coli] [SR:Escherichia coli (sub_strain MG1655, strain
K-12) (library: lambda] [DB:genpept-bct2] [EC:5.3.1.9] [DE:E. coli chromosomal
region from 89.2 to 92.8 minutes.] [NT:CG Site No. 409] [LE:99000] [RE:100649]
[DI:direct]

| ORF Name | NT ID | AA ID | NT/LN | AA/LN | Score | P-value |
|---|---|---|---|---|---|---|
| 5861687_c3_1217 | 1439 | 8610 | 381 | 126 | 540 | 5.0e-52 |

Description sp:[LN:KIECDG] [AC:A00667:A65212] [PN:probable diacylglycerol kinase,:diglyceride
kinase] [GN:dgkA] [CL:diacylglycerol kinase] [OR:Escherichia coli] [EC:2.7.1.107]
[DB:pir1] [MP:92 min] >gp:[GI:g457112] [LN:ECOPLSB] [AC:K00127] [PN:diglyceride
kinase] [GN:dgk] [OR:Escherichia coli] [SR:Escherichia coli DNA]
[DB:genpept-bct1] [DE:E.coli plsB and dgk genes coding for
sn-glycerol-3-phosphateacyltransferase and diglyceride kinase.] [LE:15] [RE:383]
[DI:complement] >gp:[GI:g1790475] [LN:AE000477] [AC:AE000477:U00096]
[PN:diacylglycerol kinase] [GN:dgkA] [FN:enzyme; Fatty acid and phosphatidic
acid] [OR:Escherichia coli] [DB:genpept-bct2] [EC:2.7.1.107] [DE:Escherichia coli
K-12 MG1655 section 367 of 400 of the completegenome.] [NT:o122; 100 pct
identical to KDGL_ECOLI SW: P00556;] [LE:8732] [RE:9100] [DI:direct]
>gp:[GI:g396377] [LN:ECOUW89] [AC:U00006] [PN:diacylglycerol kinase] [GN:dgkA]
[OR:Escherichia coli] [SR:Escherichia coli (sub_strain MG1655, strain K-12)
(library: lambda] [DB:genpept-bct2] [EC:2.7.1.107] [DE:E. coli chromosomal region
from 89.2 to 92.8 minutes.] [NT:CG Site No. 862] [LE:121879] [RE:122247]
[DI:direct]

| ORF Name | NT ID | AA ID | NT LN | AA LN | Score | P-value |
|---|---|---|---|---|---|---|
| 5917286_f1_223 | 1440 | 8611 | 1362 | 453 | 1971 | 1.1e-203 |

Description sp:[LN:AK3_ECOLI] [AC:P08660] [GN:LYSC:APK] [OR:Escherichia coli] [EC:2.7.2.4]
[DE:III)] [SP:P08660] [DB:swissprot] >sp:[LN:KIECD3] [AC:G65209:A25659:I41098]
[PN:aspartate kinase, III, lysine-sensitive:aspartokinase III] [GN:lysC]
[CL:aspartate kinase:aspartate kinase homology] [OR:Escherichia coli]
[EC:2.7.2.4] [DB:pir1] [MP:91 min] >gp:[GI:g1790455] [LN:AE000475]
[AC:AE000475:U00096] [PN:aspartokinase III, lysine sensitive] [GN:lysC]
[FN:enzyme; Amino acid biosynthesis: Lysine] [OR:Escherichia coli]
[DB:genpept-bct2] [EC:2.7.2.4] [DE:Escherichia coli K-12 MG1655 section 365 of
400 of the completegenome.] [NT:f449; 100 pct identical to AK3_ECOLI SW: P08660;
CG] [LE:9240] [RE:10589] [DI:complement] >gp:[GI:g396359] [LN:ECOUW89]
[AC:U00006] [PN:aspartokinase III] [GN:lysC] [OR:Escherichia coli]
[SR:Escherichia coli (sub_strain MG1655, strain K-12) (library: lambda]
[DB:genpept-bct2] [EC:2.7.2.4] [DE:E. coli chromosomal region from 89.2 to 92.8
minutes.] [NT:CG Site No. 539] [LE:97126] [RE:98475] [DI:complement]

| ORF Name | NT ID | AA ID | NT LN | AA LN | Score | P-value |
|---|---|---|---|---|---|---|
| 5937775_c1_811 | 1441 | 8612 | 477 | 158 | 186 | 1.6e-14 |

Description sp:[LN:YWBH_BACSU] [AC:P39591] [GN:YWBH:IPA-23R] [OR:Bacillus subtilis]
[DE:HYPOTHETICAL 14.3 KD PROTEIN IN EPR-GALK INTERGENIC REGION] [SP:P39591]
[DB:swissprot] >sp:[LN:S39678] [AC:S39678:F70051] [PN:ywbH protein:hypothetical
protein ipa-23r] [GN:ywbH] [CL:conserved hypothetical protein HI1297]
[OR:Bacillus subtilis] [DB:pir2] >gp:[GI:g413947] [LN:BSGENR] [AC:X73124]
[GN:ipa-23r] [OR:Bacillus subtilis] [DB:genpept-bct1] [DE:B.subtilis genomic
region (325 to 333).] [SP:P39591] [LE:23968] [RE:24354] [DI:complement]
>gp:[GI:e1186331:g2636367] [LN:BSUB0020] [AC:Z99123:AL009126] [GN:ywbH]
[FN:unknown] [OR:Bacillus subtilis] [DB:genpept-bct1] [DE:Bacillus subtilis
complete genome (section 20 of 21): from 3798401to 4010550.] [NT:alternate gene
name: ipa-23r] [SP:P39591] [LE:133605] [RE:133991] [DI:direct]

| ORF Name | NT ID | AA ID | NT LN | AA LN | Score | P-value |
|---|---|---|---|---|---|---|
| 5993837_f1_218 | 1442 | 8613 | 609 | 202 | 181 | 5.5e-14 |

Description gp:[GI:g2558982] [LN:AF025396] [AC:AF025396] [PN:putative acetyl transferase]
[GN:orf16x2] [OR:Vibrio anguillarum] [DB:genpept-bct2] [DE:Vibrio anguillarum rfb
region, partial sequence.] [NT:ORF16x2; similar to B. pertussis BplB encoded by]
[LE:14616] [RE:15071] [DI:direct]

| ORF Name | NT ID | AA ID | NT LN | AA LN | Score | P-value |
|---|---|---|---|---|---|---|
| 6035787_c1_771 | 1443 | 8614 | 570 | 189 | | |

Description

NO-HIT

| ORF Name | NT ID | AA ID | NT/LN | AA/LN | Score | P-value |
|---|---|---|---|---|---|---|
| 6057787_c2_1139 | 1444 | 8615 | 723 | 240 | 228 | 5.7e-19 |

Description gp:[GI:g4324612] [LN:AF106566] [AC:AF106566] [PN:putative transcriptional regulator MarT] [GN:marT] [OR:Salmonella typhimurium] [DB:genpept-bct2] [DE:Salmonella typhimurium pathogenicity island SPI-3, completesequence.] [NT:similar to Escherichia coli Orf269: GenBank] [LE:9550] [RE:10407] [DI:complement]

| ORF Name | NT ID | AA ID | NT/LN | AA/LN | Score | P-value |
|---|---|---|---|---|---|---|
| 6063256_f3_716 | 1445 | 8616 | 471 | 156 | 122 | 2.0e-07 |

Description sp:[LN:D71245] [AC:D71245] [PN:hypothetical protein PH0221] [GN:PH0221] [OR:Pyrococcus horikoshii] [DB:pir2] >gp:[GI:d1030234:g3256608] [LN:AP000001] [AC:AP000001:AB009465:AB009464:AB009466:AB009467:AB009468:AB009469] [PN:235aa long hypothetical protein] [GN:PH0221] [OR:Pyrococcus horikoshii] [SR:Pyrococcus horikoshii (strain:OT3) DNA] [DB:genpept-bct1] [DE:Pyrococcus horikoshii OT3 genomic DNA, 1-287000 nt. position (1/7).] [LE:194212] [RE:194919] [DI:complement]

| ORF Name | NT ID | AA ID | NT/LN | AA/LN | Score | P-value |
|---|---|---|---|---|---|---|
| 6101636_f2_405 | 1446 | 8617 | 255 | 84 | | |

Description

NO-HIT

| ORF Name | NT ID | AA ID | NT/LN | AA/LN | Score | P-value |
|---|---|---|---|---|---|---|
| 6145037_f2_458 | 1447 | 8618 | 786 | 261 | 110 | 0.00014 |

Description sp:[LN:YPIP_LACDL] [AC:P46543] [OR:Lactobacillus delbrueckii] [SR:,subsplactis] [DE:HYPOTHETICAL 19.8 KD PROTEIN IN PEPI 3'REGION] [SP:P46543] [DB:swissprot] >sp:[LN:S44283] [AC:S44283] [PN:paiI repressor homolog] [CL:Bacillus subtilis transcription regulator] [OR:Lactobacillus delbrueckii] [DB:pir2] >gp:[GI:g482922] [LN:LDPEPPIP] [AC:Z26948] [PN:protein with homology to paiI repressor of] [OR:Lactobacillus delbrueckii] [DB:genpept-bct1] [DE:L.delbrueckii (DSM7290) PEPI gene for proline iminopeptidase.] [SP:P46543] [LE:1291] [RE:1812] [DI:complement]

536

| ORF Name | NT ID | AA ID | NT/LN | AA/LN | Score | P-value |
|---|---|---|---|---|---|---|
| 6336526_c3_1338 | 1448 | 8619 | 609 | 202 | 913 | 1.5e-91 |

Description sp:[LN:CH60_KLEPN] [AC:O66026:O66208] [GN:GROEL] [OR:Klebsiella pneumoniae]
[DE:60 KD CHAPERONIN (PROTEIN CPN60) (GROEL PROTEIN) (HSP60KP)]
[SP:O66026:O66208] [DB:swissprot] >gp:[GI:g3002494] [LN:KPU81143] [AC:U81143]
[PN:heat shock protein] [GN:HSP60Kp] [OR:Klebsiella pneumoniae] [DB:genpept-bct2]
[DE:Klebsiella pneumoniae heat shock protein (HSP60Kp) gene, completecds.]
[NT:groEL-like] [LE:88] [RE:1731] [DI:direct]

| ORF Name | NT ID | AA ID | NT/LN | AA/LN | Score | P-value |
|---|---|---|---|---|---|---|
| 6355216_f3_644 | 1449 | 8620 | 1629 | 542 | 326 | 2.9e-27 |

Description gp:[GI:g4580031] [LN:AF086638] [AC:AF086638] [PN:unknown] [OR:Pseudomonas putida
GB-1] [DB:genpept-bct2] [DE:Pseudomonas putida CumA precursor (cumA) and CumB
(cumB) genes, complete cds; and unknown genes.] [NT:OrfY] [LE:3389] [RE:4846]
[DI:complement]

| ORF Name | NT ID | AA ID | NT/LN | AA/LN | Score | P-value |
|---|---|---|---|---|---|---|
| 6421900_c2_1001 | 1450 | 8621 | 192 | 63 | | |

Description

NO-HIT

| ORF Name | NT ID | AA ID | NT/LN | AA/LN | Score | P-value |
|---|---|---|---|---|---|---|
| 6441592_f2_332 | 1451 | 8622 | 378 | 125 | 541 | 3.9e-52 |

Description sp:[LN:PHNA_ECOLI] [AC:P16680] [GN:PHNA] [OR:Escherichia coli] [DE:PHNA PROTEIN]
[SP:P16680] [DB:swissprot] >sp:[LN:B35718] [AC:B35718:S56336:C65220] [PN:phnA
protein] [GN:phnA] [OR:Escherichia coli] [DB:pir2] >gp:[GI:g147194] [LN:ECOPHNAQ]
[AC:J05260] [OR:Escherichia coli] [SR:E.coli (strain B) DNA] [DB:genpept-bct1]
[DE:E.coli psiD locus containing alkylphosphonate uptake (phn) genes Athrough Q,
complete cds.] [NT:phnA protein] [LE:2874] [RE:3209] [DI:direct] >gp:[GI:g536952]
[LN:ECOUW93] [AC:U14003] [GN:phnA] [OR:Escherichia coli] [DB:genpept-bct1]
[DE:Escherichia coli K-12 chromosomal region from 92.8 to 00.1 minutes.]
[LE:17228] [RE:17563] [DI:complement] >gp:[GI:g1790547] [LN:AE000483]
[AC:AE000483:U00096] [PN:orf, hypothetical protein] [GN:phnA] [FN:orf; Unknown]
[OR:Escherichia coli] [DB:genpept-bct2] [DE:Escherichia coli K-12 MG1655 section
373 of 400 of the completegenome.] [NT:f111; 100 pct identical amino acid
sequence and] [LE:1198] [RE:1533] [DI:complement]

| ORF Name | NT ID | AA ID | NT LN | AA LN | Score | P-value |
|---|---|---|---|---|---|---|
| 6751518_c3_1179 | 1452 | 8623 | 942 | 313 | 1537 | 1.1e-157 |

Description sp:[LN:XYECM] [AC:D65208:A93686:A91798:S05690:A05053:JV0023] [PN:homoserine
O-succinyltransferase,:homoserine O-transsuccinylase] [GN:metA] [CL:homoserine
succinyltransferase] [OR:Escherichia coli] [EC:2.3.1.46] [DB:pirl] [MP:91]
>gp:[GI:g1790443] [LN:AE000474] [AC:AE000474:U00096] [PN:homoserine
transsuccinylase] [GN:metA] [FN:enzyme; Amino acid biosynthesis: Methionine]
[OR:Escherichia coli] [DB:genpept-bct2] [EC:2.3.1.46] [DE:Escherichia coli K-12
MG1655 section 364 of 400 of the completegenome.] [NT:o309; 99 pct identical
amino acid sequence and] [LE:6411] [RE:7340] [DI:direct] >gp:[GI:g396348]
[LN:ECOUW89] [AC:U00006] [PN:homoserine transsuccinylase] [GN:metA]
[OR:Escherichia coli] [SR:Escherichia coli (sub_strain MG1655, strain K-12)
(library: lambda) [DB:genpept-bct2] [EC:2.3.1.46] [DE:E. coli chromosomal region
from 89.2 to 92.8 minutes.] [NT:CG Site No. 516] [LE:79522] [RE:80451]
[DI:direct]

| ORF Name | NT ID | AA ID | NT LN | AA LN | Score | P-value |
|---|---|---|---|---|---|---|
| 6909752_c1_853 | 1453 | 8624 | 204 | 67 | | |

Description

NO-HIT

| ORF Name | NT ID | AA ID | NT LN | AA LN | Score | P-value |
|---|---|---|---|---|---|---|
| 6927091_f3_585 | 1454 | 8625 | 1026 | 341 | 141 | 2.9e-14 |

Description sp:[LN:RBSK_ECOLI] [AC:P05054] [GN:RBSK] [OR:Escherichia coli] [EC:2.7.1.15]
[DE:RIBOKINASE,] [SP:P05054] [DB:swissprot] >sp:[LN:KIECRB] [AC:A26305:A65179]
[PN:ribokinase,] [GN:rbsK] [CL:ribokinase] [OR:Escherichia coli] [EC:2.7.1.15]
[DB:pirl] [MP:84 min] >gp:[GI:g147516] [LN:ECORBS] [AC:M13169:M13517]
[PN:ribokinase] [GN:rbsK] [OR:Escherichia coli]
[DB:genpept-bct1] [EC:2.7.1.15] [DE:E.coli K12 rbsD, rbsA, rbsC, rbsB, rbsK, and
rbsR genes encodingthe high affinity ribose transport system, complete cds.]
[LE:4128] [RE:5057] [DI:direct] >gp:[GI:g290602] [LN:ECOUW82] [AC:L10328]
[PN:ribokinase] [GN:rbsK (CG Site No. 315)] [OR:Escherichia coli] [SR:Escherichia
coli K12 strain MG1655; lambda clones EC14-52] [DB:genpept-bct1] [DE:E. coli; the
region from 81.5 to 84.5 minutes.] [LE:126682] [RE:127611] [DI:direct]
>gp:[GI:g1790193] [LN:AE000452] [AC:AE000452:U00096] [PN:ribokinase] [GN:rbsK]
[FN:enzyme; Degradation of small molecules: Carbon] [OR:Escherichia coli]
[DB:genpept-bct2] [DE:Escherichia coli K-12 MG1655 section 342 of 400 of the
completegenome.] [NT:o309; CG Site No. 315] [LE:4299] [RE:5228] [DI:direct]

| ORF Name | NT ID | AA ID | NT/LN | AA/LN | Score | P-value |
|---|---|---|---|---|---|---|
| 7142783_f1_48 | 1455 | 8626 | 516 | 171 | 253 | 1.3e-21 |

Description gp:[GI:g1196510] [LN:MSGTCWPA] [AC:M15467] [PN:unknown protein] [OR:Mycobacterium tuberculosis] [SR:Mycobacterium tuberculosis (strain Erdman) DNA] [DB:genpept-bct1] [DE:M.tuberculosis 65 kDa antigen (cell wall protein a) gene.] [NT:ORF F175; putative] [LE:242] [RE:769] [DI:complement]

| ORF Name | NT ID | AA ID | NT/LN | AA/LN | Score | P-value |
|---|---|---|---|---|---|---|
| 906886_f2_346 | 1456 | 8627 | 1584 | 527 | 1115 | 5.8e-113 |

Description sp:[LN:H69689] [AC:H69689:I40465:S42713] [PN:ribose ABC transporter (ATP-binding protein) rbsA] [GN:rbsA] [CL:unassigned ATP-binding cassette proteins:ATP-binding cassette homology] [OR:Bacillus subtilis] [DB:pir2] >gp:[GI:e1184500:g2636119] [LN:BSUB0019] [AC:Z99122:AL009126] [PN:ribose ABC transporter (ATP-binding protein)] [GN:rbsA] [FN:ribose transport] [OR:Bacillus subtilis] [DB:genpept-bct1] [DE:Bacillus subtilis complete genome (section 19 of 21): from 3597091to 3809700.] [LE:105649] [RE:107130] [DI:direct] >gp:[GI:e308083:g1894759] [LN:BSZ92953] [AC:Z92953] [PN:ATP-binding transport protein] [GN:rbsA] [OR:Bacillus subtilis] [DB:genpept-bct1] [DE:B.subtilis yws[A,B,C] genes and rbs[A,C,D,K,R] genes.] [NT:part of the ribose transport operon] [LE:2888] [RE:4369] [DI:complement]

| ORF Name | NT ID | AA ID | NT/LN | AA/LN | Score | P-value |
|---|---|---|---|---|---|---|
| 910331_f2_442 | 1457 | 8628 | 414 | 137 | 113 | 9.8e-07 |

Description gp:[GI:d1022219:g2257475] [LN:AB003475] [AC:AB003475] [GN:orf144a] [OR:Deinococcus radiodurans] [SR:Deinococcus radiodurans (strain:KD8301) DNA, clone_lib:pDC144] [DB:genpept-bct1] [DE:Deinococcus radiodurans gene for aldehyde dehydrogenase, succinicsemialdehyde dehydrogenase,partial and complete cds.] [LE:1226] [RE:1801] [DI:direct]

| ORF Name | NT ID | AA ID | NT/LN | AA/LN | Score | P-value |
|---|---|---|---|---|---|---|
| 97662_c3_1383 | 1458 | 8629 | 192 | 63 | | |

Description

NO-HIT

| ORF Name | NT ID | AA ID | NT LN | AA LN | Score | P-value |
|---|---|---|---|---|---|---|
| 9864786_f3_594 | 1459 | 8630 | 1728 | 575 | 2878 | 8.8e-300 |

Description sp:[LN:FDHF_ECOLI] [AC:P07658:P78137] [GN:FDHF] [OR:Escherichia coli]
[EC:1.2.1.2] [DE:SUBUNIT) (FDH-H)] [SP:P07658:P78137] [DB:swissprot]
>sp:[LN:DEECFS] [AC:A24145:F65216:A36088] [PN:formate dehydrogenase, H
(hydrogenase-linked):formate dehydrogenase H (benzylviologen-linked)
(FDH-H):formate hydrogenlyase complex selenocysteine-containing protein]
[GN:fdhF] [CL:formate dehydrogenase] [OR:Escherichia coli] [EC:1.2.1.2] [DB:pir1]
[MP:92 min]

| ORF Name | NT ID | AA ID | NT LN | AA LN | Score | P-value |
|---|---|---|---|---|---|---|
| 9932188_c1_782 | 1460 | 8631 | 549 | 182 | 879 | 6.0e-88 |

Description sp:[LN:DDEC] [AC:B65214:B20023:A02681] [PN:single-stranded DNA-binding
protein:helix-destabilizing protein] [GN:ssb] [CL:bacterial single-stranded
DNA-binding protein:single-stranded DNA-binding protein homology] [OR:Escherichia
coli] [DB:pir1] [MP:92 min] >gp:[GI:g1790494] [LN:AE000479] [AC:AE000479:U00096]
[PN:ssDNA-binding protein] [GN:ssb] [FN:factor; DNA - replication, repair,]
[OR:Escherichia coli] [DB:genpept-bct2] [DE:Escherichia coli K-12 MG1655 section
369 of 400 of the completegenome.] [NT:o178; CG Site No. 150] [LE:5104] [RE:5640]
[DI:direct] >gp:[GI:g396394] [LN:ECOUW89] [AC:U00006] [PN:single-strand
DNA-binding protein] [GN:ssb] [OR:Escherichia coli] [SR:Escherichia coli
(sub_strain MG1655, strain K-12) (library: lambda) [DB:genpept-bct2] [DE:E. coli
chromosomal region from 89.2 to 92.8 minutes.] [NT:CG Site No. 150] [LE:139365]
[RE:139901] [DI:direct]

| ORF Name | NT ID | AA ID | NT LN | AA LN | Score | P-value |
|---|---|---|---|---|---|---|
| 10194790_f1_377 | 1461 | 8632 | 1047 | 348 | 1377 | 1.0e-140 |

Description sp:[LN:YTFF_ECOLI] [AC:P39314] [GN:YTFF] [OR:Escherichia coli] [DE:HYPOTHETICAL
35.5 KD PROTEIN IN RPLI-CPDB INTERGENIC REGION (F324)] [SP:P39314] [DB:swissprot]
>sp:[LN:S56435] [AC:S56435:E65232] [PN:hypothetical 35.5K protein (rpli-cpdb
intergenic region):hypothetical protein f324] [GN:ytfF] [OR:Escherichia coli]
[DB:pir2] >gp:[GI:g537051] [LN:ECOUW93] [AC:U14003] [OR:Escherichia coli]
[DB:genpept-bct1] [DE:Escherichia coli K-12 chromosomal region from 92.8 to 00.1
minutes.] [NT:ORF_f324] [LE:122923] [RE:123897] [DI:complement] >gp:[GI:g1790655]
[LN:AE000492] [AC:AE000492:U00096] [PN:putative transmembrane subunit] [GN:ytfF]
[FN:putative membrane; Not classified] [OR:Escherichia coli] [DB:genpept-bct2]
[DE:Escherichia coli K-12 MG1655 section 382 of 400 of the completegenome.]
[NT:f324; 100 pct identical amino acid sequence and] [LE:4663] [RE:5637]
[DI:complement]

| ORF Name | NT ID | AA ID | NT/LN | AA/LN | Score | P-value |
|---|---|---|---|---|---|---|
| 10242137_c2_1873 | 1462 | 8633 | 480 | 159 | 449 | 2.2e-42 |

Description sp:[LN:YKFI_ECOLI] [AC:P77692] [GN:YKFI] [OR:Escherichia coli] [DE:HYPOTHETICAL 12.9 KD PROTEIN IN PROA-PERR INTERGENIC REGION] [SP:P77692] [DB:swissprot] >sp:[LN:E64749] [AC:E64749] [PN:hypothetical protein b0245] [OR:Escherichia coli] [DB:pir2] >gp:[GI:g1552812] [LN:ECU70214] [AC:U70214] [OR:Escherichia coli] [DB:genpept-bct1] [DE:Escherichia coli chromosome minutes 4-6.] [NT:similar to E. coli ORF_o109] [LE:93627] [RE:93968] [DI:complement] >gp:[GI:g1786439] [LN:AE000132] [AC:AE000132:U00096] [PN:orf, hypothetical protein] [GN:b0245] [FN:orf; Unknown] [OR:Escherichia coli] [DB:genpept-bct2] [DE:Escherichia coli K-12 MG1655 section 22 of 400 of the completegenome.] [NT:f113; 31 pct identical (3 gaps) to 67 residues of] [LE:9268] [RE:9609] [DI:complement]

| ORF Name | NT ID | AA ID | NT/LN | AA/LN | Score | P-value |
|---|---|---|---|---|---|---|
| 10244067_c3_2460 | 1463 | 8634 | 510 | 169 | 525 | 1.9e-50 |

Description sp:[LN:TRPR_ENTAE] [AC:P39439] [GN:TRPR] [OR:Enterobacter aerogenes] [SR:,Aerobacter aerogenes] [DE:TRP OPERON REPRESSOR] [SP:P39439] [DB:swissprot] >sp:[LN:S45254] [AC:S45254] [PN:trp operon repressor:tryptophan repressor] [GN:trpR] [CL:trp repressor] [OR:Enterobacter aerogenes] [DB:pir2] >gp:[GI:g433054] [LN:ENTTRPR] [AC:L26582] [PN:tryptophan repressor] [GN:trpR] [OR:Enterobacter aerogenes] [SR:Enterobacter aerogenes DNA] [DB:genpept-bct2] [DE:Enterobacter aerogenes tryptophan repressor (trpR) gene, completecds.] [NT:putative] [LE:44] [RE:370] [DI:direct]

| ORF Name | NT ID | AA ID | NT/LN | AA/LN | Score | P-value |
|---|---|---|---|---|---|---|
| 10291087_f2_633 | 1464 | 8635 | 741 | 246 | 963 | 7.5e-97 |

Description gp:[GI:e1389908:g4456866] [LN:STY224978] [AC:AJ224978] [GN:ORF 242] [OR:Salmonella typhimurium] [DB:genpept-bct1] [DE:Salmonella typhimurium, Salmonella Pathogenicity Island 2 (SPI2)genes, ttr gene cluster.] [LE:44] [RE:772] [DI:direct]

| ORF Name | NT ID | AA ID | NT/LN | AA/LN | Score | P-value |
|---|---|---|---|---|---|---|
| 1032786_f1_340 | 1465 | 8636 | 1239 | 412 | 211 | 9.3e-15 |

Description gp:[GI:g5881935] [LN:SCF41] [AC:AL117387] [PN:hypothetical protein SCF41.25] [GN:SCF41.25] [OR:Streptomyces coelicolor A3(2)] [DB:genpept-bct1] [DE:Streptomyces coelicolor cosmid F41.] [NT:SCF41.25, unknown, len: 355 aa.] [LE:24153] [RE:25220] [DI:direct]

| ORF_Name | NT_ID | AA_ID | NT/LN | AA/LN | Score | P-value |
|---|---|---|---|---|---|---|
| 10761077_f3_1171 | 1466 | 8637 | 1518 | 505 | 2268 | 3.8e-235 |

Description sp:[LN:YJGR_ECOLI] [AC:P39342] [GN:YJGR] [OR:Escherichia coli] [DE:HYPOTHETICAL 54.3 KD PROTEIN IN PEPA-GNTV INTERGENIC REGION (F500)] [SP:P39342] [DB:swissprot] >sp:[LN:S56489] [AC:S56489:B65239] [PN:hypothetical 54.3K protein (pepa-gntv intergenic region):hypothetical protein f500] [GN:yjgR] [OR:Escherichia coli] [DB:pir2] >gp:[GI:g537105] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_f500] [LE:179396] [RE:180898] [DI:complement] >gp:[GI:g1790714] [LN:AE000497] [AC:AE000497:U00096] [PN:orf, hypothetical protein] [GN:yjgR] [FN:orf; Unknown] [OR:Escherichia coli] [DB:genpept-bct2] [DE:Escherichia coli K-12 MG1655 section 387 of 400 of the completegenome.] [NT:f500; 100 pct identical amino acid sequence and] [LE:2539] [RE:4041] [DI:complement]

| ORF_Name | NT_ID | AA_ID | NT/LN | AA/LN | Score | P-value |
|---|---|---|---|---|---|---|
| 1093_f2_763 | 1467 | 8638 | 972 | 323 | 1495 | 3.2e-153 |

Description sp:[LN:DTECC] [AC:H65236:A00561:A21121:B36599:A21120:S56471] [PN:aspartate carbamoyltransferase, catalytic chain:aspartate transcarbamylase catalytic chain:aspartyl carbamoyltransferase catalytic chain:carbamylaspartotranskinase catalytic chain] [GN:pyrB] [CL:ornithine carbamoyltransferase:aspartate/ornithine carbamoyltransferase homology] [OR:Escherichia coli] [EC:2.1.3.2] [DB:pir1] [MP:97 min] >gp:[GI:g2367364] [LN:AE000495] [AC:AE000495:U00096] [PN:aspartate carbamoyltransferase, catalytic] [GN:pyrB] [FN:enzyme; Pyrimidine ribonucleotide biosynthesis] [OR:Escherichia coli] [DB:genpept-bct2] [EC:2.1.3.2] [DE:Escherichia coli K-12 MG1655 section 385 of 400 of the completegenome.] [NT:f311; 99 pct identical amino acid sequence and] [LE:12102] [RE:13037] [DI:complement]

| ORF_Name | NT_ID | AA_ID | NT/LN | AA/LN | Score | P-value |
|---|---|---|---|---|---|---|
| 11034577_c1_1488 | 1468 | 8639 | 267 | 88 | 118 | 8.1e-07 |

Description sp:[LN:ICP3_HSV1F] [AC:P08353] [GN:ICP34.5] [OR:Herpes simplex virus] [SR:,type 1 / strain F] [DE:INFECTED CELL PROTEIN ICP34.5 (NEUROVIRULENCE FACTOR ICP34.5)] [SP:P08353] [DB:swissprot] >gp:[GI:g330115] [LN:HS1ICP345A] [AC:M33699] [OR:human herpesvirus 1] [SR:Herpes simplex virus type 1 (strain F) DNA] [DB:genpept-vrl] [DE:Herpes simplex virus type 1 infected-cell protein (ICP34.5) gene,complete cds.] [NT:infected-cell protein 34.5] [LE:133] [RE:924] [DI:direct]

| ORF Name | NT ID | AA ID | NT LN | AA LN | Score | P-value |
|---|---|---|---|---|---|---|
| 11072333_c3_2153 | 1469 | 8640 | 225 | 74 | 274 | 7.7e-24 |

Description sp:[LN:YJFF_ECOLI] [AC:P37772] [GN:YJFF] [OR:Escherichia coli] [DE:HYPOTHETICAL
ABC TRANSPORTER PERMEASE PROTEIN YJFF] [SP:P37772] [DB:swissprot] >sp:[LN:S56457]
[AC:S56457:B65235] [PN:hypothetical 34.0K protein (ppa-fbp intergenic
region):hypothetical protein o323] [GN:yjfF] [CL:l-arabinose transport system
permease araH] [OR:Escherichia coli] [DB:pir2] >gp:[GI:g537073] [LN:ECOUW93]
[AC:U14003] [OR:Escherichia coli] [DB:genpept-bct1] [DE:Escherichia coli K-12
chromosomal region from 92.8 to 00.1 minutes.] [NT:ORF_o323] [LE:144436]
[RE:145407] [DI:direct] >gp:[GI:g1790678] [LN:AE000494] [AC:AE000494:U00096]
[PN:putative transport system permease protein] [GN:yjfF] [FN:putative transport;
Not classified] [OR:Escherichia coli] [DB:genpept-bct2] [DE:Escherichia coli K-12
MG1655 section 384 of 400 of the completegenome.] [NT:o323; 100 pct identical
amino acid sequence and] [LE:5291] [RE:6262] [DI:direct]

| ORF Name | NT ID | AA ID | NT LN | AA LN | Score | P-value |
|---|---|---|---|---|---|---|
| 11183466_c2_1937 | 1470 | 8641 | 984 | 327 | 447 | 3.6e-42 |

Description sp:[LN:B69690] [AC:B69690:I40466:S42714] [PN:ribose ABC transporter (permease)
rbsC] [GN:rbsC] [CL:l-arabinose transport system permease araH] [OR:Bacillus
subtilis] [DB:pir2] >gp:[GI:e1184501:g2636120] [LN:BSUB0019] [AC:Z99122:AL009126]
[PN:ribose ABC transporter (permease)] [GN:rbsC] [FN:ribose transport]
[OR:Bacillus subtilis] [DB:genpept-bct1] [DE:Bacillus subtilis complete genome
(section 19 of 21): from 3597091to 3809700.] [LE:107132] [RE:108100] [DI:direct]
>gp:[GI:e308082:g1894758] [LN:BSZ92953] [AC:Z92953] [PN:membrane transport
protein] [GN:rbsC] [OR:Bacillus subtilis] [DB:genpept-bct1] [DE:B.subtilis
yws[A,B,C] genes and rbs[A,C,D,K,R] genes.] [NT:part of the ribose transport
operon] [LE:1918] [RE:2886] [DI:complement]

| ORF Name | NT ID | AA ID | NT LN | AA LN | Score | P-value |
|---|---|---|---|---|---|---|
| 11190767_c2_1883 | 1471 | 8642 | 309 | 102 | 399 | 4.4e-37 |

Description gp:[GI:e1549683:g5832508] [LN:YPCD1] [AC:AL117189] [PN:putative transposase]
[GN:YPCD1.93] [OR:Yersinia pestis] [DB:genpept-bct1] [DE:Yersinia pestis plasmid
pCD1.] [NT:YPCD1.93, Y0084, probable transposase, len: 88 aa;] [LE:66932]
[RE:67198] [DI:direct] >gp:[GI:g2996269] [LN:AF053946] [AC:AF053946] [PN:putative
transposase] [OR:Yersinia pestis] [DB:genpept-bct2] [DE:Yersinia pestis plasmid
pCD1, complete plasmid sequence.] [LE:49594] [RE:49860] [DI:complement]
>gp:[GI:g3822101] [LN:AF074612] [AC:AF074612] [PN:putative IS1617 transposase]
[GN:Y0084] [OR:Yersinia pestis] [DB:genpept-bct2] [DE:Yersinia pestis plasmid
pCD1, complete plasmid sequence.] [LE:62202] [RE:62468] [DI:complement]

| ORF Name | NT ID | AA ID | NT LN | AA LN | Score | P-value |
|---|---|---|---|---|---|---|
| 11734692_f2_575 | 1472 | 8643 | 1038 | 345 | 1329 | 1.2e-135 |

Description sp:[LN:YJIA_ECOLI] [AC:P24203] [GN:YJIA] [OR:Escherichia coli] [DE:HYPOTHETICAL 32.0 KD PROTEIN IN MRR-TSR INTERGENIC REGION (F284)] [SP:P24203] [DB:swissprot] >sp:[LN:S56578] [AC:S56578:B65250:S18778] [PN:yjiA protein:hypothetical 32K protein (mrr-tsr intergenic region)] [GN:yjiA] [OR:Escherichia coli] [DB:pir2] >gp:[GI:g537194] [LN:ECOUW93] [AC:U14003] [GN:yjiA] [OR:Escherichia coli] [DB:genpept-bct1] [DE:Escherichia coli K-12 chromosomal region from 92.8 to 00.1 minutes.] [LE:278742] [RE:279596] [DI:complement] >gp:[GI:g1790812] [LN:AE000506] [AC:AE000506:U00096] [PN:orf, hypothetical protein] [GN:yjiA] [FN:orf; Unknown] [OR:Escherichia coli] [DB:genpept-bct2] [DE:Escherichia coli K-12 MG1655 section 396 of 400 of the completegenome.] [NT:f284; f284; 100 pct identical amino acid] [LE:1057] [RE:1911] [DI:complement]

| ORF Name | NT ID | AA ID | NT LN | AA LN | Score | P-value |
|---|---|---|---|---|---|---|
| 11760457_c1_1695 | 1473 | 8644 | 1053 | 350 | 1487 | 2.2e-152 |

Description sp:[LN:LYTB_ECOLI] [AC:P22565] [GN:LYTB] [OR:Escherichia coli] [DE:LYTB PROTEIN] [SP:P22565] [DB:swissprot] >sp:[LN:JE0403] [AC:JE0403:S40552:E64723:S22290] [PN:lytB protein] [GN:lytB] [CL:penicillin tolerance protein] [OR:Escherichia coli] [DB:pir2] >gp:[GI:g41933] [LN:ECLSPDAP] [AC:X54945] [GN:ORF 2] [OR:Escherichia coli] [DB:genpept-bct1] [DE:E. coli lsp-dapB interval.] [SP:P22565] [LE:597] [RE:1547] [DI:direct] >gp:[GI:d1001779:g216456] [LN:ECO110K] [AC:D10483:J01597:J01683:J01706:K01298:K01990:M10420:M10611:M12544] [OR:Escherichia coli] [SR:Escherichia coli (strain:K-12) DNA] [DB:genpept-bct1] [DE:E.coli K12 genome, 0-2.4min. region.] [NT:hypothetical 34.8K protein(PIR:JE0403)] [LE:25931] [RE:26881] [DI:direct] >gp:[GI:g1786212] [LN:AE000113] [AC:AE000113:U00096] [PN:control of stringent response; involved in] [GN:lytB] [FN:regulator; Global regulatory functions] [OR:Escherichia coli] [DB:genpept-bct2] [DE:Escherichia coli K-12 MG1655 section 3 of 400 of the completegenome.] [NT:o316; 100 pct identical to LYTB_ECOLI SW: P22565] [LE:5618] [RE:6568] [DI:direct]

| ORF Name | NT ID | AA ID | NT LN | AA LN | Score | P-value |
|---|---|---|---|---|---|---|
| 11775325_f1_386 | 1474 | 8645 | 1197 | 398 | 1504 | 3.5e-154 |

Description gp:[GI:e1332415:g3758825] [LN:KPN011907] [AC:AJ011907] [PN:hypothetical protein] [OR:Klebsiella pneumoniae] [DB:genpept-bct1] [DE:Klebsiella pneumoniae DNA sequence for transposon Tn5711, partial.] [NT:ORF3] [LE:4730] [RE:5944] [DI:complement]

| ORF Name | NT ID | AA ID | NT LN | AA LN | Score | P-value |
|---|---|---|---|---|---|---|
| 11848202_c1_1385 | 1475 | 8646 | 2355 | 784 | | |

Description

NO-HIT

| ORF Name | NT ID | AA ID | NT LN | AA LN | Score | P-value |
|---|---|---|---|---|---|---|
| 11876682_f1_223 | 1476 | 8647 | 525 | 174 | 125 | 4.7e-08 |

Description sp:[LN:YI73_BURCE] [AC:P24579] [OR:Burkholderia cepacia] [SR:,Pseudomonas cepacia] [DE:INSERTION ELEMENT IS407 HYPOTHETICAL 9.1 KD PROTEIN (ORF3)] [SP:P24579] [DB:swissprot] >sp:[LN:S28801] [AC:S28801] [PN:hypothetical protein 3] [OR:Pseudomonas cepacia] [DB:pir2] >gp:[GI:g455281] [LN:INSIS407A] [AC:M82980:M38378] [OR:Insertion sequence IS407] [SR:Insertion sequence IS407 (library: ATCC 17616) DNA] [DB:genpept-bct1] [DE:Insertion sequence IS407 containing four open reading frames,complete DNA.] [NT:ORF3] [LE:179] [RE:436] [DI:complement]

| ORF Name | NT ID | AA ID | NT LN | AA LN | Score | P-value |
|---|---|---|---|---|---|---|
| 11891250_c2_1777 | 1477 | 8648 | 429 | 142 | 292 | 9.5e-26 |

Description gp:[GI:d1012413:g1783269] [LN:D83026] [AC:D83026:D45911] [PN:6-phospho-beta-glucosidase] [GN:celD(partial)] [OR:Bacillus subtilis] [SR:Bacillus subtilis (strain:BGSC 1A1) DNA] [DB:genpept-bct1] [DE:Bacillus subtilis genome sequence covering lic-cel region.] [NT:putative] [LE:64227] [RE:>65143] [DI:direct]

| ORF Name | NT ID | AA ID | NT LN | AA LN | Score | P-value |
|---|---|---|---|---|---|---|
| 11895293_c3_2434 | 1478 | 8649 | 774 | 257 | 1024 | 2.6e-103 |

Description sp:[LN:YJJG_ECOLI] [AC:P33999:P76818] [GN:YJJG] [OR:Escherichia coli] [DE:HYPOTHETICAL 25.3 KD PROTEIN IN RIMI-PRFC INTERGENIC REGION] [SP:P33999:P76818] [DB:swissprot] >sp:[LN:S56598] [AC:S56598:E65252] [PN:hypothetical 22.2K protein (rimI-prfC intergenic region):yjjG protein] [GN:yjjG] [OR:Escherichia coli] [DB:pir2] >gp:[GI:g537214] [LN:ECOUW93] [AC:U14003] [GN:yjjG] [OR:Escherichia coli] [DB:genpept-bct1] [DE:Escherichia coli K-12 chromosomal region from 92.8 to 00.1 minutes.] [LE:299477] [RE:300154] [DI:direct] >gp:[GI:g1790833] [LN:AE000507] [AC:AE000507:U00096] [PN:putative phosphatase] [GN:yjjG] [FN:putative enzyme; Not classified] [OR:Escherichia coli] [DB:genpept-bct2] [DE:Escherichia coli K-12 MG1655 section 397 of 400 of the completegenome.] [NT:o225b; o225; 100 pct identical to 200 amino acids] [LE:11595] [RE:12272] [DI:direct]

| ORF Name | NT ID | AA ID | NT LN | AA LN | Score | P-value |
|---|---|---|---|---|---|---|
| 11953915_c2_1768 | 1479 | 8650 | 1221 | 406 | 316 | 2.7e-28 |

Description sp:[LN:D69856] [AC:D69856] [PN:conserved hypothetical protein ykgB] [GN:ykgB] [OR:Bacillus subtilis] [DB:pir2] >gp:[GI:e1181502:g2632022] [LN:BSAJ2571] [AC:AJ002571] [PN:YkgB] [GN:ykgB] [FN:unknown] [OR:Bacillus subtilis] [DB:genpept-bct1] [DE:Bacillus subtilis 168 56 kb DNA fragment between xlyA and ykoR.] [LE:22000] [RE:23049] [DI:complement] >gp:[GI:e1183321:g2633655] [LN:BSUB0007] [AC:Z99110:AL009126] [GN:ykgB] [FN:unknown] [OR:Bacillus subtilis] [DB:genpept-bct1] [DE:Bacillus subtilis complete genome (section 7 of 21): from 1194391to 1411140.] [NT:similar to hypothetical proteins] [LE:174949] [RE:175998] [DI:complement]

| ORF Name | NT ID | AA ID | NT LN | AA LN | Score | P-value |
|---|---|---|---|---|---|---|
| 1197150_f1_264 | 1480 | 8651 | 828 | 275 | 256 | 6.2e-22 |

Description gp:[GI:e1427349:g4691401] [LN:SC9B1] [AC:AL049727] [PN:hypothetical protein] [GN:SC9B1.22c] [OR:Streptomyces coelicolor] [DB:genpept-bct1] [DE:Streptomyces coelicolor cosmid 9B1.] [NT:SC9B1.22c, unknown, len: 273aa; similar to many] [LE:21783] [RE:22604] [DI:complement]

| ORF Name | NT ID | AA ID | NT LN | AA LN | Score | P-value |
|---|---|---|---|---|---|---|
| 11977191_f2_484 | 1481 | 8652 | 198 | 65 | 107 | 1.1e-05 |

Description sp:[LN:D70894] [AC:D70894] [PN:probable pra protein] [GN:pra] [OR:Mycobacterium tuberculosis] [DB:pir2] >gp:[GI:e1251957:g2896715] [LN:MTV017] [AC:AL021897:AL123456] [PN:pra] [GN:pra] [OR:Mycobacterium tuberculosis] [DB:genpept-bct1] [DE:Mycobacterium tuberculosis H37Rv complete genome; segment 48/162.] [NT:Rv1078, (MTV017.31), pra, len: 240. Unknown but] [LE:31111] [RE:31833] [DI:direct]

| ORF Name | NT ID | AA ID | NT LN | AA LN | Score | P-value |
|---|---|---|---|---|---|---|
| 12207655_I3_975 | 1482 | 8653 | 855 | 284 | 1154 | 4.3e-117 |

Description sp:[LN:YJJP_ECOLI] [AC:P39402] [GN:YJJP] [OR:Escherichia coli] [DE:HYPOTHETICAL 30.5 KD PROTEIN IN DNAT-BGLJ INTERGENIC REGION (F277)] [SP:P39402] [DB:swissprot] >sp:[LN:S56591] [AC:S56591:F65251] [PN:hypothetical 30.5K protein (dnaT-holD intergenic region):hypothetical protein f277] [GN:yjjP] [OR:Escherichia coli] [DB:pir2] >gp:[GI:g537207] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_f277] [LE:292920] [RE:293753] [DI:complement] >gp:[GI:g1790826] [LN:AE000507] [AC:AE000507:U00096] [PN:putative structural protein] [GN:yjjP] [FN:putative structure; Not classified] [OR:Escherichia coli] [DB:genpept-bct2] [DE:Escherichia coli K-12 MG1655 section 397 of 400 of the completegenome.] [NT:f277; 100 pct identical amino acid sequence and] [LE:5037] [RE:5870] [DI:complement]

| ORF Name | NT ID | AA ID | NT LN | AA LN | Score | P-value |
|---|---|---|---|---|---|---|
| 12505327_f2_667 | 1483 | 8654 | 1488 | 495 | | |

Description

NO-HIT

| ORF Name | NT ID | AA ID | NT LN | AA LN | Score | P-value |
|---|---|---|---|---|---|---|
| 12535406_f1_212 | 1484 | 8655 | 1230 | 409 | 172 | 2.6e-12 |

Description sp:[LN:YD99_HAEIN] [AC:P44175] [GN:HI1399] [OR:Haemophilus influenzae] [DE:HYPOTHETICAL PROTEIN HI1399] [SP:P44175] [DB:swissprot] >sp:[LN:E64027] [AC:E64027] [PN:hypothetical protein HI1399] [OR:Haemophilus influenzae] [DB:pir2] >gp:[GI:g1574240] [LN:U32820] [AC:U32820:L42023] [PN:H. influenzae predicted coding region HI1399] [GN:HI1399] [OR:Haemophilus influenzae Rd] [DB:genpept-bct2] [DE:Haemophilus influenzae Rd section 135 of 163 of the completegenome.] [NT:hypothetical protein; identified by GeneMark;] [LE:2975] [RE:3583] [DI:direct]

| ORF Name | NT ID | AA ID | NT LN | AA LN | Score | P-value |
|---|---|---|---|---|---|---|
| 12585000_c1_1605 | 1485 | 8656 | 870 | 289 | 168 | 1.2e-10 |

Description sp:[LN:E72286] [AC:E72286] [PN:acetyltransferase-related protein] [GN:TM1178] [OR:Thermotoga maritima] [DB:pir2] >gp:[GI:g4981727] [LN:AE001774] [AC:AE001774:AE000512] [PN:acetyltransferase-related protein] [GN:TM1178] [OR:Thermotoga maritima] [DB:genpept-bct2] [DE:Thermotoga maritima section 86 of 136 of the complete genome.] [NT:similar to GB:AE000657 percent identity: 50.40;] [LE:9784] [RE:10623] [DI:complement]

| ORF Name | NT ID | AA ID | NT/LN | AA/LN | Score | P-value |
|---|---|---|---|---|---|---|
| 12605002_f2_664 | 1486 | 8657 | 1347 | 448 | 117 | 0.0011 |

Description gp:[GI:g3582206] [LN:AE001272] [AC:AE001272] [PN:trsK protein (traK)]
[GN:ORF00017] [OR:Lactococcus lactis] [DB:genpept-bct2] [DE:Lactococcus lactis
DPC3147 plasmid pMRC01, complete plasmidsequence.] [NT:similar to GB:L11998
PID:310618 PID:405570 percent] [LE:12410] [RE:14002] [DI:direct]

| ORF Name | NT ID | AA ID | NT/LN | AA/LN | Score | P-value |
|---|---|---|---|---|---|---|
| 12759633_c3_2408 | 1487 | 8658 | 1065 | 354 | 207 | 7.7e-17 |

Description sp:[LN:E71272] [AC:E71272] [PN:probable glucosamine-fructose-6-phosphate
aminotransferase (glmS)] [GN:TP0861] [CL:glutamine--fructose-6-phosphate
aminotransferase (isomerizing)] [OR:Treponema pallidum subsp. pallidum] [SR:,
syphilis spirochete] [DB:pir2] >gp:[GI:g3323172] [LN:AE001256]
[AC:AE001256:AE000520] [PN:glucosamine-fructose-6-phosphate] [GN:TP0861]
[OR:Treponema pallidum] [DB:genpept-bct2] [DE:Treponema pallidum section 72 of 87
of the complete genome.] [NT:similar to GB:L42023 SP:P44708 PID:1003742]
[LE:4262] [RE:6169] [DI:complement]

| ORF Name | NT ID | AA ID | NT/LN | AA/LN | Score | P-value |
|---|---|---|---|---|---|---|
| 12776575_f2_569 | 1488 | 8659 | 1020 | 339 | 1171 | 6.8e-119 |

Description sp:[LN:S49311] [AC:S49311] [PN:2,4-dihydroxyhept-2-ene-1,7-dioic acid aldolase]
[CL:2,4-dihydroxyhept-2-ene-1,7] [OR:Escherichia coli] [DB:pir2] >gp:[GI:g757831]
[LN:EC4HPADNA] [AC:Z37980] [PN:hypothetical] [GN:hpaI] [OR:Escherichia coli]
[DB:genpept-bct1] [DE:E.coli hpa[G,R,E,D,F,H,I,X,A,B,C] genes.] [LE:5771]
[RE:6559] [DI:direct] >gp:[GI:g633197] [LN:ECCHPCH] [AC:Z47799]
[PN:2,4-dihydroxyhept-2-ene-1,7-dioic acid aldolase] [GN:hpcH] [OR:Escherichia
coli] [DB:genpept-bct1] [DE:E.coli hpcH gene for
2,4-dihydroxyhept-2-ene-1,7-dioic acidaldolase.] [LE:12] [RE:800] [DI:direct]

| ORF Name | NT ID | AA ID | NT/LN | AA/LN | Score | P-value |
|---|---|---|---|---|---|---|
| 1289182_f3_1064 | 1489 | 8660 | 1158 | 385 | 914 | 1.2e-91 |

Description sp:[LN:SYW_CLOLO] [AC:Q46127] [GN:TRPS:TRSA] [OR:Clostridium longisporum]
[EC:6.1.1.2] [DE:(TRPRS)] [SP:Q46127] [DB:swissprot] >gp:[GI:g1100074]
[LN:CLOABG] [AC:L49336] [PN:tryptophanyl-tRNA synthetase] [GN:trsA]
[OR:Clostridium longisporum] [DB:genpept-bct2] [DE:Clostridium longisporum
methyl-accepting chemotaxis protein (macA),tryptophanyl tRNA synthetase (trsA),
abgG, PTS-dependent enzyme II(abgF), phospho-beta-glucosidase (abgA), ORF6 and
PII-like protein(glnB) genes, complete cds's.] [NT:T-box gene; putative] [LE:699]
[RE:1724] [DI:direct]

| ORF Name | NT ID | AA ID | NT LN | AA LN | Score | P-value |
|---|---|---|---|---|---|---|
| 12922715_f2_761 | 1490 | 8661 | 1029 | 342 | 1566 | 9.4e-161 |

Description sp:[LN:OWECI] [AC:A31314:A00564:S56479:A65238] [PN:ornithine carbamoyltransferase, chain I:citrulline phosphorylase chain I:ornithine transcarbamylase chain I] [GN:argI] [CL:ornithine carbamoyltransferase:aspartate/ornithine carbamoyltransferase homology] [OR:Escherichia coli] [EC:2.1.3.3] [DB:pir1] [MP:97 min] >gp:[GI:g537095] [LN:ECOUW93] [AC:U14003] [PN:ornithine carbamoyltransferase] [GN:argI] [OR:Escherichia coli] [DB:genpept-bct1] [EC:2.1.3.3] [DE:Escherichia coli K-12 chromosomal region from 92.8 to 00.1 minutes.] [NT:CG Site No. 1013; duplicate gene] [LE:168131] [RE:169135] [DI:complement] >gp:[GI:g1790703] [LN:AE000496] [AC:AE000496:U00096] [PN:ornithine carbamoyltransferase 1] [GN:argI] [FN:enzyme; Amino acid biosynthesis: Arginine] [OR:Escherichia coli] [DB:genpept-bct2] [EC:2.1.3.3] [DE:Escherichia coli K-12 MG1655 section 386 of 400 of the completegenome.] [NT:f334; 100 pct identical to OTC1_ECOLI SW: P04391;] [LE:3151] [RE:4155] [DI:complement]

| ORF Name | NT ID | AA ID | NT LN | AA LN | Score | P-value |
|---|---|---|---|---|---|---|
| 12931531_c1_1361 | 1491 | 8662 | 1029 | 342 | 1483 | 5.9e-152 |

Description sp:[LN:YTFT_ECOLI] [AC:P39328] [GN:YTFT] [OR:Escherichia coli] [DE:HYPOTHETICAL ABC TRANSPORTER PERMEASE PROTEIN YTFT] [SP:P39328] [DB:swissprot] >sp:[LN:S56456] [AC:S56456:A65235] [PN:hypothetical 35.7K protein (ppa-fbp intergenic region):hypothetical protein o341] [GN:ytfT] [CL:l-arabinose transport system permease araH] [OR:Escherichia coli] [DB:pir2] >gp:[GI:g537072] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_o341] [LE:143400] [RE:144425] [DI:direct] >gp:[GI:g1790677] [LN:AE000494] [AC:AE000494:U00096] [PN:putative transport system permease protein] [GN:ytfT] [FN:putative transport; Not classified] [OR:Escherichia coli] [DB:genpept-bct2] [DE:Escherichia coli K-12 MG1655 section 384 of 400 of the completegenome.] [NT:o341; 100 pct identical amino acid sequence and] [LE:4255] [RE:5280] [DI:direct]

| ORF Name | NT ID | AA ID | NT LN | AA LN | Score | P-value |
|---|---|---|---|---|---|---|
| 12995303_c2_2040 | 1492 | 8663 | 2016 | 671 | 2865 | 2.1e-298 |

Description sp:[LN:QQECW1] [AC:S56616:G65254:A41332:A93698:A93867:A04435] [PN:soluble lytic transglycosylase, precursor] [GN:slt] [CL:soluble lytic transglycosylase] [OR:Escherichia coli] [EC:3.2.1.-] [DB:pir1] [MP:100 min] >gp:[GI:g537232] [LN:ECOUW93] [AC:U14003] [PN:soluble lytic transglycosylase] [GN:slt] [OR:Escherichia coli] [DB:genpept-bct1] [DE:Escherichia coli K-12 chromosomal region from 92.8 to 00.1 minutes.] [LE:321539] [RE:323503] [DI:direct] >gp:[GI:g1790853] [LN:AE000509] [AC:AE000509:U00096] [PN:soluble lytic murein transglycosylase] [GN:slt] [FN:enzyme; Murein sacculus, peptidoglycan] [OR:Escherichia coli] [DB:genpept-bct2] [EC:3.2.1.-] [DE:Escherichia coli K-12 MG1655 section 399 of 400 of the completegenome.] [NT:o654; 99 pct identical to 645 amino acids] [LE:5894] [RE:7858] [DI:direct]

| ORF_Name | NT_ID | AA_ID | NT/LN | AA/LN | Score | P-value |
|---|---|---|---|---|---|---|
| 12995666_c3_2482 | 1493 | 8664 | 237 | 78 | 81 | 2.8e-05 |

Description sp:[LN:B72588] [AC:B72588] [PN:hypothetical protein APE1175] [GN:APE1175]
[OR:Aeropyrum pernix] [DB:pir2] >gp:[GI:d1043946:g5104846] [LN:AP000061]
[AC:AP000061] [PN:150aa long hypothetical protein] [GN:APE1175] [OR:Aeropyrum
pernix] [SR:Aeropyrum pernix (strain:K1) DNA] [DB:genpept-bct1] [DE:Aeropyrum
pernix genomic DNA, section 4/7.] [NT:motif=prokaryotic membrane lipoprotein
lipid] [LE:11071] [RE:11523] [DI:complement]

| ORF_Name | NT_ID | AA_ID | NT/LN | AA/LN | Score | P-value |
|---|---|---|---|---|---|---|
| 13007805_c2_1717 | 1494 | 8665 | 693 | 230 | 1058 | 6.4e-107 |

Description sp:[LN:SGAH_ECOLI] [AC:P39304] [GN:SGAH] [OR:Escherichia coli] [EC:4.1.2.-]
[DE:3-HEXULOSE 6-PHOSPHATE FORMALDEHYDE LYASE)] [SP:P39304] [DB:swissprot]
>sp:[LN:S56421] [AC:S56421:G65230] [PN:hypothetical 23.6K protein (aidB-rpsF
intergenic region):hypothetical protein o216] [GN:yjfV] [CL:hypothetical protein
HI1024] [OR:Escherichia coli] [DB:pir2] >gp:[GI:g537037] [LN:ECOUW93] [AC:U14003]
[OR:Escherichia coli] [DB:genpept-bct1] [DE:Escherichia coli K-12 chromosomal
region from 92.8 to 00.1 minutes.] [NT:ORF_o216] [LE:113018] [RE:113668]
[DI:direct] >gp:[GI:g1790640] [LN:AE000491] [AC:AE000491:U00096] [PN:probable
hexulose-6-phosphate synthase] [GN:sgaH] [FN:putative enzyme; Central
intermediary] [OR:Escherichia coli] [DB:genpept-bct2] [DE:Escherichia coli K-12
MG1655 section 381 of 400 of the completegenome.] [NT:o216; formerly designated
yjfV] [LE:5852] [RE:6502] [DI:direct]

| ORF_Name | NT_ID | AA_ID | NT/LN | AA/LN | Score | P-value |
|---|---|---|---|---|---|---|
| 13009525_f1_218 | 1495 | 8666 | 1299 | 432 | | |

Description

NO-HIT

| ORF_Name | NT_ID | AA_ID | NT LN | AA LN | Score | P-value |
|---|---|---|---|---|---|---|
| 13011562_f3_1260 | 1496 | 8667 | 1959 | 652 | 2983 | 0.0 |

Description sp:[LN:CN16_ECOLI] [AC:P08331] [GN:CPDB] [OR:Escherichia coli] [EC:3.1.4.16]
[DE:2',3'-CYCLIC-NUCLEOTIDE 2'-PHOSPHODIESTERASE PRECURSOR,] [SP:P08331]
[DB:swissprot] >sp:[LN:ESECPC] [AC:H65232:S56438:A26398:PS0149]
[PN:2',3'-cyclic-nucleotide 2'-phosphodiesterase, precursor] [GN:cpdB]
[CL:2',3'-cyclic-nucleotide 2'-phosphodiesterase:2',3'-cyclic-nucleotide
2'-phosphodiesterase homology:phosphoesterase core homology] [OR:Escherichia
coli] [EC:3.1.4.16] [DB:pir1] [MP:96 min] >gp:[GI:g537054] [LN:ECOUW93]
[AC:U14003] [PN:2',3'-cyclic-nucleotide 2'-phosphodiesterase] [GN:cpdB]
[OR:Escherichia coli] [DB:genpept-bct1] [EC:3.1.4.16] [DE:Escherichia coli K-12
chromosomal region from 92.8 to 00.1 minutes.] [NT:CG Site No. 909] [LE:125454]
[RE:127397] [DI:complement] >gp:[GI:g1790658] [LN:AE000492] [AC:AE000492:U00096]
[PN:2':3'-cyclic-nucleotide 2'-phosphodiesterase] [GN:cpdB] [FN:enzyme; Salvage
of nucleosides and nucleotides] [OR:Escherichia coli] [DB:genpept-bct2]
[EC:3.1.4.16] [DE:Escherichia coli K-12 MG1655 section 382 of 400 of the
completegenome.] [NT:f647; 100 pct identical to CN16_ECOLI SW: P08331;] [LE:7194]
[RE:9137] [DI:complement]

| ORF_Name | NT_ID | AA_ID | NT LN | AA LN | Score | P-value |
|---|---|---|---|---|---|---|
| 13016627_c2_1818 | 1497 | 8668 | 939 | 312 | 708 | 7.9e-70 |

Description sp:[LN:IOLE_BACSU] [AC:P42416] [GN:IOLE:E83E] [OR:Bacillus subtilis] [DE:IOLE
PROTEIN] [SP:P42416] [DB:swissprot] >sp:[LN:E69645] [AC:E69645] [PN:myo-inositol
catabolism iolE] [GN:iolE] [CL:Rhizobium meliloti mocC protein] [OR:Bacillus
subtilis] [DB:pir2] >gp:[GI:d1003804:g709985] [LN:BACIOLO] [AC:D14399]
[PN:hypothetical protein] [GN:E83E] [OR:Bacillus subtilis] [SR:Bacillus subtilis
(strain:BGSC 1A1 (168 trpC2)) DNA] [DB:genpept-bct1] [DE:Bacillus subtilis 15 kb
chromosome segment contains the iol operon.] [LE:5110] [RE:6003] [DI:direct]
>gp:[GI:e1184697:g2636518] [LN:BSUB0021] [AC:Z99124:AL009126] [GN:iolE]
[OR:Bacillus subtilis] [DB:genpept-bct1] [DE:Bacillus subtilis complete genome
(section 21 of 21): from 3999281to 4214814.] [NT:alternate gene name: yxdE;
myo-inositol catabolism] [SP:P42416] [LE:76686] [RE:78579] [DI:complement]

| ORF_Name | NT_ID | AA_ID | NT LN | AA LN | Score | P-value |
|---|---|---|---|---|---|---|
| 13080410_f3_1104 | 1498 | 8669 | 369 | 122 | 104 | 3.3e-05 |

Description sp:[LN:YIA_RHISP] [AC:P17986] [OR:Rhizobium sp] [DE:INSERTION ELEMENT ISR1
HYPOTHETICAL 30.8 KD PROTEIN A] [SP:P17986] [DB:swissprot] >sp:[LN:S09662]
[AC:S09662] [PN:hypothetical protein A (insertion sequence ISR1)] [OR:Rhizobium
sp.] [DB:pir2] >gp:[GI:g581509] [LN:RHISR1] [AC:X06616] [OR:Rhizobium sp.]
[SR:Rhizobium sp] [DB:genpept-bct1] [DE:Rhizobium insertion element ISR1.]
[NT:ORF A (AA 1-278)] [SP:P17986] [LE:34] [RE:870] [DI:complement]

| ORF Name | NT ID | AA ID | NT LN | AA LN | Score | P-value |
|---|---|---|---|---|---|---|
| 13158127_f1_129 | 1499 | 8670 | 861 | 286 | 1343 | 4.0e-137 |

Description gp:[GI:g757830] [LN:EC4HPADNA] [AC:Z37980] [PN:2-oxo-hept-3-ene-1,7-dioate hydratase] [GN:hpaH] [OR:Escherichia coli] [DB:genpept-bct1] [DE:E.coli hpa[G,R,E,D,F,H,I,X,A,B,C] genes.] [LE:4957] [RE:5760] [DI:direct] >gp:[GI:g2695682] [LN:AF036583] [AC:AF036583] [PN:2-oxo-hept-4-ene-1,7-dioate hydratase] [GN:hpcG] [OR:Escherichia coli] [DB:genpept-bct2] [DE:Escherichia coli 2-oxo-hept-4-ene-1,7-dioate hydratase (hpcG) gene,complete cds.] [NT:OHED hydratase] [LE:1] [RE:804] [DI:direct]

| ORF Name | NT ID | AA ID | NT LN | AA LN | Score | P-value |
|---|---|---|---|---|---|---|
| 13160431_c3_2493 | 1500 | 8671 | 2874 | 957 | 4677 | 0.0 |

Description sp:[LN:SYECIT] [AC:B64723:S40549:A94277:A91325:A93991:A01184] [PN:isoleucine--tRNA ligase,:isoleucyl-tRNA synthetase] [GN:ileS] [CL:isoleucine--tRNA ligase] [OR:Escherichia coli] [EC:6.1.1.5] [DB:pir1] [MP:1 min] >gp:[GI:g2367096] [LN:AE000113] [AC:AE000113:U00096] [PN:isoleucine tRNA synthetase] [GN:ileS] [FN:enzyme; Aminoacyl tRNA synthetases, tRNA] [OR:Escherichia coli] [DB:genpept-bct2] [EC:6.1.1.5] [DE:Escherichia coli K-12 MG1655 section 3 of 400 of the completegenome.] [NT:o938; 100 pct identical to SYI_ECOLI SW: P00956;] [LE:1732] [RE:4548] [DI:direct]

| ORF Name | NT ID | AA ID | NT LN | AA LN | Score | P-value |
|---|---|---|---|---|---|---|
| 132812_c3_2275 | 1501 | 8672 | 858 | 285 | 1351 | 5.7e-138 |

Description gp:[GI:g5420068] [LN:YEN132945] [AC:AJ132945] [PN:IS1400 transposase B] [GN:trp1400B] [OR:Yersinia enterocolitica] [DB:genpept-bct1] [DE:Yersinia enterocolitica WA 314 right arm of the high-pathogenicityisland.] [LE:5619] [RE:6503] [DI:complement]

| ORF Name | NT ID | AA ID | NT LN | AA LN | Score | P-value |
|---|---|---|---|---|---|---|
| 13676902_f2_858 | 1502 | 8673 | 396 | 131 | 357 | 1.2e-32 |

Description sp:[LN:YJFN_ECOLI] [AC:P39296] [GN:YJFN] [OR:Escherichia coli] [DE:HYPOTHETICAL
11.0 KD PROTEIN IN AIDB-SGAT INTERGENIC REGION] [SP:P39296] [DB:swissprot]
>sp:[LN:S56413] [AC:S56413:G65229] [PN:hypothetical 11K protein (aidB-rpsF
intergenic region):hypothetical protein f100] [GN:yjfN] [CL:conserved
hypothetical protein b3238] [OR:Escherichia coli] [DB:pir2] >gp:[GI:g537029]
[LN:ECOUW93] [AC:U14003] [OR:Escherichia coli] [DB:genpept-bct1] [DE:Escherichia
coli K-12 chromosomal region from 92.8 to 00.1 minutes.] [NT:ORF_f100]
[LE:106849] [RE:107151] [DI:complement] >gp:[GI:g1790631] [LN:AE000490]
[AC:AE000490:U00096] [PN:orf, hypothetical protein] [GN:yjfN] [FN:orf; Unknown]
[OR:Escherichia coli] [DB:genpept-bct2] [DE:Escherichia coli K-12 MG1655 section
380 of 400 of the completegenome.] [NT:f100; 100 pct identical amino acid
sequence and] [LE:11701] [RE:12003] [DI:complement]

| ORF Name | NT ID | AA ID | NT LN | AA LN | Score | P-value |
|---|---|---|---|---|---|---|
| 13696930_f2_762 | 1503 | 8674 | 303 | 100 | 109 | 2.3e-06 |

Description sp:[LN:LPPY_SALTY] [AC:P08522] [GN:PYRL] [OR:Salmonella typhimurium] [DE:PYRBI
OPERON LEADER PEPTIDE (ATTENUATOR)] [SP:P08522] [DB:swissprot] >sp:[LN:LFEBYB]
[AC:S00028] [PN:pyrBI leader peptide] [CL:pyrBI leader peptide] [OR:Salmonella
typhimurium] [DB:pir1] >gp:[GI:g47862] [LN:STPYRBIG] [AC:X05641] [OR:Salmonella
typhimurium] [DB:genpept-bct1] [DE:S.typhimurium LT2 pyrBI operon.]
[NT:put.leader peptide (AA 1-33) (pot. attenuator; pot.] [SP:P08522] [LE:236]
[RE:337] [DI:direct]

| ORF Name | NT ID | AA ID | NT LN | AA LN | Score | P-value |
|---|---|---|---|---|---|---|
| 13750300_f1_162 | 1504 | 8675 | 846 | 281 | 461 | 1.2e-43 |

Description sp:[LN:A32667] [AC:A32667:A54055] [PN:NAD(P)H dehydrogenase (quinone), 2]
[GN:NMOR2] [CL:NAD(P)H dehydrogenase (quinone) 2] [OR:Homo sapiens] [SR:, man]
[EC:1.6.99.2] [DB:pir1] [MP:6pter-6q12] >gp:[GI:g190818] [LN:HUMQRE] [AC:J02888]
[GN:NMOR2] [OR:Homo sapiens] [SR:Human liver, cDNA to mRNA] [DB:genpept-pri2]
[DE:Human quinone oxidoreductase (NQO2) mRNA, complete cds.] [NT:quinone
oxidoreductase] [LE:176] [RE:871] [DI:direct] >gp:[GI:g516534] [LN:HSNQORII8]
[AC:U07736] [PN:quinone oxidoreductase2] [GN:NQO2] [FN:quinone reductase related,
oxidoreductase, drug] [OR:Homo sapiens] [SR:human] [DB:genpept-pri3] [DE:Human
quinone oxidoreductase2 (NQO2) gene, exon 7, complete cds.] [NT:There is a
conflict between the cDNA sequence and] [LE:U07731.1:398:U07732.1:241]
[RE:404:405] [DI:directJoin]

| ORF Name | NT ID | AA ID | NT LN | AA LN | Score | P-value |
|---|---|---|---|---|---|---|
| 13772555_f2_644 | 1505 | 8676 | 324 | 107 | 119 | 1.5e-06 |

Description gp:[GI:e1486707;g5019347] [LN:SCH35] [AC:AL078610] [PN:putative oxidoreductase]
[GN:SCH35.27] [OR:Streptomyces coelicolor] [DB:genpept-bct1] [DE:Streptomyces
coelicolor cosmid H35.] [NT:SCH35.27, possible oxidoreductase, len: 406aa;]
[LE:23964] [RE:25184] [DI:complement]

| ORF Name | NT ID | AA ID | NT LN | AA LN | Score | P-value |
|---|---|---|---|---|---|---|
| 1381525_c2_1868 | 1506 | 8677 | 750 | 249 | 694 | 2.4e-68 |

Description sp:[LN:YFJR_ECOLI] [AC:P52133] [GN:YFJR] [OR:Escherichia coli] [DE:HYPOTHETICAL
TRANSCRIPTIONAL REGULATOR IN ALPA-GABD INTERGENIC REGION] [SP:P52133]
[DB:swissprot] >sp:[LN:T08646] [AC:T08646;D65042] [PN:hypothetical protein b2634]
[OR:Escherichia coli] [DB:pir2] [MP:57 min] >gp:[GI:g1033129] [LN:ECU36840]
[AC:U36840] [OR:Escherichia coli] [DB:genpept-bct1] [DE:Escherichia coli K-12
genome, approximately 57 minutes.] [NT:ORF_o233] [LE:18657] [RE:19358]
[DI:direct] >gp:[GI:g1788988] [LN:AE000349] [AC:AE000349;U00096] [PN:orf,
hypothetical protein] [GN:yfjR] [FN:orf; Unknown] [OR:Escherichia coli]
[DB:genpept-bct2] [DE:Escherichia coli K-12 MG1655 section 239 of 400 of the
completegenome.] [NT:o233; 29 pct identical (9 gaps) to 116 residues] [LE:2204]
[RE:2905] [DI:direct]

| ORF Name | NT ID | AA ID | NT LN | AA LN | Score | P-value |
|---|---|---|---|---|---|---|
| 13839660_f2_679 | 1507 | 8678 | 1002 | 333 | 1340 | 8.4e-137 |

Description sp:[LN:YJHU_ECOLI] [AC:P39356] [GN:YJHU] [OR:Escherichia coli] [DE:HYPOTHETICAL
TRANSCRIPTIONAL REGULATOR IN FECI-FIMB INTERGENIC REGION] [SP:P39356]
[DB:swissprot] >sp:[LN:S56520] [AC:S56520;A65243] [PN:hypothetical 29.1K protein
(fecI-fimB intergenic region):hypothetical protein f266] [GN:yjhU]
[OR:Escherichia coli] [DB:pir2] >gp:[GI:g537136] [LN:ECOUW93] [AC:U14003]
[OR:Escherichia coli] [DB:genpept-bct1] [DE:Escherichia coli K-12 chromosomal
region from 92.8 to 00.1 minutes.] [NT:ORF_f266] [LE:210172] [RE:210972]
[DI:complement] >gp:[GI:g1790748] [LN:AE000500] [AC:AE000500;U00096] [PN:orf,
hypothetical protein] [GN:yjhU] [FN:orf; Unknown] [OR:Escherichia coli]
[DB:genpept-bct2] [DE:Escherichia coli K-12 MG1655 section 390 of 400 of the
completegenome.] [NT:f266; 100 pct identical amino acid sequence and] [LE:2648]
[RE:3448] [DI:complement]

| ORF Name | NT ID | AA ID | NT LN | AA LN | Score | P-value |
|---|---|---|---|---|---|---|
| 1384665_f1_291 | 1508 | 8679 | 1050 | 349 | 1714 | 2.0e-176 |

Description sp:[LN:AMPA_ECOLI] [AC:P11648] [GN:PEPA:XERB:CARP] [OR:Escherichia coli]
[EC:3.4.11.1] [DE:AMINOPEPTIDASE A/I,] [SP:P11648] [DB:swissprot] >sp:[LN:APECA]
[AC:S04462:A33212:S56486:S58667:G65238] [PN:leucyl aminopeptidase,
A:aminopeptidase I:cytosol aminopeptidase A] [GN:pepA:xerB] [CL:cytosol
aminopeptidase] [OR:Escherichia coli] [EC:3.4.11.1] [DB:pir1] [MP:96.5 min]
>gp:[GI:g537102] [LN:ECOUW93] [AC:U14003] [PN:aminopeptidase A/1] [GN:pepA]
[OR:Escherichia coli] [DB:genpept-bct1] [EC:3.4.11.1] [DE:Escherichia coli K-12
chromosomal region from 92.8 to 00.1 minutes.] [NT:alternate gene name xerB]
[LE:175275] [RE:176786] [DI:complement] >gp:[GI:g1054725] [LN:ECPEPCAR]
[AC:X86443] [PN:aminopeptidase A] [GN:pepA/carP] [OR:Escherichia coli]
[DB:genpept-bct1] [DE:E.coli pepA/carP gene.] [SP:P11648] [LE:371] [RE:1882]
[DI:direct] >gp:[GI:g43309] [LN:ECXERB] [AC:X15130] [OR:Escherichia coli]
[DB:genpept-bct1] [DE:E. coli xerB gene for aminopeptidase A/I (EC 3.4.11.1).]
[NT:aminopeptidase A/I (AA 1 - 503)] [SP:P11648] [LE:60] [RE:1571] [DI:direct]
>gp:[GI:g1790710] [LN:AE000496] [AC:AE000496:U00096] [PN:aminopeptidase A/I]
[GN:pepA] [FN:enzyme; Degradation of proteins, peptides,] [OR:Escherichia coli]
[DB:genpept-bct2] [EC:3.4.11.1] [DE:Escherichia coli K-12 MG1655 section 386 of
400 of the completegenome.] [NT:f503; 100 pct identical to AMPA_ECOLI SW:
P11648;] [LE:10289] [RE:11800] [DI:complement]

| ORF Name | NT ID | AA ID | NT LN | AA LN | Score | P-value |
|---|---|---|---|---|---|---|
| 13881668_f3_936 | 1509 | 8680 | 1425 | 474 | | |

Description

NO-HIT

| ORF Name | NT ID | AA ID | NT LN | AA LN | Score | P-value |
|---|---|---|---|---|---|---|
| 13960952_f2_562 | 1510 | 8681 | 633 | 210 | 898 | 5.8e-90 |

Description gp:[GI:g757826] [LN:EC4HPADNA] [AC:Z37980] [PN:5-oxo-1,2,5-tricarboxilic-3-penten
acid] [GN:hpaG] [OR:Escherichia coli] [DB:genpept-bct1] [DE:E.coli
hpa[G,R,E,D,F,H,I,X,A,B,C] genes.] [LE:851] [RE:2140] [DI:direct]

| ORF Name | NT ID | AA ID | NT LN | AA LN | Score | P-value |
|---|---|---|---|---|---|---|
| 14100833_f1_70 | 1511 | 8682 | 1581 | 526 | | |

Description

NO-HIT

| ORF_Name | NT_ID | AA_ID | NT/LN | AA/LN | Score | P-value |
|---|---|---|---|---|---|---|
| 14188266_c3_2411 | 1512 | 8683 | 1206 | 401 | | |

Description

NO-HIT

| ORF_Name | NT_ID | AA_ID | NT/LN | AA/LN | Score | P-value |
|---|---|---|---|---|---|---|
| 14192711_f2_435 | 1513 | 8684 | 1290 | 429 | | |

Description

NO-HIT

| ORF_Name | NT_ID | AA_ID | NT/LN | AA/LN | Score | P-value |
|---|---|---|---|---|---|---|
| 14299133_c1_1555 | 1514 | 8685 | 1077 | 358 | | |

Description

NO-HIT

| ORF_Name | NT_ID | AA_ID | NT/LN | AA/LN | Score | P-value |
|---|---|---|---|---|---|---|
| 14300216_f3_1158 | 1515 | 8686 | 1374 | 457 | | |

Description

NO-HIT

| ORF_Name | NT_ID | AA_ID | NT/LN | AA/LN | Score | P-value |
|---|---|---|---|---|---|---|
| 14337780_f2_634 | 1516 | 8687 | 438 | 145 | 89 | 0.00044 |

Description sp:[LN:SDIS_NOCSI] [AC:P77816:O08058] [GN:KSDI] [OR:Nocardioides simplex]
[SR:,Arthrobacter simplex] [EC:5.3.3.1] [DE:ISOMERASE)] [SP:P77816:O08058]
[DB:swissprot] >sp:[LN:S61890] [AC:S61890] [PN:steroid
Delta-isomerase,:3-ketosteroid-delta5-isomerase ksdI] [GN:ksdI] [CL:steroid
Delta-isomerase] [OR:Arthrobacter simplex] [EC:5.3.3.1] [DB:pir2]
>gp:[GI:e308986:g1906821] [LN:ASZ93338] [AC:Z93338] [PN:4,5delta ketosteroid
isomerase] [GN:ksdI] [OR:Nocardioides simplex] [DB:genpept-bct1] [DE:A.simplex
ksdI genes and three open reading frames.] [SP:P77816] [LE:53] [RE:424]
[DI:direct] >gp:[GI:d1007764:g1518168] [LN:D37969] [AC:D37969]
[PN:3-ketosteroid-5-isomerase] [GN:ksdI] [OR:Nocardioides simplex]
[SR:Arthrobacter simplex (strain:IFO12096) DNA] [DB:genpept-bct1] [EC:5.3.3.1]
[DE:Arthrobacter simplex ksdR, ksdD and ksdI genes for hypotheticregulatory
protein, 3-ketosteroid-1-dehydrogenase and3-ketosteroid-5-isomerase.] [LE:2979]
[RE:3350] [DI:direct]

| ORF Name | NT ID | AA ID | NT/LN | AA/LN | Score | P-value |
|---|---|---|---|---|---|---|
| 1445336_f2_473 | 1517 | 8688 | 195 | 64 | | |

Description

NO-HIT

| ORF Name | NT ID | AA ID | NT/LN | AA/LN | Score | P-value |
|---|---|---|---|---|---|---|
| 14460927_c1_1501 | 1518 | 8689 | 1410 | 469 | 250 | 3.5e-19 |

Description sp:[LN:LAMB_KLEPN] [AC:P31242] [GN:LAMB] [OR:Klebsiella pneumoniae]
[DE:MALTOPORIN PRECURSOR (MALTOSE-INDUCIBLE PORIN)] [SP:P31242] [DB:swissprot]
>sp:[LN:S23581] [AC:S23581] [PN:lamB protein precursor] [GN:lamB] [CL:lambda
receptor protein] [OR:Klebsiella pneumoniae] [DB:pir2] >gp:[GI:g43817]
[LN:KPLAMBA] [AC:X66952:S38943] [PN:maltoporin] [GN:lamB] [OR:Klebsiella
pneumoniae] [DB:genpept-bct1] [DE:K. pneumoniae lamB gene.] [SP:P31242] [LE:1]
[RE:1290] [DI:direct]

| ORF Name | NT ID | AA ID | NT/LN | AA/LN | Score | P-value |
|---|---|---|---|---|---|---|
| 14505000_f2_764 | 1519 | 8690 | 423 | 140 | 611 | 1.5e-59 |

Description gp:[GI:g4558864] [LN:AF095578] [AC:AF095578] [PN:YjgF] [GN:yjgF] [OR:Salmonella
typhimurium] [DB:genpept-bct2] [DE:Salmonella typhimurium YjgF (yjgF) gene,
complete cds; and unknowngene.] [NT:member of YER057c/YjgF protein family;
mutations in] [LE:102] [RE:488] [DI:direct]

| ORF Name | NT ID | AA ID | NT/LN | AA/LN | Score | P-value |
|---|---|---|---|---|---|---|
| 14579775_c3_2325 | 1520 | 8691 | 483 | 160 | 283 | 8.5e-25 |

Description gp:[GI:g208931] [LN:SYNORFLAC] [AC:M15619] [OR:synthetic construct] [SR:E.coli
(strain SE5000) synthetic DNA, clone pKB1] [DB:genpept-syn] [DE:Synthetic E.coli
ORF16/lacZ fusion protein, partial cds.] [NT:ORF16-lacZ fusion protein] [LE:29]
[RE:>232] [DI:direct]

| ORF Name | NT ID | AA ID | NT/LN | AA/LN | Score | P-value |
|---|---|---|---|---|---|---|
| 14644005_f2_683 | 1521 | 8692 | 201 | 66 | 73 | 0.016 |

Description gp:[GI:g2702375] [LN:CELC02B10] [AC:AF038605] [GN:C02B10.6] [OR:Caenorhabditis
elegans] [SR:Caenorhabditis elegans strain=Bristol N2] [DB:genpept-inv1]
[DE:Caenorhabditis elegans cosmid C02B10.] [NT:coded for by C. elegans cDNA
yk386f10.3; coded for] [LE:39093:39375] [RE:39325:39549] [DI:complementJoin]

| ORF Name | NT ID | AA ID | NT/LN | AA/LN | Score | P-value |
|---|---|---|---|---|---|---|
| 14647807_f2_572 | 1522 | 8693 | 1623 | 540 | 2664 | 4.2e-277 |

Description sp:[LN:B55349] [AC:B55349:S41919] [PN:4-hydroxyphenylacetate 3-monooxygenase,
large chain:4-hydroxyphenylacetate 3-hydroxylase large chain] [GN:hpaB]
[CL:Escherichia coli 4-hydroxyphenylacetate 3-monooxygenase large chain]
[OR:Escherichia coli] [EC:1.14.13.3] [DB:pir1] >gp:[GI:g757834] [LN:EC4HPADNA]
[AC:Z37980] [PN:component B of the 4HPA-hydroxylase] [GN:hpaB] [OR:Escherichia
coli] [DB:genpept-bct1] [DE:E.coli hpa[G,R,E,D,F,H,I,X,A,B,C] genes.] [LE:9258]
[RE:10820] [DI:direct] >gp:[GI:g452841] [LN:ECHPAXG] [AC:Z29081]
[PN:4-hydroxyphenylacetic hydroxylase] [GN:hpaB] [FN:hydroxylation of
4-hydroxyphenylacetic acid] [OR:Escherichia coli] [DB:genpept-bct1] [DE:E.coli
(ATCC 11105) hpaA, hpaB, hpaC genes for4-hydroxyphenylacetic hydroxylase.]
[LE:1112] [RE:2674] [DI:direct]

| ORF Name | NT ID | AA ID | NT/LN | AA/LN | Score | P-value |
|---|---|---|---|---|---|---|
| 14659777_f2_621 | 1523 | 8694 | 1407 | 468 | 1754 | 1.1e-180 |

Description sp:[LN:YLCB_ECOLI] [AC:P77211] [GN:YLCB] [OR:Escherichia coli] [DE:PRECURSOR]
[SP:P77211] [DB:swissprot] >sp:[LN:B64790] [AC:B64790] [PN:yclB protein]
[GN:yclB] [CL:nodulation protein nodT] [OR:Escherichia coli] [DB:pir2]
>gp:[GI:d1036192:g4062196] [LN:D90699] [AC:D90699:AB001340] [PN:50k outer
membrane protein oprK] [OR:Escherichia coli] [SR:Escherichia coli(strain:K12)
DNA, clone:Kohara clone #162] [DB:genpept-bct1] [DE:Escherichia coli genomic DNA.
(12.6 - 12.9 min).] [NT:ORF_ID:o163#2; similar to PIR Accession Number]
[LE:10015] [RE:11388] [DI:direct] >gp:[GI:d1036198:g4062202] [LN:D90700]
[AC:D90700:AB001340] [PN:50k outer membrane protein oprK] [OR:Escherichia coli]
[SR:Escherichia coli(strain:K12) DNA, clone:Kohara clone #163] [DB:genpept-bct1]
[DE:Escherichia coli genomic DNA. (12.8 - 13.2 min).] [NT:ORF_ID:o163#2; similar
to PIR Accession Number] [LE:938] [RE:2311] [DI:direct] >gp:[GI:g1778487]
[LN:ECU82598] [AC:U82598] [PN:outer membrane protein OprK homolog]
[OR:Escherichia coli] [DB:genpept-bct1] [DE:Escherichia coli genomic sequence of
minutes 9 to 12.] [NT:similar to P. aeruginosa OprK] [LE:36231] [RE:37604]
[DI:direct] >gp:[GI:g1786785] [LN:AE000162] [AC:AE000162:U00096] [PN:putative
resistance protein] [GN:ylcB] [FN:putative transport; Drug/analog sensitivity]
[OR:Escherichia coli] [DB:genpept-bct2] [DE:Escherichia coli K-12 MG1655 section
52 of 400 of the completegenome.] [NT:o457; This 457 aa ORF is 26 pct identical
(12 gaps)] [LE:2377] [RE:3750] [DI:direct]

| ORF Name | NT ID | AA ID | NT/LN | AA/LN | Score | P-value |
|---|---|---|---|---|---|---|
| 14730307_c1_1476 | 1524 | 8695 | 1275 | 424 | 552 | 2.7e-53 |

Description sp:[LN:D69863] [AC:D69863] [PN:hypothetical protein ykrT] [GN:ykrT] [OR:Bacillus
subtilis] [DB:pir2] >gp:[GI:e1184946:g2633727] [LN:BSUB0008] [AC:Z99111:AL009126]
[GN:ykrT] [FN:unknown] [OR:Bacillus subtilis] [DB:genpept-bct1] [DE:Bacillus
subtilis complete genome (section 8 of 21): from 1394791to 1603020.] [LE:27917]
[RE:29116] [DI:complement]

| ORF Name | NT ID | AA ID | NT LN | AA LN | Score | P-value |
|---|---|---|---|---|---|---|
| 14742050_c3_2168 | 1525 | 8696 | 1926 | 641 | 603 | 1.1e-58 |

Description sp:[LN:CELR_BACSU] [AC:P46321] [GN:CELR:LICR] [OR:Bacillus subtilis] [DE:PUTATIVE CEL OPERON REGULATOR] [SP:P46321] [DB:swissprot] >sp:[LN:H69651] [AC:H69651:S57758] [PN:lichenan operon transcription antiterminator licR:cel operon regulator] [GN:licR] [OR:Bacillus subtilis] [DB:pir2] >gp:[GI:g895747] [LN:BSCELABCD] [AC:Z49992] [PN:putative cel operon regulator] [GN:celR] [OR:Bacillus subtilis] [DB:genpept-bct1] [DE:B.subtilis celA, celB, celC, celD and ywaA genes.] [SP:P46321] [LE:187] [RE:2112] [DI:direct] >gp:[GI:e1186359:g2636395] [LN:BSUB0020] [AC:Z99123:AL009126] [PN:transcriptional regulator (antiterminator)] [GN:licR] [FN:regulation of the lichenan operon (licBCAH)] [OR:Bacillus subtilis] [DB:genpept-bct1] [DE:Bacillus subtilis complete genome (section 20 of 21): from 3798401to 4010550.] [NT:alternate gene name: celR] [SP:P46321] [LE:162396] [RE:164321] [DI:complement] >gp:[GI:d1012409:g1783265] [LN:D83026] [AC:D83026:D45911] [PN:cel operon regulator] [GN:celR] [OR:Bacillus subtilis] [SR:Bacillus subtilis (strain:BGSC 1A1) DNA] [DB:genpept-bct1] [DE:Bacillus subtilis genome sequence covering lic-cel region.] [NT:putative] [LE:60144] [RE:62069] [DI:direct]

| ORF Name | NT ID | AA ID | NT LN | AA LN | Score | P-value |
|---|---|---|---|---|---|---|
| 14878332_f3_1093 | 1526 | 8697 | 1227 | 408 | 665 | 2.8e-65 |

Description sp:[LN:H70830] [AC:H70830] [PN:probable ufaA1 protein] [GN:ufaA1] [CL:cyclopropane-fatty-acyl-phospholipid synthase:MCM homology] [OR:Mycobacterium tuberculosis] [DB:pir2] >gp:[GI:e1252516:g2909522] [LN:MTV037] [AC:AL021932:AL123456] [PN:ufaA1] [GN:ufaA1] [OR:Mycobacterium tuberculosis] [DB:genpept-bct1] [DE:Mycobacterium tuberculosis H37Rv complete genome; segment 22/162.] [NT:Rv0447c, (MTV037.11c), len: 427. Probable] [LE:9123] [RE:10406] [DI:complement]

| ORF Name | NT ID | AA ID | NT LN | AA LN | Score | P-value |
|---|---|---|---|---|---|---|
| 14880405_c2_2029 | 1527 | 8698 | 807 | 268 | 1252 | 1.8e-127 |

Description sp:[LN:DEOC_ECOLI] [AC:P00882] [GN:DEOC:DRA:THYR] [OR:Escherichia coli] [EC:4.1.2.4] [DE:(DEOXYRIBOALDOLASE)] [SP:P00882] [DB:swissprot] >sp:[LN:ADECD] [AC:A01102:S56605:D65253] [PN:deoxyribose-phosphate aldolase,] [GN:deoC] [CL:deoxyribose-phosphate aldolase] [OR:Escherichia coli] [EC:4.1.2.4] [DB:pir1] [MP:100 min] >gp:[GI:g537221] [LN:ECOUW93] [AC:U14003] [PN:deoxyribose-phosphate aldolase] [GN:deoC] [OR:Escherichia coli] [DB:genpept-bct1] [EC:4.1.2.4] [DE:Escherichia coli K-12 chromosomal region from 92.8 to 00.1 minutes.] [NT:CG Site No. 866; alternate gene names dra, thyR] [LE:308154] [RE:308933] [DI:direct] >gp:[GI:g1790841] [LN:AE000508] [AC:AE000508:U00096] [PN:2-deoxyribose-5-phosphate aldolase] [GN:deoC] [FN:enzyme; Salvage of nucleosides and nucleotides] [OR:Escherichia coli] [DB:genpept-bct2] [EC:4.1.2.4] [DE:Escherichia coli K-12 MG1655 section 398 of 400 of the completegenome.] [NT:o259b; 100 pct identical to DEOC_ECOLI SW:] [LE:7971] [RE:8750] [DI:direct]

| ORF Name | NT ID | AA ID | NT LN | AA LN | Score | P-value |
|---|---|---|---|---|---|---|
| 14884578_c1_1403 | 1528 | 8699 | 276 | 91 | 112 | 1.1e-06 |

Description sp:[LN:H71118] [AC:H71118] [PN:hypothetical protein PH0719] [GN:PH0719]
[CL:Pyrococcus horikoshii hypothetical protein PH0719] [OR:Pyrococcus horikoshii]
[DB:pir2] >gp:[GI:d1030753:g3257127] [LN:AP000003]
[AC:AP000003:AB009484:AB009485:AB009486:AB009487:AB009488:AB009489] [PN:112aa
long hypothetical protein] [GN:PH0719] [OR:Pyrococcus horikoshii] [SR:Pyrococcus
horikoshii (strain:OT3) DNA] [DB:genpept-bct1] [DE:Pyrococcus horikoshii OT3
genomic DNA, 544001-777000 nt. position(3/7).] [LE:98571] [RE:98909]
[DI:complement]

| ORF Name | NT ID | AA ID | NT LN | AA LN | Score | P-value |
|---|---|---|---|---|---|---|
| 14886278_c3_2169 | 1529 | 8700 | 291 | 96 | 286 | 4.1e-25 |

Description sp:[LN:RELE_ECOLI] [AC:P07008] [GN:RELE] [OR:Escherichia coli] [DE:HYPOTHETICAL
RELE PROTEIN] [SP:P07008] [DB:swissprot] >sp:[LN:QQECR1] [AC:B22830:F64911]
[PN:relE protein] [GN:relE] [CL:Escherichia coli relE protein] [OR:Escherichia
coli] [DB:pir1] [MP:34 min] >gp:[GI:d1015983:g1742558] [LN:D90798]
[AC:D90798:AB001340] [GN:relE] [OR:Escherichia coli] [SR:Escherichia coli
(strain:K12) DNA, clone_lib:Kohara lambda minise] [DB:genpept-bct1] [DE:E.coli
genomic DNA, Kohara clone #307(35.1-35.5 min.).] [NT:ORF_ID:o308#19; similar to
[PIR Accession Number] [LE:17340] [RE:17627] [DI:complement]
>gp:[GI:d1015993:g1742569] [LN:D90799] [AC:D90799:AB001340] [GN:relE]
[OR:Escherichia coli] [SR:Escherichia coli (strain:K12) DNA, clone_lib:Kohara
lambda minise] [DB:genpept-bct1] [DE:E.coli genomic DNA, Kohara clone
308(35.3-35.7 min.).] [NT:ORF_ID:o308#19; similar to [PIR Accession Number]
[LE:7313] [RE:7600] [DI:complement] >gp:[GI:d1016015:g1742592] [LN:D90800]
[AC:D90800:AB001340] [GN:relE] [OR:Escherichia coli] [SR:Escherichia coli
(strain:K12) DNA, clone_lib:Kohara lambda minise] [DB:genpept-bct1] [DE:E.coli
genomic DNA, Kohara clone #309(35.4-35.7 min.).] [NT:ORF_ID:o308#19; similar to
[PIR Accession Number] [LE:4089] [RE:4376] [DI:complement] >gp:[GI:g42701]
[LN:ECRELB] [AC:X02405] [OR:Escherichia coli] [DB:genpept-bct1] [DE:E. coli relB
gene region.] [NT:relE protein (aa 1-95)] [SP:P07008] [LE:733] [RE:1020]
[DI:direct] >gp:[GI:g1787846] [LN:AE000253] [AC:AE000253:U00096] [PN:orf,
hypothetical protein] [GN:relE] [FN:orf; Unknown] [OR:Escherichia coli]
[DB:genpept-bct2] [DE:Escherichia coli K-12 MG1655 section 143 of 400 of the
completegenome.] [NT:f95; 100 pct identical to RELE_ECOLI SW: P07008; CG]
[LE:3098] [RE:3385] [DI:complement]

| ORF Name | NT ID | AA ID | NT LN | AA LN | Score | P-value |
|---|---|---|---|---|---|---|
| 14929516_f1_188 | 1530 | 8701 | 213 | 70 | | |

Description

NO-HIT

| ORF Name | NT ID | AA ID | NT LN | AA LN | Score | P-value |
|---|---|---|---|---|---|---|
| 14959387_f2_516 | 1531 | 8702 | 1077 | 358 | 769 | 1.2e-80 |

Description gp:[GI:g4583441] [LN:AF129277] [AC:AF129277] [PN:HmsT] [GN:hmsT] [FN:involved in hemin storage system] [OR:Yersinia pestis] [DB:genpept-bct2] [DE:Yersinia pestis HmsT (hmsT) gene, complete cds.] [LE:760] [RE:1932] [DI:direct] >gp:[GI:g5758037] [LN:AF132982] [AC:AF132982] [PN:HmsT] [GN:hmsT] [OR:Yersinia pestis] [DB:genpept-bct2] [DE:Yersinia pestis HmsT (hmsT) gene, complete cds.] [NT:required for binding of Congo Red dye] [LE:138] [RE:1310] [DI:direct]

| ORF Name | NT ID | AA ID | NT LN | AA LN | Score | P-value |
|---|---|---|---|---|---|---|
| 15022807_c3_2126 | 1532 | 8703 | 783 | 260 | 1198 | 9.3e-122 |

Description sp:[LN:CYCA_ECOLI] [AC:P39312] [GN:CYCA:DAGA] [OR:Escherichia coli] [DE:D-SERINE/D-ALANINE/GLYCINE TRANSPORTER] [SP:P39312] [DB:swissprot] >sp:[LN:S56433] [AC:S56433:C65232] [PN:d-serine/d-alanine/glycine transporter] [GN:cycA] [CL:arginine permease] [OR:Escherichia coli] [DB:pir2] >gp:[GI:g537049] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_o470] [LE:120696] [RE:122108] [DI:direct] >gp:[GI:g1790653] [LN:AE000492] [AC:AE000492:U00096] [PN:transport of D-alanine, D-serine, and glycine] [GN:cycA] [FN:transport; Transport of small molecules: Amino] [OR:Escherichia coli] [DB:genpept-bct2] [DE:Escherichia coli K-12 MG1655 section 382 of 400 of the completegenome.] [NT:o470; 100 pct identical amino acid sequence and] [LE:2436] [RE:3848] [DI:direct]

| ORF Name | NT ID | AA ID | NT LN | AA LN | Score | P-value |
|---|---|---|---|---|---|---|
| 15056377_c1_1326 | 1533 | 8704 | 246 | 81 | 385 | 1.3e-35 |

Description sp:[LN:R3EC18] [AC:S56427:A02741:E65231] [PN:ribosomal protein S18] [GN:rpsR] [CL:Escherichia coli ribosomal protein S18] [OR:Escherichia coli] [DB:pir1] [MP:96 min] >gp:[GI:g537043] [LN:ECOUW93] [AC:U14003] [PN:30S ribosomal subunit protein S18] [GN:rpsR] [OR:Escherichia coli] [DB:genpept-bct1] [DE:Escherichia coli K-12 chromosomal region from 92.8 to 00.1 minutes.] [NT:CG Site No. 214] [LE:116671] [RE:116898] [DI:direct] >gp:[GI:g42847] [LN:ECRPSFRI] [AC:X04022] [OR:Escherichia coli] [DB:genpept-bct1] [DE:E. coli genes rpsF, rpsR and rplI for ribosomal proteins S6, S18,L9.] [NT:ribosomal protein S18 (aa 1-75)] [SP:P02374] [LE:1169] [RE:1396] [DI:direct] >gp:[GI:g1790646] [LN:AE000491] [AC:AE000491:U00096] [PN:30S ribosomal subunit protein S18] [GN:rpsR] [FN:structural component; Ribosomal proteins -] [OR:Escherichia coli] [DB:genpept-bct2] [DE:Escherichia coli K-12 MG1655 section 381 of 400 of the completegenome.] [NT:o75; 100 pct identical to RS18_ECOLI SW: P02374; CG] [LE:9505] [RE:9732] [DI:direct]

| ORF Name | NT ID | AA ID | NT LN | AA LN | Score | P-value |
|---|---|---|---|---|---|---|
| 15132250_c3_2284 | 1534 | 8705 | 216 | 71 | | |

Description

NO-HIT

| ORF Name | NT ID | AA ID | NT LN | AA LN | Score | P-value |
|---|---|---|---|---|---|---|
| 15625328_c2_1979 | 1535 | 8706 | 1188 | 395 | 199 | 2.6e-15 |

Description gp:[GI:g642964] [LN:ABCARRA] [AC:X70360] [GN:carR] [OR:Azospirillum brasilense]
[DB:genpept-bct1] [DE:A.brasilense carR gene.] [LE:<1] [RE:588] [DI:direct]

| ORF Name | NT ID | AA ID | NT LN | AA LN | Score | P-value |
|---|---|---|---|---|---|---|
| 15636465_f2_696 | 1536 | 8707 | 582 | 193 | | |

Description

NO-HIT

| ORF Name | NT ID | AA ID | NT LN | AA LN | Score | P-value |
|---|---|---|---|---|---|---|
| 15659385_c3_2321 | 1537 | 8708 | 756 | 251 | 1087 | 5.4e-110 |

Description sp:[LN:YLCA_ECOLI] [AC:P77380] [GN:YLCA] [OR:Escherichia coli] [DE:PROBABLE
TRANSCRIPTIONAL REGULATORY PROTEIN YLCA] [SP:P77380] [DB:swissprot]
>sp:[LN:A64790] [AC:A64790] [PN:probable transcription regulator yclA:probable
transcription regulation protein yclA] [GN:yclA] [CL:ompR protein:response
regulator homology] [OR:Escherichia coli] [DB:pir2] >gp:[GI:d1036191:g4062195]
[LN:D90699] [AC:D90699:AB001340] [PN:Transcriptional activator protein copR.]
[GN:copR] [OR:Escherichia coli] [SR:Escherichia coli(strain:K12) DNA,
clone:Kohara clone #162] [DB:genpept-bct1] [DE:Escherichia coli genomic DNA.
(12.6 - 12.9 min).] [NT:ORF_ID:o163#1; similar to PIR Accession Number] [LE:9175]
[RE:9858] [DI:complement] >gp:[GI:d1036197:g4062201] [LN:D90700]
[AC:D90700:AB001340] [PN:Transcriptional activator protein copR.] [GN:copR]
[OR:Escherichia coli] [SR:Escherichia coli(strain:K12) DNA, clone:Kohara clone
163] [DB:genpept-bct1] [DE:Escherichia coli genomic DNA. (12.8 - 13.2 min).]
[NT:ORF_ID:o163#1; similar to PIR Accession Number] [LE:98] [RE:781]
[DI:complement] >gp:[GI:g1778486] [LN:ECU82598] [AC:U82598] [PN:CopR homolog]
[OR:Escherichia coli] [DB:genpept-bct1] [DE:Escherichia coli genomic sequence of
minutes 9 to 12.] [NT:similar to P. syringae CopR] [LE:35391] [RE:36074]
[DI:complement] >gp:[GI:g1786784] [LN:AE000162] [AC:AE000162:U00096] [PN:putative
2-component transcriptional regulator] [GN:ylcA] [FN:putative regulator; Not
classified] [OR:Escherichia coli] [DB:genpept-bct2] [DE:Escherichia coli K-12
MG1655 section 52 of 400 of the completegenome.] [NT:f227; This 227 aa ORF is 61
pct identical (0 gaps)] [LE:1537] [RE:2220] [DI:complement]

| ORF_Name | NT ID | AA ID | NT LN | AA LN | Score | P-value |
|---|---|---|---|---|---|---|
| 15707666_c2_1706 | 1538 | 8709 | 2469 | 822 | 3949 | 0.0 |

Description sp:[LN:S56404] [AC:S56404:C31965:F65228] [PN:virulence-associated protein vacB homolog] [GN:vacB] [CL:virulence-associated protein vacB homolog] [OR:Escherichia coli] [DB:pir1] [MP:95 min] >gp:[GI:g537020] [LN:ECOUW93] [AC:U14003] [GN:vacB] [OR:Escherichia coli] [DB:genpept-bct1] [DE:Escherichia coli K-12 chromosomal region from 92.8 to 00.1 minutes.] [LE:97440] [RE:99923] [DI:direct] >gp:[GI:g1790622] [LN:AE000490] [AC:AE000490:U00096] [PN:putative enzyme] [GN:vacB] [FN:putative enzyme; Not classified] [OR:Escherichia coli] [DB:genpept-bct2] [DE:Escherichia coli K-12 MG1655 section 380 of 400 of the completegenome.] [NT:o827; 100 pct identical to 813 amino acids] [LE:2296] [RE:4779] [DI:direct]

| ORF_Name | NT ID | AA ID | NT LN | AA LN | Score | P-value |
|---|---|---|---|---|---|---|
| 15713437_f1_127 | 1539 | 8710 | 912 | 303 | 1486 | 2.8e-152 |

Description gp:[GI:g5833399] [LN:AF144422] [AC:AF144422] [PN:HpaD] [GN:hpaD] [OR:Salmonella dublin] [DB:genpept-bct2] [DE:Salmonella dublin 4-hydroxyphenylacetate catabolic locus, completesequence.] [LE:4502] [RE:5353] [DI:complement]

| ORF_Name | NT ID | AA ID | NT LN | AA LN | Score | P-value |
|---|---|---|---|---|---|---|
| 15801377_c2_1703 | 1540 | 8711 | 261 | 86 | 295 | 4.6e-26 |

Description sp:[LN:YJET_ECOLI] [AC:P39289] [GN:YJET] [OR:Escherichia coli] [DE:HYPOTHETICAL 7.2 KD PROTEIN IN HFLC-PURA INTERGENIC REGION (O65)] [SP:P39289] [DB:swissprot] >sp:[LN:S56401] [AC:S56401:C65228] [PN:hypothetical protein o65] [OR:Escherichia coli] [DB:pir2] >gp:[GI:g537017] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_o65] [LE:95214] [RE:95411] [DI:direct] >gp:[GI:g1790619] [LN:AE000490] [AC:AE000490:U00096] [PN:orf, hypothetical protein] [GN:yjeT] [FN:orf; Unknown] [OR:Escherichia coli] [DB:genpept-bct2] [DE:Escherichia coli K-12 MG1655 section 380 of 400 of the completegenome.] [NT:o65] [LE:70] [RE:267] [DI:direct]

| ORF_Name | NT ID | AA ID | NT LN | AA LN | Score | P-value |
|---|---|---|---|---|---|---|
| 15829138_c2_1940 | 1541 | 8712 | 510 | 169 | 541 | 3.9e-52 |

Description sp:[LN:A60635] [AC:A60635:A60631] [PN:glutathione transferase,, fosfomycin-modifying:fosfomycin resistance protein] [CL:fosfomycin resistance protein] [OR:Escherichia coli] [EC:2.5.1.18] [DB:pir1] >gp:[GI:g154989] [LN:TRNFOS] [AC:M85195:M31685] [PN:fosfomycin-resistance protein] [GN:fos] [OR:Transposon Tn2921] [SR:Transposon Tn2921 DNA] [DB:genpept-una] [DE:Transposon Tn2921 (from Serratia marcescens) fosfomycin-resistanceprotein (fos) gene, complete cds.] [LE:296] [RE:721] [DI:direct]

| ORF Name | NT ID | AA ID | NT LN | AA LN | Score | P-value |
|---|---|---|---|---|---|---|
| 15911008_c1_1544 | 1542 | 8713 | 1179 | 392 | 438 | 3.2e-41 |

Description sp:[LN:B69690] [AC:B69690:I40466:S42714] [PN:ribose ABC transporter (permease) rbsC] [GN:rbsC] [CL:l-arabinose transport system permease araH] [OR:Bacillus subtilis] [DB:pir2] >gp:[GI:e1184501:g2636120] [LN:BSUB0019] [AC:Z99122:AL009126] [PN:ribose ABC transporter (permease)] [GN:rbsC] [FN:ribose transport] [OR:Bacillus subtilis] [DB:genpept-bct1] [DE:Bacillus subtilis complete genome (section 19 of 21): from 3597091to 3809700.] [LE:107132] [RE:108100] [DI:direct] >gp:[GI:e308082:g1894758] [LN:BSZ92953] [AC:Z92953] [PN:membrane transport protein] [GN:rbsC] [OR:Bacillus subtilis] [DB:genpept-bct1] [DE:B.subtilis yws[A,B,C] genes and rbs[A,C,D,K,R] genes.] [NT:part of the ribose transport operon] [LE:1918] [RE:2886] [DI:complement]

| ORF Name | NT ID | AA ID | NT LN | AA LN | Score | P-value |
|---|---|---|---|---|---|---|
| 16020791_f3_1205 | 1543 | 8714 | 360 | 119 | | |

Description

NO-HIT

| ORF Name | NT ID | AA ID | NT LN | AA LN | Score | P-value |
|---|---|---|---|---|---|---|
| 16022711_c2_1861 | 1544 | 8715 | 1077 | 358 | 169 | 6.9e-21 |

Description gp:[GI:g4406756] [LN:ATAC006836] [AC:AC006836] [PN:putative integral membrane protein A3] [GN:F19B11.4] [OR:Arabidopsis thaliana] [SR:thale cress] [DB:genpept-pln2] [DE:Arabidopsis thaliana chromosome II BAC F19B11 genomic sequence,complete sequence.] [LE:16276:16583:16810:17036] [RE:16503:16721:16963:17159] [DI:directJoin]

| ORF Name | NT ID | AA ID | NT LN | AA LN | Score | P-value |
|---|---|---|---|---|---|---|
| 16034662_f1_295 | 1545 | 8716 | 582 | 193 | 727 | 7.6e-72 |

Description sp:[LN:YJGM_SALTY] [AC:Q08021] [GN:YJGM] [OR:Salmonella typhimurium] [DE:HYPOTHETICAL 18.3 KD PROTEIN IN MIAE 3'REGION (ORF 18.3)] [SP:Q08021] [DB:swissprot] >sp:[LN:S34363] [AC:S34363] [PN:hypothetical protein 18.3] [OR:Salmonella typhimurium] [DB:pir2] >gp:[GI:g312710] [LN:STMIAE] [AC:X73368] [OR:Salmonella typhimurium] [DB:genpept-bct1] [DE:S.typhimurium genes miaE, argI (partial) and orf's.] [NT:ORF 18.3] [SP:Q08021] [LE:2890] [RE:3393] [DI:complement]

| ORF_Name | NT_ID | AA_ID | NT/LN | AA/LN | Score | P-value |
|---|---|---|---|---|---|---|
| 16119016_c2_1920 | 1546 | 8717 | 270 | 89 | 329 | 1.1e-29 |

Description gp:[GI:g6009456] [LN:AB024946] [AC:AB024946] [GN:orf80] [OR:Escherichia coli]
[SR:Escherichia coli (sub_species:enteropathogenic, strain:B171]
[DB:genpept-bct1] [DE:Escherichia coli plasmid pB171 genomic DNA, complete
sequence.] [LE:67923] [RE:68210] [DI:complement]

| ORF_Name | NT_ID | AA_ID | NT/LN | AA/LN | Score | P-value |
|---|---|---|---|---|---|---|
| 16120665_c2_1764 | 1547 | 8718 | 471 | 156 | | |

Description

NO-HIT

| ORF_Name | NT_ID | AA_ID | NT/LN | AA/LN | Score | P-value |
|---|---|---|---|---|---|---|
| 16144033_f2_561 | 1548 | 8719 | 189 | 62 | 45 | 0.044 |

Description gp:[GI:g2662563] [LN:CELC44B12] [AC:AF036692] [GN:C44B12.6] [OR:Caenorhabditis
elegans] [SR:Caenorhabditis elegans strain=Bristol N2] [DB:genpept-inv1]
[DE:Caenorhabditis elegans cosmid C44B12.] [LE:29402:31419:31656]
[RE:29547:31476:31817] [DI:complementJoin]

| ORF_Name | NT_ID | AA_ID | NT/LN | AA/LN | Score | P-value |
|---|---|---|---|---|---|---|
| 16183587_c2_1755 | 1549 | 8720 | 1080 | 359 | 1239 | 4.2e-126 |

Description sp:[LN:YJFF_ECOLI] [AC:P37772] [GN:YJFF] [OR:Escherichia coli] [DE:HYPOTHETICAL
ABC TRANSPORTER PERMEASE PROTEIN YJFF] [SP:P37772] [DB:swissprot] >sp:[LN:S56457]
[AC:S56457:B65235] [PN:hypothetical 34.0K protein (ppa-fbp intergenic
region):hypothetical protein o323] [GN:yjfF] [CL:1-arabinose transport system
permease araH] [OR:Escherichia coli] [DB:pir2] >gp:[GI:g537073] [LN:ECOUW93]
[AC:U14003] [OR:Escherichia coli] [DB:genpept-bct1] [DE:Escherichia coli K-12
chromosomal region from 92.8 to 00.1 minutes.] [NT:ORF_o323] [LE:144436]
[RE:145407] [DI:direct] >gp:[GI:g1790678] [LN:AE000494] [AC:AE000494:U00096]
[PN:putative transport system permease protein] [GN:yjfF] [FN:putative transport;
Not classified] [OR:Escherichia coli] [DB:genpept-bct2] [DE:Escherichia coli K-12
MG1655 section 384 of 400 of the completegenome.] [NT:o323; 100 pct identical
amino acid sequence and] [LE:5291] [RE:6262] [DI:direct]

| ORF Name | NT ID | AA ID | NT LN | AA LN | Score | P-value |
|---|---|---|---|---|---|---|
| 16289842_c2_1776 | 1550 | 8721 | 321 | 106 | 215 | 1.4e-17 |

Description sp:[LN:PTCB_BACST] [AC:Q45399] [GN:CELA] [OR:Bacillus stearothermophilus]
[EC:2.7.1.69] [DE:(EC 2.7.1.69)] [SP:Q45399] [DB:swissprot] >sp:[LN:B49898]
[AC:B49898] [PN:cellobiose phosphotransferase system celA] [CL:phosphotransferase
system enzyme II cellobiose-specific factor IIB] [OR:Bacillus stearothermophilus]
[DB:pir2] >gp:[GI:g466473] [LN:BSU07818] [AC:U07818:S66216] [PN:cellobiose
phosphotransferase enzyme II'] [GN:celA] [OR:Bacillus stearothermophilus]
[DB:genpept-bct1] [DE:Bacillus stearothermophilus XL-65-6 PTS regulatory protein
(celR')gene, partial cds, and cellobiose phosphotransferase system operon(celA,
celB, celC, and celD) genes, complete cds.] [NT:cellobiose PTS enzyme II']
[LE:1541] [RE:1843] [DI:direct]

| ORF Name | NT ID | AA ID | NT LN | AA LN | Score | P-value |
|---|---|---|---|---|---|---|
| 16307828_f3_1013 | 1551 | 8722 | 507 | 168 | | |

Description

NO-HIT

| ORF Name | NT ID | AA ID | NT LN | AA LN | Score | P-value |
|---|---|---|---|---|---|---|
| 16506441_c1_1304 | 1552 | 8723 | 1032 | 343 | 1546 | 1.2e-158 |

Description sp:[LN:HFLC_ECOLI] [AC:P25661] [GN:HFLC:HFLA] [OR:Escherichia coli] [EC:3.4.-.-]
[DE:HFLC PROTEIN,] [SP:P25661] [DB:swissprot] >sp:[LN:C43653]
[AC:C43653:S56400:B65228] [PN:probable integral membrane proteinase, hflC]
[GN:hflC] [OR:Escherichia coli] [EC:3.4.-.-] [DB:pir2] >gp:[GI:g537016]
[LN:ECOUW93] [AC:U14003] [GN:hflC] [OR:Escherichia coli] [DB:genpept-bct1]
[DE:Escherichia coli K-12 chromosomal region from 92.8 to 00.1 minutes.] [NT:CG
Site No. 17520; alternate gene name hflA;] [LE:94128] [RE:95132] [DI:direct]
>gp:[GI:g1790617] [LN:AE000489] [AC:AE000489:U00096] [PN:protease specific for
phage lambda cII] [GN:hflC] [FN:enzyme; Degradation of proteins, peptides,]
[OR:Escherichia coli] [DB:genpept-bct2] [EC:3.4.-.-] [DE:Escherichia coli K-12
MG1655 section 379 of 400 of the completegenome.] [NT:o334; 100 pct identical to
HFLC_ECOLI SW: P25661;] [LE:11014] [RE:12018] [DI:direct] >gp:[GI:g436158]
[LN:ECOHFLA] [AC:U00005] [GN:hflC] [OR:Escherichia coli] [SR:Escherichia coli
K12] [DB:genpept-bct2] [DE:E. coli hflA locus encoding the hflX, hflK and hflC
genes, hfqgene, complete cds; miaA gene, partial cds.] [NT:putative integral
membrane protease required for] [LE:3750] [RE:4754] [DI:direct]

| ORF Name | NT ID | AA ID | NT LN | AA LN | Score | P-value |
|---|---|---|---|---|---|---|
| 16525962_f1_250 | 1553 | 8724 | 3627 | 1208 | 109 | 0.00023 |

Description sp:[LN:MLP1_YEAST] [AC:Q02455] [GN:MLP1:YKR095W:YKR415] [OR:Saccharomyces cerevisiae] [SR:,Baker's yeast] [DE:MYOSIN-LIKE PROTEIN MLP1] [SP:Q02455] [DB:swissprot] >sp:[LN:S38173] [AC:S38173:S40647:S31207] [PN:myosin-like protein MLP1:protein YKR095w:protein YKR415] [GN:MLP1] [OR:Saccharomyces cerevisiae] [DB:pir2] [MP:11R] >gp:[GI:g450554] [LN:SCDNACHXI] [AC:X73541] [GN:MPL1] [OR:Saccharomyces cerevisiae] [SR:baker's yeast] [DB:genpept-pln1] [DE:S.cerevisiae DNA of chromosome XI, right arm.] [SP:Q02455] [LE:9091] [RE:14718] [DI:direct] >gp:[GI:g486587] [LN:SCYKR095W] [AC:Z28320:Y13137] [GN:MLP1] [OR:Saccharomyces cerevisiae] [SR:baker's yeast] [DB:genpept-pln1] [DE:S.cerevisiae chromosome XI reading frame ORF YKR095w.] [NT:ORF YKR095w] [SP:Q02455] [LE:1063] [RE:6690] [DI:direct]

| ORF Name | NT ID | AA ID | NT LN | AA LN | Score | P-value |
|---|---|---|---|---|---|---|
| 16535216_f3_1095 | 1554 | 8725 | 915 | 304 | | |

Description

NO-HIT

| ORF Name | NT ID | AA ID | NT LN | AA LN | Score | P-value |
|---|---|---|---|---|---|---|
| 16536415_f1_125 | 1555 | 8726 | 939 | 312 | 962 | 9.5e-97 |

Description gp:[GI:g5833401] [LN:AF144422] [AC:AF144422] [PN:HpaG] [GN:hpaG] [OR:Salmonella dublin] [DB:genpept-bct2] [DE:Salmonella dublin 4-hydroxyphenylacetate catabolic locus, completesequence.] [LE:6815] [RE:8104] [DI:complement]

| ORF Name | NT ID | AA ID | NT LN | AA LN | Score | P-value |
|---|---|---|---|---|---|---|
| 16542187_f2_765 | 1556 | 8727 | 1224 | 407 | 61 | 0.025 |

Description sp:[LN:D71821] [AC:D71821] [PN:probable histidine and glutamine-rich metal-binding protein] [GN:jhp1321] [OR:Helicobacter pylori] [SR:strain J99, , strain J99] [SR:strain J99, ] [DB:pir2] >gp:[GI:g4155936] [LN:AE001555] [AC:AE001555:AE001439] [PN:putative histidine and glutamine-rich] [GN:jhp1321] [OR:Helicobacter pylori J99] [DB:genpept-bct2] [DE:Helicobacter pylori, strain J99 section 116 of 132 of the completegenome.] [NT:similar to H. pylori 26695 gene HP1432] [LE:1391] [RE:1624] [DI:complement]

| ORF_Name | NT_ID | AA_ID | NT/LN | AA/LN | Score | P-value |
|---|---|---|---|---|---|---|
| 16598262_c3_2367 | 1557 | 8728 | 1257 | 418 | 125 | 4.5e-05 |

Description gp:[GI:g11084] [LN:PFHRPII2C] [AC:X69925] [PN:HRPII] [GN:HRPII] [OR:Plasmodium falciparum] [SR:malaria parasite P. falciparum] [DB:genpept-inv1] [DE:P.falciparum (S15) HRPII gene, exon 2.] [LE:<7] [RE:900] [DI:direct]

| ORF_Name | NT_ID | AA_ID | NT/LN | AA/LN | Score | P-value |
|---|---|---|---|---|---|---|
| 16601642_f1_259 | 1558 | 8729 | 255 | 84 | | |

Description

NO-HIT

| ORF_Name | NT_ID | AA_ID | NT/LN | AA/LN | Score | P-value |
|---|---|---|---|---|---|---|
| 16620302_f1_366 | 1559 | 8730 | 1254 | 417 | 964 | 5.9e-97 |

Description sp:[LN:RAFB_ECOLI] [AC:P16552] [GN:RAFB] [OR:Escherichia coli] [DE:RAFFINOSE PERMEASE] [SP:P16552] [DB:swissprot] >sp:[LN:B43717] [AC:B43717] [PN:raffinose permease] [GN:rafB] [CL:lactose permease] [OR:Escherichia coli] [DB:pir2] >gp:[GI:g147506] [LN:ECORAF] [AC:M27273] [OR:Escherichia coli] [SR:E.coli (strain K-12) DNA] [DB:genpept-bct1] [DE:E.coli rafA, rafB, and rafD genes encoding alpha-D-galactosidase,raf-permease, and raf-invertase, complete cds.] [NT:raf-permease] [LE:2259] [RE:3536] [DI:direct]

| ORF_Name | NT_ID | AA_ID | NT/LN | AA/LN | Score | P-value |
|---|---|---|---|---|---|---|
| 16813202_f2_578 | 1560 | 8731 | 984 | 327 | 221 | 3.2e-18 |

Description sp:[LN:D69749] [AC:D69749] [PN:transcription regulator AraC/XylS family homolog ybfI] [GN:ybfI] [OR:Bacillus subtilis] [DB:pir2] >gp:[GI:d1034085:g3599644] [LN:AB006424] [AC:AB006424] [GN:ybfI] [OR:Bacillus subtilis] [SR:Bacillus subtilis (strain:168) DNA] [DB:genpept-bct1] [DE:Bacillus subtilis genomic DNA, 70 kb region between 17 and 23degree.] [LE:45824] [RE:46651] [DI:complement] >gp:[GI:e1182174:g2632508] [LN:BSUB0002] [AC:Z99105:AL009126] [GN:ybfI] [FN:unknown] [OR:Bacillus subtilis] [DB:genpept-bct1] [DE:Bacillus subtilis complete genome (section 2 of 21): from 194651 to415810.] [NT:similar to transcriptional regulator (AraC/XylS)] [LE:48173] [RE:49000] [DI:complement]

| ORF_Name | NT_ID | AA_ID | NT/LN | AA/LN | Score | P-value |
|---|---|---|---|---|---|---|
| 16836443_f2_663 | 1561 | 8732 | 1134 | 377 | | |

Description

NO-HIT

| ORF Name | NT ID | AA ID | NT LN | AA LN | Score | P-value |
|---|---|---|---|---|---|---|
| 16875665_f2_580 | 1562 | 8733 | 1350 | 449 | 1718 | 7.4e-177 |

Description sp:[LN:YJIN_ECOLI] [AC:P39385] [GN:YJIN] [OR:Escherichia coli] [DE:HYPOTHETICAL
48.2 KD PROTEIN IN IADA-MCRD INTERGENIC REGION (F426)] [SP:P39385] [DB:swissprot]
>sp:[LN:S56561] [AC:S56561:B65248] [PN:hypothetical 48.2K protein (iadA-mcrD
intergenic region):hypothetical protein f426] [GN:yjiN] [OR:Escherichia coli]
[DB:pir2] >gp:[GI:g537177] [LN:ECOUW93] [AC:U14003] [OR:Escherichia coli]
[DB:genpept-bct1] [DE:Escherichia coli K-12 chromosomal region from 92.8 to 00.1
minutes.] [NT:ORF_f426] [LE:256798] [RE:258078] [DI:complement] >gp:[GI:g1790793]
[LN:AE000504] [AC:AE000504:U00096] [PN:orf, hypothetical protein] [GN:yjiN]
[FN:orf; Unknown] [OR:Escherichia coli] [DB:genpept-bct2] [DE:Escherichia coli
K-12 MG1655 section 394 of 400 of the completegenome.] [NT:f426; 100 pct
identical amino acid sequence and] [LE:3287] [RE:4567] [DI:complement]

| ORF Name | NT ID | AA ID | NT LN | AA LN | Score | P-value |
|---|---|---|---|---|---|---|
| 16895791_f2_751 | 1563 | 8734 | 489 | 162 | 707 | 1.0e-69 |

Description sp:[LN:HOLC_ECOLI] [AC:P28905:P11649] [GN:HOLC] [OR:Escherichia coli]
[EC:2.7.7.7] [DE:DNA POLYMERASE III, CHI SUBUNIT,] [SP:P28905:P11649]
[DB:swissprot] >sp:[LN:A46739] [AC:A46739:S39954:S56485:S04527:F65238:S31227]
[PN:DNA-directed DNA polymerase, III chi chain:DNA polymerase III chi chain]
[GN:holC] [OR:Escherichia coli] [EC:2.7.7.7] [DB:pir2] [MP:96.5 min]
>gp:[GI:g41740] [LN:ECHOLCG] [AC:Z14155] [PN:DNA polymerase III holoenzyme chi
subunit] [GN:holC] [OR:Escherichia coli] [DB:genpept-bct1] [DE:E.coli holC gene
encoding chi subunit of DNA polymerase IIIholoenzyme.] [SP:P28905] [LE:211]
[RE:654] [DI:direct] >gp:[GI:g145537] [LN:ECOCHI] [AC:L04574] [PN:DNA polymerase
III chi subunit] [GN:holC] [OR:Escherichia coli] [SR:Escherichia coli (strain
K-12) (tissue library: lamda-phage of Y] [DB:genpept-bct1] [DE:Escherichia coli
(clone pUC-chi) DNA polymerase III chi subunit(holC) gene, complete cds.]
[LE:176] [RE:619] [DI:direct] >gp:[GI:g537101] [LN:ECOUW93] [AC:U14003] [PN:DNA
polymerase III chi subunit] [GN:holC] [OR:Escherichia coli] [DB:genpept-bct1]
[DE:Escherichia coli K-12 chromosomal region from 92.8 to 00.1 minutes.]
[LE:174672] [RE:175115] [DI:complement] >gp:[GI:g1790709] [LN:AE000496]
[AC:AE000496:U00096] [PN:DNA polymerase III, chi subunit] [GN:holC] [FN:enzyme;
DNA - replication, repair,] [OR:Escherichia coli] [DB:genpept-bct2] [EC:2.7.7.7]
[DE:Escherichia coli K-12 MG1655 section 386 of 400 of the completegenome.]
[NT:f147; 100 pct identical amino acid sequence and] [LE:9686] [RE:10129]
[DI:complement]

| ORF Name | NT ID | AA ID | NT LN | AA LN | Score | P-value |
|---|---|---|---|---|---|---|
| 16900203_c1_1664 | 1564 | 8735 | 633 | 210 | 626 | 3.8e-61 |

Description sp:[LN:CRED_ECOLI] [AC:P08369] [GN:CRED:CET] [OR:Escherichia coli] [DE:INNER MEMBRANE PROTEIN CRED] [SP:P08369] [DB:swissprot] >sp:[LN:BVECCT] [AC:D25038:S03765:A92515:S56624:G65255:B22277] [PN:inner membrane protein creD:creD protein] [GN:creD:cet] [CL:cet protein] [OR:Escherichia coli] [DB:pir1] [MP:100 min] >gp:[GI:g41104] [LN:ECCET] [AC:Y00538] [PN:Cet protein (AA 1-450)] [OR:Escherichia coli] [DB:genpept-bct1] [DE:E. coli cet gene and phoM gene 3'-terminal region.] [SP:P08369] [LE:344] [RE:1696] [DI:direct] >gp:[GI:g147252] [LN:ECOPHOM] [AC:M13608] [OR:Escherichia coli] [SR:Escherichia coli (strain KLF125/KL181) DNA] [DB:genpept-bct1] [DE:E.coli (clone pTHR34) phoM operon, containing phoM gene (positveregulation for pho regulon) and three unidentified genes.] [NT:ORF4] [LE:3237] [RE:4589] [DI:direct] >gp:[GI:g537240] [LN:ECOUW93] [AC:U14003] [GN:creD] [OR:Escherichia coli] [DB:genpept-bct1] [DE:Escherichia coli K-12 chromosomal region from 92.8 to 00.1 minutes.] [NT:alternate gene name cet; CG Site No. 929] [LE:329011] [RE:330363] [DI:direct] >gp:[GI:g1790862] [LN:AE000510] [AC:AE000510:U00096] [PN:tolerance to colicin E2] [GN:creD] [FN:putative membrane; Colicin-related functions] [OR:Escherichia coli] [DB:genpept-bct2] [DE:Escherichia coli K-12 MG1655 section 400 of 400 of the completegenome.] [NT:o450; 100 pct identical to CRED_ECOLI SW: P08369;] [LE:2835] [RE:4187] [DI:direct]

| ORF Name | NT ID | AA ID | NT LN | AA LN | Score | P-value |
|---|---|---|---|---|---|---|
| 16922891_f2_790 | 1565 | 8736 | 1362 | 453 | 59 | 0.010 |

Description sp:[LN:C58213] [AC:C58213] [PN:protamine II] [CL:sperm histone] [OR:Alligator mississippiensis] [SR:, American alligator] [DB:pir2]

| ORF Name | NT ID | AA ID | NT LN | AA LN | Score | P-value |
|---|---|---|---|---|---|---|
| 16926652_f3_1289 | 1566 | 8737 | 453 | 150 | 180 | 7.8e-14 |

Description sp:[LN:VACB_SHIFL] [AC:P30851] [GN:VACB] [OR:Shigella flexneri] [DE:VACB PROTEIN] [SP:P30851] [DB:swissprot] >gp:[GI:d1002252:g391901] [LN:SHFVACB] [AC:D11024] [PN:ORF-2] [GN:vacB] [OR:Shigella flexneri] [SR:Shigella flexneri (sub_species:2a) DNA] [DB:genpept-bct1] [DE:Shigella flexneri vacB gene.] [LE:674] [RE:2956] [DI:direct]

| ORF Name | NT ID | AA ID | NT/LN | AA/LN | Score | P-value |
|---|---|---|---|---|---|---|
| 16931907_c3_2220 | 1567 | 8738 | 1113 | 370 | 874 | 2.0e-87 |

Description sp:[LN:IOLD_BACSU] [AC:P42415] [GN:IOLD:E83D] [OR:Bacillus subtilis] [DE:IOLD
PROTEIN] [SP:P42415] [DB:swissprot] >sp:[LN:D69645] [AC:D69645] [PN:myo-inositol
catabolism iolD] [GN:iolD] [OR:Bacillus subtilis] [DB:pir2]
>gp:[GI:d1003803:g709984] [LN:BACIOLO] [AC:D14399] [PN:hypothetical protein]
[GN:E83D] [OR:Bacillus subtilis] [SR:Bacillus subtilis (strain:BGSC 1A1 (168
trpC2)) DNA] [DB:genpept-bct1] [DE:Bacillus subtilis 15 kb chromosome segment
contains the iol operon.] [NT:homologous to acetolactate synthases] [LE:3351]
[RE:5093] [DI:direct] >gp:[GI:e1184698:g2636519] [LN:BSUB0021]
[AC:Z99124:AL009126] [GN:iolD] [OR:Bacillus subtilis] [DB:genpept-bct1]
[DE:Bacillus subtilis complete genome (section 21 of 21): from 3999281to
4214814.] [NT:alternate gene name: yxdD; myo-inositol catabolism] [SP:P42415]
[LE:78596] [RE:80338] [DI:complement]

| ORF Name | NT ID | AA ID | NT/LN | AA/LN | Score | P-value |
|---|---|---|---|---|---|---|
| 17052040_c3_2494 | 1568 | 8739 | 492 | 163 | 698 | 9.0e-69 |

Description sp:[LN:JE0402] [AC:JE0402:S40551:D64723:S22289] [PN:probable peptidylprolyl
isomerase, 16K fkbP-type:orf149 protein] [GN:yaaD] [CL:BKBP-type peptidylprolyl
isomerase homology] [OR:Escherichia coli] [EC:5.2.1.8] [DB:pir2] >gp:[GI:g41932]
[LN:ECLSPDAP] [AC:X54945] [GN:ORF 1] [OR:Escherichia coli] [DB:genpept-bct1]
[DE:E. coli lsp-dapB interval.] [SP:P22563] [LE:146] [RE:595] [DI:direct]
>gp:[GI:d1001778:g216455] [LN:ECO110K]
[AC:D10483:J01597:J01683:J01706:K01298:K01990:M10420:M10611:M12544]
[OR:Escherichia coli] [SR:Escherichia coli (strain:K-12) DNA] [DB:genpept-bct1]
[DE:E.coli K12 genome, 0-2.4min. region.] [NT:hypothetical 16.4K
protein(PIR:JE0402)] [LE:25480] [RE:25929] [DI:direct] >gp:[GI:g1786211]
[LN:AE000113] [AC:AE000113:U00096] [PN:probable FKBX-type 16KD peptidyl-prolyl]
[GN:slpA] [FN:putative enzyme; Proteins - translation and] [OR:Escherichia coli]
[DB:genpept-bct2] [DE:Escherichia coli K-12 MG1655 section 3 of 400 of the
completegenome.] [NT:o149; 100 pct identical to FKBX_ECOLI SW: P22563] [LE:5167]
[RE:5616] [DI:direct]

| ORF Name | NT ID | AA ID | NT LN | AA LN | Score | P-value |
|---|---|---|---|---|---|---|
| 17056682_c3_2472 | 1569 | 8740 | 2508 | 835 | 3853 | 0.0 |

Description sp:[LN:DEECK] [AC:B64720:S56629:A00671:A15659:A14560:S40531:I57719;I73480]
[PN:thrA bifunctional enzyme:aspartokinase I / homoserine dehydrogenase I:protein
f132] [GN:thrA:thrA1:thrA2] [CL:thrA bifunctional enzyme:aspartate kinase
homology:homoserine dehydrogenase homology] [OR:Escherichia coli] [DB:pir1] [MP:0
min] >gp:[GI:g537245] [LN:ECOUW93] [AC:U14003] [PN:aspartokinase I-homoserine
dehydrogenase I] [GN:thrA] [OR:Escherichia coli] [DB:genpept-bct1]
[EC:2.7.2.4:1.1.1.3] [DE:Escherichia coli K-12 chromosomal region from 92.8 to
00.1 minutes.] [NT:CG Site No. 111] [LE:332822] [RE:335284] [DI:direct]
>gp:[GI:g1786183] [LN:AE000111] [AC:AE000111:U00096] [PN:aspartokinase I,
homoserine dehydrogenase I] [GN:thrA] [FN:enzyme; Amino acid biosynthesis:
Threonine] [OR:Escherichia coli] [DB:genpept-bct2] [EC:2.7.2.4] [DE:Escherichia
coli K-12 MG1655 section 1 of 400 of the completegenome.] [NT:o820; 99 pct
identical to AK1H_ECOLI SW: P00561; CG] [LE:337] [RE:2799] [DI:direct]

| ORF Name | NT ID | AA ID | NT LN | AA LN | Score | P-value |
|---|---|---|---|---|---|---|
| 175750_f1_251 | 1570 | 8741 | 3705 | 1234 | 114 | 6.9e-08 |

Description sp:[LN:YY02_METJA] [AC:Q60301] [GN:MJECS02] [OR:Methanococcus jannaschii]
[DE:HYPOTHETICAL PROTEIN MJECS02] [SP:Q60301] [DB:swissprot] >sp:[LN:B64516]
[AC:B64516] [PN:hypothetical protein MJECS02] [OR:Methanococcus jannaschii]
[DB:pir2] [MP:ECSREV4814-1269] >gp:[GI:g1522636] [LN:MII1CG] [AC:L77119] [PN:M.
jannaschii predicted coding region MJECS02] [GN:MJECS02] [OR:Methanococcus
jannaschii] [DB:genpept-bct2] [DE:Methanococcus jannaschii small
extra-chromosomal element, completesequence.] [NT:identified by GeneMark;
putative] [LE:1269] [RE:4814] [DI:complement]

| ORF Name | NT ID | AA ID | NT/LN | AA/LN | Score | P-value |
|---|---|---|---|---|---|---|
| 194758_f2_488 | 1571 | 8742 | 672 | 223 | 941 | 1.6e-94 |

Description sp:[LN:SMP_ECOLI] [AC:P18838] [GN:SMP] [OR:Escherichia coli] [DE:SMP PROTEIN
PRECURSOR] [SP:P18838] [DB:swissprot] >sp:[LN:A26227]
[AC:A26227:S56611:B65254:Q00807] [PN:smp protein] [GN:smp] [OR:Escherichia coli]
[DB:pir2] [MP:100 min] >gp:[GI:g436177] [LN:ECOSMP] [AC:M30784] [GN:smp]
[OR:Escherichia coli] [SR:Escherichia coli DNA] [DB:genpept-bct1] [DE:Escherichia
coli smp gene, complete cds.] [NT:ORF] [LE:141] [RE:785] [DI:direct]
>gp:[GI:g537227] [LN:ECOUW93] [AC:U14003] [GN:smp] [OR:Escherichia coli]
[DB:genpept-bct1] [DE:Escherichia coli K-12 chromosomal region from 92.8 to 00.1
minutes.] [LE:314977] [RE:315621] [DI:complement] >gp:[GI:g432633] [LN:ECSMP]
[AC:X03046:M30784] [PN:Smp protein] [GN:smp] [OR:Escherichia coli]
[DB:genpept-bct1] [DE:E.coli phosphoserine phosphatase (serB) and smp protein
genes,complete cds., and ORF, 5' end.] [SP:P18838] [LE:1135] [RE:1779]
[DI:direct] >gp:[GI:g1790847] [LN:AE000508] [AC:AE000508:U00096] [PN:orf,
hypothetical protein] [GN:smp] [FN:orf; Unknown] [OR:Escherichia coli]
[DB:genpept-bct2] [DE:Escherichia coli K-12 MG1655 section 398 of 400 of the
completegenome.] [NT:f214; 100 pct identical amino acid sequence and] [LE:14793]
[RE:15437] [DI:complement]

| ORF Name | NT ID | AA ID | NT/LN | AA/LN | Score | P-value |
|---|---|---|---|---|---|---|
| 19616512_f2_837 | 1572 | 8743 | 699 | 232 | 1059 | 5.0e-107 |

Description sp:[LN:YTFE_ECOLI] [AC:P39313] [GN:YTFE] [OR:Escherichia coli] [DE:HYPOTHETICAL
24.9 KD PROTEIN IN RPLI-CPDB INTERGENIC REGION (F220)] [SP:P39313] [DB:swissprot]
>sp:[LN:S56434] [AC:S56434:D65232] [PN:hypothetical protein f220:hypothetical
protein b4209] [OR:Escherichia coli] [DB:pir2] >gp:[GI:g537050] [LN:ECOUW93]
[AC:U14003] [OR:Escherichia coli] [DB:genpept-bct1] [DE:Escherichia coli K-12
chromosomal region from 92.8 to 00.1 minutes.] [NT:ORF_f220] [LE:122153]
[RE:122815] [DI:complement] >gp:[GI:g1790654] [LN:AE000492] [AC:AE000492:U00096]
[PN:orf, hypothetical protein] [GN:ytfE] [FN:orf; Unknown] [OR:Escherichia coli]
[DB:genpept-bct2] [DE:Escherichia coli K-12 MG1655 section 382 of 400 of the
completegenome.] [NT:f220] [LE:3893] [RE:4555] [DI:complement]

| ORF Name | NT ID | AA ID | NT/LN | AA/LN | Score | P-value |
|---|---|---|---|---|---|---|
| 19665955_f3_1080 | 1573 | 8744 | 1125 | 374 | 1364 | 2.4e-139 |

Description sp:[LN:E64857] [AC:E64857:D41966] [PN:ycfD protein] [GN:ycfD] [OR:Escherichia
coli] [DB:pir2] >gp:[GI:g1787373] [LN:AE000213] [AC:AE000213:U00096] [PN:orf,
hypothetical protein] [GN:ycfD] [FN:orf; Unknown] [OR:Escherichia coli]
[DB:genpept-bct2] [DE:Escherichia coli K-12 MG1655 section 103 of 400 of the
completegenome.] [NT:f376; 100 pct identical to fragment YCFD_ECOLI] [LE:1430]
[RE:2560] [DI:complement]

| ORF Name | NT ID | AA ID | NT LN | AA LN | Score | P-value |
|---|---|---|---|---|---|---|
| 1992001_c3_2466 | 1574 | 8745 | 921 | 306 | 859 | 7.8e-86 |

Description sp:[LN:CRED_ECOLI] [AC:P08369] [GN:CRED:CET] [OR:Escherichia coli] [DE:INNER
MEMBRANE PROTEIN CRED] [SP:P08369] [DB:swissprot] >sp:[LN:BVECCT]
[AC:D25038:S03765:A92515:S56624:G65255:B22277] [PN:inner membrane protein
creD:creD protein] [GN:creD:cet] [CL:cet protein] [OR:Escherichia coli] [DB:pir1]
[MP:100 min] >gp:[GI:g41104] [LN:ECCET] [AC:Y00538] [PN:Cet protein (AA 1-450)]
[OR:Escherichia coli] [DB:genpept-bct1] [DE:E. coli cet gene and phoM gene
3'-terminal region.] [SP:P08369] [LE:344] [RE:1696] [DI:direct] >gp:[GI:g147252]
[LN:ECOPHOM] [AC:M13608] [OR:Escherichia coli] [SR:Escherichia coli (strain
KLF125/KL181) DNA] [DB:genpept-bct1] [DE:E.coli (clone pTHR34) phoM operon,
containing phoM gene (positveregulation for pho regulon) and three unidentified
genes.] [NT:ORF4] [LE:3237] [RE:4589] [DI:direct] >gp:[GI:g537240] [LN:ECOUW93]
[AC:U14003] [GN:creD] [OR:Escherichia coli] [DB:genpept-bct1] [DE:Escherichia
coli K-12 chromosomal region from 92.8 to 00.1 minutes.] [NT:alternate gene name
cet; CG Site No. 929] [LE:329011] [RE:330363] [DI:direct] >gp:[GI:g1790862]
[LN:AE000510] [AC:AE000510:U00096] [PN:tolerance to colicin E2] [GN:creD]
[FN:putative membrane; Colicin-related functions] [OR:Escherichia coli]
[DB:genpept-bct2] [DE:Escherichia coli K-12 MG1655 section 400 of 400 of the
completegenome.] [NT:o450; 100 pct identical to CRED_ECOLI SW: P08369;] [LE:2835]
[RE:4187] [DI:direct]

| ORF Name | NT ID | AA ID | NT LN | AA LN | Score | P-value |
|---|---|---|---|---|---|---|
| 20057675_f3_1139 | 1575 | 8746 | 675 | 224 | | |

Description

NO-HIT

| ORF Name | NT ID | AA ID | NT LN | AA LN | Score | P-value |
|---|---|---|---|---|---|---|
| 20098168_f3_1280 | 1576 | 8747 | 345 | 114 | 377 | 9.3e-35 |

Description sp:[LN:YJFO_ECOLI] [AC:P39297] [GN:YJFO] [OR:Escherichia coli] [DE:HYPOTHETICAL
16.0 KD PROTEIN IN AIDB-SGAT INTERGENIC REGION] [SP:P39297] [DB:swissprot]
>sp:[LN:S56414] [AC:S56414:H65229] [PN:hypothetical 16K protein (aidB-rpsF
intergenic region):hypothetical protein f142] [GN:yjfO] [OR:Escherichia coli]
[DB:pir2] >gp:[GI:g537030] [LN:ECOUW93] [AC:U14003] [OR:Escherichia coli]
[DB:genpept-bct1] [DE:Escherichia coli K-12 chromosomal region from 92.8 to 00.1
minutes.] [NT:ORF_f142] [LE:107273] [RE:107701] [DI:complement] >gp:[GI:g1790633]
[LN:AE000491] [AC:AE000491:U00096] [PN:orf, hypothetical protein] [GN:yjfO]
[FN:orf; Unknown] [OR:Escherichia coli] [DB:genpept-bct2] [DE:Escherichia coli
K-12 MG1655 section 381 of 400 of the completegenome.] [NT:f142; 100 pct
identical amino acid sequence and] [LE:107] [RE:535] [DI:complement]

| ORF Name | NT ID | AA ID | NT/LN | AA/LN | Score | P-value |
|---|---|---|---|---|---|---|
| 20197208_c3_2437 | 1577 | 8748 | 228 | 75 | 59 | 0.024 |

Description sp:[LN:CVPA_ECOLI] [AC:P08550] [GN:CVPA:DEDE] [OR:Escherichia coli] [DE:PROTEIN)]
[SP:P08550] [DB:swissprot] >sp:[LN:XMECED]
[AC:A29803:A92491:A44760:G65003:A23892:F29803] [PN:colicin V production protein]
[GN:cvpA:dedE] [CL:dedE protein] [OR:Escherichia coli] [DB:pirl] [MP:50 min]
>gp:[GI:d1016887:g1799694] [LN:D90862] [AC:D90862:AB001340] [PN:dedE protein]
[GN:cvpA] [OR:Escherichia coli] [SR:Escherichia coli (strain:K12) DNA,
clone_lib:Kohara lambda minise] [DB:genpept-bct1] [DE:E.coli genomic DNA, Kohara
clone #406(52.2-52.5 min.).] [NT:similar to [PIR Accession Number A29803]]
[LE:13852] [RE:14340] [DI:complement] >gp:[GI:d1016895:g1799703] [LN:D90863]
[AC:D90863:AB001340] [PN:dedE protein] [GN:cvpA] [OR:Escherichia coli]
[SR:Escherichia coli (strain:K12) DNA, clone_lib:Kohara lambda minise]
[DB:genpept-bct1] [DE:E.coli genomic DNA, Kohara clone #407(52.4-52.8 min.).]
[NT:similar to [PIR Accession Number A29803]] [LE:917] [RE:1405] [DI:complement]
>gp:[GI:g146367] [LN:ECOHISPUR1] [AC:M68934:J02800] [OR:Escherichia coli]
[SR:E.coli (strain K12) DNA, clone psi210] [DB:genpept-bct1] [DE:E.coli histidine
(hisT, 3' end), dedA, dedB (acetyl-CoA carboxylasebeta subunit) complete cds,
dedC, dedD, dedE (complete cds.), andamidophosphoribosyltransferase (purF),
segment 1.] [NT:dedE protein] [LE:4115] [RE:4603] [DI:direct] >gp:[GI:g147415]
[LN:ECOPURF] [AC:J01666:M10318] [OR:Escherichia coli] [SR:Escherichia coli DNA,
clones pSB5 [1] and pSB2 [1],[2]] [DB:genpept-bct1] [DE:E.coli purF operon: gene
coding for protein 17.9 of unknownfunction and purF gene coding for
amidophosphoribosyltransferase.] [NT:protein 17.9] [LE:353] [RE:841] [DI:direct]
>gp:[GI:g1788652] [LN:AE000320] [AC:AE000320:U00096] [PN:membrane protein
required for colicin V] [GN:cvpA] [FN:membrane; Colicin-related functions]
[OR:Escherichia coli] [DB:genpept-bct2] [DE:Escherichia coli K-12 MG1655 section
210 of 400 of the completegenome.] [NT:f162; 100 pct identical to CVPA_ECOLI SW:
P08550;] [LE:4344] [RE:4832] [DI:complement]

| ORF Name | NT ID | AA ID | NT/LN | AA/LN | Score | P-value |
|---|---|---|---|---|---|---|
| 2035025_f3_888 | 1578 | 8749 | 1017 | 338 | 1599 | 3.0e-164 |

Description sp:[LN:LTRA_KLEPN] [AC:P52689] [GN:LTRA] [OR:Klebsiella pneumoniae] [DE:PROBABLE
TRANSCRIPTIONAL REGULATOR LTRA] [SP:P52689] [DB:swissprot] >sp:[LN:S70535]
[AC:S70535] [PN:probable transcription regulator ltrA] [GN:ltrA] [CL:conserved
hypothetical protein HI1364] [OR:Klebsiella pneumoniae] [DB:pir2]
>gp:[GI:g924993] [LN:KPU31464] [AC:U31464] [PN:transcriptional regulator LtrA]
[GN:ltrA] [OR:Klebsiella pneumoniae] [DB:genpept-bct2] [DE:Klebsiella pneumoniae
citrate fermentation regulatory genes: sensorkinase CitA (citA), response
regulator CitB (citB) andtranscriptional regulator LtrA (ltrA) genes, complete
cds.] [NT:target genes regulated by LtrA are unknown;] [LE:3225] [RE:4154]
[DI:direct]

| ORF_Name | NT ID | AA ID | $\frac{NT}{LN}$ | $\frac{AA}{LN}$ | Score | P-value |
|---|---|---|---|---|---|---|
| 2057006_f1_316 | 1579 | 8750 | 2181 | 726 | 3568 | 0.0 |

Description sp:[LN:A47331] [AC:A47331:S56464:A65236] [PN:ribonucleoside-triphosphate reductase, oxygen-sensitive,:anaerobic ribonucleotide reductase] [GN:nrdD] [CL:Escherichia coli oxygen-sensitive ribonucleoside-triphosphate reductase:oxygen-sensitive ribonucleoside-triphosphate reductase carboxyl-terminal homology:oxygen-sensitive ribonucleoside-triphosphate reductase middle homology:rubredoxin homology] [OR:Escherichia coli] [EC:1.17.4.-] [DB:pir1] [MP:96 min] >gp:[GI:g537080] [LN:ECOUW93] [AC:U14003] [PN:ribonucleoside triphosphate reductase] [GN:nrdD] [OR:Escherichia coli] [DB:genpept-bct1] [DE:Escherichia coli K-12 chromosomal region from 92.8 to 00.1 minutes.] [LE:151351] [RE:153489] [DI:complement] >gp:[GI:g1790686] [LN:AE000495] [AC:AE000495:U00096] [PN:anaerobic ribonucleoside-triphosphate reductase] [GN:nrdD] [FN:enzyme; 2'-Deoxyribonucleotide metabolism] [OR:Escherichia coli] [DB:genpept-bct2] [EC:1.17.4.2] [DE:Escherichia coli K-12 MG1655 section 385 of 400 of the completegenome.] [NT:f712; 99 pct identical amino acid sequence and] [LE:1164] [RE:3302] [DI:complement]

| ORF_Name | NT ID | AA ID | $\frac{NT}{LN}$ | $\frac{AA}{LN}$ | Score | P-value |
|---|---|---|---|---|---|---|
| 20833427_c3_2158 | 1580 | 8751 | 600 | 199 | 96 | 0.0069 |

Description sp:[LN:C69843] [AC:C69843] [PN:hypothetical protein yjbC] [GN:yjbC] [OR:Bacillus subtilis] [DB:pir2] >gp:[GI:e1183169:g2633503] [LN:BSUB0007] [AC:Z99110:AL009126] [GN:yjbC] [FN:unknown] [OR:Bacillus subtilis] [DB:genpept-bct1] [DE:Bacillus subtilis complete genome (section 7 of 21): from 1194391to 1411140.] [LE:32020] [RE:32598] [DI:direct]

| ORF_Name | NT ID | AA ID | $\frac{NT}{LN}$ | $\frac{AA}{LN}$ | Score | P-value |
|---|---|---|---|---|---|---|
| 21600905_c2_1765 | 1581 | 8752 | 684 | 227 | 99 | 0.0050 |

Description sp:[LN:JQ0138] [AC:JQ0138] [PN:hypothetical 18.2K protein] [OR:Pseudomonas aeruginosa] [DB:pir2]

| ORF_Name | NT ID | AA ID | $\frac{NT}{LN}$ | $\frac{AA}{LN}$ | Score | P-value |
|---|---|---|---|---|---|---|
| 21614132_c2_1865 | 1582 | 8753 | 279 | 92 | | |

Description

NO-HIT

| ORF Name | NT ID | AA ID | NT LN | AA LN | Score | P-value |
|---|---|---|---|---|---|---|
| 21647967_f2_530 | 1583 | 8754 | 579 | 192 | 483 | 5.5e-46 |

Description sp:[LN:RMEC14] [AC:S56590:E65251:A31983] [PN:primosomal operon 14K protein:P14 protein] [GN:yjjB] [CL:primosomal operon 14K protein] [OR:Escherichia coli] [DB:pir1] [MP:99 min] >gp:[GI:g537206] [LN:ECOUW93] [AC:U14003] [PN:P14 protein] [GN:yjjB] [OR:Escherichia coli] [DB:genpept-bct1] [DE:Escherichia coli K-12 chromosomal region from 92.8 to 00.1 minutes.] [LE:292456] [RE:292782] [DI:complement] >gp:[GI:g1790825] [LN:AE000507] [AC:AE000507:U00096] [PN:orf, hypothetical protein] [GN:yjjB] [FN:orf; Unknown] [OR:Escherichia coli] [DB:genpept-bct2] [DE:Escherichia coli K-12 MG1655 section 397 of 400 of the completegenome.] [NT:f108] [LE:4573] [RE:4899] [DI:complement]

| ORF Name | NT ID | AA ID | NT LN | AA LN | Score | P-value |
|---|---|---|---|---|---|---|
| 22057041_f2_643 | 1584 | 8755 | 528 | 175 | | |

Description

NO-HIT

| ORF Name | NT ID | AA ID | NT LN | AA LN | Score | P-value |
|---|---|---|---|---|---|---|
| 22146891_c3_2204 | 1585 | 8756 | 1161 | 386 | 1614 | 7.7e-166 |

Description sp:[LN:YJGP_ECOLI] [AC:P39340] [GN:YJGP] [OR:Escherichia coli] [DE:HYPOTHETICAL 40.4 KD PROTEIN IN PEPA-GNTV INTERGENIC REGION (O366)] [SP:P39340] [DB:swissprot] >sp:[LN:S56487] [AC:S56487:H65238] [PN:hypothetical 40.4K protein (pepa-gntv intergenic region):hypothetical protein o366] [GN:yjgP] [OR:Escherichia coli] [DB:pir2] >gp:[GI:g537103] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_o366] [LE:177053] [RE:178153] [DI:direct] >gp:[GI:g1790712] [LN:AE000497] [AC:AE000497:U00096] [PN:orf, hypothetical protein] [GN:yjgP] [FN:orf; Unknown] [OR:Escherichia coli] [DB:genpept-bct2] [DE:Escherichia coli K-12 MG1655 section 387 of 400 of the completegenome.] [NT:o366; 100 pct identical amino acid sequence and] [LE:196] [RE:1296] [DI:direct]

| ORF Name | NT ID | AA ID | NT LN | AA LN | Score | P-value |
|---|---|---|---|---|---|---|
| 22297156_f2_611 | 1586 | 8757 | 354 | 117 | | |

Description

NO-HIT

| ORF_Name | NT_ID | AA_ID | NT LN | AA LN | Score | P-value |
|---|---|---|---|---|---|---|
| 22307956_f3_1124 | 1587 | 8758 | 222 | 73 | 106 | 4.9e-06 |

Description sp:[LN:G42465] [AC:G42465] [PN:hypothetical protein 88] [CL:Escherichia coli prophage cp4-57 regulatory protein alpA] [OR:phage phi-R73] [DB:pir2]

| ORF_Name | NT_ID | AA_ID | NT LN | AA LN | Score | P-value |
|---|---|---|---|---|---|---|
| 22345267_f3_1025 | 1588 | 8759 | 537 | 178 | 743 | 1.5e-73 |

Description gp:[GI:g974147] [LN:KPNHPAH] [AC:L41068] [PN:coupling protein] [OR:Klebsiella pneumoniae] [DB:genpept-bct2] [DE:Klebsiella pneumoniae 4-hydroxyphenylacetate-3-hydroxylase (hpaA)and coupling protein genes, complete cds.] [NT:also known as helper protein] [LE:1581] [RE:2093] [DI:direct]

| ORF_Name | NT_ID | AA_ID | NT LN | AA LN | Score | P-value |
|---|---|---|---|---|---|---|
| 22384713_f3_1188 | 1589 | 8760 | 465 | 154 | 742 | 2.0e-73 |

Description sp:[LN:DTEBCT] [AC:S00050] [PN:aspartate carbamoyltransferase, regulatory chain] [GN:pyrI] [CL:aspartate carbamoyltransferase regulatory chain] [OR:Salmonella typhimurium] [EC:2.1.3.2] [DB:pir1] >gp:[GI:g47864] [LN:STPYRBIG] [AC:X05641] [OR:Salmonella typhimurium] [DB:genpept-bct1] [DE:S.typhimurium LT2 pyrBI operon.] [NT:pyrI (AA 1-153)] [SP:P08421] [LE:1321] [RE:1782] [DI:direct]

| ORF_Name | NT_ID | AA_ID | NT LN | AA LN | Score | P-value |
|---|---|---|---|---|---|---|
| 22519691_f1_94 | 1590 | 8761 | 780 | 259 | 1174 | 3.3e-119 |

Description gp:[GI:g145791] [LN:ECODNATC] [AC:J04030:J02785:M13005] [OR:Escherichia coli] [SR:E.coli (strain K12 C600) DNA [1]; clone pJK137 [2]] [DB:genpept-bct1] [DE:E.coli dna operon encoding normal and stable DNA replicationproteins P-14, dnaT, dnaC and P-18, complete cds.] [NT:dnaC protein] [LE:1065] [RE:1802] [DI:direct] >gp:[GI:g537204] [LN:ECOUW93] [AC:U14003] [GN:dnaC] [FN:DNA biosynthesis; initiation and chain] [OR:Escherichia coli] [DB:genpept-bct1] [DE:Escherichia coli K-12 chromosomal region from 92.8 to 00.1 minutes.] [NT:CG Site No. 849; alternate gene name dnaD] [LE:291070] [RE:291807] [DI:complement] >gp:[GI:g1790823] [LN:AE000507] [AC:AE000507:U00096] [PN:chromosome replication; initiation and chain] [GN:dnaC] [FN:putative enzyme; DNA - replication, repair,] [OR:Escherichia coli] [DB:genpept-bct2] [DE:Escherichia coli K-12 MG1655 section 397 of 400 of the completegenome.] [NT:f245; 99 pct identical amino acid sequence and] [LE:3187] [RE:3924] [DI:complement]

| ORF Name | NT ID | AA ID | NT LN | AA LN | Score | P-value |
|---|---|---|---|---|---|---|
| 22558193_f3_932 | 1591 | 8762 | 885 | 294 | 1272 | 1.3e-129 |

Description sp:[LN:ROB_ECOLI] [AC:P27292] [GN:ROB] [OR:Escherichia coli] [DE:RIGHT ORIGIN-BINDING PROTEIN] [SP:P27292] [DB:swissprot] >sp:[LN:JU0158] [AC:JU0158:JU0159:S56620:C65255:S27571] [PN:right oriC-binding protein:rob protein] [GN:rob] [OR:Escherichia coli] [DB:pir2] [MP:99.8 min] >gp:[GI:g147692] [LN:ECOROBPHOM] [AC:M97495:M94042] [PN:right origin-binding protein] [GN:rob] [OR:Escherichia coli] [SR:Escherichia coli (sub_strain W3110, strain K-12) (library: EMBL] [DB:genpept-bct1] [DE:E.coli right origin-binding protein (rob) gene, complete cds, andpositive regulatory protein for pho operon (phoM) gene, 5' end.] [LE:295] [RE:1164] [DI:direct] >gp:[GI:g537236] [LN:ECOUW93] [AC:U14003] [GN:rob] [FN:right origin-binding protein] [OR:Escherichia coli] [DB:genpept-bct1] [DE:Escherichia coli K-12 chromosomal region from 92.8 to 00.1 minutes.] [LE:325274] [RE:326143] [DI:complement] >gp:[GI:g1790857] [LN:AE000509] [AC:AE000509:U00096] [PN:right origin-binding protein] [GN:rob] [FN:factor; DNA - replication, repair,] [OR:Escherichia coli] [DB:genpept-bct2] [DE:Escherichia coli K-12 MG1655 section 399 of 400 of the completegenome.] [NT:f289; 100 pct identical to ROB_ECOLI SW: P27292] [LE:9629] [RE:10498] [DI:complement]

| ORF Name | NT ID | AA ID | NT LN | AA LN | Score | P-value |
|---|---|---|---|---|---|---|
| 22687918_f2_698 | 1592 | 8763 | 2082 | 693 | 165 | 1.3e-08 |

Description sp:[LN:LON_BORBU] [AC:Q59185] [GN:LON:BB0253] [OR:Borrelia burgdorferi] [SR:,Lyme disease spirochete] [EC:3.4.21.53] [DE:ATP-DEPENDENT PROTEASE LA,] [SP:Q59185] [DB:swissprot] >sp:[LN:E70131] [AC:E70131] [PN:endopeptidase La, 1:ATP-dependent proteinase lon-1:ATP-dependent serine proteinase La:ATP-dependent proteinase lon-1:ATP-dependent serine proteinase La] [CL:ATP-dependent serine proteinase La] [OR:Borrelia burgdorferi] [SR:, Lyme disease spirochete] [EC:3.4.21.53] [DB:pir1] >gp:[GI:g2688145] [LN:AE001135] [AC:AE001135:AE000783] [PN:ATP-dependent protease LA (lon-1)] [GN:BB0253] [OR:Borrelia burgdorferi] [SR:Lyme disease spirochete] [DB:genpept-bct2] [DE:Borrelia burgdorferi (section 21 of 70) of the complete genome.] [NT:similar to GP:1255893 percent identity: 100.00;] [LE:8987] [RE:11407] [DI:complement] >gp:[GI:g1255893] [LN:BORLONAA] [AC:L77216] [PN:Lon protease] [GN:lon] [OR:Borrelia burgdorferi] [SR:Lyme disease spirochete] [DB:genpept-bct2] [DE:Borrelia burgdorferi strain B31 Lon protease (lon) gene, completecds.] [LE:264] [RE:2684] [DI:direct]

| ORF Name | NT ID | AA ID | NT LN | AA LN | Score | P-value |
|---|---|---|---|---|---|---|
| 22737883_c1_1422 | 1593 | 8764 | 243 | 80 | | |

Description

NO-HIT

| ORF_Name | NT_ID | AA_ID | NT LN | AA LN | Score | P-value |
|---|---|---|---|---|---|---|
| 22754636_f3_905 | 1594 | 8765 | 495 | 164 | 522 | 4.0e-50 |

Description sp:[LN:YAAI_ECOLI] [AC:P28696] [GN:YAAI] [OR:Escherichia coli] [DE:(ORF3)]
[SP:P28696] [DB:swissprot] >sp:[LN:C56688] [AC:C56688:E64721:S28461] [PN:probable
membrane protein yaaI] [GN:yaaI] [CL:Escherichia coli probable membrane protein
yaaI] [OR:Escherichia coli] [DB:pir2] >gp:[GI:g41758] [LN:ECHTGA] [AC:X67700]
[OR:Escherichia coli] [DB:genpept-bct1] [DE:E.coli dnaK and htgA genes.]
[NT:ORF3] [SP:P28696] [LE:2472] [RE:2876] [DI:complement] >gp:[GI:g1786195]
[LN:AE000112] [AC:AE000112:U00096] [PN:orf, hypothetical protein] [GN:yaaI]
[FN:orf; Unknown] [OR:Escherichia coli] [DB:genpept-bct2] [DE:Escherichia coli
K-12 MG1655 section 2 of 400 of the completegenome.] [NT:f134; 100 pct identical
to YAAI_ECOLI SW: P28696] [LE:844] [RE:1248] [DI:complement]

| ORF_Name | NT_ID | AA_ID | NT LN | AA LN | Score | P-value |
|---|---|---|---|---|---|---|
| 22756668_f1_294 | 1595 | 8766 | 2904 | 967 | 4864 | 0.0 |

Description sp:[LN:SYV_ECOLI] [AC:P07118:P78142] [GN:VALS] [OR:Escherichia coli] [EC:6.1.1.9]
[DE:VALYL-TRNA SYNTHETASE, (VALINE--TRNA LIGASE) (VALRS)] [SP:P07118:P78142]
[DB:swissprot] >sp:[LN:SYECVT] [AC:E65238:A27302:B27302:A28522:S56484]
[PN:valine--tRNA ligase,:valyl-tRNA synthetase] [GN:valS] [CL:valine--tRNA
ligase] [OR:Escherichia coli] [EC:6.1.1.9] [DB:pir1] [MP:97 min]
>gp:[GI:g1790708] [LN:AE000496] [AC:AE000496:U00096] [PN:valine tRNA synthetase]
[GN:valS] [FN:enzyme; Aminoacyl tRNA synthetases, tRNA] [OR:Escherichia coli]
[DB:genpept-bct2] [EC:6.1.1.9] [DE:Escherichia coli K-12 MG1655 section 386 of
400 of the completegenome.] [NT:f951; 99 pct identical amino acid sequence and]
[LE:6831] [RE:9686] [DI:complement]

| ORF_Name | NT_ID | AA_ID | NT LN | AA LN | Score | P-value |
|---|---|---|---|---|---|---|
| 22900957_f2_768 | 1596 | 8767 | 261 | 86 | | |

Description

NO-HIT

| ORF_Name | NT_ID | AA_ID | NT LN | AA LN | Score | P-value |
|---|---|---|---|---|---|---|
| 23438160_c3_2277 | 1597 | 8768 | 198 | 65 | | |

Description

NO-HIT

| ORF Name | NT ID | AA ID | NT LN | AA LN | Score | P-value |
|---|---|---|---|---|---|---|
| 2344203_f1_241 | 1598 | 8769 | 525 | 174 | 198 | 1.6e-15 |

Description gp:[GI:g5006989] [LN:AF146532] [AC:AF146532] [PN:glycosyltransferase]
[OR:Klebsiella pneumoniae] [DB:genpept-bct2] [DE:Klebsiella pneumoniae waa gene cluster.] [NT:similar to putative protein encoded by yibD from E.] [LE:10867]
[RE:11856] [DI:direct]

| ORF Name | NT ID | AA ID | NT LN | AA LN | Score | P-value |
|---|---|---|---|---|---|---|
| 23595312_f1_220 | 1599 | 8770 | 1734 | 577 | 1385 | 1.4e-141 |

Description gp:[GI:g2773302] [LN:AF040720] [AC:AF040720] [PN:xylosidase/arabinosidase]
[GN:Xsa] [OR:Selenomonas ruminantium] [DB:genpept-bct2] [DE:Selenomonas ruminantium xylosidase/arabinosidase (Xsa) gene,complete cds.] [LE:110] [RE:1726]
[DI:direct]

| ORF Name | NT ID | AA ID | NT LN | AA LN | Score | P-value |
|---|---|---|---|---|---|---|
| 23632260_c2_2090 | 1600 | 8771 | 1161 | 386 | 1719 | 5.8e-177 |

Description sp:[LN:CARA_ECOLI] [AC:P00907] [GN:CARA:PYRA] [OR:Escherichia coli] [EC:6.3.5.5]
[DE:PHOSPHATE SYNTHETASE GLUTAMINE CHAIN)] [SP:P00907] [DB:swissprot]
>sp:[LN:SYECCS] [AC:A01128:S40555:H64723] [PN:carbamoyl-phosphate synthase (glutamine-hydrolyzing), small chain:carbamoyl-phosphate synthetase glutamine chain] [GN:carA:pyrA] [CL:carbamoyl-phosphate synthase (glutamine-hydrolyzing) small chain:carbamoyl-phosphate synthase (glutamine-hydrolyzing) small chain homology:trpG homology] [OR:Escherichia coli] [EC:6.3.5.5] [DB:pir1] [MP:1 min]
>gp:[GI:d1001782:g285764] [LN:ECO110K]
[AC:D10483:J01597:J01683:J01706:K01298:K01990:M10420:M10611:M12544]
[PN:carbamoyl-phosphate synthase small chain] [GN:carA] [OR:Escherichia coli]
[SR:Escherichia coli (strain:K-12) DNA] [DB:genpept-bct1] [EC:6.3.5.5] [DE:E.coli K12 genome, 0-2.4min. region.] [LE:29305] [RE:30453] [DI:direct] >gp:[GI:g551790]
[LN:ECOCARAB] [AC:J01597] [GN:carA] [OR:Escherichia coli] [SR:Escherichia coli K12 DNA, clone pMC40 [2],[3]] [DB:genpept-bct1] [DE:E.coli carbamoyl-phosphate synthetase subunits A and B (carAB)genes, complete cds.] [NT:carbamoyl-phosphate synthetase subunit A (ttg start] [LE:474] [RE:1622] [DI:direct] >gp:[GI:g1786215]
[LN:AE000113] [AC:AE000113:U00096] [PN:carbamoyl-phosphate synthetase, glutamine]
[GN:carA] [FN:enzyme; Pyrimidine ribonucleotide biosynthesis] [OR:Escherichia coli] [DB:genpept-bct2] [EC:6.3.5.5] [DE:Escherichia coli K-12 MG1655 section 3 of 400 of the completegenome.] [NT:o382; 100 pct identical to CARA_ECOLI SW:]
[LE:8992] [RE:10140] [DI:direct]

| ORF_Name | NT ID | AA ID | NT/LN | AA/LN | Score | P-value |
|---|---|---|---|---|---|---|
| 23634658_c1_1599 | 1601 | 8772 | 1491 | 496 | 360 | 1.1e-32 |

Description sp:[LN:G64526] [AC:G64526] [PN:sodium/proline symporter:proline permease]
[GN:putP] [CL:proline carrier protein] [OR:Helicobacter pylori] [DB:pir2]
>gp:[GI:g2313133] [LN:AE000527] [AC:AE000527:AE000511] [PN:proline permease
(putP)] [GN:HP0055] [OR:Helicobacter pylori 26695] [DB:genpept-bct2]
[DE:Helicobacter pylori 26695 section 5 of 134 of the complete genome.]
[NT:similar to GP:1787251 percent identity: 51.35;] [LE:5070] [RE:6560]
[DI:complement]

| ORF_Name | NT ID | AA ID | NT/LN | AA/LN | Score | P-value |
|---|---|---|---|---|---|---|
| 23642703_c1_1659 | 1602 | 8773 | 519 | 172 | 672 | 5.1e-66 |

Description sp:[LN:CREA_ECOLI] [AC:P08367] [GN:CREA] [OR:Escherichia coli] [DE:CREA PROTEIN]
[SP:P08367] [DB:swissprot] >sp:[LN:QQECF1]
[AC:A25038:A46614:S56621:D65255:S27570] [PN:creA protein] [GN:creA] [CL:creA
protein] [OR:Escherichia coli] [DB:pir1] [MP:100 min] >gp:[GI:g147249]
[LN:ECOPHOM] [AC:M13608] [OR:Escherichia coli] [SR:Escherichia coli (strain
KLF125/KL181) DNA] [DB:genpept-bct1] [DE:E.coli (clone pTHR34) phoM operon,
containing phoM gene (positveregulation for pho regulon) and three unidentified
genes.] [NT:17 kd protein] [LE:580] [RE:1053] [DI:direct] >gp:[GI:g537237]
[LN:ECOUW93] [AC:U14003] [GN:creA] [OR:Escherichia coli] [DB:genpept-bct1]
[DE:Escherichia coli K-12 chromosomal region from 92.8 to 00.1 minutes.]
[LE:326354] [RE:326827] [DI:direct] >gp:[GI:g1790859] [LN:AE000510]
[AC:AE000510:U00096] [PN:orf, hypothetical protein] [GN:creA] [FN:orf; Unknown]
[OR:Escherichia coli] [DB:genpept-bct2] [DE:Escherichia coli K-12 MG1655 section
400 of 400 of the completegenome.] [NT:o157; 100 pct identical amino acid
sequence and] [LE:178] [RE:651] [DI:direct]

| ORF_Name | NT ID | AA ID | NT/LN | AA/LN | Score | P-value |
|---|---|---|---|---|---|---|
| 23676416_c1_1337 | 1603 | 8774 | 771 | 256 | 1149 | 1.5e-116 |

Description sp:[LN:S56439] [AC:S56439:A65233:A49759:A41962] [PN:ammonium transport system
structural protein] [GN:cysQ:amtA] [CL:Aquifex aeolicus cysQ protein]
[OR:Escherichia coli] [DB:pir1] >gp:[GI:g537055] [LN:ECOUW93] [AC:U14003]
[GN:cysQ] [FN:ammonium transport protein] [OR:Escherichia coli] [DB:genpept-bct1]
[DE:Escherichia coli K-12 chromosomal region from 92.8 to 00.1 minutes.]
[NT:alternate gene name amtA] [LE:127587] [RE:128327] [DI:direct]
>gp:[GI:g1790659] [LN:AE000492] [AC:AE000492:U00096] [PN:affects pool of]
[GN:cysQ] [FN:phenotype; Central intermediary metabolism:] [OR:Escherichia coli]
[DB:genpept-bct2] [DE:Escherichia coli K-12 MG1655 section 382 of 400 of the
completegenome.] [NT:o246; 99 pct identical amino acid sequence and] [LE:9327]
[RE:10067] [DI:direct]

| ORF Name | NT ID | AA ID | NT LN | AA LN | Score | P-value |
|---|---|---|---|---|---|---|
| 23679650_c2_1772 | 1604 | 8775 | 294 | 97 | 223 | 1.9e-18 |

Description sp:[LN:RELB_ECOLI] [AC:P07007] [GN:RELB] [OR:Escherichia coli] [DE:RELB PROTEIN]
[SP:P07007] [DB:swissprot] >sp:[LN:BVECRB] [AC:A22830:G64911] [PN:relB protein]
[GN:relB] [CL:relB protein] [OR:Escherichia coli] [DB:pir1] [MP:34 min]
>gp:[GI:d1015984:g1742559] [LN:D90798] [AC:D90798:AB001340] [PN:RelB protein]
[GN:relB] [OR:Escherichia coli] [SR:Escherichia coli (strain:K12) DNA,
clone_lib:Kohara lambda minise] [DB:genpept-bct1] [DE:E.coli genomic DNA, Kohara
clone #307(35.1-35.5 min.).] [NT:ORF_ID:o308#20; similar to [PIR Accession
Number] [LE:17627] [RE:17866] [DI:complement] >gp:[GI:d1015994:g1742570]
[LN:D90799] [AC:D90799:AB001340] [PN:RelB protein] [GN:relB] [OR:Escherichia
coli] [SR:Escherichia coli (strain:K12) DNA, clone_lib:Kohara lambda minise]
[DB:genpept-bct1] [DE:E.coli genomic DNA, Kohara clone #308(35.3-35.7 min.).]
[NT:ORF_ID:o308#20; similar to [PIR Accession Number] [LE:7600] [RE:7839]
[DI:complement] >gp:[GI:d1016016:g1742593] [LN:D90800] [AC:D90800:AB001340]
[PN:RelB protein] [GN:relB] [OR:Escherichia coli] [SR:Escherichia coli
(strain:K12) DNA, clone_lib:Kohara lambda minise] [DB:genpept-bct1] [DE:E.coli
genomic DNA, Kohara clone #309(35.4-35.7 min.).] [NT:ORF_ID:o308#20; similar to
[PIR Accession Number] [LE:4376] [RE:4615] [DI:complement] >gp:[GI:g42700]
[LN:ECRELB] [AC:X02405] [OR:Escherichia coli] [DB:genpept-bct1] [DE:E. coli relB
gene region.] [NT:relB protein (aa 1-79)] [SP:P07007] [LE:494] [RE:733]
[DI:direct] >gp:[GI:g1787847] [LN:AE000253] [AC:AE000253:U00096] [PN:negative
regulator of translation] [GN:relB] [FN:regulator; Global regulatory functions]
[OR:Escherichia coli] [DB:genpept-bct2] [DE:Escherichia coli K-12 MG1655 section
143 of 400 of the completegenome.] [NT:f79; 100 pct identical to RELB_ECOLI SW:
P07007; CG] [LE:3385] [RE:3624] [DI:complement]

| ORF Name | NT ID | AA ID | NT LN | AA LN | Score | P-value |
|---|---|---|---|---|---|---|
| 23697183_c3_2161 | 1605 | 8776 | 390 | 129 | 441 | 1.5e-41 |

Description sp:[LN:C562_ECOLI] [AC:P00192:P76805] [GN:CYBC] [OR:Escherichia coli] [DE:SOLUBLE
CYTOCHROME B562 PRECURSOR] [SP:P00192:P76805] [DB:swissprot] >sp:[LN:CBEC62]
[AC:S19544:S25107:S56462:A33153:A00195:G65235] [PN:cytochrome b562 precursor]
[GN:cybC] [CL:cytochrome b562] [OR:Escherichia coli] [DB:pir1] >gp:[GI:g41195]
[LN:ECCYBC] [AC:X67290] [PN:cytochrome b562] [GN:cybC] [OR:Escherichia coli]
[DB:genpept-bct1] [DE:E.coli (OP7) cybC gene for cytochrome b562.] [SP:P00192]
[LE:114] [RE:500] [DI:direct] >gp:[GI:g241593] [LN:S74736] [AC:S74736]
[PN:cytochrome b562] [GN:cytochrome b562] [OR:Escherichia coli] [SR:Escherichia
coli B] [DB:genpept-bct1] [DE:cytochrome b562 [Escherichia coli, B, Genomic, 703
nt].] [NT:Method: conceptual translation with partial peptide] [LE:187] [RE:573]
[DI:direct]

| ORF Name | NT ID | AA ID | NT/LN | AA/LN | Score | P-value |
|---|---|---|---|---|---|---|
| 23728437_c2_1704 | 1606 | 8777 | 1302 | 433 | 2163 | 5.2e-224 |

Description sp:[LN:AJECDS] [AC:S56402:A31965:A61592:D65228] [PN:adenylosuccinate synthase,:IMP--aspartate ligase] [GN:purA] [CL:adenylosuccinate synthase] [OR:Escherichia coli] [EC:6.3.4.4] [DB:pir1] [MP:95 min] >gp:[GI:g537018] [LN:ECOUW93] [AC:U14003] [PN:adenylosuccinate synthetase] [GN:purA] [OR:Escherichia coli] [DB:genpept-bct1] [EC:6.3.4.4] [DE:Escherichia coli K-12 chromosomal region from 92.8 to 00.1 minutes.] [NT:CG Site No. 345; alternate gene names adeK, Ad4] [LE:95515] [RE:96813] [DI:direct] >gp:[GI:g1790620] [LN:AE000490] [AC:AE000490:U00096] [PN:adenylosuccinate synthetase] [GN:purA] [FN:enzyme; Purine ribonucleotide biosynthesis] [OR:Escherichia coli] [DB:genpept-bct2] [EC:6.3.4.4] [DE:Escherichia coli K-12 MG1655 section 380 of 400 of the completegenome.] [NT:o432; 100 pct identical to PURA_ECOLI SW: P12283;] [LE:371] [RE:1669] [DI:direct]

| ORF Name | NT ID | AA ID | NT/LN | AA/LN | Score | P-value |
|---|---|---|---|---|---|---|
| 238125_c1_1500 | 1607 | 8778 | 1350 | 449 | 2066 | 9.8e-214 |

Description sp:[LN:XYLA_KLEAE] [AC:P29442] [GN:XYLA] [OR:Klebsiella aerogenes] [EC:5.3.1.5] [DE:XYLOSE ISOMERASE,] [SP:P29442] [DB:swissprot] >sp:[LN:ISKBX] [AC:S25069] [PN:xylose isomerase,] [GN:xylA] [CL:xylose isomerase] [OR:Klebsiella pneumoniae] [EC:5.3.1.5] [DB:pir1] >gp:[GI:g43952] [LN:KPXYLABG] [AC:X61059:S43323] [PN:xylose isomerase] [GN:xylA] [OR:Klebsiella pneumoniae] [DB:genpept-bct1] [EC:5.3.1.5] [DE:K.pneumoniae xylA and xylB genes for xylose isomerase andxylulokinase.] [SP:P29442] [LE:325] [RE:1647] [DI:direct]

| ORF Name | NT ID | AA ID | NT/LN | AA/LN | Score | P-value |
|---|---|---|---|---|---|---|
| 2381692_c3_2121 | 1608 | 8779 | 327 | 108 | 517 | 1.4e-49 |

Description sp:[LN:Q4ECFR] [AC:A30281:PQ0204:S56426:D65231] [PN:primosomal replication protein n:priB protein] [GN:priB] [CL:primosomal protein n] [OR:Escherichia coli] [DB:pir1] [MP:95.5 min] >gp:[GI:g537042] [LN:ECOUW93] [AC:U14003] [GN:priB] [OR:Escherichia coli] [DB:genpept-bct1] [DE:Escherichia coli K-12 chromosomal region from 92.8 to 00.1 minutes.] [LE:116352] [RE:116666] [DI:direct] >gp:[GI:g42846] [LN:ECRPSFRI] [AC:X04022] [OR:Escherichia coli] [DB:genpept-bct1] [DE:E. coli genes rpsF, rpsR and rplI for ribosomal proteins S6, S18,L9.] [NT:unidentified reading frame (aa 1-104)] [SP:P07013] [LE:850] [RE:1164] [DI:direct] >gp:[GI:g1790645] [LN:AE000491] [AC:AE000491:U00096] [PN:primosomal replication protein N] [GN:priB] [FN:factor; DNA - replication, repair,] [OR:Escherichia coli] [DB:genpept-bct2] [DE:Escherichia coli K-12 MG1655 section 381 of 400 of the completegenome.] [NT:o104; 100 pct identical amino acid sequence and] [LE:9186] [RE:9500] [DI:direct]

| ORF_Name | NT ID | AA ID | NT LN | AA LN | Score | P-value |
|---|---|---|---|---|---|---|
| 23945277_f3_1279 | 1609 | 8780 | 1116 | 371 | 1884 | 1.9e-194 |

Description sp:[LN:YJFR_ECOLI] [AC:P39300] [GN:YJFR] [OR:Escherichia coli] [DE:HYPOTHETICAL 40.1 KD PROTEIN IN AIDB-SGAT INTERGENIC REGION] [SP:P39300] [DB:swissprot]

| ORF_Name | NT ID | AA ID | NT LN | AA LN | Score | P-value |
|---|---|---|---|---|---|---|
| 23947187_c2_1887 | 1610 | 8781 | 813 | 270 | 92 | 8.5e-06 |

Description sp:[LN:G70037] [AC:G70037] [PN:conserved hypothetical protein yvfF] [GN:yvfF] [CL:hypothetical protein yxaB] [OR:Bacillus subtilis] [DB:pir1] >gp:[GI:e1186110:g2635935] [LN:BSUB0018] [AC:Z99121:AL009126] [GN:yvfF] [FN:unknown] [OR:Bacillus subtilis] [DB:genpept-bct1] [DE:Bacillus subtilis complete genome (section 18 of 21): from 3399551to 3609060.] [NT:similar to hypothetical proteins from B. subtilis] [LE:113628] [RE:114596] [DI:complement] >gp:[GI:e238670:g1495294] [LN:BSYVEFGNS] [AC:Z71928] [PN:hypothetical protein] [GN:yvfF] [OR:Bacillus subtilis] [DB:genpept-bct1] [DE:B.subtilis pnbA, sigL, yve[J,K,L,M,N,O,P,Q,R,S,T] andyvf[A,B,C,D,E,F,G,H] genes.] [LE:17150] [RE:18118] [DI:direct] >gp:[GI:e313005:g1945705] [LN:BSZ94043] [AC:Z94043] [PN:hypothetical protein] [GN:yvfF] [OR:Bacillus subtilis] [DB:genpept-bct1] [DE:B.subtilis genomic DNA fragment (88 kb).] [NT:similar to tremblnew:ST40830_13 epsL Streptococcus] [LE:67075] [RE:68043] [DI:direct]

| ORF_Name | NT ID | AA ID | NT LN | AA LN | Score | P-value |
|---|---|---|---|---|---|---|
| 23958562_c3_2465 | 1611 | 8782 | 1479 | 492 | 1728 | 6.4e-178 |

Description sp:[LN:RGECFM] [AC:S56623:F65255:C25038:S03764] [PN:sensor protein creC,:pho regulon positive regulatory protein creC] [GN:creC:phoM] [CL:envZ protein:sensor histidine kinase homology] [OR:Escherichia coli] [EC:2.7.3.-] [DB:pir1] [MP:100 min] >gp:[GI:g537239] [LN:ECOUW93] [AC:U14003] [GN:creC] [FN:positive regulatory gene for pho regulon] [OR:Escherichia coli] [DB:genpept-bct1] [DE:Escherichia coli K-12 chromosomal region from 92.8 to 00.1 minutes.] [NT:alternate gene name phoM; CG Site No. 395] [LE:327529] [RE:328953] [DI:direct] >gp:[GI:g1790861] [LN:AE000510] [AC:AE000510:U00096] [PN:catabolite repression sensor kinase for PhoB;] [GN:creC] [FN:enzyme; Global regulatory functions] [OR:Escherichia coli] [DB:genpept-bct2] [EC:2.7.3.-] [DE:Escherichia coli K-12 MG1655 section 400 of 400 of the completegenome.] [NT:o474; 99 pct identical amino acid sequence and] [LE:1353] [RE:2777] [DI:direct]

| ORF Name | NT ID | AA ID | NT/LN | AA/LN | Score | P-value |
|---|---|---|---|---|---|---|
| 23989662_c2_1996 | 1612 | 8783 | 888 | 295 | 388 | 6.4e-36 |

Description gp:[GI:g1732200] [LN:VFU65015] [AC:U65015] [PN:PTS permease for mannose subunit IIPMan] [GN:manY] [OR:Vibrio furnissii] [DB:genpept-bct2] [DE:Vibrio furnissii PTS permease for mannose subunits IIIMan Cterminal domain (manX), IIPMan (manY), IIBMan (manZ), and IIIManN-terminal domain (manW), GlcNAc-6-P deacetylase (manD) andputative aldolase (manF) genes, complete cds.] [NT:ManY; Pel; IIDMan] [LE:838] [RE:1614] [DI:direct]

| ORF Name | NT ID | AA ID | NT/LN | AA/LN | Score | P-value |
|---|---|---|---|---|---|---|
| 23993836_c2_2077 | 1613 | 8784 | 987 | 328 | 1412 | 2.0e-144 |

Description sp:[LN:RIBF_ECOLI] [AC:P08391:P75621] [GN:RIBF] [OR:Escherichia coli] [EC:2.7.1.26:2.7.7.2] [DE:(FAD PYROPHOSPHORYLASE) (FAD SYNTHETASE)]] [SP:P08391:P75621] [DB:swissprot] >sp:[LN:QQECIL] [AC:A64723:A22609:S40548] [PN:conserved hypothetical protein, 34.6K (rpsT-ileS intergenic region)] [GN:yaaC] [CL:conserved hypothetical protein HI0963] [OR:Escherichia coli] [DB:pir1] [MP:0.5 min] >gp:[GI:g1786208] [LN:AE000113] [AC:AE000113:U00096] [PN:putative regulator] [GN:ribF] [FN:putative regulator; Not classified] [OR:Escherichia coli] [DB:genpept-bct2] [DE:Escherichia coli K-12 MG1655 section 3 of 400 of the completegenome.] [NT:o312; formerly designated yaaC] [LE:748] [RE:1689] [DI:direct]

| ORF Name | NT ID | AA ID | NT/LN | AA/LN | Score | P-value |
|---|---|---|---|---|---|---|
| 23996040_c3_2241 | 1614 | 8785 | 1338 | 445 | 1610 | 2.1e-165 |

Description sp:[LN:INTB_ECOLI] [AC:P39347] [GN:INTB] [OR:Escherichia coli] [DE:PROPHAGE P4 INTEGRASE (INT(P4))] [SP:P39347] [DB:swissprot] >sp:[LN:S56496] [AC:S56496:A65240] [PN:prophage P4 integrase:hypothetical protein o396] [GN:intB] [CL:satellite phage P4 integrase] [OR:Escherichia coli] [DB:pir2] >gp:[GI:g537112] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_o396] [LE:187585] [RE:188775] [DI:direct] >gp:[GI:g1790722] [LN:AE000498] [AC:AE000498:U00096] [PN:prophage P4 integrase] [GN:intB] [FN:IS, phage, Tn; Phage-related functions and] [OR:Escherichia coli] [DB:genpept-bct2] [DE:Escherichia coli K-12 MG1655 section 388 of 400 of the completegenome.] [NT:o396; 100 pct identical INTB_ECOLI SW: P39347] [LE:452] [RE:1642] [DI:direct]

| ORF Name | NT ID | AA ID | NT/LN | AA/LN | Score | P-value |
|---|---|---|---|---|---|---|
| 24004516_f1_113 | 1615 | 8786 | 675 | 224 | 133 | 3.0e-06 |

Description gp:[GI:e282242:g1679831] [LN:MAMAMIRM] [AC:X79027] [PN:unknown] [OR:Microbacterium ammoniaphilum] [DB:genpept-bct1] [DE:M.ammoniaphilum genes mamIR and mamIM.] [LE:3382] [RE:>4972] [DI:complement]

| ORF Name | NT ID | AA ID | NT LN | AA LN | Score | P-value |
|---|---|---|---|---|---|---|
| 24040950_c2_1990 | 1616 | 8787 | 603 | 200 | 521 | 5.1e-50 |

Description sp:[LN:DGOA_ECOLI] [AC:P31458] [GN:DGOA:DGOD] [OR:Escherichia coli]
[EC:4.1.2.21:4.2.1.6] [DE:(EC 4.2.1.6)]] [SP:P31458] [DB:swissprot]
>sp:[LN:E65171] [AC:E65171] [PN:hypothetical 64.0 kD protein in ibpA-gyrB
intergenic region] [GN:yidU] [OR:Escherichia coli] [DB:pir2] >gp:[GI:g2367262]
[LN:AE000446] [AC:AE000446:U00096] [PN:2-oxo-3-deoxygalactonate 6-phosphate
aldolase] [GN:dgoA] [FN:enzyme; Degradation of small molecules: Carbon]
[OR:Escherichia coli] [DB:genpept-bct2] [DE:Escherichia coli K-12 MG1655 section
336 of 400 of the completegenome.] [NT:f587; formerly designated yidU] [LE:4924]
[RE:6687] [DI:complement]

| ORF Name | NT ID | AA ID | NT LN | AA LN | Score | P-value |
|---|---|---|---|---|---|---|
| 24066333_f2_704 | 1617 | 8788 | 402 | 133 | 106 | 2.1e-05 |

Description gp:[GI:g1657601] [LN:NEU66220] [AC:U66220] [PN:unknown] [OR:Nannocystis exedens]
[DB:genpept-bct2] [DE:Nannocystis exedens unknown protein, partial cds and
microsatellitesequence 7A140.] [NT:ORF1] [LE:<1] [RE:872] [DI:complement]

| ORF Name | NT ID | AA ID | NT LN | AA LN | Score | P-value |
|---|---|---|---|---|---|---|
| 24119833_c3_2438 | 1618 | 8789 | 1131 | 376 | 1467 | 2.9e-150 |

Description sp:[LN:YJJU_ECOLI] [AC:P39407] [GN:YJJU] [OR:Escherichia coli] [DE:HYPOTHETICAL
39.8 KD PROTEIN IN OSMY-DEOC INTERGENIC REGION (O357)] [SP:P39407] [DB:swissprot]
>sp:[LN:S56601] [AC:S56601:H65252] [PN:hypothetical 39.8K protein (osmY-deoC
intergenic region):hypothetical protein o357] [GN:yjjU] [OR:Escherichia coli]
[DB:pir2] >gp:[GI:g537217] [LN:ECOUW93] [AC:U14003] [OR:Escherichia coli]
[DB:genpept-bct1] [DE:Escherichia coli K-12 chromosomal region from 92.8 to 00.1
minutes.] [NT:ORF_o357] [LE:303242] [RE:304315] [DI:direct] >gp:[GI:g1790837]
[LN:AE000508] [AC:AE000508:U00096] [PN:orf, hypothetical protein] [GN:yjjU]
[FN:orf; Unknown] [OR:Escherichia coli] [DB:genpept-bct2] [DE:Escherichia coli
K-12 MG1655 section 398 of 400 of the completegenome.] [NT:o357; 100 pct
identical amino acid sequence and] [LE:3059] [RE:4132] [DI:direct]

| ORF Name | NT ID | AA ID | NT LN | AA LN | Score | P-value |
|---|---|---|---|---|---|---|
| 24223416_c3_2490 | 1619 | 8790 | 1329 | 442 | 1353 | 3.5e-138 |

Description sp:[LN:NHAA_ECOLI] [AC:P13738] [GN:NHAA:ANT] [OR:Escherichia coli] [DE:NA(+)/H(+) ANTIPORTER 1] [SP:P13738] [DB:swissprot] >sp:[LN:C64722] [AC:C64722:A41201:S40541:A28800] [PN:Na+/H+-exchanging protein nhaA:Na+/H+ antiporter] [GN:nhaA:ant] [CL:Na+/H+-exchanging protein nhaA] [OR:Escherichia coli] [DB:pir2] [MP:0 min] >gp:[GI:g1786201] [LN:AE000112] [AC:AE000112:U00096] [PN:Na+/H antiporter, pH dependent] [GN:nhaA] [FN:transport; Transport of small molecules;] [OR:Escherichia coli] [DB:genpept-bct2] [DE:Escherichia coli K-12 MG1655 section 2 of 400 of the completegenome.] [NT:o388; 100 pct identical to NHAA_ECOLI SW: P13738] [LE:6951] [RE:8117] [DI:direct]

| ORF Name | NT ID | AA ID | NT LN | AA LN | Score | P-value |
|---|---|---|---|---|---|---|
| 24224181_f2_520 | 1620 | 8791 | 483 | 160 | 358 | 9.6e-33 |

Description sp:[LN:A70058] [AC:A70058] [PN:conserved hypothetical protein ywhH] [GN:ywhH] [OR:Bacillus subtilis] [DB:pir2] >gp:[GI:e267590:g1565243] [LN:BSTHRZ] [AC:Z80360] [PN:Unknown] [GN:ywhH] [OR:Bacillus subtilis] [DB:genpept-bct1] [DE:B.subtilis thrZ downstream chromosomal region.] [LE:8240] [RE:8713] [DI:complement] >gp:[GI:e1186248:g2636284] [LN:BSUB0020] [AC:Z99123:AL009126] [GN:ywhH] [FN:unknown] [OR:Bacillus subtilis] [DB:genpept-bct1] [DE:Bacillus subtilis complete genome (section 20 of 21): from 3798401to 4010550.] [NT:similar to hypothetical proteins] [LE:48001] [RE:48474] [DI:direct]

| ORF Name | NT ID | AA ID | NT LN | AA LN | Score | P-value |
|---|---|---|---|---|---|---|
| 24334391_c3_2368 | 1621 | 8792 | 648 | 215 | | |

Description

NO-HIT

| ORF Name | NT ID | AA ID | NT LN | AA LN | Score | P-value |
|---|---|---|---|---|---|---|
| 24350075_c1_1377 | 1622 | 8793 | 798 | 265 | | |

Description

NO-HIT

| ORF_Name | NT ID | AA ID | NT LN | AA LN | Score | P-value |
|---|---|---|---|---|---|---|
| 24415703_f3_1143 | 1623 | 8794 | 324 | 107 | 120 | 1.3e-06 |

Description sp:[LN:S51939] [AC:S51939:S72315:S45025] [PN:chitinase, precursor] [CL:plant chitinase homology] [OR:Beta vulgaris] [SR:, beet] [EC:3.2.1.14] [DB:pir2] >gp:[GI:g904359] [LN:A23786] [AC:A23786] [PN:chitinase 1] [OR:Beta vulgaris] [SR:beet] [DB:genpept-pat] [DE:B.vulgaris gene for chitinase 1.] [LE:1428:4621:5408] [RE:2171:4776:5827] [DI:directJoin] >gp:[GI:g829258] [LN:BVCH1EX1] [AC:X81056] [PN:Chitinase] [GN:Ch1] [OR:Beta vulgaris] [SR:beet] [DB:genpept-pln1] [EC:3.2.1.14] [DE:B.vulgaris Chitinase Ch1 gene exon 1.] [LE:1428:X81057.1:392:X81057.1:1180] [RE:2169:548:1600] [DI:directJoin] >gp:[GI:g488731] [LN:BVCHCH1] [AC:X79301] [PN:chitinase] [OR:Beta vulgaris] [SR:beet] [DB:genpept-pln1] [DE:B.vulgaris Chitinase Ch1 gene.] [LE:1428:3606:4394] [RE:2169:3762:4814] [DI:directJoin]

| ORF_Name | NT ID | AA ID | NT LN | AA LN | Score | P-value |
|---|---|---|---|---|---|---|
| 24429556_c3_2285 | 1624 | 8795 | 597 | 198 | 660 | 9.6e-65 |

Description gp:[GI:e1549659:g5832489] [LN:YPCD1] [AC:AL117189] [GN:YPCD1.69] [OR:Yersinia pestis] [DB:genpept-bct1] [DE:Yersinia pestis plasmid pCD1.] [NT:YPCD1.69, probable transposase remnant, len: 193] [LE:49044] [RE:49625] [DI:direct]

| ORF_Name | NT ID | AA ID | NT LN | AA LN | Score | P-value |
|---|---|---|---|---|---|---|
| 2447812_c1_1412 | 1625 | 8796 | 2946 | 981 | | |

Description

NO-HIT

| ORF_Name | NT ID | AA ID | NT LN | AA LN | Score | P-value |
|---|---|---|---|---|---|---|
| 24492888_f2_662 | 1626 | 8797 | 204 | 67 | | |

Description

NO-HIT

| ORF_Name | NT ID | AA ID | NT LN | AA LN | Score | P-value |
|---|---|---|---|---|---|---|
| 24494032_f3_1030 | 1627 | 8798 | 549 | 182 | 369 | 6.6e-34 |

Description sp:[LN:YFAZ_ECOLI] [AC:P76471] [GN:YFAZ] [OR:Escherichia coli] [DE:HYPOTHETICAL 18.6 KD PROTEIN IN GLPC-AIS INTERGENIC REGION PRECURSOR] [SP:P76471] [DB:swissprot]

| ORF_Name | NT ID | AA ID | NT LN | AA LN | Score | P-value |
|---|---|---|---|---|---|---|
| 245456_c3_2433 | 1628 | 8799 | 429 | 142 | 526 | 1.5e-50 |

Description sp:[LN:HOLD_ECOLI] [AC:P28632] [GN:HOLD] [OR:Escherichia coli] [EC:2.7.7.7]
[DE:DNA POLYMERASE III, PSI SUBUNIT,] [SP:P28632] [DB:swissprot] >sp:[LN:A48647]
[AC:A48647:B46739:S56596:C65252] [PN:DNA-directed DNA polymerase, III psi chain]
[GN:holD] [CL:yeast peptidylprolyl isomerase FPR3:BKBP-type peptidylprolyl
isomerase homology] [OR:Escherichia coli] [EC:2.7.7.7] [DB:pir1] >gp:[GI:g146390]
[LN:ECOHOLDPSI] [AC:L05387] [PN:DNA polymerase III psi subunit] [GN:holD]
[OR:Escherichia coli] [SR:Escherichia coli (strain MAF102) DNA] [DB:genpept-bct1]
[DE:Escherichia coli DNA polymerase III psi subunit (holD) andribosomal protein
S18 acetylating enzyme (rimI) genes, completecds.] [NT:putative] [LE:39] [RE:452]
[DI:direct] >gp:[GI:g147387] [LN:ECOPSI] [AC:L04575] [PN:DNA polymerase III psi
subunit] [GN:holD] [OR:Escherichia coli] [SR:Escherichia coli (strain K-12)
(library: lambda-phage of Y. Kohara] [DB:genpept-bct1] [DE:Escherichia coli
(clone pUC-psi) DNA polymerase III psi subunit(holD) gene, complete cds.] [LE:78]
[RE:491] [DI:direct] >gp:[GI:g537212] [LN:ECOUW93] [AC:U14003] [PN:DNA polymerase
III psi subunit] [GN:holD] [OR:Escherichia coli] [DB:genpept-bct1]
[DE:Escherichia coli K-12 chromosomal region from 92.8 to 00.1 minutes.]
[LE:298635] [RE:299048] [DI:direct] >gp:[GI:g1790831] [LN:AE000507]
[AC:AE000507:U00096] [PN:DNA polymerase III, psi subunit] [GN:holD] [FN:enzyme;
DNA - replication, repair,] [OR:Escherichia coli] [DB:genpept-bct2] [EC:2.7.7.7]
[DE:Escherichia coli K-12 MG1655 section 397 of 400 of the completegenome.]
[NT:o137; 100 pct identical to HOLD_ECOLI SW: P28632] [LE:10752] [RE:11165]
[DI:direct]

| ORF_Name | NT ID | AA ID | NT LN | AA LN | Score | P-value |
|---|---|---|---|---|---|---|
| 2459681_f1_274 | 1629 | 8800 | 1998 | 665 | 476 | 3.0e-45 |

Description sp:[LN:IOLC_BACSU] [AC:P42414] [GN:IOLC:E83C] [OR:Bacillus subtilis] [DE:IOLC
PROTEIN] [SP:P42414] [DB:swissprot] >sp:[LN:C69645] [AC:C69645] [PN:myo-inositol
catabolism iolC] [GN:iolC] [OR:Bacillus subtilis] [DB:pir2]
>gp:[GI:d1003802:g709983] [LN:BACIOLO] [AC:D14399] [PN:hypothetical protein]
[GN:E83C] [OR:Bacillus subtilis] [SR:Bacillus subtilis (strain:BGSC 1A1 (168
trpC2)) DNA] [DB:genpept-bct1] [DE:Bacillus subtilis 15 kb chromosome segment
contains the iol operon.] [NT:homologous to fructokinases] [LE:2170] [RE:3147]
[DI:direct] >gp:[GI:e1184699:g2636520] [LN:BSUB0021] [AC:Z99124:AL009126]
[GN:iolC] [OR:Bacillus subtilis] [DB:genpept-bct1] [DE:Bacillus subtilis complete
genome (section 21 of 21): from 3999281to 4214814.] [NT:alternate gene name:
yxdC; myo-inositol catabolism] [SP:P42414] [LE:80542] [RE:81519] [DI:complement]

| ORF Name | NT ID | AA ID | NT/LN | AA/LN | Score | P-value |
|---|---|---|---|---|---|---|
| 24610761_c3_2151 | 1630 | 8801 | 1527 | 508 | 1737 | 7.1e-179 |

Description sp:[LN:YTFR_ECOLI] [AC:P39326] [GN:YTFR] [OR:Escherichia coli] [DE:REGION]
[SP:P39326] [DB:swissprot] >sp:[LN:S56454] [AC:S56454:G65234] [PN:hypothetical
ABC transporter (ppa-fbp intergenic region):hypothetical protein o417a] [GN:ytfR]
[CL:unassigned ATP-binding cassette proteins:ATP-binding cassette homology]
[OR:Escherichia coli] [DB:pir2] >gp:[GI:g537070] [LN:ECOUW93] [AC:U14003]
[OR:Escherichia coli] [DB:genpept-bct1] [DE:Escherichia coli K-12 chromosomal
region from 92.8 to 00.1 minutes.] [NT:ORF_o417a] [LE:141888] [RE:143141]
[DI:direct] >gp:[GI:g1790675] [LN:AE000494] [AC:AE000494:U00096] [PN:putative
ATP-binding component of a transport] [GN:ytfR] [FN:putative transport; Not
classified] [OR:Escherichia coli] [DB:genpept-bct2] [DE:Escherichia coli K-12
MG1655 section 384 of 400 of the completegenome.] [NT:o417a; 100 pct identical
amino acid sequence and] [LE:2743] [RE:3996] [DI:direct]

| ORF Name | NT ID | AA ID | NT/LN | AA/LN | Score | P-value |
|---|---|---|---|---|---|---|
| 24632962_c2_2033 | 1631 | 8802 | 732 | 243 | 1166 | 2.3e-118 |

Description sp:[LN:A27854] [AC:A41143:A27854:S56608:G65253] [PN:purine-nucleoside
phosphorylase,:inosine phosphorylase] [GN:deoD] [CL:purine-nucleoside
phosphorylase pnp] [OR:Escherichia coli] [EC:2.4.2.1] [DB:pir2] [MP:100]
>gp:[GI:g147309] [LN:ECOPNP] [AC:M60917] [PN:purine nucleoside phosphorylase]
[GN:deoD] [OR:Escherichia coli] [SR:Escherichia coli (strain K-12) DNA]
[DB:genpept-bct1] [EC:2.4.2.1] [DE:E.coli purine nucleoside phosphorylase (deoD)
gene, complete cds.] [NT:putative] [LE:123] [RE:842] [DI:direct] >gp:[GI:g537224]
[LN:ECOUW93] [AC:U14003] [PN:purine-nucleoside phosphorylase] [GN:deoD]
[OR:Escherichia coli] [DB:genpept-bct1] [EC:2.4.2.1] [DE:Escherichia coli K-12
chromosomal region from 92.8 to 00.1 minutes.] [NT:CG Site No. 865; alternate
gene name pup] [LE:311715] [RE:312434] [DI:direct] >gp:[GI:g1790844]
[LN:AE000508] [AC:AE000508:U00096] [PN:purine-nucleoside phosphorylase] [GN:deoD]
[FN:enzyme; Salvage of nucleosides and nucleotides] [OR:Escherichia coli]
[DB:genpept-bct2] [EC:2.4.2.1] [DE:Escherichia coli K-12 MG1655 section 398 of
400 of the completegenome.] [NT:o239; 100 pct identical to DEOD_ECOLI SW:
P09743;] [LE:11531] [RE:12250] [DI:direct]

| ORF Name | NT ID | AA ID | NT/LN | AA/LN | Score | P-value |
|---|---|---|---|---|---|---|
| 24647187_f1_256 | 1632 | 8803 | 837 | 278 | | |

Description

NO-HIT

| ORF Name | NT ID | AA ID | NT LN | AA LN | Score | P-value |
|---|---|---|---|---|---|---|
| 2469078_f3_1178 | 1633 | 8804 | 360 | 119 | 598 | 3.6e-58 |

Description sp:[LN:AMPA_ECOLI] [AC:P11648] [GN:PEPA:XERB:CARP] [OR:Escherichia coli]
[EC:3.4.11.1] [DE:AMINOPEPTIDASE A/I,] [SP:P11648] [DB:swissprot] >sp:[LN:APECA]
[AC:S04462:A33212:S56486:S58667:G65238] [PN:leucyl aminopeptidase,
A:aminopeptidase I:cytosol aminopeptidase A] [GN:pepA:xerB] [CL:cytosol
aminopeptidase] [OR:Escherichia coli] [EC:3.4.11.1] [DB:pir1] [MP:96.5 min]
>gp:[GI:g537102] [LN:ECOUW93] [AC:U14003] [PN:aminopeptidase A/1] [GN:pepA]
[OR:Escherichia coli] [DB:genpept-bct1] [EC:3.4.11.1] [DE:Escherichia coli K-12
chromosomal region from 92.8 to 00.1 minutes.] [NT:alternate gene name xerB]
[LE:175275] [RE:176786] [DI:complement] >gp:[GI:g1054725] [LN:ECPEPCAR]
[AC:X86443] [PN:aminopeptidase A] [GN:pepA/carP] [OR:Escherichia coli]
[DB:genpept-bct1] [DE:E.coli pepA/carP gene.] [SP:P11648] [LE:371] [RE:1882]
[DI:direct] >gp:[GI:g43309] [LN:ECXERB] [AC:X15130] [OR:Escherichia coli]
[DB:genpept-bct1] [DE:E. coli xerB gene for aminopeptidase A/I (EC 3.4.11.1).]
[NT:aminopeptidase A/I (AA 1 - 503)] [SP:P11648] [LE:60] [RE:1571] [DI:direct]
>gp:[GI:g1790710] [LN:AE000496] [AC:AE000496:U00096] [PN:aminopeptidase A/I]
[GN:pepA] [FN:enzyme; Degradation of proteins, peptides,] [OR:Escherichia coli]
[DB:genpept-bct2] [EC:3.4.11.1] [DE:Escherichia coli K-12 MG1655 section 386 of
400 of the completegenome.] [NT:f503; 100 pct identical to AMPA_ECOLI SW:
P11648;] [LE:10289] [RE:11800] [DI:complement]

| ORF Name | NT ID | AA ID | NT LN | AA LN | Score | P-value |
|---|---|---|---|---|---|---|
| 24713530_f1_109 | 1634 | 8805 | 246 | 81 | 119 | 2.0e-07 |

Description gp:[GI:g639720] [LN:ECU19577] [AC:U19577] [PN:galactonate dehydratase] [GN:dgoD]
[OR:Escherichia coli] [DB:genpept-bct2] [DE:Escherichia coli galactonate
dehydratase (dgoD) gene, partial cds.] [LE:97] [RE:>329] [DI:direct]

| ORF Name | NT ID | AA ID | NT LN | AA LN | Score | P-value |
|---|---|---|---|---|---|---|
| 24741582_f3_1109 | 1635 | 8806 | 297 | 98 | | |

Description

NO-HIT

| ORF_Name | NT_ID | AA_ID | NT LN | AA LN | Score | P-value |
|---|---|---|---|---|---|---|
| 24745437_f3_937 | 1636 | 8807 | 1686 | 561 | 2785 | 6.3e-290 |

Description sp:[LN:F65254] [AC:F65254:S56615] [PN:ABC transporter in nadR-slt intergenic region] [GN:yjjK] [CL:unassigned ATP-binding cassette proteins:ATP-binding cassette homology] [OR:Escherichia coli] [DB:pir2] >gp:[GI:g2367384] [LN:AE000509] [AC:AE000509:U00096] [PN:putative ATP-binding component of a transport] [GN:yjjK] [FN:putative transport; Not classified] [OR:Escherichia coli] [DB:genpept-bct2] [DE:Escherichia coli K-12 MG1655 section 399 of 400 of the completegenome.] [NT:f555; sequence change shortens and] [LE:4043] [RE:5710] [DI:complement]

| ORF_Name | NT_ID | AA_ID | NT LN | AA LN | Score | P-value |
|---|---|---|---|---|---|---|
| 24801591_f2_685 | 1637 | 8808 | 219 | 72 | | |

Description

NO-HIT

| ORF_Name | NT_ID | AA_ID | NT LN | AA LN | Score | P-value |
|---|---|---|---|---|---|---|
| 24882937_f1_67 | 1638 | 8809 | 1035 | 344 | 1615 | 6.1e-166 |

Description sp:[LN:A54035] [AC:A54035:S56610:PQ0014:A65254:S56124] [PN:lipoate--protein ligase, A] [GN:lplA:yjjF] [CL:lipoate-protein ligase] [OR:Escherichia coli] [EC:6.3.4.-] [DB:pir1] [MP:100 min] >gp:[GI:g504496] [LN:ECOLPLA] [AC:L27665] [PN:lipoate-protein ligase A] [OR:Escherichia coli] [SR:Escherichia coli (individual_isolate TM134, sub_strain W3110] [DB:genpept-bct1] [DE:Escherichia coli lipoate-protein ligase A (lplA) gene, completecds; smp gene, 3' end.] [LE:83] [RE:1099] [DI:direct] >gp:[GI:g537226] [LN:ECOUW93] [AC:U14003] [GN:yjjF] [OR:Escherichia coli] [DB:genpept-bct1] [DE:Escherichia coli K-12 chromosomal region from 92.8 to 00.1 minutes.] [LE:313933] [RE:314949] [DI:complement] >gp:[GI:g1790846] [LN:AE000508] [AC:AE000508:U00096] [PN:lipoate-protein ligase A] [GN:lplA] [FN:enzyme; Macromolecule synthesis, modification:] [OR:Escherichia coli] [DB:genpept-bct2] [EC:6.-.-.-] [DE:Escherichia coli K-12 MG1655 section 398 of 400 of the completegenome.] [NT:f338; 100 pct identical amino acid sequence and] [LE:13749] [RE:14765] [DI:complement]

| ORF_Name | NT_ID | AA_ID | NT LN | AA LN | Score | P-value |
|---|---|---|---|---|---|---|
| 24897532_f1_410 | 1639 | 8810 | 252 | 83 | | |

Description

NO-HIT

| ORF_Name | NT_ID | AA_ID | NT/LN | AA/LN | Score | P-value |
|---|---|---|---|---|---|---|
| 25494068_c2_1872 | 1640 | 8811 | 555 | 184 | 471 | 1.0e-44 |

Description sp:[LN:YFJY_ECOLI] [AC:P52140] [GN:YFJY] [OR:Escherichia coli] [DE:HYPOTHETICAL 18.0 KD PROTEIN IN ALPA-GABD INTERGENIC REGION] [SP:P52140] [DB:swissprot] >sp:[LN:T08655] [AC:T08655:F65043] [PN:yfjY protein] [GN:yfjY] [OR:Escherichia coli] [DB:pir2] [MP:57 min] >gp:[GI:d1017244:g1800034] [LN:D90889] [AC:D90889:AB001340] [GN:yfjY] [OR:Escherichia coli] [SR:Escherichia coli (strain:K12) DNA, clone_lib:Kohara lambda minise] [DB:genpept-bct1] [DE:E.coli genomic DNA, Kohara clone #442(59.7-60.0 min.).] [NT:similar to [SwissProt Accession Number P52140]] [LE:4377] [RE:4859] [DI:direct] >gp:[GI:g1033138] [LN:ECU36840] [AC:U36840] [OR:Escherichia coli] [DB:genpept-bct1] [DE:Escherichia coli K-12 genome, approximately 57 minutes.] [NT:ORF_o160] [LE:25341] [RE:25823] [DI:direct] >gp:[GI:g1788997] [LN:AE000349] [AC:AE000349:U00096] [PN:putative DNA repair protein] [GN:yfjY] [FN:putative enzyme; Not classified] [OR:Escherichia coli] [DB:genpept-bct2] [DE:Escherichia coli K-12 MG1655 section 239 of 400 of the completegenome.] [NT:o160] [LE:8887] [RE:9369] [DI:direct]

| ORF_Name | NT_ID | AA_ID | NT/LN | AA/LN | Score | P-value |
|---|---|---|---|---|---|---|
| 25548125_c1_1671 | 1641 | 8812 | 453 | 150 | | |

Description

NO-HIT

| ORF_Name | NT_ID | AA_ID | NT/LN | AA/LN | Score | P-value |
|---|---|---|---|---|---|---|
| 25587791_f1_249 | 1642 | 8813 | 606 | 201 | | |

Description

NO-HIT

| ORF_Name | NT_ID | AA_ID | NT/LN | AA/LN | Score | P-value |
|---|---|---|---|---|---|---|
| 25664540_c2_1912 | 1643 | 8814 | 1650 | 549 | | |

Description

NO-HIT

| ORF_Name | NT_ID | AA_ID | NT/LN | AA/LN | Score | P-value |
|---|---|---|---|---|---|---|
| 25681683_f3_1152 | 1644 | 8815 | 1167 | 388 | 805 | 4.1e-80 |

Description sp:[LN:UGPC_ECOLI] [AC:P10907:P76696] [GN:UGPC] [OR:Escherichia coli] [DE:SN-GLYCEROL-3-PHOSPHATE TRANSPORT ATP-BINDING PROTEIN UGPC] [SP:P10907:P76696] [DB:swissprot] >gp:[GI:g43249] [LN:ECUGP] [AC:X13141] [OR:Escherichia coli] [DB:genpept-bct1] [DE:E. coli ugp locus DNA with genes ugpBACE.] [NT:ugpC protein (AA 1-356)] [SP:P10907] [LE:3500] [RE:4570] [DI:direct]

| ORF_Name | NT_ID | AA_ID | NT/LN | AA/LN | Score | P-value |
|---|---|---|---|---|---|---|
| 25682150_c2_1714 | 1645 | 8816 | 291 | 96 | | |

Description

NO-HIT

| ORF_Name | NT_ID | AA_ID | NT/LN | AA/LN | Score | P-value |
|---|---|---|---|---|---|---|
| 2584762_c3_2423 | 1646 | 8817 | 357 | 118 | 108 | 7.0e-06 |

Description sp:[LN:S56593] [AC:S56593:H65251:S72534] [PN:bglJ protein:protein o225a]
[GN:bglJ:yjjR] [CL:regulatory protein comA:response regulator homology]
[OR:Escherichia coli] [DB:pir2] [MP:99 min] >gp:[GI:g537209] [LN:ECOUW93]
[AC:U14003] [OR:Escherichia coli] [DB:genpept-bct1] [DE:Escherichia coli K-12
chromosomal region from 92.8 to 00.1 minutes.] [NT:ORF_o225a] [LE:294992]
[RE:295669] [DI:direct] >gp:[GI:g1754973] [LN:ECU35834] [AC:U35834] [GN:bglJ]
[OR:Escherichia coli] [DB:genpept-bct1] [DE:Escherichia coli bglJ gene, complete
cds.] [LE:38] [RE:715] [DI:direct] >gp:[GI:g1790828] [LN:AE000507]
[AC:AE000507:U00096] [PN:2-component transcriptional regulator] [GN:bglJ]
[FN:regulator; Not classified] [OR:Escherichia coli] [DB:genpept-bct2]
[DE:Escherichia coli K-12 MG1655 section 397 of 400 of the completegenome.]
[NT:o225a; 100 pct identical amino acid sequence and] [LE:7109] [RE:7786]
[DI:direct]

| ORF_Name | NT_ID | AA_ID | NT/LN | AA/LN | Score | P-value |
|---|---|---|---|---|---|---|
| 26016391_f3_1129 | 1647 | 8818 | 225 | 74 | | |

Description

NO-HIT

| ORF_Name | NT ID | AA ID | NT LN | AA LN | Score | P-value |
|---|---|---|---|---|---|---|
| 26064766_f1_200 | 1648 | 8819 | 549 | 182 | 511 | 5.9e-49 |

Description sp:[LN:YLCD_ECOLI] [AC:P77239] [GN:YLCD] [OR:Escherichia coli] [DE:HYPOTHETICAL
44.3 KD PROTEIN IN NFRB-PHEP INTERGENIC REGION PRECURSOR] [SP:P77239]
[DB:swissprot] >sp:[LN:D64790] [AC:D64790] [PN:yclD protein] [GN:yclD]
[OR:Escherichia coli] [DB:pir2] >gp:[GI:d1036194;g4062198] [LN:D90699]
[AC:D90699;AB001340] [PN:Membrane fusion protein MtrC precursor.] [GN:mtrC]
[OR:Escherichia coli] [SR:Escherichia coli(strain:K12) DNA, clone:Kohara clone
162] [DB:genpept-bct1] [DE:Escherichia coli genomic DNA. (12.6 - 12.9 min).]
[NT:ORF_ID:o163#4; similar to SwissProt Accession] [LE:11894] [RE:13117]
[DI:direct] >gp:[GI:d1036200;g4062204] [LN:D90700] [AC:D90700;AB001340]
[PN:Membrane fusion protein MtrC precursor.] [GN:mtrC] [OR:Escherichia coli]
[SR:Escherichia coli(strain:K12) DNA, clone:Kohara clone #163] [DB:genpept-bct1]
[DE:Escherichia coli genomic DNA. (12.8 - 13.2 min).] [NT:ORF_ID:o163#4; similar
to SwissProt Accession] [LE:2817] [RE:4040] [DI:direct] >gp:[GI:g1778489]
[LN:ECU82598] [AC:U82598] [OR:Escherichia coli] [DB:genpept-bct1] [DE:Escherichia
coli genomic sequence of minutes 9 to 12.] [NT:hypothetical protein] [LE:38110]
[RE:39333] [DI:direct] >gp:[GI:g1786787] [LN:AE000162] [AC:AE000162;U00096]
[PN:putative resistance protein] [GN:ylcD] [FN:putative transport; Drug/analog
sensitivity] [OR:Escherichia coli] [DB:genpept-bct2] [DE:Escherichia coli K-12
MG1655 section 52 of 400 of the completegenome.] [NT:o407; This 407 aa ORF is 24
pct identical (37 gaps)] [LE:4256] [RE:5479] [DI:direct]

| ORF_Name | NT ID | AA ID | NT LN | AA LN | Score | P-value |
|---|---|---|---|---|---|---|
| 26065833_f2_814 | 1649 | 8820 | 1263 | 420 | 98 | 0.034 |

Description gp:[GI:g2160524] [LN:AHU56832] [AC:U56832] [OR:Aeromonas hydrophila]
[DB:genpept-bct2] [DE:Aeromonas hydrophila FK506 binding protein (fkpA) gene,
completecds in 3.9 kb fragment.] [NT:ORF5; no significant similarity with known]
[LE:2969] [RE:3721] [DI:complement]

| ORF Name | NT ID | AA ID | NT LN | AA LN | Score | P-value |
|---|---|---|---|---|---|---|
| 26066466_f1_199 | 1650 | 8821 | 765 | 254 | 906 | 8.2e-91 |

Description sp:[LN:YLCD_ECOLI] [AC:P77239] [GN:YLCD] [OR:Escherichia coli] [DE:HYPOTHETICAL 44.3 KD PROTEIN IN NFRB-PHEP INTERGENIC REGION PRECURSOR] [SP:P77239] [DB:swissprot] >sp:[LN:D64790] [AC:D64790] [PN:yclD protein] [GN:yclD] [OR:Escherichia coli] [DB:pir2] >gp:[GI:d1036194:g4062198] [LN:D90699] [AC:D90699:AB001340] [PN:Membrane fusion protein MtrC precursor.] [GN:mtrC] [OR:Escherichia coli] [SR:Escherichia coli(strain:K12) DNA, clone:Kohara clone #162] [DB:genpept-bct1] [DE:Escherichia coli genomic DNA. (12.6 - 12.9 min).] [NT:ORF_ID:o163#4; similar to SwissProt Accession] [LE:11894] [RE:13117] [DI:direct] >gp:[GI:d1036200:g4062204] [LN:D90700] [AC:D90700:AB001340] [PN:Membrane fusion protein MtrC precursor.] [GN:mtrC] [OR:Escherichia coli] [SR:Escherichia coli(strain:K12) DNA, clone:Kohara clone #163] [DB:genpept-bct1] [DE:Escherichia coli genomic DNA. (12.8 - 13.2 min).] [NT:ORF_ID:o163#4; similar to SwissProt Accession] [LE:2817] [RE:4040] [DI:direct] >gp:[GI:g1778489] [LN:ECU82598] [AC:U82598] [OR:Escherichia coli] [DB:genpept-bct1] [DE:Escherichia coli genomic sequence of minutes 9 to 12.] [NT:hypothetical protein] [LE:38110] [RE:39333] [DI:direct] >gp:[GI:g1786787] [LN:AE000162] [AC:AE000162:U00096] [PN:putative resistance protein] [GN:ylcD] [FN:putative transport; Drug/analog sensitivity] [OR:Escherichia coli] [DB:genpept-bct2] [DE:Escherichia coli K-12 MG1655 section 52 of 400 of the completegenome.] [NT:o407; This 407 aa ORF is 24 pct identical (37 gaps)] [LE:4256] [RE:5479] [DI:direct]

| ORF Name | NT ID | AA ID | NT LN | AA LN | Score | P-value |
|---|---|---|---|---|---|---|
| 26208410_f2_700 | 1651 | 8822 | 270 | 89 | | |

Description

NO-HIT

| ORF_Name | NT_ID | AA_ID | NT/LN | AA/LN | Score | P-value |
|---|---|---|---|---|---|---|
| 26259758_f2_532 | 1652 | 8823 | 2295 | 764 | 3497 | 0.0 |

Description sp:[LN:MDOB_ECOLI] [AC:P39401] [GN:MDOB] [OR:Escherichia coli] [EC:2.7.8.20]
[DE:MEMBRANE-OLIGOSACCHARIDE GLYCEROPHOSPHOTRANSFERASE)] [SP:P39401]
[DB:swissprot] >sp:[LN:S56586] [AC:S56586:A65251]
[PN:phosphatidylglycerol--membrane-oligosaccharide
glycerophosphotransferase,:mdoB protein] [GN:mdoB] [OR:Escherichia coli]
[EC:2.7.8.20] [DB:pir2] >gp:[GI:g537202] [LN:ECOUW93] [AC:U14003]
[PN:phosphoglycerol transferase I] [GN:mdoB] [OR:Escherichia coli]
[DB:genpept-bct1] [DE:Escherichia coli K-12 chromosomal region from 92.8 to 00.1
minutes.] [LE:287982] [RE:290234] [DI:complement] >gp:[GI:g1263175] [LN:ECOUW93]
[AC:U14003] [PN:phosphoglycerol transferase I activity] [GN:mdoB] [OR:Escherichia
coli] [DB:genpept-bct1] [DE:Escherichia coli K-12 chromosomal region from 92.8 to
00.1 minutes.] [NT:CG Site No. 18169] [LE:287982] [RE:290234] [DI:complement]
>gp:[GI:g1790821] [LN:AE000507] [AC:AE000507:U00096] [PN:phosphoglycerol
transferase I] [GN:mdoB] [FN:enzyme; Osmotic adaptation] [OR:Escherichia coli]
[DB:genpept-bct2] [EC:2.7.8.20] [DE:Escherichia coli K-12 MG1655 section 397 of
400 of the completegenome.] [NT:f750; 100 pct identical amino acid sequence and]
[LE:99] [RE:2351] [DI:complement]

| ORF_Name | NT_ID | AA_ID | NT/LN | AA/LN | Score | P-value |
|---|---|---|---|---|---|---|
| 26299157_f3_1146 | 1653 | 8824 | 1590 | 529 | 624 | 6.3e-61 |

Description sp:[LN:B70979] [AC:B70979] [PN:hypothetical protein Rv3273] [GN:Rv3273]
[OR:Mycobacterium tuberculosis] [DB:pir2] >gp:[GI:e306542:g1877328] [LN:MTCY71]
[AC:Z92771:AL123456] [PN:hypothetical protein Rv3273] [GN:Rv3273]
[OR:Mycobacterium tuberculosis] [DB:genpept-bct1] [DE:Mycobacterium tuberculosis
H37Rv complete genome; segment 141/162.] [NT:Rv3273, (MTCY71.13), len: 764,
membrane protein,] [LE:14316] [RE:16610] [DI:direct]

| ORF_Name | NT_ID | AA_ID | NT/LN | AA/LN | Score | P-value |
|---|---|---|---|---|---|---|
| 2630342_c2_1803 | 1654 | 8825 | 1095 | 364 | 1717 | 9.4e-177 |

Description sp:[LN:YJGQ_ECOLI] [AC:P39341] [GN:YJGQ] [OR:Escherichia coli] [DE:HYPOTHETICAL
39.8 KD PROTEIN IN PEPA-GNTV INTERGENIC REGION (O361)] [SP:P39341] [DB:swissprot]
>sp:[LN:S56488] [AC:S56488:A65239] [PN:hypothetical 39.8K protein (pepa-gntv
intergenic region):hypothetical protein o361] [GN:yjgQ] [OR:Escherichia coli]
[DB:pir2] >gp:[GI:g537104] [LN:ECOUW93] [AC:U14003] [OR:Escherichia coli]
[DB:genpept-bct1] [DE:Escherichia coli K-12 chromosomal region from 92.8 to 00.1
minutes.] [NT:ORF_o361] [LE:178150] [RE:179235] [DI:direct] >gp:[GI:g1790713]
[LN:AE000497] [AC:AE000497:U00096] [PN:orf, hypothetical protein] [GN:yjgQ]
[FN:orf; Unknown] [OR:Escherichia coli] [DB:genpept-bct2] [DE:Escherichia coli
K-12 MG1655 section 387 of 400 of the completegenome.] [NT:o361; 100 pct
identical amino acid sequence and] [LE:1293] [RE:2378] [DI:direct]

| ORF Name | NT ID | AA ID | NT/LN | AA/LN | Score | P-value |
|---|---|---|---|---|---|---|
| 26369002_f3_1125 | 1655 | 8826 | 597 | 198 | | |

Description

NO-HIT

| ORF Name | NT ID | AA ID | NT/LN | AA/LN | Score | P-value |
|---|---|---|---|---|---|---|
| 26426561_f2_646 | 1656 | 8827 | 1047 | 348 | 1393 | 2.0e-142 |

Description gp:[GI:e1389909:g4456867] [LN:STY224978] [AC:AJ224978] [GN:ORF 319]
[OR:Salmonella typhimurium] [DB:genpept-bct1] [DE:Salmonella typhimurium,
Salmonella Pathogenicity Island 2 (SPI2)genes, ttr gene cluster.] [LE:945]
[RE:1904] [DI:direct]

| ORF Name | NT ID | AA ID | NT/LN | AA/LN | Score | P-value |
|---|---|---|---|---|---|---|
| 267318_c2_1871 | 1657 | 8828 | 456 | 151 | 529 | 7.3e-51 |

Description sp:[LN:YFJX_ECOLI] [AC:P52139] [GN:YFJX] [OR:Escherichia coli] [DE:HYPOTHETICAL
17.3 KD PROTEIN IN ALPA-GABD INTERGENIC REGION (O152)] [SP:P52139] [DB:swissprot]
>sp:[LN:E65043] [AC:E65043:T08654] [PN:yfjX protein] [GN:yfjX] [CL:klcA protein]
[OR:Escherichia coli] [DB:pir2] [MP:57 min] >gp:[GI:d1017243:g1800033]
[LN:D90889] [AC:D90889:AB001340] [GN:yfjX] [OR:Escherichia coli] [SR:Escherichia
coli (strain:K12) DNA, clone_lib:Kohara lambda minise] [DB:genpept-bct1]
[DE:E.coli genomic DNA, Kohara clone #442(59.7-60.0 min.).] [NT:similar to
[SwissProt Accession Number P52139]] [LE:3910] [RE:4368] [DI:direct]
>gp:[GI:g1033137] [LN:ECU36840] [AC:U36840] [OR:Escherichia coli]
[DB:genpept-bct1] [DE:Escherichia coli K-12 genome, approximately 57 minutes.]
[NT:ORF_o152] [LE:24874] [RE:25332] [DI:direct] >gp:[GI:g1788996] [LN:AE000349]
[AC:AE000349:U00096] [PN:orf, hypothetical protein] [GN:yfjX] [FN:orf; Unknown]
[OR:Escherichia coli] [DB:genpept-bct2] [DE:Escherichia coli K-12 MG1655 section
239 of 400 of the completegenome.] [NT:o152; This 152 aa ORF is 25 pct identical
(1 gap)] [LE:8420] [RE:8878] [DI:direct]

| ORF Name | NT ID | AA ID | NT/LN | AA/LN | Score | P-value |
|---|---|---|---|---|---|---|
| 26745656_c3_2138 | 1658 | 8829 | 225 | 74 | 344 | 2.9e-31 |

Description sp:[LN:D65233] [AC:D65233:S56442] [PN:hypothetical 9.6 kD protein in cysq-msrA
intergenic region:hypothetical protein o81] [GN:ytfK] [OR:Escherichia coli]
[DB:pir2] >gp:[GI:g537058] [LN:ECOUW93] [AC:U14003] [OR:Escherichia coli]
[DB:genpept-bct1] [DE:Escherichia coli K-12 chromosomal region from 92.8 to 00.1
minutes.] [NT:ORF_o81] [LE:130379] [RE:130624] [DI:direct] >gp:[GI:g1790663]
[LN:AE000493] [AC:AE000493:U00096] [PN:orf, hypothetical protein] [GN:ytfK]
[FN:orf; Unknown] [OR:Escherichia coli] [DB:genpept-bct2] [DE:Escherichia coli
K-12 MG1655 section 383 of 400 of the completegenome.] [NT:o81; 100 pct identical
amino acid sequence and] [LE:1996] [RE:2241] [DI:direct]

| ORF Name | NT ID | AA ID | NT/LN | AA/LN | Score | P-value |
|---|---|---|---|---|---|---|
| 26758337_f3_912 | 1659 | 8830 | 1500 | 499 | 1796 | 4.0e-185 |

Description sp:[LN:YAAJ_ECOLI] [AC:P30143] [GN:YAAJ] [OR:Escherichia coli] [DE:HYPOTHETICAL 51.7 KD PROTEIN IN THRC-TALB INTERGENIC REGION (ORF8)] [SP:P30143] [DB:swissprot] >sp:[LN:G64720] [AC:G64720] [PN:probable amino acid transport protein yaaJ, sodium-dependent] [GN:yaaJ] [CL:sodium-dependent D-alanine/glycine transport protein] [OR:Escherichia coli] [DB:pir2] >gp:[GI:g1786188] [LN:AE000111] [AC:AE000111:U00096] [PN:inner membrane transport protein] [GN:yaaJ] [FN:putative transport; Transport of small] [OR:Escherichia coli] [DB:genpept-bct2] [DE:Escherichia coli K-12 MG1655 section 1 of 400 of the completegenome.] [NT:f476; 100 pct identical to YAAJ_ECOLI SW: P30143] [LE:6529] [RE:7959] [DI:complement]

| ORF Name | NT ID | AA ID | NT/LN | AA/LN | Score | P-value |
|---|---|---|---|---|---|---|
| 26760455_c2_1807 | 1660 | 8831 | 828 | 275 | 631 | 1.1e-61 |

Description sp:[LN:IOLB_BACSU] [AC:P42413] [GN:IOLB:E83B] [OR:Bacillus subtilis] [DE:IOLB PROTEIN] [SP:P42413] [DB:swissprot] >sp:[LN:B69645] [AC:B69645] [PN:myo-inositol catabolism iolB] [GN:iolB] [OR:Bacillus subtilis] [DB:pir2] >gp:[GI:d1003801:g709982] [LN:BACIOLO] [AC:D14399] [PN:hypothetical protein] [GN:E83B] [OR:Bacillus subtilis] [SR:Bacillus subtilis (strain:BGSC 1A1 (168 trpC2)) DNA] [DB:genpept-bct1] [DE:Bacillus subtilis 15 kb chromosome segment contains the iol operon.] [LE:1331] [RE:2146] [DI:direct] >gp:[GI:e1184700:g2636521] [LN:BSUB0021] [AC:Z99124:AL009126] [GN:iolB] [OR:Bacillus subtilis] [DB:genpept-bct1] [DE:Bacillus subtilis complete genome (section 21 of 21): from 3999281to 4214814.] [NT:alternate gene name: yxdB; myo-inositol catabolism] [SP:P42413] [LE:81543] [RE:82358] [DI:complement]

| ORF Name | NT ID | AA ID | NT/LN | AA/LN | Score | P-value |
|---|---|---|---|---|---|---|
| 26769753_c2_2044 | 1661 | 8832 | 315 | 104 | 105 | 1.1e-05 |

Description gp:[GI:d1001576:g912433] [LN:ECOALVB] [AC:D10264] [PN:ORF3] [OR:Escherichia coli] [SR:Escherichia coli (strain:K-12, sub_strain:C600) DNA] [DB:genpept-bct1] [DE:Escherichia coli hem genes for delta-aminolevulinate synthase,5-aminolevulinate synthase and ORF, complete cds.] [LE:1159] [RE:1770] [DI:direct]

| ORF Name | NT ID | AA ID | NT LN | AA LN | Score | P-value |
|---|---|---|---|---|---|---|
| 26770031_c3_2150 | 1662 | 8833 | 975 | 324 | 1491 | 8.4e-153 |

Description sp:[LN:YTFQ_ECOLI] [AC:P39325] [GN:YTFQ] [OR:Escherichia coli] [DE:ABC
TRANSPORTER PERIPLASMIC BINDING PROTEIN YTFQ PRECURSOR] [SP:P39325]
[DB:swissprot] >sp:[LN:S56453] [AC:S56453:F65234] [PN:hypothetical 32.1K protein
(ppa-fbp intergenic region) precursor (o318)] [GN:ytfQ] [OR:Escherichia coli]
[DB:pir2] >gp:[GI:g537069] [LN:ECOUW93] [AC:U14003] [OR:Escherichia coli]
[DB:genpept-bct1] [DE:Escherichia coli K-12 chromosomal region from 92.8 to 00.1
minutes.] [NT:ORF_o318] [LE:140794] [RE:141750] [DI:direct] >gp:[GI:g1790674]
[LN:AE000494] [AC:AE000494:U00096] [PN:putative LACI-type transcriptional
regulator] [GN:ytfQ] [FN:putative regulator; Not classified] [OR:Escherichia
coli] [DB:genpept-bct2] [DE:Escherichia coli K-12 MG1655 section 384 of 400 of
the completegenome.] [NT:o318; 100 pct identical amino acid sequence and]
[LE:1649] [RE:2605] [DI:direct]

| ORF Name | NT ID | AA ID | NT LN | AA LN | Score | P-value |
|---|---|---|---|---|---|---|
| 26770312_c3_2436 | 1663 | 8834 | 639 | 212 | 558 | 6.2e-54 |

Description sp:[LN:OSMY_ECOLI] [AC:P27291] [GN:OSMY] [OR:Escherichia coli] [DE:OSMOTICALLY
INDUCIBLE PROTEIN Y PRECURSOR] [SP:P27291] [DB:swissprot] >sp:[LN:A41899]
[AC:A41899:S56600:A49909:G65252] [PN:hyperosmotically inducible periplasmic
protein osmY:csi-5] [GN:osmY] [OR:Escherichia coli] [DB:pir2] >gp:[GI:g147148]
[LN:ECOPERPLAS] [AC:M89635] [PN:periplasmic protein] [OR:Escherichia coli]
[SR:Escherichia coli (strain K-12) DNA] [DB:genpept-bct1] [DE:Escherichia coli
K-12 periplasmic protein gene, complete cds.] [NT:Hyperosmotically induced
periplasmic protein with] [LE:366] [RE:971] [DI:direct] >gp:[GI:g537216]
[LN:ECOUW93] [AC:U14003] [PN:periplasmic protein] [GN:osmY] [OR:Escherichia coli]
[DB:genpept-bct1] [DE:Escherichia coli K-12 chromosomal region from 92.8 to 00.1
minutes.] [LE:302227] [RE:302832] [DI:direct] >gp:[GI:g1790836] [LN:AE000508]
[AC:AE000508:U00096] [PN:hyperosmotically inducible periplasmic protein]
[GN:osmY] [FN:phenotype; Osmotic adaptation] [OR:Escherichia coli]
[DB:genpept-bct2] [DE:Escherichia coli K-12 MG1655 section 398 of 400 of the
completegenome.] [NT:o201; 100 pct identical amino acid sequence and] [LE:2044]
[RE:2649] [DI:direct]

| ORF Name | NT ID | AA ID | NT LN | AA LN | Score | P-value |
|---|---|---|---|---|---|---|
| 26814505_c3_2268 | 1664 | 8835 | 600 | 199 | 402 | 2.1e-37 |

Description sp:[LN:YKFB_ECOLI] [AC:P77162] [GN:YKFB] [OR:Escherichia coli] [DE:HYPOTHETICAL
17.0 KD PROTEIN IN PROA-PERR INTERGENIC REGION PRECURSOR] [SP:P77162]
[DB:swissprot] >sp:[LN:B64750] [AC:B64750] [PN:ykfB protein] [GN:ykfB]
[OR:Escherichia coli] [DB:pir2] >gp:[GI:d1041687;g4902985] [LN:ECOTSF]
[AC:D83536] [PN:Hypothetical 17.1 kd protein in alpA-gabD] [GN:yfjT]
[OR:Escherichia coli] [SR:Escherichia coli (strain:K12) DNA] [DB:genpept-bct1]
[DE:Escherichia coli genomic DNA. (4.1 - 6.1 min).] [NT:ORF_ID:o128#11; similar
to SwissProt Accession] [LE:74362] [RE:74829] [DI:complement] >gp:[GI:g1552817]
[LN:ECU70214] [AC:U70214] [OR:Escherichia coli] [DB:genpept-bct1] [DE:Escherichia
coli chromosome minutes 4-6.] [NT:similar to E. coli ORF_o155] [LE:95919]
[RE:96386] [DI:complement] >gp:[GI:g1786444] [LN:AE000133] [AC:AE000133:U00096]
[PN:orf, hypothetical protein] [GN:ykfB] [FN:orf; Unknown] [OR:Escherichia coli]
[DB:genpept-bct2] [DE:Escherichia coli K-12 MG1655 section 23 of 400 of the
completegenome.] [NT:f155; 24 pct identical (11 gaps) to 128 residues] [LE:1414]
[RE:1881] [DI:complement]

| ORF Name | NT ID | AA ID | NT LN | AA LN | Score | P-value |
|---|---|---|---|---|---|---|
| 26833187_f2_809 | 1665 | 8836 | 1017 | 338 | 1672 | 5.5e-172 |

Description sp:[LN:F16P_ECOLI] [AC:P09200] [GN:FBP:FDP] [OR:Escherichia coli] [EC:3.1.3.11]
[DE:1-PHOSPHOHYDROLASE) (FBPASE)] [SP:P09200] [DB:swissprot] >sp:[LN:PAEC]
[AC:S01383:B24242:S56458:C65235]
[PN:fructose-bisphosphatase,:fructose-1,6-bisphosphatase] [GN:fbp]
[CL:fructose-bisphosphatase] [OR:Escherichia coli] [EC:3.1.3.11] [DB:pir1]
>gp:[GI:g41416] [LN:ECFBPASE] [AC:X12545] [OR:Escherichia coli] [DB:genpept-bct1]
[DE:E.coli mRNA for fructose-1,6-bisphosphatase (EC 3.1.3.11).]
[NT:fructose-1,6-bisphosphatase (AA 1-332)] [SP:P09200] [LE:353] [RE:1351]
[DI:direct] >gp:[GI:g537074] [LN:ECOUW93] [AC:U14003]
[PN:fructose-1,6-bisphosphatase] [GN:fbp] [OR:Escherichia coli] [DB:genpept-bct1]
[EC:3.1.3.11] [DE:Escherichia coli K-12 chromosomal region from 92.8 to 00.1
minutes.] [NT:CG Site No. 784; alternate gene name fdp] [LE:145440] [RE:146438]
[DI:complement] >gp:[GI:g1790679] [LN:AE000494] [AC:AE000494:U00096]
[PN:fructose-bisphosphatase] [GN:fbp] [FN:enzyme; Central intermediary
metabolism:] [OR:Escherichia coli] [DB:genpept-bct2] [EC:3.1.3.11]
[DE:Escherichia coli K-12 MG1655 section 384 of 400 of the completegenome.]
[NT:f332; 100 pct identical to F16P_ECOLI SW: P09200;] [LE:6295] [RE:7293]
[DI:complement]

| ORF Name | NT ID | AA ID | NT LN | AA LN | Score | P-value |
|---|---|---|---|---|---|---|
| 26833558_c2_1960 | 1666 | 8837 | 945 | 314 | 1003 | 4.3e-101 |

Description sp:[LN:YFCI_ECOLI] [AC:P77768] [GN:YFCI] [OR:Escherichia coli] [DE:HYPOTHETICAL 34.2 KD PROTEIN IN FOLX-HISP INTERGENIC REGION] [SP:P77768] [DB:swissprot] >sp:[LN:G65002] [AC:G65002] [PN:hypothetical protein b2305] [OR:Escherichia coli] [DB:pir2] >gp:[GI:d1016870:g1799676] [LN:D90861] [AC:D90861:AB001340] [GN:yhgA] [OR:Escherichia coli] [SR:Escherichia coli (strain:K12) DNA, clone_lib:Kohara lambda minise] [DB:genpept-bct1] [DE:E.coli genomic DNA, Kohara clone #405(52.0-52.3 min.).] [NT:similar to [SwissProt Accession Number P31667]] [LE:12638] [RE:13528] [DI:complement] >gp:[GI:d1016879:g1799686] [LN:D90862] [AC:D90862:AB001340] [GN:yhgA] [OR:Escherichia coli] [SR:Escherichia coli (strain:K12) DNA, clone_lib:Kohara lambda minise] [DB:genpept-bct1] [DE:E.coli genomic DNA, Kohara clone #406(52.2-52.5 min.).] [NT:similar to [SwissProt Accession Number P31667]] [LE:6226] [RE:7116] [DI:complement] >gp:[GI:g1788643] [LN:AE000319] [AC:AE000319:U00096] [PN:orf, hypothetical protein] [GN:yfcI] [FN:orf; Unknown] [OR:Escherichia coli] [DB:genpept-bct2] [DE:Escherichia coli K-12 MG1655 section 209 of 400 of the completegenome.] [NT:f296; This 296 aa ORF is 66 pct identical (4 gaps)] [LE:7970] [RE:8860] [DI:complement]

| ORF Name | NT ID | AA ID | NT LN | AA LN | Score | P-value |
|---|---|---|---|---|---|---|
| 270166_c3_2481 | 1667 | 8838 | 612 | 203 | 911 | 2.4e-91 |

Description sp:[LN:MOG_ECOLI] [AC:P28694] [GN:MOG:CHLG] [OR:Escherichia coli] [DE:MOLYBDOPTERIN BIOSYNTHESIS MOG PROTEIN] [SP:P28694] [DB:swissprot] >sp:[LN:B56688] [AC:B56688:A64721:S28458] [PN:molybdopterin biosynthesis protein mog] [GN:mog] [OR:Escherichia coli] [DB:pir2] >gp:[GI:g41755] [LN:ECHTGA] [AC:X67700] [OR:Escherichia coli] [DB:genpept-bct1] [DE:E.coli dnaK and htgA genes.] [NT:ORF1] [SP:P28694] [LE:395] [RE:982] [DI:direct] >gp:[GI:g1786190] [LN:AE000111] [AC:AE000111:U00096] [PN:required for the efficient incorporation of] [GN:mog] [FN:transport; Biosynthesis of cofactors, carriers:] [OR:Escherichia coli] [DB:genpept-bct2] [DE:Escherichia coli K-12 MG1655 section 1 of 400 of the completegenome.] [NT:o195; 100 pct identical to MOG_ECOLI SW: P28694] [LE:9306] [RE:9893] [DI:direct]

| ORF Name | NT ID | AA ID | NT LN | AA LN | Score | P-value |
|---|---|---|---|---|---|---|
| 2751025_c1_1542 | 1668 | 8839 | 1548 | 515 | 883 | 2.2e-88 |

Description sp:[LN:H69689] [AC:H69689:I40465:S42713] [PN:ribose ABC transporter (ATP-binding protein) rbsA] [GN:rbsA] [CL:unassigned ATP-binding cassette proteins:ATP-binding cassette homology] [OR:Bacillus subtilis] [DB:pir2] >gp:[GI:e1184500:g2636119] [LN:BSUB0019] [AC:Z99122:AL009126] [PN:ribose ABC transporter (ATP-binding protein)] [GN:rbsA] [FN:ribose transport] [OR:Bacillus subtilis] [DB:genpept-bct1] [DE:Bacillus subtilis complete genome (section 19 of 21): from 3597091to 3809700.] [LE:105649] [RE:107130] [DI:direct] >gp:[GI:e308083:g1894759] [LN:BSZ92953] [AC:Z92953] [PN:ATP-binding transport protein] [GN:rbsA] [OR:Bacillus subtilis] [DB:genpept-bct1] [DE:B.subtilis yws[A,B,C] genes and rbs[A,C,D,K,R] genes.] [NT:part of the ribose transport operon] [LE:2888] [RE:4369] [DI:complement]

| ORF Name | NT ID | AA ID | NT LN | AA LN | Score | P-value |
|---|---|---|---|---|---|---|
| 275252_c2_1748 | 1669 | 8840 | 3780 | 1259 | 5395 | 0.0 |

Description sp:[LN:YTFN_ECOLI] [AC:P39321:P39322:P76802] [GN:YTFN] [OR:Escherichia coli] [DE:HYPOTHETICAL 136.8 KD PROTEIN IN MSRA-CHPB INTERGENIC REGION] [SP:P39321:P39322:P76802] [DB:swissprot] >sp:[LN:H65233] [AC:H65233:S56447:S56446] [PN:ytfN protein] [GN:ytfN] [CL:ytfN protein] [OR:Escherichia coli] [DB:pir2] >gp:[GI:g1790667] [LN:AE000493] [AC:AE000493:U00096] [PN:orf, hypothetical protein] [GN:ytfN] [FN:orf; Unknown] [OR:Escherichia coli] [DB:genpept-bct2] [DE:Escherichia coli K-12 MG1655 section 383 of 400 of the completegenome.] [NT:o1259; N-ter of this 492 aa ORF is 100 pct] [LE:6560] [RE:10339] [DI:direct]

| ORF Name | NT ID | AA ID | NT LN | AA LN | Score | P-value |
|---|---|---|---|---|---|---|
| 2859702_c1_1312 | 1670 | 8841 | 717 | 238 | 704 | 2.1e-69 |

Description sp:[LN:YJFP_ECOLI] [AC:P39298] [GN:YJFP] [OR:Escherichia coli] [DE:HYPOTHETICAL 27.6 KD PROTEIN IN AIDB-SGAT INTERGENIC REGION] [SP:P39298] [DB:swissprot] >sp:[LN:S56415] [AC:S56415:A65230] [PN:hypothetical 27.6K protein (aidB-rpsF intergenic region):hypothetical protein o249] [GN:yjfP] [OR:Escherichia coli] [DB:pir2] >gp:[GI:g537031] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_o249] [LE:107784] [RE:108533] [DI:direct] >gp:[GI:g1790634] [LN:AE000491] [AC:AE000491:U00096] [PN:orf, hypothetical protein] [GN:yjfP] [FN:orf; Unknown] [OR:Escherichia coli] [DB:genpept-bct2] [DE:Escherichia coli K-12 MG1655 section 381 of 400 of the completegenome.] [NT:o249; 100 pct identical amino acid sequence and] [LE:618] [RE:1367] [DI:direct]

| ORF Name | NT ID | AA ID | NT LN | AA LN | Score | P-value |
|---|---|---|---|---|---|---|
| 287961_c3_2187 | 1671 | 8842 | 2775 | 924 | 4078 | 0.0 |

Description sp:[LN:ATMA_SALTY] [AC:P36640] [GN:MGTA] [OR:Salmonella typhimurium] [EC:3.6.1.-]
[DE:MG(2+) TRANSPORT ATPASE, P-TYPE 1,] [SP:P36640] [DB:swissprot]
>sp:[LN:B57147] [AC:B57147] [PN:Mg2+-transporting ATPase, mgtA, P-type]
[CL:Na+/K+-transporting ATPase alpha chain:ATPase nucleotide-binding domain
homology] [OR:Salmonella typhimurium] [EC:3.6.1.-] [DB:pir2] >gp:[GI:g468207]
[LN:STU07843] [AC:U07843] [GN:mgtA] [PN:Mg2+ transport] [OR:Salmonella
typhimurium] [DB:genpept-bct1] [DE:Salmonella typhimurium treR gene, complete
cds, and mgtA gene, complete cds.] [NT:Submitter comments: A Mg2+ transporting
P-type] [LE:1806] [RE:4514] [DI:direct]

| ORF Name | NT ID | AA ID | NT LN | AA LN | Score | P-value |
|---|---|---|---|---|---|---|
| 2917812_c2_2039 | 1672 | 8843 | 1725 | 574 | 146 | 1.6e-07 |

Description sp:[LN:JQ0133] [AC:JQ0133] [PN:hypothetical 26.4K protein] [OR:Pseudomonas
aeruginosa] [DB:pir2]

| ORF Name | NT ID | AA ID | NT LN | AA LN | Score | P-value |
|---|---|---|---|---|---|---|
| 29297080_c2_2032 | 1673 | 8844 | 1260 | 419 | 2076 | 8.5e-215 |

Description sp:[LN:DEOB_ECOLI] [AC:P07651] [GN:DEOB:DRM:THYR] [OR:Escherichia coli]
[EC:5.4.2.7] [DE:PHOSPHOPENTOMUTASE, (PHOSPHODEOXYRIBOMUTASE)] [SP:P07651]
[DB:swissprot] >sp:[LN:S56607] [AC:S56607:B22909:F65253] [PN:phosphopentomutase,]
[GN:deoB] [CL:phosphopentomutase] [OR:Escherichia coli] [EC:5.4.2.7] [DB:pir2]
[MP:100 min] >gp:[GI:g537223] [LN:ECOUW93] [AC:U14003] [PN:phosphopentomutase]
[GN:deoB] [OR:Escherichia coli] [DB:genpept-bct1] [EC:2.7.5.6] [DE:Escherichia
coli K-12 chromosomal region from 92.8 to 00.1 minutes.] [NT:CG Site No. 867;
alternate gene names drm, thyR] [LE:310434] [RE:311657] [DI:direct]
>gp:[GI:g1790843] [LN:AE000508] [AC:AE000508:U00096] [PN:phosphopentomutase]
[GN:deoB] [FN:enzyme; Salvage of nucleosides and nucleotides] [OR:Escherichia
coli] [DB:genpept-bct2] [EC:5.4.2.7] [DE:Escherichia coli K-12 MG1655 section 398
of 400 of the completegenome.] [NT:o407; 100 pct identical to DEOB_ECOLI SW:
P07651;] [LE:10251] [RE:11474] [DI:direct]

| ORF Name | NT ID | AA ID | NT/LN | AA/LN | Score | P-value |
|---|---|---|---|---|---|---|
| 2931510_f2_847 | 1674 | 8845 | 279 | 92 | 282 | 1.1e-24 |

Description sp:[LN:YJFY_ECOLI] [AC:P39307] [GN:YJFY] [OR:Escherichia coli] [DE:HYPOTHETICAL
10.1 KD PROTEIN IN SGAE-RPSF INTERGENIC REGION PRECURSOR] [SP:P39307]
[DB:swissprot] >sp:[LN:S56424] [AC:S56424:B65231] [PN:hypothetical 10.1 kD
protein in aidB-rpsF intergenic region:hypothetical protein f91] [GN:yjfY]
[OR:Escherichia coli] [DB:pir2] >gp:[GI:g537040] [LN:ECOUW93] [AC:U14003]
[OR:Escherichia coli] [DB:genpept-bct1] [DE:Escherichia coli K-12 chromosomal
region from 92.8 to 00.1 minutes.] [NT:ORF_f91] [LE:115348] [RE:115623]
[DI:complement] >gp:[GI:g1790643] [LN:AE000491] [AC:AE000491:U00096] [PN:orf,
hypothetical protein] [GN:yjfY] [FN:orf; Unknown] [OR:Escherichia coli]
[DB:genpept-bct2] [DE:Escherichia coli K-12 MG1655 section 381 of 400 of the
completegenome.] [NT:f91; 100 pct identical amino acid sequence and] [LE:8182]
[RE:8457] [DI:complement]

| ORF Name | NT ID | AA ID | NT/LN | AA/LN | Score | P-value |
|---|---|---|---|---|---|---|
| 2931556_c1_1669 | 1675 | 8846 | 1284 | 427 | 2014 | 3.2e-208 |

Description sp:[LN:THRC_ECOLI] [AC:P00934] [GN:THRC] [OR:Escherichia coli] [EC:4.2.99.2]
[DE:THREONINE SYNTHASE,] [SP:P00934] [DB:swissprot] >sp:[LN:SYECR]
[AC:A01157:S40533:S56631:D64720] [PN:threonine synthase,] [GN:thrC] [CL:threonine
synthase] [OR:Escherichia coli] [EC:4.2.99.2] [DB:pir1] [MP:0 min]
>gp:[GI:d1001760:g216437] [LN:ECO110K]
[AC:D10483:J01597:J01683:J01706:K01298:K01990:M10420:M10611:M12544] [PN:threonine
synthase] [GN:thrC] [OR:Escherichia coli] [SR:Escherichia coli (strain:K-12) DNA]
[DB:genpept-bct1] [EC:4.2.99.2] [DE:E.coli K12 genome, 0-2.4min. region.]
[LE:3395] [RE:4681] [DI:direct] >gp:[GI:g147981] [LN:ECOTHR]
[AC:J01706:J01707:J01708:J01709:V00360:X00092] [PN:threonine synthase] [GN:thrC]
[OR:Escherichia coli] [SR:Escherichia coli (strain K-12) (clone: pIP2.) DNA]
[DB:genpept-bct1] [EC:4.2.99.2] [DE:E.coli threonine operon with thrA, thrB and
thrC genes coding forasparokinase I-homoserine dehydrogenase I, homoserine
kinase andthreonine synthase.] [LE:3591] [RE:4877] [DI:direct] >gp:[GI:g537247]
[LN:ECOUW93] [AC:U14003] [PN:threonine synthase] [OR:Escherichia coli]
[DB:genpept-bct1] [EC:4.2.99.2] [DE:Escherichia coli K-12 chromosomal region from
92.8 to 00.1 minutes.] [NT:CG Site No. 109] [LE:336219] [RE:337505] [DI:direct]
>gp:[GI:g1786185] [LN:AE000111] [AC:AE000111:U00096] [PN:threonine synthase]
[GN:thrC] [FN:enzyme; Amino acid biosynthesis: Threonine] [OR:Escherichia coli]
[DB:genpept-bct2] [EC:4.2.99.2] [DE:Escherichia coli K-12 MG1655 section 1 of 400
of the completegenome.] [NT:o428; 100 pct identical to THRC_ECOLI SW: P00934;]
[LE:3734] [RE:5020] [DI:direct]

| ORF Name | NT ID | AA ID | NT/LN | AA/LN | Score | P-value |
|---|---|---|---|---|---|---|
| 29348506_f3_1300 | 1676 | 8847 | 570 | 190 | 155 | 3.1e-11 |

Description sp:[LN:T2_MOUSE] [AC:Q06666] [GN:SRST:T2] [OR:Mus musculus] [SR:,Mouse]
[DE:OCTAPEPTIDE-REPEAT PROTEIN T2] [SP:Q06666] [DB:swissprot] >sp:[LN:S71512]
[AC:S71512] [PN:hypothetical protein T2] [OR:Mus musculus] [SR:, house mouse]
[DB:pir2] >gp:[GI:g296382] [LN:MMT2] [AC:X67863:S50883] [GN:T2] [OR:Mus musculus]
[SR:house mouse] [DB:genpept-rod] [DE:M.musculus T2 mRNA.] [SP:Q06666] [LE:175]
[RE:732] [DI:direct]

| ORF Name | NT ID | AA ID | NT/LN | AA/LN | Score | P-value |
|---|---|---|---|---|---|---|
| 29469208_f3_1106 | 1677 | 8848 | 288 | 95 | | |

Description

NO-HIT

| ORF Name | NT ID | AA ID | NT/LN | AA/LN | Score | P-value |
|---|---|---|---|---|---|---|
| 29708518_f1_149 | 1678 | 8849 | 696 | 231 | 207 | 9.7e-17 |

Description sp:[LN:RHTC_ECOLI] [AC:P27846] [GN:RHTC] [OR:Escherichia coli] [DE:THREONINE
EFFLUX PROTEIN] [SP:P27846] [DB:swissprot]

| ORF Name | NT ID | AA ID | NT/LN | AA/LN | Score | P-value |
|---|---|---|---|---|---|---|
| 29730066_c2_1994 | 1679 | 8850 | 2898 | 965 | 881 | 3.7e-88 |

Description sp:[LN:LEVR_BACSU] [AC:P23914] [GN:LEVR] [OR:Bacillus subtilis]
[DE:TRANSCRIPTIONAL REGULATORY PROTEIN LEVR] [SP:P23914] [DB:swissprot]
>sp:[LN:A39160] [AC:A39160:A69651] [PN:transcription activator of levanase operon
levR] [GN:levR] [CL:RNA polymerase sigma factor interaction domain homology]
[OR:Bacillus subtilis] [DB:pir2] >gp:[GI:g143150] [LN:BACLEVRA] [AC:M60105]
[GN:levR] [OR:Bacillus subtilis] [SR:B.subtilis (168 Marburg) DNA]
[DB:genpept-bct1] [DE:Bacillus subtilis levR gene, complete cds.] [LE:49]
[RE:2865] [DI:direct] >gp:[GI:e209878:g2108261] [LN:BS233DEG] [AC:X92868:X79978]
[PN:transcriptional regulatory protein] [GN:levR] [OR:Bacillus subtilis]
[DB:genpept-bct1] [DE:B.subtilis 23.9kb fragment from map position 233 degrees on
thechromosome.] [SP:P23914] [LE:2472] [RE:5288] [DI:direct]
>gp:[GI:e1183938:g2635154] [LN:BSUB0014] [AC:Z99117:AL009126] [PN:transcriptional
regulator (NifA/NtrC family)] [GN:levR] [FN:positive regulation of the levanase
operon] [OR:Bacillus subtilis] [DB:genpept-bct1] [DE:Bacillus subtilis complete
genome (section 14 of 21): from 2599451to 2812870.] [SP:P23914] [LE:162843]
[RE:165659] [DI:complement]

| ORF Name | NT ID | AA ID | NT/LN | AA/LN | Score | P-value |
|---|---|---|---|---|---|---|
| 29770766_c1_1687 | 1680 | 8851 | 324 | 107 | 280 | 1.8e-24 |

Description sp:[LN:NHAA_ECOLI] [AC:P13738] [GN:NHAA:ANT] [OR:Escherichia coli] [DE:NA(+)/H(+) ANTIPORTER 1] [SP:P13738] [DB:swissprot] >sp:[LN:C64722] [AC:C64722:A41201:S40541:A28800] [PN:Na+/H+-exchanging protein nhaA:Na+/H+ antiporter] [GN:nhaA:ant] [CL:Na+/H+-exchanging protein nhaA] [OR:Escherichia coli] [DB:pir2] [MP:0 min] >gp:[GI:g1786201] [LN:AE000112] [AC:AE000112:U00096] [PN:Na+/H antiporter, pH dependent] [GN:nhaA] [FN:transport; Transport of small molecules:] [OR:Escherichia coli] [DB:genpept-bct2] [DE:Escherichia coli K-12 MG1655 section 2 of 400 of the completegenome.] [NT:o388; 100 pct identical to NHAA_ECOLI SW: P13738] [LE:6951] [RE:8117] [DI:direct]

| ORF Name | NT ID | AA ID | NT/LN | AA/LN | Score | P-value |
|---|---|---|---|---|---|---|
| 29786391_f3_906 | 1681 | 8852 | 777 | 258 | 807 | 2.5e-80 |

Description sp:[LN:C64721] [AC:C64721:D56688:S28462] [PN:hypothetical protein b0011] [OR:Escherichia coli] [DB:pir2] >gp:[GI:g1786193] [LN:AE000112] [AC:AE000112:U00096] [PN:putative oxidoreductase] [GN:b0011] [FN:putative enzyme; Not classified] [OR:Escherichia coli] [DB:genpept-bct2] [DE:Escherichia coli K-12 MG1655 section 2 of 400 of the completegenome.] [NT:f237; 99 pct identical to PIR: D56688; overlaps] [LE:105] [RE:818] [DI:complement]

| ORF Name | NT ID | AA ID | NT/LN | AA/LN | Score | P-value |
|---|---|---|---|---|---|---|
| 29859652_c1_1452 | 1682 | 8853 | 234 | 77 | | |

Description

NO-HIT

| ORF_Name | NT_ID | AA_ID | NT/LN | AA/LN | Score | P-value |
|---|---|---|---|---|---|---|
| 29932668_c3_2093 | 1683 | 8854 | 1356 | 451 | 2018 | 1.2e-208 |

Description sp:[LN:HFLX_ECOLI] [AC:P25519] [GN:HFLX] [OR:Escherichia coli] [DE:GTP-BINDING PROTEIN HFLX] [SP:P25519] [DB:swissprot] >sp:[LN:S56398] [AC:S56398;A43653:S26834:H65227] [PN:probable GTP-binding protein hflX] [GN:hflX] [CL:GTP-binding protein hflX:translation elongation factor Tu homology] [OR:Escherichia coli] [DB:pir2] >gp:[GI:g537014] [LN:ECOUW93] [AC:U14003] [GN:hflX] [OR:Escherichia coli] [DB:genpept-bct1] [DE:Escherichia coli K-12 chromosomal region from 92.8 to 00.1 minutes.] [NT:putative GTPase required for high frequency] [LE:91500] [RE:92780] [DI:direct] >gp:[GI:g1790615] [LN:AE000489] [AC:AE000489:U00096] [PN:GTP - binding subunit of protease specific for] [GN:hflX] [FN:enzyme; Degradation of proteins, peptides,] [OR:Escherichia coli] [DB:genpept-bct2] [DE:Escherichia coli K-12 MG1655 section 379 of 400 of the completegenome.] [NT:o426; 100 pct identical to HFLX_ECOLI SW:] [LE:8386] [RE:9666] [DI:direct] >gp:[GI:g436156] [LN:ECOHFLA] [AC:U00005] [GN:hflX] [OR:Escherichia coli] [SR:Escherichia coli K12] [DB:genpept-bct2] [DE:E. coli hflA locus encoding the hflX, hflK and hflC genes, hfqgene, complete cds; miaA gene, partial cds.] [NT:putative GTPase required for high frequency] [LE:1122] [RE:2402] [DI:direct]

| ORF_Name | NT_ID | AA_ID | NT/LN | AA/LN | Score | P-value |
|---|---|---|---|---|---|---|
| 29941531_c1_1536 | 1684 | 8855 | 435 | 144 | 128 | 2.3e-08 |

Description sp:[LN:E72756] [AC:E72756] [PN:hypothetical protein APE0042] [GN:APE0042] [OR:Aeropyrum pernix] [DB:pir2] >gp:[GI:d1042727:g5103430] [LN:AP000058] [AC:AP000058] [PN:110aa long hypothetical protein] [GN:APE0042] [OR:Aeropyrum pernix] [SR:Aeropyrum pernix (strain:K1) DNA] [DB:genpept-bct1] [DE:Aeropyrum pernix genomic DNA, section 1/7.] [NT:similar to OWL:AP000006197 percent identity:37.705] [LE:25576] [RE:25908] [DI:complement]

| ORF_Name | NT_ID | AA_ID | NT/LN | AA/LN | Score | P-value |
|---|---|---|---|---|---|---|
| 29947932_c1_1509 | 1685 | 8856 | 384 | 127 | 93 | 1.4e-06 |

Description gp:[GI:g1947160] [LN:CELW03D2] [AC:AF000298] [GN:W03D2.1] [OR:Caenorhabditis elegans] [SR:Caenorhabditis elegans strain=Bristol N2] [DB:genpept-inv2] [DE:Caenorhabditis elegans cosmid W03D2.] [NT:weak similarity to collagens; glycine- and] [LE:27621:27799:27989:28126] [RE:27740:27942:28069:28218] [DI:directJoin]

| ORF_Name | NT ID | AA ID | NT LN | AA LN | Score | P-value |
|---|---|---|---|---|---|---|
| 30082556_c1_1309 | 1686 | 8857 | 1677 | 558 | 2294 | 6.8e-238 |

Description sp:[LN:AIDB_ECOLI] [AC:P33224:P33223] [GN:AIDB] [OR:Escherichia coli] [DE:AIDB PROTEIN] [SP:P33224:P33223] [DB:swissprot] >gp:[GI:g537028] [LN:ECOUW93] [AC:U14003] [GN:aidB] [OR:Escherichia coli] [DB:genpept-bct1] [DE:Escherichia coli K-12 chromosomal region from 92.8 to 00.1 minutes.] [NT:CG Site No. 18553; induced by alkylating agents; an] [LE:105088] [RE:106728] [DI:direct]
>gp:[GI:g1790630] [LN:AE000490] [AC:AE000490:U00096] [PN:putative acyl coenzyme A dehydrogenase] [GN:aidB] [FN:putative enzyme; Not classified] [OR:Escherichia coli] [DB:genpept-bct2] [DE:Escherichia coli K-12 MG1655 section 380 of 400 of the completegenome.] [NT:o546; 100 pct identical to AIDB_ECOLI SW: P33224;] [LE:9944] [RE:11584] [DI:direct] >gp:[GI:g457172] [LN:ECOAIDB] [AC:L20915] [OR:Escherichia coli] [DB:genpept-bct2] [DE:Escherichia coli (aidB) gene, complete cds.] [NT:putative; homology to acyl CoA dehydrogenases and] [LE:612] [RE:2252] [DI:direct]

| ORF_Name | NT ID | AA ID | NT LN | AA LN | Score | P-value |
|---|---|---|---|---|---|---|
| 30113516_f2_845 | 1687 | 8858 | 225 | 74 | | |

Description

NO-HIT

| ORF_Name | NT ID | AA ID | NT LN | AA LN | Score | P-value |
|---|---|---|---|---|---|---|
| 30135407_c2_1806 | 1688 | 8859 | 1200 | 399 | 1121 | 1.3e-113 |

Description sp:[LN:D70825] [AC:D70825] [PN:probable methylmalonate semialdehyde dehydrogenase] [GN:mmsA] [CL:aldehyde dehydrogenase (NAD+):aldehyde dehydrogenase homology] [OR:Mycobacterium tuberculosis] [DB:pir2] >gp:[GI:e1253291:g2911027] [LN:MTV041] [AC:AL021958:AL123456] [PN:mmsA] [GN:mmsA] [OR:Mycobacterium tuberculosis] [DB:genpept-bct1] [DE:Mycobacterium tuberculosis H37Rv complete genome; segment 35/162.] [NT:Rv0753c, (MTV041.27c), len: 510. mmsA, probable] [LE:22945] [RE:24477] [DI:complement]

| ORF Name | NT ID | AA ID | NT/LN | AA/LN | Score | P-value |
|---|---|---|---|---|---|---|
| 30354702_c2_2036 | 1689 | 8860 | 993 | 330 | 1465 | 4.8e-150 |

Description sp:[LN:SERB_ECOLI] [AC:P06862] [GN:SERB] [OR:Escherichia coli] [EC:3.1.3.3]
[DE:PHOSPHOHYDROLASE)] [SP:P06862] [DB:swissprot] >sp:[LN:PAECS]
[AC:A24271:S56612:C65254] [PN:phosphoserine phosphatase,:O-phosphoserine
phosphohydrolase] [GN:serB] [CL:phosphoserine phosphatase] [OR:Escherichia coli]
[EC:3.1.3.3] [DB:pir1] [MP:100 min] >gp:[GI:g537228] [LN:ECOUW93] [AC:U14003]
[PN:phosphoserine phosphatase] [GN:serB] [OR:Escherichia coli] [DB:genpept-bct1]
[EC:3.1.3.3] [DE:Escherichia coli K-12 chromosomal region from 92.8 to 00.1
minutes.] [NT:CG Site No. 172] [LE:315727] [RE:316695] [DI:direct]
>gp:[GI:g42948] [LN:ECSMP] [AC:X03046:M30784] [PN:phosphoserine phosphatase (EC
3.1.3.3)] [GN:serB] [OR:Escherichia coli] [DB:genpept-bct1] [EC:3.1.3.3]
[DE:E.coli phosphoserine phosphatase (serB) and smp protein genes,complete cds.,
and ORF, 5' end.] [SP:P06862] [LE:61] [RE:1029] [DI:complement] >gp:[GI:g1790849]
[LN:AE000509] [AC:AE000509:U00096] [PN:3-phosphoserine phosphatase] [GN:serB]
[FN:enzyme; Amino acid biosynthesis: Serine] [OR:Escherichia coli]
[DB:genpept-bct2] [EC:3.1.3.3] [DE:Escherichia coli K-12 MG1655 section 399 of
400 of the completegenome.] [NT:o322; 100 pct identical to SERB_ECOLI SW:
P06862;] [LE:83] [RE:1051] [DI:direct]

| ORF Name | NT ID | AA ID | NT/LN | AA/LN | Score | P-value |
|---|---|---|---|---|---|---|
| 30363255_f2_802 | 1690 | 8861 | 276 | 91 | | |

Description

NO-HIT

| ORF Name | NT ID | AA ID | NT/LN | AA/LN | Score | P-value |
|---|---|---|---|---|---|---|
| 30363500_c1_1642 | 1691 | 8862 | 1428 | 475 | 2112 | 1.3e-218 |

Description sp:[LN:TYPH_ECOLI] [AC:P07650] [GN:DEOA:TPP:TTG] [OR:Escherichia coli]
[EC:2.4.2.4] [DE:THYMIDINE PHOSPHORYLASE, (TDRPASE)] [SP:P07650] [DB:swissprot]
>sp:[LN:S56606] [AC:S56606:E65253:A37131:A22909] [PN:thymidine phosphorylase,]
[GN:deoA] [CL:thymidine phosphorylase] [OR:Escherichia coli] [EC:2.4.2.4]
[DB:pir1] [MP:100] >gp:[GI:g537222] [LN:ECOUW93] [AC:U14003] [PN:thymidine
phosphorylase] [GN:deoA] [OR:Escherichia coli] [DB:genpept-bct1] [EC:2.4.2.4]
[DE:Escherichia coli K-12 chromosomal region from 92.8 to 00.1 minutes.] [NT:CG
Site No. 868; alternate gene names tpp, TP; TTG] [LE:309060] [RE:310382]
[DI:direct] >gp:[GI:g1790842] [LN:AE000508] [AC:AE000508:U00096] [PN:thymidine
phosphorylase] [GN:deoA] [FN:enzyme; Salvage of nucleosides and nucleotides]
[OR:Escherichia coli] [DB:genpept-bct2] [EC:2.4.2.4] [DE:Escherichia coli K-12
MG1655 section 398 of 400 of the completegenome.] [NT:o440; 100 pct identical to
TYPH_ECOLI SW: P07650;] [LE:8877] [RE:10199] [DI:direct]

| ORF Name | NT ID | AA ID | NT LN | AA LN | Score | P-value |
|---|---|---|---|---|---|---|
| 30363518_c2_1919 | 1692 | 8863 | 1443 | 480 | 1622 | 1.1e-166 |

Description sp:[LN:YBCZ_ECOLI] [AC:P77485] [GN:YBCZ] [OR:Escherichia coli] [EC:2.7.3.-]
[DE:PROBABLE SENSOR PROTEIN YBCZ,] [SP:P77485] [DB:swissprot] >sp:[LN:H64789]
[AC:H64789] [PN:probable sensor protein ybcZ] [GN:ybcZ] [CL:sensor histidine
kinase homology] [OR:Escherichia coli] [DB:pir2] >gp:[GI:g1778485] [LN:ECU82598]
[AC:U82598] [PN:PcoS homolog] [OR:Escherichia coli] [DB:genpept-bct1]
[DE:Escherichia coli genomic sequence of minutes 9 to 12.] [NT:similar to E. coli
PcoS] [LE:33959] [RE:35401] [DI:complement] >gp:[GI:g1786783] [LN:AE000162]
[AC:AE000162:U00096] [PN:putative 2-component sensor protein] [GN:ybcZ]
[FN:putative regulator; Not classified] [OR:Escherichia coli] [DB:genpept-bct2]
[DE:Escherichia coli K-12 MG1655 section 52 of 400 of the completegenome.]
[NT:f480; This 480 aa ORF is 33 pct identical (22 gaps)] [LE:105] [RE:1547]
[DI:complement]

| ORF Name | NT ID | AA ID | NT LN | AA LN | Score | P-value |
|---|---|---|---|---|---|---|
| 30581526_f3_896 | 1693 | 8864 | 267 | 88 | | |

Description

NO-HIT

| ORF Name | NT ID | AA ID | NT LN | AA LN | Score | P-value |
|---|---|---|---|---|---|---|
| 30753958_f3_1275 | 1694 | 8865 | 270 | 89 | 115 | 1.8e-06 |

Description gp:[GI:g2183261] [LN:AF002133] [AC:AF002133] [PN:MAV264] [GN:mav264]
[OR:Mycobacterium avium] [DB:genpept-bct2] [DE:Mycobacterium avium strain GIR10
transcriptional regulator (mav81)gene, partial cds, aconitase (acn), invasin 1
(inv1), invasin 2(inv2), transcriptional regulator (moxR),
ketoacyl-reductase(fabG), enoyl-reductase (inhA) and ferrochelatase (mav272)
genes,complete cds.] [NT:unknown] [LE:7612] [RE:8406] [DI:complement]

| ORF Name | NT ID | AA ID | NT LN | AA LN | Score | P-value |
|---|---|---|---|---|---|---|
| 31284426_c3_2287 | 1695 | 8866 | 192 | 63 | | |

Description

NO-HIT

| ORF Name | NT ID | AA ID | NT LN | AA LN | Score | P-value |
|---|---|---|---|---|---|---|
| 3130407_c3_2263 | 1696 | 8867 | 291 | 96 | | |

Description

NO-HIT

| ORF Name | NT ID | AA ID | NT LN | AA LN | Score | P-value |
|---|---|---|---|---|---|---|
| 31362760_c1_1697 | 1697 | 8868 | 396 | 131 | 148 | 1.7e-10 |

Description sp:[LN:YHAI_ECOLI] [AC:P42622] [GN:YHAI] [OR:Escherichia coli] [DE:HYPOTHETICAL 13.5 KD PROTEIN IN EXUR-TDCC INTERGENIC REGION] [SP:P42622] [DB:swissprot] >sp:[LN:E65099] [AC:E65099] [PN:hypothetical 13.5 kD protein in exuR-tdcC intergenic region] [GN:yhaI] [OR:Escherichia coli] [DB:pir2] >gp:[GI:g1789491] [LN:AE000392] [AC:AE000392:U00096] [PN:putative cytochrome] [GN:yhaI] [FN:putative carrier; Not classified] [OR:Escherichia coli] [DB:genpept-bct2] [DE:Escherichia coli K-12 MG1655 section 282 of 400 of the completegenome.] [NT:o118; 100 pct identical amino acid sequence and] [LE:4053] [RE:4409] [DI:direct] >gp:[GI:g606045] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_o118] [LE:33664] [RE:34020] [DI:direct]

| ORF Name | NT ID | AA ID | NT LN | AA LN | Score | P-value |
|---|---|---|---|---|---|---|
| 31382017_f2_487 | 1698 | 8869 | 378 | 125 | 112 | 9.9e-06 |

Description sp:[LN:YOR3_GLUSU] [AC:O05543] [OR:Gluconobacter suboxydans] [DE:HYPOTHETICAL PROTEIN IN ADHS 5'REGION (ORF3) (FRAGMENT)] [SP:O05543] [DB:swissprot] >gp:[GI:d1020536:g2055289] [LN:D86440] [AC:D86440] [OR:Gluconobacter suboxydans] [SR:Gluconobacter suboxydans (strain:IFO12528) DNA] [DB:genpept-bct1] [DE:Gluconobacter suboxydans DNA for the smallest subunit precursor ofmembrane-bound alcohol dehydrogenase, complete cds.] [NT:unnamed protein product] [LE:<1] [RE:1337] [DI:direct]

| ORF Name | NT ID | AA ID | NT LN | AA LN | Score | P-value |
|---|---|---|---|---|---|---|
| 31445941_f3_985 | 1699 | 8870 | 555 | 184 | | |

Description

NO-HIT

| ORF Name | NT ID | AA ID | NT LN | AA LN | Score | P-value |
|---|---|---|---|---|---|---|
| 31511540_c1_1447 | 1700 | 8871 | 297 | 98 | 89 | 2.4e-05 |

Description gp:[GI:g3044086] [LN:AF055904] [AC:AF055904] [PN:unknown] [OR:Myxococcus xanthus] [DB:genpept-bct2] [DE:Myxococcus xanthus acetylornithine deacetylase (argE) gene,complete cds; and unknown gene.] [NT:ORF2; no developmental phenotype] [LE:10] [RE:1638] [DI:complement]

| ORF_Name | NT ID | AA ID | NT/LN | AA/LN | Score | P-value |
|---|---|---|---|---|---|---|
| 31648566_f3_1193 | 1701 | 8872 | 960 | 319 | 1349 | 9.3e-138 |

Description sp:[LN:TRER_SALTY] [AC:P36674] [GN:TRER] [OR:Salmonella typhimurium] [DE:TREHALOSE OPERON REPRESSOR] [SP:P36674] [DB:swissprot] >sp:[LN:A57147] [AC:A57147] [PN:regulatory protein treR] [OR:Salmonella typhimurium] [DB:pir2] >gp:[GI:g468206] [LN:STU07843] [AC:U07843] [GN:treR] [FN:trehalose regulation] [OR:Salmonella typhimurium] [DB:genpept-bct1] [DE:Salmonella typhimurium treR gene, complete cds, and mgtA gene,complete cds.] [NT:Submitter comments: Cloned as part of mgtA locus.] [LE:475] [RE:1422] [DI:complement]

| ORF_Name | NT ID | AA ID | NT/LN | AA/LN | Score | P-value |
|---|---|---|---|---|---|---|
| 31829842_f1_376 | 1702 | 8873 | 849 | 282 | 320 | 1.0e-28 |

Description gp:[GI:e1310305;g3294250] [LN:SC7C7] [AC:AL031031] [PN:putative transcriptional regulator] [GN:SC7C7.17] [OR:Streptomyces coelicolor] [DB:genpept-bct1] [DE:Streptomyces coelicolor cosmid 7C7.] [NT:SC7C7.17, possible transcriptional regulatory] [LE:30760] [RE:31626] [DI:direct]

| ORF_Name | NT ID | AA ID | NT/LN | AA/LN | Score | P-value |
|---|---|---|---|---|---|---|
| 31897053_f1_206 | 1703 | 8874 | 1113 | 370 | 237 | 9.2e-20 |

Description sp:[LN:A41768] [AC:A41768] [PN:orf 5' to uraA] [CL:short-chain alcohol dehydrogenase homology] [OR:Myxococcus xanthus] [DB:pir2]

| ORF_Name | NT ID | AA ID | NT/LN | AA/LN | Score | P-value |
|---|---|---|---|---|---|---|
| 31900777_c1_1627 | 1704 | 8875 | 333 | 110 | 216 | 1.1e-17 |

Description sp:[LN:BGLJ_ECOLI] [AC:P39404] [GN:BGLJ] [OR:Escherichia coli] [DE:BGLJ PROTEIN] [SP:P39404] [DB:swissprot]

| ORF Name | NT ID | AA ID | NT/LN | AA/LN | Score | P-value |
|---|---|---|---|---|---|---|
| 3204830_f2_854 | 1705 | 8876 | 768 | 255 | 1124 | 6.5e-114 |

Description sp:[LN:YJFQ_ECOLI] [AC:P39299] [GN:YJFQ] [OR:Escherichia coli] [DE:HYPOTHETICAL TRANSCRIPTIONAL REGULATOR IN AIDB-RPSF INTERGENIC REGION] [SP:P39299] [DB:swissprot] >sp:[LN:S56416] [AC:S56416:B65230] [PN:hypothetical transcription regulator, aidB-rpsF intergenic region:hypothetical protein f251] [GN:yjfQ] [OR:Escherichia coli] [DB:pir2] >gp:[GI:g537032] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_f251] [LE:108530] [RE:109285] [DI:complement] >gp:[GI:g1790635] [LN:AE000491] [AC:AE000491:U00096] [PN:putative DEOR-type transcriptional regulator] [GN:yjfQ] [FN:putative regulator; Not classified] [OR:Escherichia coli] [DB:genpept-bct2] [DE:Escherichia coli K-12 MG1655 section 381 of 400 of the completegenome.] [NT:f251; 100 pct identical amino acid sequence and] [LE:1364] [RE:2119] [DI:complement]

| ORF Name | NT ID | AA ID | NT/LN | AA/LN | Score | P-value |
|---|---|---|---|---|---|---|
| 32140635_c1_1625 | 1706 | 8877 | 882 | 293 | 707 | 1.0e-69 |

Description sp:[LN:YJJQ_ECOLI] [AC:P39403] [GN:YJJQ] [OR:Escherichia coli] [DE:HYPOTHETICAL 27.0 KD PROTEIN IN DNAT-BGLJ INTERGENIC REGION (O241)] [SP:P39403] [DB:swissprot] >sp:[LN:S56592] [AC:S56592:G65251] [PN:hypothetical 27K protein (dnaT-holD intergenic region):hypothetical protein o241] [GN:yjjQ] [OR:Escherichia coli] [DB:pir2] >gp:[GI:g537208] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_o241] [LE:294309] [RE:295034] [DI:direct] >gp:[GI:g1790827] [LN:AE000507] [AC:AE000507:U00096] [PN:putative regulator] [GN:yjjQ] [FN:putative regulator; Not classified] [OR:Escherichia coli] [DB:genpept-bct2] [DE:Escherichia coli K-12 MG1655 section 397 of 400 of the completegenome.] [NT:o241; 100 pct identical amino acid sequence and] [LE:6426] [RE:7151] [DI:direct]

| ORF Name | NT ID | AA ID | NT/LN | AA/LN | Score | P-value |
|---|---|---|---|---|---|---|
| 32234681_f1_285 | 1707 | 8878 | 864 | 287 | 184 | 8.2e-13 |

Description sp:[LN:IOLI_BACSU] [AC:P42419] [GN:IOLI:B65B] [OR:Bacillus subtilis] [DE:IOLI PROTEIN] [SP:P42419] [DB:swissprot] >sp:[LN:A69646] [AC:A69646] [PN:myo-inositol catabolism iolI] [GN:iolI] [OR:Bacillus subtilis] [DB:pir2] >gp:[GI:d1003808:g709989] [LN:BACIOLO] [AC:D14399] [PN:hypothetical protein] [GN:B65B] [OR:Bacillus subtilis] [SR:Bacillus subtilis (strain:BGSC 1A1 (168 trpC2)) DNA] [DB:genpept-bct1] [DE:Bacillus subtilis 15 kb chromosome segment contains the iol operon.] [LE:9369] [RE:10205] [DI:direct] >gp:[GI:e1184693:g2636514] [LN:BSUB0021] [AC:Z99124:AL009126] [GN:iolI] [OR:Bacillus subtilis] [DB:genpept-bct1] [DE:Bacillus subtilis complete genome (section 21 of 21): from 3999281to 4214814.] [NT:alternate gene name: yxdH; myo-inositol catabolism] [SP:P42419] [LE:73484] [RE:74320] [DI:complement]

| ORF Name | NT ID | AA ID | NT/LN | AA/LN | Score | P-value |
|---|---|---|---|---|---|---|
| 32322778_c1_1473 | 1708 | 8879 | 3531 | 1176 | 1345 | 2.5e-137 |

Description sp:[LN:YJHR_ECOLI] [AC:P39369] [GN:YJHR] [OR:Escherichia coli] [DE:HYPOTHETICAL 38.0 KD PROTEIN IN FECI-FIMB INTERGENIC REGION (O338)] [SP:P39369] [DB:swissprot] >sp:[LN:S56533] [AC:S56533:F65244] [PN:hypothetical 38K protein (fecI-fimB intergenic region):hypothetical protein o338] [GN:yjhR] [OR:Escherichia coli] [DB:pir2] >gp:[GI:g537149] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_o338] [LE:225847] [RE:226863] [DI:direct] >gp:[GI:g1790762] [LN:AE000501] [AC:AE000501:U00096] [PN:putative frameshift suppressor] [GN:yjhR] [FN:phenotype; Not classified] [OR:Escherichia coli] [DB:genpept-bct2] [DE:Escherichia coli K-12 MG1655 section 391 of 400 of the completegenome.] [NT:o338; 100 pct identical amino acid sequence and] [LE:7000] [RE:8016] [DI:direct]

| ORF Name | NT ID | AA ID | NT/LN | AA/LN | Score | P-value |
|---|---|---|---|---|---|---|
| 32507056_c3_2422 | 1709 | 8880 | 948 | 315 | 731 | 2.9e-72 |

Description gp:[GI:e1455585:g4886553] [LN:PSEY18527] [AC:Y18527] [PN:pobR regulator] [GN:pobR] [OR:Pseudomonas sp.] [SR:Pseudomonas sp] [DB:genpept-bct1] [DE:Pseudomonas sp. pobA, pobR, pcaQ, pcaH and pcaG genes.] [LE:2122] [RE:3003] [DI:direct]

| ORF Name | NT ID | AA ID | NT/LN | AA/LN | Score | P-value |
|---|---|---|---|---|---|---|
| 32542657_f1_208 | 1710 | 8881 | 948 | 315 | 206 | 3.9e-23 |

Description sp:[LN:T14455] [AC:T14455] [PN:hypothetical protein] [OR:Brassica oleracea] [SR:, wild cabbage] [DB:pir2]

| ORF Name | NT ID | AA ID | NT/LN | AA/LN | Score | P-value |
|---|---|---|---|---|---|---|
| 32547905_f3_1110 | 1711 | 8882 | 381 | 126 | 82 | 0.0017 |

Description sp:[LN:D72723] [AC:D72723] [PN:hypothetical protein APE0325] [GN:APE0325] [OR:Aeropyrum pernix] [DB:pir2] >gp:[GI:d1043066:g5103964] [LN:AP000059] [AC:AP000059] [PN:111aa long hypothetical protein] [GN:APE0325] [OR:Aeropyrum pernix] [SR:Aeropyrum pernix (strain:K1) DNA] [DB:genpept-bct1] [DE:Aeropyrum pernix genomic DNA, section 2/7.] [LE:33836] [RE:34171] [DI:direct]

| ORF Name | NT ID | AA ID | NT/LN | AA/LN | Score | P-value |
|---|---|---|---|---|---|---|
| 32551002_f2_455 | 1712 | 8883 | 867 | 288 | 1111 | 1.5e-112 |

Description sp:[LN:YAAA_ECOLI] [AC:P11288] [GN:YAAA] [OR:Escherichia coli] [DE:HYPOTHETICAL 29.6 KD PROTEIN IN THRC-TALB INTERGENIC REGION] [SP:P11288] [DB:swissprot] >sp:[LN:Q3ECTC] [AC:S40534:A30283:S56632:F64720] [PN:yaaA protein:protein f121] [GN:yaaA] [OR:Escherichia coli] [DB:pir2] [MP:0 min] >gp:[GI:d1001761:g216438] [LN:ECO110K] [AC:D10483:J01597:J01683:J01706:K01298:K01990:M10420:M10611:M12544] [OR:Escherichia coli] [SR:Escherichia coli (strain:K-12) DNA] [DB:genpept-bct1] [DE:E.coli K12 genome, 0-2.4min. region.] [NT:Hypothetical protein 126: PIR:Q3ECTC] [LE:5344] [RE:6120] [DI:complement] >gp:[GI:g1786187] [LN:AE000111] [AC:AE000111:U00096] [PN:orf, hypothetical protein] [GN:yaaA] [FN:orf; Unknown] [OR:Escherichia coli] [DB:genpept-bct2] [DE:Escherichia coli K-12 MG1655 section 1 of 400 of the completegenome.] [NT:f258; 100 pct identical to YAAA_ECOLI SW: P11288] [LE:5683] [RE:6459] [DI:complement]

| ORF Name | NT ID | AA ID | NT/LN | AA/LN | Score | P-value |
|---|---|---|---|---|---|---|
| 32555457_c1_1660 | 1713 | 8884 | 702 | 233 | 920 | 2.7e-92 |

Description sp:[LN:CREB_ECOLI] [AC:P08368] [GN:CREB] [OR:Escherichia coli] [DE:TRANSCRIPTIONAL REGULATORY PROTEIN CREB] [SP:P08368] [DB:swissprot] >sp:[LN:QQECFJ] [AC:B25038:S56622:E65255] [PN:transcription regulator creB] [GN:creB] [CL:ompR protein:response regulator homology] [OR:Escherichia coli] [DB:pir1] [MP:100 min] >gp:[GI:g147250] [LN:ECOPHOM] [AC:M13608] [OR:Escherichia coli] [SR:Escherichia coli (strain KLF125/KL181) DNA] [DB:genpept-bct1] [DE:E.coli (clone pTHR34) phoM operon, containing phoM gene (positveregulation for pho regulon) and three unidentified genes.] [NT:28 kd protein] [LE:1066] [RE:1755] [DI:direct] >gp:[GI:g537238] [LN:ECOUW93] [AC:U14003] [GN:creB] [FN:involved in catabolic regulation] [OR:Escherichia coli] [DB:genpept-bct1] [DE:Escherichia coli K-12 chromosomal region from 92.8 to 00.1 minutes.] [LE:326840] [RE:327529] [DI:direct] >gp:[GI:g1790860] [LN:AE000510] [AC:AE000510:U00096] [PN:catabolic regulation response regulator] [GN:creB] [FN:regulator; Global regulatory functions] [OR:Escherichia coli] [DB:genpept-bct2] [DE:Escherichia coli K-12 MG1655 section 400 of 400 of the completegenome.] [NT:o229; 100 pct identical amino acid sequence and] [LE:664] [RE:1353] [DI:direct]

| ORF Name | NT ID | AA ID | NT/LN | AA/LN | Score | P-value |
|---|---|---|---|---|---|---|
| 32597928_f3_1065 | 1714 | 8885 | 1215 | 404 | 1460 | 1.6e-149 |

Description sp:[LN:YHII_ECOLI] [AC:P37626] [GN:YHII] [OR:Escherichia coli] [DE:(F355)]
[SP:P37626] [DB:swissprot] >sp:[LN:S47707] [AC:S47707:B65146] [PN:hypothetical
38.8K protein (rhsB-pit intergenic region)] [GN:yhiI] [CL:lipoyl/biotin-binding
homology] [OR:Escherichia coli] [DB:pir2] >gp:[GI:g466624] [LN:ECOUW76]
[AC:U00039] [OR:Escherichia coli] [SR:Escherichia coli (sub_strain MG1655, strain
K-12) (library: lambda] [DB:genpept-bct1] [DE:E. coli chromosomal region from
76.0 to 81.5 minutes.] [LE:43795] [RE:44862] [DI:complement] >gp:[GI:g1789900]
[LN:AE000424] [AC:AE000424:U00096] [PN:putative membrane protein] [GN:yhiI]
[FN:putative membrane; Not classified] [OR:Escherichia coli] [DB:genpept-bct2]
[DE:Escherichia coli K-12 MG1655 section 314 of 400 of the completegenome.]
[NT:f355; 100 pct identical amino acid sequence and] [LE:10407] [RE:11474]
[DI:complement]

| ORF Name | NT ID | AA ID | NT/LN | AA/LN | Score | P-value |
|---|---|---|---|---|---|---|
| 32603537_c3_2322 | 1715 | 8886 | 576 | 191 | 596 | 5.8e-58 |

Description gp:[GI:g6009455] [LN:AB024946] [AC:AB024946] [GN:orf79] [OR:Escherichia coli]
[SR:Escherichia coli (sub_species:enteropathogenic, strain:B171]
[DB:genpept-bct1] [DE:Escherichia coli plasmid pB171 genomic DNA, complete
sequence.] [LE:67389] [RE:67919] [DI:complement]

| ORF Name | NT ID | AA ID | NT/LN | AA/LN | Score | P-value |
|---|---|---|---|---|---|---|
| 32605392_c1_1316 | 1716 | 8887 | 1464 | 487 | 2310 | 1.4e-239 |

Description sp:[LN:SGAT_ECOLI] [AC:P39301] [GN:SGAT] [OR:Escherichia coli] [DE:PUTATIVE
TRANSPORT PROTEIN SGAT] [SP:P39301] [DB:swissprot] >sp:[LN:D65230]
[AC:D65230:S56418] [PN:hypothetical 52.9 kD protein in aidB-rpsF intergenic
region:hypothetical protein o488] [GN:yjfS] [OR:Escherichia coli] [DB:pir2]
>gp:[GI:g2367358] [LN:AE000491] [AC:AE000491:U00096] [PN:orf, hypothetical
protein] [GN:sgaT] [FN:orf; Unknown] [OR:Escherichia coli] [DB:genpept-bct2]
[DE:Escherichia coli K-12 MG1655 section 381 of 400 of the completegenome.]
[NT:o484; formerly designated yjfS] [LE:3589] [RE:5043] [DI:direct]

| ORF Name | NT ID | AA ID | NT/LN | AA/LN | Score | P-value |
|---|---|---|---|---|---|---|
| 3260816_c3_2332 | 1717 | 8888 | 1245 | 414 | | |

Description

NO-HIT

| ORF_Name | NT_ID | AA_ID | NT LN | AA LN | Score | P-value |
|---|---|---|---|---|---|---|
| 32614826_f2_463 | 1718 | 8889 | 240 | 79 | | |

Description

NO-HIT

| ORF_Name | NT_ID | AA_ID | NT LN | AA LN | Score | P-value |
|---|---|---|---|---|---|---|
| 32663902_f3_1087 | 1719 | 8890 | 3324 | 1107 | 4842 | 0.0 |

Description sp:[LN:YBDE_ECOLI] [AC:P38054:P77767] [GN:YBDE] [OR:Escherichia coli]
[DE:HYPOTHETICAL 114.7 KD PROTEIN IN NFRB-PHEP INTERGENIC REGION]
[SP:P38054:P77767] [DB:swissprot] >sp:[LN:E64790] [AC:E64790] [PN:ybdE protein]
[GN:ybdE] [CL:cation efflux system membrane protein czcA] [OR:Escherichia coli]
[DB:pir2] >gp:[GI:d1036201:g4062205] [LN:D90700] [AC:D90700:AB001340]
[PN:Hypothetical protein in pheP 5'region .] [GN:ybdE] [OR:Escherichia coli]
[SR:Escherichia coli(strain:K12) DNA, clone:Kohara clone #163] [DB:genpept-bct1]
[DE:Escherichia coli genomic DNA. (12.8 - 13.2 min).] [NT:ORF_ID:o163#5; similar
to SwissProt Accession] [LE:4052] [RE:7195] [DI:direct] >gp:[GI:g1778490]
[LN:ECU82598] [AC:U82598] [PN:HelA homolog] [OR:Escherichia coli]
[DB:genpept-bct1] [DE:Escherichia coli genomic sequence of minutes 9 to 12.]
[NT:similar to L. pneumophila HelA] [LE:39345] [RE:42488] [DI:direct]
>gp:[GI:g1786788] [LN:AE000162] [AC:AE000162:U00096] [PN:putative inner membrane
component for iron] [GN:ybdE] [FN:putative transport; Not classified]
[OR:Escherichia coli] [DB:genpept-bct2] [DE:Escherichia coli K-12 MG1655 section
52 of 400 of the completegenome.] [NT:o1047; 98 pct identical to fragment
YBDE_ECOLI SW:] [LE:5491] [RE:8634] [DI:direct]

| ORF_Name | NT_ID | AA_ID | NT LN | AA LN | Score | P-value |
|---|---|---|---|---|---|---|
| 32666632_f3_999 | 1720 | 8891 | 597 | 198 | 120 | 1.7e-07 |

Description gp:[GI:e1517587:g5531443] [LN:SCI11] [AC:AL096849] [PN:putative
acetyltransferase] [GN:SCI11.22c] [OR:Streptomyces coelicolor A3(2)]
[DB:genpept-bct1] [DE:Streptomyces coelicolor cosmid I11.] [NT:SCI11.22c,
possible acetyltransferase, len: 156 aa;] [LE:16769] [RE:17239] [DI:complement]

| ORF_Name | NT_ID | AA_ID | NT LN | AA LN | Score | P-value |
|---|---|---|---|---|---|---|
| 32682625_f1_108 | 1721 | 8892 | 921 | 306 | 401 | 2.7e-37 |

Description gp:[GI:g2935660] [LN:AF029673] [AC:AF029673] [PN:HexR] [GN:hexR] [FN:hex regulon
repressor (includes zwf, eda, edd,] [OR:Pseudomonas aeruginosa] [DB:genpept-bct2]
[DE:Pseudomonas aeruginosa HexR (hexR), glucose-6-phosphate1-dehydrogenase (zwf),
6-phosphogluconolactonase (pgl), and2-keto-3-deoxy-6-phosphogluconate aldolase
(eda) genes, completecds.] [NT:similar to RpiR] [LE:76] [RE:933] [DI:complement]

619

| ORF Name | NT ID | AA ID | NT/LN | AA/LN | Score | P-value |
|---|---|---|---|---|---|---|
| 32704010_c1_1698 | 1722 | 8893 | 660 | 219 | 181 | 5.5e-14 |

Description sp:[LN:B71231] [AC:B71231] [PN:alanine--tRNA ligase,] [GN:PH0108] [OR:Pyrococcus horikoshii] [EC:6.1.1.7] [DB:pir2] >gp:[GI:d1030120:g3256494] [LN:AP000001] [AC:AP000001:AB009465:AB009464:AB009466:AB009467:AB009468:AB009469] [PN:216aa long hypothetical alanyl-tRNA synthetase] [GN:PH0108] [OR:Pyrococcus horikoshii] [SR:Pyrococcus horikoshii (strain:OT3) DNA] [DB:genpept-bct1] [DE:Pyrococcus horikoshii OT3 genomic DNA, 1-287000 nt. position (1/7).] [NT:similar to PIR:D64370 percent identity:37.143 in] [LE:89207] [RE:89857] [DI:direct]

| ORF Name | NT ID | AA ID | NT/LN | AA/LN | Score | P-value |
|---|---|---|---|---|---|---|
| 32714762_c2_2053 | 1723 | 8894 | 738 | 245 | 939 | 2.6e-94 |

Description sp:[LN:LAST_ECOLI] [AC:P37005] [GN:LAST] [OR:Escherichia coli] [EC:2.1.1.-] [DE:HYPOTHETICAL TRNA/RRNA METHYLTRANSFERASE LAST,] [SP:P37005] [DB:swissprot] >sp:[LN:S56627] [AC:S56627:B65256] [PN:hypothetical protein o228b:hypothetical protein lasT] [GN:lasT] [CL:conserved hypothetical protein] [OR:Escherichia coli] [DB:pir1] >gp:[GI:g537243] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_o228b] [LE:331775] [RE:332461] [DI:direct] >gp:[GI:g1790865] [LN:AE000510] [AC:AE000510:U00096] [PN:orf, hypothetical protein] [GN:lasT] [FN:orf; Unknown] [OR:Escherichia coli] [DB:genpept-bct2] [DE:Escherichia coli K-12 MG1655 section 400 of 400 of the completegenome.] [NT:o228b; 100 pct identical amino acid sequence and] [LE:5599] [RE:6285] [DI:direct]

| ORF Name | NT ID | AA ID | NT/LN | AA/LN | Score | P-value |
|---|---|---|---|---|---|---|
| 33203138_c3_2369 | 1724 | 8895 | 807 | 268 | | |

Description

NO-HIT

| ORF Name | NT ID | AA ID | NT LN | AA LN | Score | P-value |
|---|---|---|---|---|---|---|
| 33204051_c2_1731 | 1725 | 8896 | 411 | 136 | 591 | 2.0e-57 |

Description sp:[LN:YTFH_ECOLI] [AC:P39316] [GN:YTFH] [OR:Escherichia coli] [DE:HYPOTHETICAL 17.6 KD PROTEIN IN RPLI-CPDB INTERGENIC REGION (O156)] [SP:P39316] [DB:swissprot] >sp:[LN:S56437] [AC:S56437:G65232] [PN:hypothetical protein o163:hypothetical protein b4212] [CL:conserved hypothetical protein MTH1285] [OR:Escherichia coli] [DB:pir2] >gp:[GI:g537053] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_o163] [LE:124855] [RE:125325] [DI:direct] >gp:[GI:g1790657] [LN:AE000492] [AC:AE000492:U00096] [PN:orf, hypothetical protein] [GN:ytfH] [FN:orf; Unknown] [OR:Escherichia coli] [DB:genpept-bct2] [DE:Escherichia coli K-12 MG1655 section 382 of 400 of the completegenome.] [NT:o156] [LE:6595] [RE:7065] [DI:direct]

| ORF Name | NT ID | AA ID | NT LN | AA LN | Score | P-value |
|---|---|---|---|---|---|---|
| 33379758_f2_689 | 1726 | 8897 | 699 | 232 | | |

Description

NO-HIT

| ORF Name | NT ID | AA ID | NT LN | AA LN | Score | P-value |
|---|---|---|---|---|---|---|
| 33631941_f3_1245 | 1727 | 8898 | 567 | 188 | 179 | 9.0e-14 |

Description gp:[GI:g146449] [LN:ECOILER] [AC:M14018] [OR:Escherichia coli] [SR:Escherichia coli K12 DNA, clone pAR6-2] [DB:genpept-bct1] [DE:E.coli K12 ileR gene encoding the Ile repressor, and orf83 encodinga protein of unknown function, complete cds.] [NT:Ile repressor (ileR)] [LE:537] [RE:839] [DI:direct]

| ORF Name | NT ID | AA ID | NT LN | AA LN | Score | P-value |
|---|---|---|---|---|---|---|
| 3367830_f3_1033 | 1728 | 8899 | 273 | 90 | | |

Description

NO-HIT

| ORF Name | NT ID | AA ID | NT LN | AA LN | Score | P-value |
|---|---|---|---|---|---|---|
| 33724042_f1_174 | 1729 | 8900 | 276 | 91 | 124 | 4.6e-07 |

Description sp:[LN:EXLP_TOBAC] [AC:Q03211] [OR:Nicotiana tabacum] [SR:,Common tobacco]
[DE:PISTIL-SPECIFIC EXTENSIN-LIKE PROTEIN PRECURSOR (PELP)] [SP:Q03211]
[DB:swissprot] >sp:[LN:JQ1696] [AC:JQ1696:S24621] [PN:pistil extensin-like
protein precursor (clone pMG15)] [OR:Nicotiana tabacum] [SR:, common tobacco]
[DB:pir2] >gp:[GI:g19929] [LN:NTPMG15] [AC:Z14019:S48638] [PN:pistil extensin
like protein] [FN:unknown] [OR:Nicotiana tabacum] [SR:common tobacco]
[DB:genpept-pln1] [DE:N.tabacum mRNA for pistil extensin like protein.]
[SP:Q03211] [LE:11] [RE:1291] [DI:direct]

| ORF Name | NT ID | AA ID | NT LN | AA LN | Score | P-value |
|---|---|---|---|---|---|---|
| 33725808_c2_1901 | 1730 | 8901 | 1737 | 578 | 149 | 9.4e-07 |

Description gp:[GI:g3005587] [LN:AF048977] [AC:AF048977] [PN:Ser/Arg-related nuclear matrix
protein] [GN:SRM160] [FN:splicing factor] [OR:Homo sapiens] [SR:human]
[DB:genpept-pri3] [DE:Homo sapiens Ser/Arg-related nuclear matrix protein
(SRM160) mRNA,complete cds.] [NT:160 kDa] [LE:6] [RE:2468] [DI:direct]

| ORF Name | NT ID | AA ID | NT LN | AA LN | Score | P-value |
|---|---|---|---|---|---|---|
| 33768802_f1_152 | 1731 | 8902 | 1263 | 420 | 1625 | 5.3e-167 |

Description sp:[LN:YJIO_ECOLI] [AC:P39386] [GN:YJIO] [OR:Escherichia coli] [DE:HYPOTHETICAL
44.7 KD PROTEIN IN IADA-MCRD INTERGENIC REGION (F410)] [SP:P39386] [DB:swissprot]
>sp:[LN:S56562] [AC:S56562:C65248] [PN:hypothetical 44.7K protein (iadA-mcrD
intergenic region):hypothetical protein f410] [GN:yjiO] [CL:Escherichia coli
hypothetical protein (iadA-mcrD intergenic region)] [OR:Escherichia coli]
[DB:pir2] >gp:[GI:g537178] [LN:ECOUW93] [AC:U14003] [OR:Escherichia coli]
[DB:genpept-bct1] [DE:Escherichia coli K-12 chromosomal region from 92.8 to 00.1
minutes.] [NT:ORF_f410] [LE:258119] [RE:259351] [DI:complement] >gp:[GI:g1790794]
[LN:AE000504] [AC:AE000504:U00096] [PN:putative transport protein] [GN:yjiO]
[FN:putative transport; Not classified] [OR:Escherichia coli] [DB:genpept-bct2]
[DE:Escherichia coli K-12 MG1655 section 394 of 400 of the completegenome.]
[NT:f410; 100 pct identical amino acid sequence and] [LE:4608] [RE:5840]
[DI:complement]

| ORF Name | NT ID | AA ID | NT LN | AA LN | Score | P-value |
|---|---|---|---|---|---|---|
| 3382305_f2_434 | 1732 | 8903 | 1698 | 565 | | |

Description

NO-HIT

| ORF Name | NT ID | AA ID | NT LN | AA LN | Score | P-value |
|---|---|---|---|---|---|---|
| 33831256_c1_1688 | 1733 | 8904 | 951 | 316 | 1410 | 3.2e-144 |

Description sp:[LN:QQEC3R] [AC:D64722:S07928:S40542:JN0325] [PN:transcription activator nhaR]
[GN:nhaR] [CL:regulatory protein nhaR] [OR:Escherichia coli] [DB:pir1] [MP:0 min]
>gp:[GI:g1786202] [LN:AE000112] [AC:AE000112:U00096] [PN:transcriptional
activator of nhaA] [GN:nhaR] [FN:regulator; Transport of small molecules:]
[OR:Escherichia coli] [DB:genpept-bct2] [DE:Escherichia coli K-12 MG1655 section
2 of 400 of the completegenome.] [NT:o301; 100 pct identical to NHAR_ECOLI SW:
P10087] [LE:8177] [RE:9082] [DI:direct]

| ORF Name | NT ID | AA ID | NT LN | AA LN | Score | P-value |
|---|---|---|---|---|---|---|
| 3394033_c3_2484 | 1734 | 8905 | 195 | 64 | 158 | 1.5e-11 |

Description sp:[LN:HTGA_ECOLI] [AC:P28697] [GN:HTGA:HTPY] [OR:Escherichia coli] [DE:HEAT
SHOCK PROTEIN HTGA (HEAT SHOCK PROTEIN HTPY)] [SP:P28697] [DB:swissprot]
>sp:[LN:A40623] [AC:A40623:A56688:D64721:S28460] [PN:heat shock protein htgA:heat
shock protein Y] [GN:htgA:htpY] [CL:Escherichia coli heat shock protein htgA]
[OR:Escherichia coli] [DB:pir2] [MP:0 min] >gp:[GI:g1786194] [LN:AE000112]
[AC:AE000112:U00096] [PN:positive regulator for sigma 32 heat shock] [GN:htgA]
[FN:regulator; Adaptations, atypical conditions] [OR:Escherichia coli]
[DB:genpept-bct2] [DE:Escherichia coli K-12 MG1655 section 2 of 400 of the
completegenome.] [NT:o196; 100 pct identical to HTGA_ECOLI SW:] [LE:187] [RE:777]
[DI:direct]

| ORF Name | NT ID | AA ID | NT LN | AA LN | Score | P-value |
|---|---|---|---|---|---|---|
| 3401562_c3_2160 | 1735 | 8906 | 1434 | 477 | 2150 | 1.2e-222 |

Description sp:[LN:PMBA_ECOLI] [AC:P24231] [GN:PMBA:TLDE] [OR:Escherichia coli] [DE:PMBA
PROTEIN (TLDE PROTEIN)] [SP:P24231] [DB:swissprot] >sp:[LN:S13730]
[AC:S13730:S56461:F65235] [PN:pmbA protein] [GN:pmbA] [CL:Escherichia coli pmbA
protein] [OR:Escherichia coli] [DB:pir1] [MP:96 min] >gp:[GI:d1008503:g1732440]
[LN:ECOTLDE2] [AC:D44452] [PN:TldE protein] [GN:tldE] [FN:Modulator of
interaction between LetD protein] [OR:Escherichia coli] [SR:Escherichia coli
(strain:K12, isolate:KP5254) DNA, clone:pKP1838] [DB:genpept-bct1]
[DE:Escherichia coli DNA for TldE protein and 21K protein, completecds.] [LE:857]
[RE:2209] [DI:direct] >gp:[GI:g537077] [LN:ECOUW93] [AC:U14003] [GN:pmbA]
[FN:involved in production of antibiotic MccB17] [OR:Escherichia coli]
[DB:genpept-bct1] [DE:Escherichia coli K-12 chromosomal region from 92.8 to 00.1
minutes.] [LE:148788] [RE:150140] [DI:direct] >gp:[GI:g42440] [LN:ECPMBA]
[AC:X54152] [GN:pmbA] [OR:Escherichia coli] [DB:genpept-bct1] [DE:E. coli pmbA
gene involved in McCB17 production.] [NT:pmbA is involved in the production of
antibiotic] [SP:P24231] [LE:210] [RE:1562] [DI:direct] >gp:[GI:g1790682]
[LN:AE000494] [AC:AE000494:U00096] [PN:maturation of antibiotic MccB17, see tld
genes] [GN:pmbA] [FN:phenotype; Proteins - translation and] [OR:Escherichia coli]
[DB:genpept-bct2] [DE:Escherichia coli K-12 MG1655 section 384 of 400 of the
completegenome.] [NT:o450; 100 pct identical amino acid sequence and] [LE:9643]
[RE:10995] [DI:direct]

| ORF Name | NT ID | AA ID | NT LN | AA LN | Score | P-value |
|---|---|---|---|---|---|---|
| 34101693_c2_1767 | 1736 | 8907 | 753 | 250 | 95 | 0.022 |

Description sp:[LN:ALKH_ERWCH] [AC:P38448] [GN:EDA:KDGA] [OR:Erwinia chrysanthemi]
[EC:4.1.3.16:4.1.2.14] [DE:ALDOLASE)]] [SP:P38448] [DB:swissprot] >sp:[LN:S37054]
[AC:S37054] [PN:KHG-KDPG bifunctional aldolase:2-keto-4-hydroxyglutarate aldolase
(KHG aldolase):phospho-2-keto-3-deoxygluconate aldolase (KDPG aldolase)]
[GN:kdgA] [CL:2-dehydro-3-deoxyphosphogluconate aldolase] [OR:Erwinia
chrysanthemi] [DB:pir2] >gp:[GI:g397855] [LN:ECZWFKDGA] [AC:X74866]
[PN:2-dehydro-3-deoxyphosphogluconate aldolase] [GN:kdgA] [OR:Erwinia
chrysanthemi] [DB:genpept-bct1] [EC:4.1.2.14] [DE:E.chrysanthemi genes zwf and
kdgA.] [SP:P38448] [LE:1950] [RE:2591] [DI:direct]

| ORF Name | NT ID | AA ID | NT LN | AA LN | Score | P-value |
|---|---|---|---|---|---|---|
| 34164206_c2_1724 | 1737 | 8908 | 774 | 257 | 954 | 6.7e-96 |

Description sp:[LN:S56432] [AC:S56432:B65232:S46294] [PN:peptidylprolyl
isomerase,:FK506-binding protein FKBP22] [GN:fklB] [CL:BKBP-type peptidylprolyl
isomerase homology] [OR:Escherichia coli] [EC:5.2.1.8] [DB:pir2] >gp:[GI:g537048]
[LN:ECOUW93] [AC:U14003] [OR:Escherichia coli] [DB:genpept-bct1] [DE:Escherichia
coli K-12 chromosomal region from 92.8 to 00.1 minutes.] [NT:ORF_o259a]
[LE:119608] [RE:120387] [DI:direct] >gp:[GI:g1790652] [LN:AE000492]
[AC:AE000492:U00096] [PN:FKBP-type 22KD peptidyl-prolyl cis-trans] [GN:fklB]
[FN:enzyme; Proteins - translation and] [OR:Escherichia coli] [DB:genpept-bct2]
[DE:Escherichia coli K-12 MG1655 section 382 of 400 of the completegenome.]
[NT:o259a; 100 pct identical to 205 amino acids] [LE:1348] [RE:2127] [DI:direct]

| ORF Name | NT ID | AA ID | NT LN | AA LN | Score | P-value |
|---|---|---|---|---|---|---|
| 34181550_c1_1437 | 1738 | 8909 | 1095 | 364 | 1033 | 2.9e-104 |

Description sp:[LN:MI2D_BACSU] [AC:P26935] [GN:IDH:IOLG:E83G] [OR:Bacillus subtilis]
[EC:1.1.1.18] [DE:MYO-INOSITOL 2-DEHYDROGENASE,] [SP:P26935] [DB:swissprot]
>sp:[LN:JH0511] [AC:JH0511:G69645:I39864] [PN:myo-inositol 2-dehydrogenase,
iolG:inositol dehydrogenase] [GN:iolG:idh] [OR:Bacillus subtilis] [EC:1.1.1.18]
[DB:pir2] >gp:[GI:g143086] [LN:BACIDH] [AC:M76431] [PN:inositol dehydrogenase]
[GN:idh] [OR:Bacillus subtilis] [SR:Bacillus subtilis DNA] [DB:genpept-bct1]
[DE:Bacillus subtilis inositol dehydrogenase (idh) gene.] [LE:527] [RE:1561]
[DI:direct] >gp:[GI:d1003806:g709987] [LN:BACIOLO] [AC:D14399] [PN:myo-inositol
dehydrogenase] [GN:E83G(idh)] [OR:Bacillus subtilis] [SR:Bacillus subtilis
(strain:BGSC 1A1 (168 trpC2)) DNA] [DB:genpept-bct1] [DE:Bacillus subtilis 15 kb
chromosome segment contains the iol operon.] [LE:7360] [RE:8394] [DI:direct]
>gp:[GI:e1184695:g2636516] [LN:BSUB0021] [AC:Z99124:AL009126] [PN:myo-inositol
2-dehydrogenase] [GN:iolG] [FN:myo-inositol catabolism] [OR:Bacillus subtilis]
[DB:genpept-bct1] [EC:1.1.1.18] [DE:Bacillus subtilis complete genome (section 21
of 21): from 3999281to 4214814.] [NT:alternate gene name: iol, idh] [SP:P26935]
[LE:75295] [RE:76329] [DI:complement]

| ORF Name | NT ID | AA ID | NT/LN | AA/LN | Score | P-value |
|---|---|---|---|---|---|---|
| 34242841_c2_1983 | 1739 | 8910 | 1047 | 348 | 404 | 1.3e-37 |

Description sp:[LN:H69027] [AC:H69027] [PN:malate dehydrogenase] [GN:MTH1205] [CL:malate dehydrogenase ylbC] [OR:Methanobacterium thermoautotrophicum] [DB:pir2] >gp:[GI:g2622314] [LN:AE000888] [AC:AE000888:AE000666] [PN:malate dehydrogenase] [GN:MTH1205] [OR:Methanobacterium thermoautotrophicum] [DB:genpept-bct2] [DE:Methanobacterium thermoautotrophicum from bases 1098908 to 1112186(section 94 of 148) of the complete genome.] [NT:Function Code:1.02 - Carbohydrate Metabolism,] [LE:9278] [RE:10303] [DI:direct]

| ORF Name | NT ID | AA ID | NT/LN | AA/LN | Score | P-value |
|---|---|---|---|---|---|---|
| 34416550_f2_671 | 1740 | 8911 | 309 | 102 | 190 | 6.1e-15 |

Description gp:[GI:g1552814] [LN:ECU70214] [AC:U70214] [OR:Escherichia coli] [DB:genpept-bct1] [DE:Escherichia coli chromosome minutes 4-6.] [NT:hypothetical protein] [LE:94091] [RE:94585] [DI:direct]

| ORF Name | NT ID | AA ID | NT/LN | AA/LN | Score | P-value |
|---|---|---|---|---|---|---|
| 34472777_c3_2462 | 1741 | 8912 | 714 | 237 | 965 | 4.6e-97 |

Description sp:[LN:S56619] [AC:S56619:B65255] [PN:gpmB protein:hypothetical protein o215b] [GN:gpmB] [CL:Aquifex aeolicus phosphoglycerate mutase:phosphoglycerate mutase homology] [OR:Escherichia coli] [DB:pir2] >gp:[GI:g537235] [LN:ECOUW93] [AC:U14003] [OR:Escherichia coli] [DB:genpept-bct1] [DE:Escherichia coli K-12 chromosomal region from 92.8 to 00.1 minutes.] [NT:Kenn Rudd identifies as gpmB] [LE:324630] [RE:325277] [DI:direct] >gp:[GI:g1790856] [LN:AE000509] [AC:AE000509:U00096] [PN:phosphoglyceromutase 2] [GN:gpmB] [FN:enzyme; Energy metabolism, carbon: Glycolysis] [OR:Escherichia coli] [DB:genpept-bct2] [DE:Escherichia coli K-12 MG1655 section 399 of 400 of the completegenome.] [LE:8985] [RE:9632] [DI:direct]

| ORF Name | NT ID | AA ID | NT/LN | AA/LN | Score | P-value |
|---|---|---|---|---|---|---|
| 34489790_c3_2347 | 1742 | 8913 | 540 | 179 | 201 | 4.2e-16 |

Description sp:[LN:SLYA_ECOLI] [AC:P55740] [GN:SLYA] [OR:Escherichia coli]
[DE:TRANSCRIPTIONAL REGULATOR SLYA] [SP:P55740] [DB:swissprot]
>gp:[GI:d1016124:g1742708] [LN:D90807] [AC:D90807:AB001340] [PN:Salmolysin
(Cytolysin SlyA).] [OR:Escherichia coli] [SR:Escherichia coli (strain:K12) DNA,
clone_lib:Kohara lambda minise] [DB:genpept-bct1] [DE:E.coli genomic DNA, Kohara
clone #316(36.7-37.1 min.).] [NT:ORF_ID:o316#22; similar to [SwissProt Accession]
[LE:17995] [RE:18435] [DI:complement] >gp:[GI:e1363543:g4127820] [LN:ECAJ10965]
[AC:AJ010965] [PN:SlyA protein] [GN:slyA] [FN:regulatory protein] [OR:Escherichia
coli] [DB:genpept-bct1] [DE:Escherichia coli slyA gene.] [LE:176] [RE:616]
[DI:direct] >gp:[GI:g1787930] [LN:AE000259] [AC:AE000259:U00096]
[PN:transcriptional regulator for cryptic hemolysin] [GN:slyA] [FN:regulator;
Adaptations, atypical conditions] [OR:Escherichia coli] [DB:genpept-bct2]
[DE:Escherichia coli K-12 MG1655 section 149 of 400 of the completegenome.]
[NT:f146; This 146 aa ORF is 90 pct identical (0 gaps)] [LE:7997] [RE:8437]
[DI:complement]

| ORF Name | NT ID | AA ID | NT/LN | AA/LN | Score | P-value |
|---|---|---|---|---|---|---|
| 34585943_c3_2092 | 1743 | 8914 | 321 | 106 | 470 | 1.3e-44 |

Description sp:[LN:S56397] [AC:S26832:S78010:C37318:S56397:S77719:G65227:S23014] [PN:host
factor I:ndh-binding protein (Nbp)] [GN:hfq] [CL:host factor I] [OR:Escherichia
coli] [DB:pir2] >gp:[GI:d1001102:g216568] [LN:ECOHFQ] [AC:D00743] [OR:Escherichia
coli] [SR:E.coli genomic DNA] [DB:genpept-bct1] [DE:E.coli host factor-I for
bacteriophage Q beta gene (hfq) and its 5'and 3' flanking regions.] [NT:host
factor-I protein] [LE:739] [RE:1047] [DI:direct] >gp:[GI:g537013] [LN:ECOUW93]
[AC:U14003] [PN:Host Factor-I (HF-I)] [GN:hfq] [OR:Escherichia coli]
[DB:genpept-bct1] [DE:Escherichia coli K-12 chromosomal region from 92.8 to 00.1
minutes.] [NT:required for bacteriophage Q Beta RNA-directed] [LE:91116]
[RE:91424] [DI:direct] >gp:[GI:g1790614] [LN:AE000489] [AC:AE000489:U00096]
[PN:host factor I for bacteriophage Q beta] [GN:hfq] [FN:putative factor;
Phage-related functions and] [OR:Escherichia coli] [DB:genpept-bct2]
[DE:Escherichia coli K-12 MG1655 section 379 of 400 of the completegenome.]
[NT:o102; 100 pct identical to HFQ_ECOLI SW:] [LE:8002] [RE:8310] [DI:direct]
>gp:[GI:g436155] [LN:ECOHFLA] [AC:U00005] [PN:Host Factor-I (HF-I)] [GN:hfq]
[OR:Escherichia coli] [SR:Escherichia coli K12] [DB:genpept-bct2] [DE:E. coli
hflA locus encoding the hflX, hflK and hflC genes, hfqgene, complete cds; miaA
gene, partial cds.] [NT:required for bacteriophage Q Beta RNA-directed] [LE:738]
[RE:1046] [DI:direct]

| ORF_Name | NT_ID | AA_ID | NT LN | AA LN | Score | P-value |
|---|---|---|---|---|---|---|
| 34614412_f3_1149 | 1744 | 8915 | 912 | 303 | 413 | 1.4e-38 |

Description sp:[LN:E70693] [AC:E70693] [PN:probable ugpE protein] [GN:ugpE] [CL:maltose transport protein malG] [OR:Mycobacterium tuberculosis] [DB:pir2] >gp:[GI:e276781:g1648886] [LN:MTCY16B7] [AC:Z81331:AL123456] [PN:ugpE] [GN:ugpE] [OR:Mycobacterium tuberculosis] [DB:genpept-bct1] [DE:Mycobacterium tuberculosis H37Rv complete genome; segment 123/162.] [NT:Rv2834c, (MTCY16B7.08), len: 275 aa. ugpE] [LE:35564] [RE:36391] [DI:complement]

| ORF_Name | NT_ID | AA_ID | NT LN | AA LN | Score | P-value |
|---|---|---|---|---|---|---|
| 34644131_c1_1629 | 1745 | 8916 | 1362 | 453 | 879 | 6.0e-88 |

Description sp:[LN:H70216] [AC:H70216] [PN:PTS system, cellobiose-specific IIC component (celB) homolog] [CL:phosphotransferase system enzyme II factor II, phosphoenolpyruvate-dependent] [OR:Borrelia burgdorferi] [SR:, Lyme disease spirochete] [DB:pir2] >gp:[GI:g2689900] [LN:AE000792] [AC:AE000792] [PN:PTS system, cellobiose-specific IIC component] [GN:BBB04] [OR:Borrelia burgdorferi] [SR:Lyme disease spirochete] [DB:genpept-bct2] [DE:Borrelia burgdorferi plasmid cp26, complete plasmid sequence.] [NT:similar to GB:U07818 PID:466474 SP:Q45400 percent] [LE:2476] [RE:3807] [DI:complement]

| ORF_Name | NT_ID | AA_ID | NT LN | AA LN | Score | P-value |
|---|---|---|---|---|---|---|
| 34647280_c1_1324 | 1746 | 8917 | 414 | 137 | 642 | 7.7e-63 |

Description sp:[LN:RS6_ECOLI] [AC:P02358] [GN:RPSF] [OR:Escherichia coli] [DE:30S RIBOSOMAL PROTEIN S6] [SP:P02358] [DB:swissprot]

| ORF_Name | NT_ID | AA_ID | NT LN | AA LN | Score | P-value |
|---|---|---|---|---|---|---|
| 34648378_c2_2038 | 1747 | 8918 | 1251 | 416 | 2020 | 7.3e-209 |

Description sp:[LN:NADR_SALTY] [AC:P24518] [GN:NADR:NADI:PNUA] [OR:Salmonella typhimurium] [DE:TRANSCRIPTIONAL REGULATOR NADR] [SP:P24518] [DB:swissprot] >sp:[LN:B37753] [AC:B37753] [PN:NadR protein] [OR:Salmonella typhimurium] [DB:pir2] >gp:[GI:g643057] [LN:STYNADR] [AC:M85181:M33722] [PN:NAD-responsive repressor] [GN:nadR] [OR:Salmonella typhimurium] [SR:Salmonella typhimurium (strain LT2) DNA] [DB:genpept-bct1] [DE:Salmonella typhimurium NAD repressor (nadR) gene, complete cds.] [LE:1048] [RE:2277] [DI:direct]

| ORF Name | NT ID | AA ID | NT LN | AA LN | Score | P-value |
|---|---|---|---|---|---|---|
| 34648932_f2_834 | 1748 | 8919 | 867 | 288 | 1217 | 9.1e-124 |

Description sp:[LN:YTFG_ECOLI] [AC:P39315] [GN:YTFG] [OR:Escherichia coli] [DE:HYPOTHETICAL
29.7 KD PROTEIN IN RPLI-CPDB INTERGENIC REGION (F286)] [SP:P39315] [DB:swissprot]
>sp:[LN:S56436] [AC:S56436:F65232] [PN:hypothetical 29.7K protein (rpli-cpdb
intergenic region):hypothetical protein f286] [GN:ytfG] [OR:Escherichia coli]
[DB:pir2] >gp:[GI:g537052] [LN:ECOUW93] [AC:U14003] [OR:Escherichia coli]
[DB:genpept-bct1] [DE:Escherichia coli K-12 chromosomal region from 92.8 to 00.1
minutes.] [NT:ORF_f286] [LE:123996] [RE:124856] [DI:complement] >gp:[GI:g1790656]
[LN:AE000492] [AC:AE000492:U00096] [PN:putative oxidoreductase] [GN:ytfG]
[FN:putative enzyme; Not classified] [OR:Escherichia coli] [DB:genpept-bct2]
[DE:Escherichia coli K-12 MG1655 section 382 of 400 of the completegenome.]
[NT:f286; 100 pct identical amino acid sequence and] [LE:5736] [RE:6596]
[DI:complement]

| ORF Name | NT ID | AA ID | NT LN | AA LN | Score | P-value |
|---|---|---|---|---|---|---|
| 35163412_f2_438 | 1749 | 8920 | 285 | 94 | 421 | 2.0e-39 |

Description sp:[LN:R3EC20] [AC:A30425:A02748:S40547:G64722:S07374] [PN:ribosomal protein
S20/L26:ribosomal protein L26:ribosomal protein S20] [GN:rpsT] [CL:Escherichia
coli ribosomal protein S20] [OR:Escherichia coli] [DB:pir1] [MP:0 min]
>gp:[GI:d1001774:g285763] [LN:ECO110K]
[AC:D10483:J01597:J01683:J01706:K01298:K01990:M10420:M10611:M12544] [PN:ribosomal
protein S20] [GN:rpsT] [OR:Escherichia coli] [SR:Escherichia coli (strain:K-12)
DNA] [DB:genpept-bct1] [DE:E.coli K12 genome, 0-2.4min. region.] [LE:20478]
[RE:20741] [DI:complement] >gp:[GI:g581224] [LN:ECRPSTB]
[AC:X04382:J01683:V00345] [PN:ribosomal protein S20] [GN:rpsT] [OR:Escherichia
coli] [DB:genpept-bct1] [DE:E. coli gene rpsT for ribosomal protein S20 and
distal region withIS1 and ORF for 28kd polypeptide.] [SP:P02378] [LE:273]
[RE:536] [DI:direct] >gp:[GI:g1786206] [LN:AE000113] [AC:AE000113:U00096] [PN:30S
ribosomal subunit protein S20] [GN:rpsT] [FN:structural component; Ribosomal
proteins -] [OR:Escherichia coli] [DB:genpept-bct2] [DE:Escherichia coli K-12
MG1655 section 3 of 400 of the completegenome.] [NT:f87; 100 pct identical
RS20_ECOLI SW: P02378 but] [LE:156] [RE:419] [DI:complement]

| ORF Name | NT ID | AA ID | NT LN | AA LN | Score | P-value |
|---|---|---|---|---|---|---|
| 35244756_f3_1092 | 1750 | 8921 | 1521 | 506 | 709 | 6.2e-70 |

Description sp:[LN:B70831] [AC:B70831] [PN:probable dehydrogenase] [GN:Rv0449c]
[OR:Mycobacterium tuberculosis] [DB:pir2] >gp:[GI:e1252518:g2909524] [LN:MTV037]
[AC:AL021932:AL123456] [PN:hypothetical protein Rv0449c] [GN:Rv0449c]
[OR:Mycobacterium tuberculosis] [DB:genpept-bct1] [DE:Mycobacterium tuberculosis
H37Rv complete genome; segment 22/162.] [NT:Rv0449c, (MTV037.13c), len: 439.
Possible] [LE:11128] [RE:12447] [DI:complement]

| ORF Name | NT ID | AA ID | NT LN | AA LN | Score | P-value |
|---|---|---|---|---|---|---|
| 35245381_c1_1492 | 1751 | 8922 | 204 | 67 | 149 | 2.7e-10 |

Description gp:[GI:e1549684:g5832509] [LN:YPCD1] [AC:AL117189] [PN:putative transposase]
[GN:YPCD1.94] [OR:Yersinia pestis] [DB:genpept-bct1] [DE:Yersinia pestis plasmid
pCD1.] [NT:YPCD1.94, probable transposase, len: 269 aa;] [LE:67222] [RE:68031]
[DI:direct]

| ORF Name | NT ID | AA ID | NT LN | AA LN | Score | P-value |
|---|---|---|---|---|---|---|
| 35289692_c1_1376 | 1752 | 8923 | 357 | 118 | | |

Description

NO-HIT

| ORF Name | NT ID | AA ID | NT LN | AA LN | Score | P-value |
|---|---|---|---|---|---|---|
| 35290833_c2_1705 | 1753 | 8924 | 498 | 165 | 660 | 9.6e-65 |

Description sp:[LN:YJEB_ECOLI] [AC:P21498] [GN:YJEB] [OR:Escherichia coli] [DE:HYPOTHETICAL
15.6 KD PROTEIN IN PURA-VACB INTERGENIC REGION] [SP:P21498] [DB:swissprot]
>sp:[LN:S56403] [AC:S56403:E65228:B31965] [PN:hypothetical 15.6K protein
(purA-vacB intergenic region):hypothetical protein o141] [GN:yjeB]
[CL:hypothetical protein b2531] [OR:Escherichia coli] [DB:pir1] [MP:95 min]
>gp:[GI:g537019] [LN:ECOUW93] [AC:U14003] [GN:yjeB] [OR:Escherichia coli]
[DB:genpept-bct1] [DE:Escherichia coli K-12 chromosomal region from 92.8 to 00.1
minutes.] [LE:97018] [RE:97443] [DI:direct] >gp:[GI:d1002251:g912442]
[LN:SHFVACB] [AC:D11024] [PN:ORF-1] [OR:Shigella flexneri] [SR:Shigella flexneri
(sub_species:2a) DNA] [DB:genpept-bct1] [DE:Shigella flexneri vacB gene.]
[LE:210] [RE:635] [DI:direct] >gp:[GI:g1790621] [LN:AE000490]
[AC:AE000490:U00096] [PN:orf, hypothetical protein] [GN:yjeB] [FN:orf; Unknown]
[OR:Escherichia coli] [DB:genpept-bct2] [DE:Escherichia coli K-12 MG1655 section
380 of 400 of the completegenome.] [NT:o141; 100 pct identical amino acid
sequence and] [LE:1874] [RE:2299] [DI:direct]

| ORF Name | NT ID | AA ID | NT LN | AA LN | Score | P-value |
|---|---|---|---|---|---|---|
| 35291716_f3_1147 | 1754 | 8925 | 1125 | 374 | 1553 | 2.3e-159 |

Description sp:[LN:S56495] [AC:S56495:H65239] [PN:probable aryl alcohol dehydrogenase, yjgB]
[GN:yjgB] [CL:alcohol dehydrogenase:long-chain alcohol dehydrogenase homology]
[OR:Escherichia coli] [EC:1.1.1.-] [DB:pir1] >gp:[GI:g537111] [LN:ECOUW93]
[AC:U14003] [GN:yjgB] [OR:Escherichia coli] [DB:genpept-bct1] [DE:Escherichia
coli K-12 chromosomal region from 92.8 to 00.1 minutes.] [LE:186025] [RE:187086]
[DI:complement] >gp:[GI:g1790720] [LN:AE000497] [AC:AE000497:U00096] [PN:putative
oxidoreductase] [GN:yjgB] [FN:putative enzyme; Not classified] [OR:Escherichia
coli] [DB:genpept-bct2] [DE:Escherichia coli K-12 MG1655 section 387 of 400 of
the completegenome.] [NT:f353; 100 pct identical to 339 amino acids of] [LE:9168]
[RE:10229] [DI:complement]

| ORF Name | NT ID | AA ID | NT/LN | AA/LN | Score | P-value |
|---|---|---|---|---|---|---|
| 35314506_c1_1566 | 1755 | 8926 | 1494 | 497 | 1195 | 1.9e-121 |

Description gp:[GI:g4378160] [LN:AF102543] [AC:AF102543] [PN:succinic semialdehyde dehydrogenase] [GN:gabD] [OR:Zymomonas mobilis] [DB:genpept-bct2] [DE:Zymomonas mobilis ZM4 fosmid clone 43A9, complete sequence.] [LE:6332] [RE:7708] [DI:complement]

| ORF Name | NT ID | AA ID | NT/LN | AA/LN | Score | P-value |
|---|---|---|---|---|---|---|
| 35361651_c1_1650 | 1756 | 8927 | 480 | 159 | 123 | 7.7e-08 |

Description sp:[LN:B48571] [AC:B48571] [PN:circumsporozoite protein PVCS type 2 (repeat region)] [CL:circumsporozoite protein:thrombospondin type 1 repeat homology] [OR:Plasmodium simium] [DB:pir2]

| ORF Name | NT ID | AA ID | NT/LN | AA/LN | Score | P-value |
|---|---|---|---|---|---|---|
| 35401080_f2_709 | 1757 | 8928 | 399 | 132 | 181 | 8.9e-14 |

Description sp:[LN:D72331] [AC:D72331] [PN:sugar ABC transporter, permease protein] [GN:TM0811] [CL:inner membrane protein ugpA] [OR:Thermotoga maritima] [DB:pir2] >gp:[GI:g4981341] [LN:AE001748] [AC:AE001748:AE000512] [PN:sugar ABC transporter, permease protein] [GN:TM0811] [OR:Thermotoga maritima] [DB:genpept-bct2] [DE:Thermotoga maritima section 60 of 136 of the complete genome.] [NT:similar to PID:1652461 percent identity: 68.25;] [LE:11278] [RE:12180] [DI:direct]

| ORF Name | NT ID | AA ID | NT/LN | AA/LN | Score | P-value |
|---|---|---|---|---|---|---|
| 35406951_f1_421 | 1758 | 8929 | 555 | 185 | 148 | 2.0e-09 |

Description sp:[LN:A40437] [AC:A40437] [PN:glutamic acid-rich protein, retinal] [OR:Bos primigenius taurus] [SR:, cattle] [DB:pir2] >gp:[GI:g163078] [LN:BOVGARPRET] [AC:M61185] [OR:Bos taurus] [SR:B.taurus, cDNA to mRNA] [DB:genpept-mam] [DE:Bovine glutamic acid-rich protein mRNA, complete cds.] [NT:glutamic acid-rich protein] [LE:61] [RE:1833] [DI:direct]

| ORF Name | NT ID | AA ID | NT/LN | AA/LN | Score | P-value |
|---|---|---|---|---|---|---|
| 35433290_c1_1681 | 1759 | 8930 | 195 | 64 | | |

Description

NO-HIT

| ORF_Name | NT ID | AA ID | NT LN | AA LN | Score | P-value |
|---|---|---|---|---|---|---|
| 35562903_f2_743 | 1760 | 8931 | 357 | 118 | 108 | 3.9e-06 |

Description gp:[GI:e1370577:g4158178] [LN:SC1A6] [AC:AL023496] [PN:hypothetical protein]
[OR:Streptomyces coelicolor] [DB:genpept-bct1] [DE:Streptomyces coelicolor cosmid
1A6.] [NT:Protein sequence is in conflict with the conceptual] [LE:<1] [RE:574]
[DI:direct]

| ORF_Name | NT ID | AA ID | NT LN | AA LN | Score | P-value |
|---|---|---|---|---|---|---|
| 35625692_c1_1485 | 1761 | 8932 | 309 | 102 | 431 | 1.8e-40 |

Description gp:[GI:g5420069] [LN:YEN132945] [AC:AJ132945] [PN:IS1400 transposase A]
[GN:trp1400A] [OR:Yersinia enterocolitica] [DB:genpept-bct1] [DE:Yersinia
enterocolitica WA 314 right arm of the high-pathogenicityisland.] [LE:6464]
[RE:6754] [DI:complement]

| ORF_Name | NT ID | AA ID | NT LN | AA LN | Score | P-value |
|---|---|---|---|---|---|---|
| 35632081_f3_1028 | 1762 | 8933 | 240 | 79 | 350 | 6.8e-32 |

Description sp:[LN:YJIX_ECOLI] [AC:P39395] [GN:YJIX] [OR:Escherichia coli] [DE:HYPOTHETICAL
7.7 KD PROTEIN IN MRR-TSR INTERGENIC REGION (F67)] [SP:P39395] [DB:swissprot]
>sp:[LN:S56579] [AC:S56579:C65250] [PN:hypothetical 7.7K protein (mrr-tsr
intergenic region):hypothetical protein f67] [GN:yjiX] [OR:Escherichia coli]
[DB:pir2] >gp:[GI:g537195] [LN:ECOUW93] [AC:U14003] [OR:Escherichia coli]
[DB:genpept-bct1] [DE:Escherichia coli K-12 chromosomal region from 92.8 to 00.1
minutes.] [NT:ORF_f67] [LE:279710] [RE:279913] [DI:complement] >gp:[GI:g1790813]
[LN:AE000506] [AC:AE000506:U00096] [PN:orf, hypothetical protein] [GN:yjiX]
[FN:orf; Unknown] [OR:Escherichia coli] [DB:genpept-bct2] [DE:Escherichia coli
K-12 MG1655 section 396 of 400 of the completegenome.] [NT:f67; 100 pct identical
amino acid sequence and] [LE:2024] [RE:2227] [DI:complement]

| ORF_Name | NT ID | AA ID | NT LN | AA LN | Score | P-value |
|---|---|---|---|---|---|---|
| 35651580_f2_581 | 1763 | 8934 | 285 | 94 | | |

Description

NO-HIT

| ORF Name | NT ID | AA ID | NT LN | AA LN | Score | P-value |
|---|---|---|---|---|---|---|
| 35657783_f3_970 | 1764 | 8935 | 237 | 78 | 312 | 7.2e-28 |

Description sp:[LN:FHUF_ECOLI] [AC:P39405] [GN:FHUF] [OR:Escherichia coli] [DE:FERRIC
HYDROXAMATE TRANSPORT PROTEIN FHUF] [SP:P39405] [DB:swissprot] >sp:[LN:S56594]
[AC:S56594:A65252] [PN:hypothetical 30.1K protein (dnaT-holD intergenic
region):hypothetical protein f262b] [GN:yjjS] [CL:Escherichia coli hypothetical
30.1K protein (dnaT-holD intergenic region)] [OR:Escherichia coli] [DB:pir2]
>gp:[GI:g537210] [LN:ECOUW93] [AC:U14003] [OR:Escherichia coli] [DB:genpept-bct1]
[DE:Escherichia coli K-12 chromosomal region from 92.8 to 00.1 minutes.]
[NT:ORF_f262b] [LE:295707] [RE:296495] [DI:complement] >gp:[GI:g1790829]
[LN:AE000507] [AC:AE000507:U00096] [PN:orf, hypothetical protein] [GN:fhuF]
[FN:orf; Unknown] [OR:Escherichia coli] [DB:genpept-bct2] [DE:Escherichia coli
K-12 MG1655 section 397 of 400 of the completegenome.] [NT:f262b; 100 pct
identical amino acid sequence and] [LE:7824] [RE:8612] [DI:complement]

| ORF Name | NT ID | AA ID | NT LN | AA LN | Score | P-value |
|---|---|---|---|---|---|---|
| 35798268_f3_1247 | 1765 | 8936 | 2502 | 833 | | |

Description

NO-HIT

| ORF Name | NT ID | AA ID | NT LN | AA LN | Score | P-value |
|---|---|---|---|---|---|---|
| 35823901_c1_1636 | 1766 | 8937 | 615 | 204 | 643 | 6.1e-63 |

Description sp:[LN:RIMI_ECOLI] [AC:P09453] [GN:RIMI] [OR:Escherichia coli] [EC:2.3.1.128]
[DE:(ACETYLATING ENZYME FOR N-TERMINAL OF RIBOSOMAL PROTEIN S18)] [SP:P09453]
[DB:swissprot] >sp:[LN:D65252] [AC:D65252:B48647:S01083]
[PN:ribosomal-protein-alanine N-acetyltransferase, rimI] [GN:rimI]
[CL:Escherichia coli ribosomal-protein-alanine N-acetyltransferase rimI]
[OR:Escherichia coli] [EC:2.3.1.128] [DB:pir1] [MP:99.3 min] >gp:[GI:g2367381]
[LN:AE000507] [AC:AE000507:U00096] [PN:acyltransferase for 30S ribosomal subunit]
[GN:rimI] [FN:enzyme; Ribosomes - maturation and] [OR:Escherichia coli]
[DB:genpept-bct2] [EC:2.3.1.128] [DE:Escherichia coli K-12 MG1655 section 397 of
400 of the completegenome.] [NT:o148; sequence change shortens and] [LE:11134]
[RE:11580] [DI:direct]

| ORF_Name | NT_ID | AA_ID | NT/LN | AA/LN | Score | P-value |
|---|---|---|---|---|---|---|
| 35828917_f2_605 | 1767 | 8938 | 2769 | 922 | 3906 | 0.0 |

Description sp:[LN:YHIH_ECOLI] [AC:P37624:P37625] [GN:YHIH] [OR:Escherichia coli]
[DE:HYPOTHETICAL ABC TRANSPORTER ATP-BINDING PROTEIN YHIH] [SP:P37624:P37625]
[DB:swissprot] >sp:[LN:A65146] [AC:A65146:S47705:S47706] [PN:probable ABC
transporter yhiH:hyoithetical protein, rhsB-pit intergenic region] [GN:yhiH:yhiH]
[CL:Escherichia coli probable ABC transporter yhiH:ATP-binding cassette homology]
[OR:Escherichia coli] [DB:pir1] >gp:[GI:g2367231] [LN:AE000424]
[AC:AE000424:U00096] [PN:putative ATP-binding component of a transport] [GN:yhiH]
[FN:putative transport; Not classified] [OR:Escherichia coli] [DB:genpept-bct2]
[DE:Escherichia coli K-12 MG1655 section 314 of 400 of the completegenome.]
[NT:f894; sequence change joins ORFs yhiG and yhiH from] [LE:7676] [RE:10360]
[DI:complement]

| ORF_Name | NT_ID | AA_ID | NT/LN | AA/LN | Score | P-value |
|---|---|---|---|---|---|---|
| 35833316_f1_368 | 1768 | 8939 | 903 | 300 | 653 | 5.3e-64 |

Description sp:[LN:ARAC_ERWCH] [AC:P07642] [GN:ARAC] [OR:Erwinia chrysanthemi] [DE:ARABINOSE
OPERON REGULATORY PROTEIN] [SP:P07642] [DB:swissprot] >sp:[LN:A25027] [AC:A25027]
[PN:arabinose operon regulatory protein] [GN:araC] [CL:arabinose operon
regulatory protein] [OR:Erwinia carotovora] [DB:pir2] >gp:[GI:g148382]
[LN:ERWARAC] [AC:M11981] [OR:Erwinia carotovora] [SR:E.carotovora DNA]
[DB:genpept-bct1] [DE:Erwinia carotovora araC gene encoding the araBAD operon
regulator,complete cds.] [NT:operon regulatory protein] [LE:483] [RE:1415]
[DI:direct]

| ORF_Name | NT_ID | AA_ID | NT/LN | AA/LN | Score | P-value |
|---|---|---|---|---|---|---|
| 35955312_f1_222 | 1769 | 8940 | 2253 | 750 | 216 | 1.5e-16 |

Description gp:[GI:g5814316] [LN:AF144879] [AC:AF144879] [PN:unknown] [OR:Leptospira
interrogans] [DB:genpept-bct2] [DE:Leptospira interrogans rfb locus, complete
sequence.] [NT:OrfJ22] [LE:25109] [RE:25954] [DI:direct]

| ORF_Name | NT_ID | AA_ID | NT/LN | AA/LN | Score | P-value |
|---|---|---|---|---|---|---|
| 36031377_f3_1101 | 1770 | 8941 | 1521 | 506 | 2195 | 2.1e-227 |

Description gp:[GI:g4416204] [LN:AF092042] [AC:AF092042] [PN:xyloside transporter] [GN:xynT]
[OR:Lactococcus lactis subsp. lactis] [DB:genpept-bct2] [DE:Lactococcus lactis
subsp. lactis (Lactobacillus xylosus) strainNRRL B-4449 xylose regulatory protein
(xylR), xylose isomerase(xylA), xylulokinase (xylB), mutarotase (xylM), and
xylosidetransporter (xynT) genes, complete cds; and beta-1,4-xylosidase(xynB)
gene, partial cds.] [LE:5289] [RE:6773] [DI:direct]

| ORF Name | NT ID | AA ID | NT LN | AA LN | Score | P-value |
|---|---|---|---|---|---|---|
| 36041550_f2_574 | 1771 | 8942 | 2169 | 722 | 3553 | 0.0 |

Description sp:[LN:YJIY_ECOLI] [AC:P39396] [GN:YJIY] [OR:Escherichia coli] [DE:HYPOTHETICAL 77.9 KD PROTEIN IN MRR-TSR INTERGENIC REGION] [SP:P39396] [DB:swissprot] >sp:[LN:S56580] [AC:S56580:D65250] [PN:carbon starvation protein-like protein yjiY:protein f721] [GN:yjiY] [CL:carbon starvation protein] [OR:Escherichia coli] [DB:pir2] >gp:[GI:g537196] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_f721] [LE:279963] [RE:282128] [DI:complement] >gp:[GI:g1790814] [LN:AE000506] [AC:AE000506:U00096] [PN:putative carbon starvation protein] [GN:yjiY] [FN:orf; Not classified] [OR:Escherichia coli] [DB:genpept-bct2] [DE:Escherichia coli K-12 MG1655 section 396 of 400 of the completegenome.] [NT:f721; 100 pct identical amino acid sequence and] [LE:2277] [RE:4442] [DI:complement]

| ORF Name | NT ID | AA ID | NT LN | AA LN | Score | P-value |
|---|---|---|---|---|---|---|
| 36142951_c1_1319 | 1772 | 8943 | 735 | 244 | 1062 | 2.4e-107 |

Description sp:[LN:SGAE_ECOLI] [AC:P39306] [GN:SGAE] [OR:Escherichia coli] [EC:5.1.-.-] [DE:PROBABLE SUGAR ISOMERASE SGAE,] [SP:P39306] [DB:swissprot] >sp:[LN:S56423] [AC:S56423:A65231] [PN:L-ribulose-phosphate 4-epimerase homolog, o228a:protein b4198:protein o228a] [CL:L-ribulose-phosphate 4-epimerase] [OR:Escherichia coli] [EC:5.1.3.-] [DB:pir2] >gp:[GI:g537039] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_o228a] [LE:114532] [RE:115218] [DI:direct] >gp:[GI:g1790642] [LN:AE000491] [AC:AE000491:U00096] [PN:putative epimerase/aldolase] [GN:sgaE] [FN:putative enzyme; Not classified] [OR:Escherichia coli] [DB:genpept-bct2] [DE:Escherichia coli K-12 MG1655 section 381 of 400 of the completegenome.] [NT:o228a] [LE:7366] [RE:8052] [DI:direct]

| ORF Name | NT ID | AA ID | NT LN | AA LN | Score | P-value |
|---|---|---|---|---|---|---|
| 36194668_f2_665 | 1773 | 8944 | 510 | 169 | | |

Description

NO-HIT

| ORF Name | NT ID | AA ID | NT LN | AA LN | Score | P-value |
|---|---|---|---|---|---|---|
| 36220161_f2_816 | 1774 | 8945 | 219 | 72 | 72 | 0.019 |

Description gp:[GI:g780643] [LN:MMU23020] [AC:U23020] [PN:immunoglobulin heavy chain] [OR:Mus musculus] [SR:house mouse] [DB:genpept-rod] [DE:Mus musculus C57BL/6 immunoglobulin heavy chain V region mRNA,clone CB17H-10, partial cds.] [NT:7183 Vh gene family] [LE:<1] [RE:>286] [DI:direct]

| ORF Name | NT ID | AA ID | NT/LN | AA/LN | Score | P-value |
|---|---|---|---|---|---|---|
| 36359693_f1_26 | 1775 | 8946 | 573 | 190 | 840 | 8.1e-84 |

Description sp:[LN:YAAH_ECOLI] [AC:P28695] [GN:YAAH] [OR:Escherichia coli] [DE:HYPOTHETICAL
20.1 KD PROTEIN IN MOG-HTGA INTERGENIC REGION (ORF5)] [SP:P28695] [DB:swissprot]
>sp:[LN:E56688] [AC:E56688:B64721:S28459] [PN:protein yaaH] [GN:yaaH]
[OR:Escherichia coli] [DB:pir2] >gp:[GI:g41756] [LN:ECHTGA] [AC:X67700]
[OR:Escherichia coli] [DB:genpept-bct1] [DE:E.coli dnaK and htgA genes.]
[NT:ORF5] [SP:P28695] [LE:1017] [RE:1583] [DI:complement] >gp:[GI:g1786191]
[LN:AE000111] [AC:AE000111:U00096] [PN:orf, hypothetical protein] [GN:yaaH]
[FN:orf; Unknown] [OR:Escherichia coli] [DB:genpept-bct2] [DE:Escherichia coli
K-12 MG1655 section 1 of 400 of the completegenome.] [NT:f188; 100 pct identical
to YAAH_ECOLI SW: P28695] [LE:9928] [RE:10494] [DI:complement]

| ORF Name | NT ID | AA ID | NT/LN | AA/LN | Score | P-value |
|---|---|---|---|---|---|---|
| 36375066_f1_179 | 1776 | 8947 | 1215 | 404 | 1687 | 1.4e-173 |

Description sp:[LN:S47704] [AC:S47704:H65145] [PN:hypothetical 41.1K protein (rhsB-pit
intergenic region):yhhJ protein] [GN:yhhJ] [OR:Escherichia coli] [DB:pir2]
>gp:[GI:g466621] [LN:ECOUW76] [AC:U00039] [OR:Escherichia coli] [SR:Escherichia
coli (sub_strain MG1655, strain K-12) (library: lambda] [DB:genpept-bct1] [DE:E.
coli chromosomal region from 76.0 to 81.5 minutes.] [NT:alternate gene name yhhJ]
[LE:39941] [RE:41068] [DI:complement] >gp:[GI:g1789897] [LN:AE000424]
[AC:AE000424:U00096] [PN:putative transporter] [GN:yhhJ] [FN:putative transport;
Not classified] [OR:Escherichia coli] [DB:genpept-bct2] [DE:Escherichia coli K-12
MG1655 section 314 of 400 of the completegenome.] [NT:f375; 100 pct identical
amino acid sequence and] [LE:6552] [RE:7679] [DI:complement]

| ORF Name | NT ID | AA ID | NT/LN | AA/LN | Score | P-value |
|---|---|---|---|---|---|---|
| 36437713_f1_279 | 1777 | 8948 | 297 | 98 | 78 | 0.018 |

Description gp:[GI:d1045488:g5139695] [LN:AB029147] [AC:AB029147] [OR:Cucumis sativus]
[SR:Cucumis sativus cDNA to mRNA] [DB:genpept-pln1] [DE:Cucumis sativus mRNA
expressed in cucumber hypocotyls, completecds.] [NT:expressed in cucumber
hypocotyls] [LE:21] [RE:752] [DI:direct]

| ORF Name | NT ID | AA ID | NT/LN | AA/LN | Score | P-value |
|---|---|---|---|---|---|---|
| 36448292_c3_2440 | 1778 | 8949 | 1356 | 451 | 1366 | 1.5e-139 |

Description sp:[LN:YEIM_HAEIN] [AC:P44742] [GN:HI0519] [OR:Haemophilus influenzae]
[DE:HYPOTHETICAL PROTEIN HI0519] [SP:P44742] [DB:swissprot] >sp:[LN:A64154]
[AC:A64154] [PN:hypothetical protein HI0519] [CL:pyrimidine nucleoside transport
protein nupC] [OR:Haemophilus influenzae] [DB:pir2] >gp:[GI:g1573502] [LN:U32734]
[AC:U32734:L42023] [PN:transport protein, putative] [GN:HI0519] [OR:Haemophilus
influenzae Rd] [DB:genpept-bct2] [DE:Haemophilus influenzae Rd section 49 of 163
of the complete genome.] [NT:similar to GB:AE000511 PID:2314337 percent]
[LE:2317] [RE:3570] [DI:complement]

| ORF Name | NT ID | AA ID | NT/LN | AA/LN | Score | P-value |
|---|---|---|---|---|---|---|
| 36507842_c3_2146 | 1779 | 8950 | 1761 | 586 | 2585 | 9.8e-269 |

Description sp:[LN:YTFM_ECOLI] [AC:P39320] [GN:YTFM] [OR:Escherichia coli] [DE:(O577)]
[SP:P39320] [DB:swissprot] >sp:[LN:S56445] [AC:S56445:G65233] [PN:hypothetical
64.8K protein (msra-chpbi intergenic region):hypothetical protein o577] [GN:ytfM]
[OR:Escherichia coli] [DB:pir2] >gp:[GI:g537061] [LN:ECOUW93] [AC:U14003]
[OR:Escherichia coli] [DB:genpept-bct1] [DE:Escherichia coli K-12 chromosomal
region from 92.8 to 00.1 minutes.] [NT:ORF_o577] [LE:133213] [RE:134946]
[DI:direct] >gp:[GI:g1790666] [LN:AE000493] [AC:AE000493:U00096] [PN:orf,
hypothetical protein] [GN:ytfM] [FN:orf; Unknown] [OR:Escherichia coli]
[DB:genpept-bct2] [DE:Escherichia coli K-12 MG1655 section 383 of 400 of the
completegenome.] [NT:o577; 100 pct identical amino acid sequence and] [LE:4830]
[RE:6563] [DI:direct]

| ORF Name | NT ID | AA ID | NT/LN | AA/LN | Score | P-value |
|---|---|---|---|---|---|---|
| 36520331_c3_2166 | 1780 | 8951 | 1140 | 379 | 179 | 8.2e-11 |

Description gp:[GI:e1537847:g5763686] [LN:EAC245960] [AC:AJ245960] [PN:selenocysteine
synthase] [GN:selA] [FN:conversion of seryl-tRNA(Sec) to] [OR:Eubacterium
acidaminophilum] [DB:genpept-bct1] [DE:Eubacterium acidaminophilum selD1, selA,
selB and ackA (partial)genes.] [LE:1189] [RE:2592] [DI:direct]

| ORF Name | NT ID | AA ID | NT/LN | AA/LN | Score | P-value |
|---|---|---|---|---|---|---|
| 36522760_c3_2327 | 1781 | 8952 | 408 | 135 | | |

Description

NO-HIT

| ORF Name | NT ID | AA ID | NT/LN | AA/LN | Score | P-value |
|---|---|---|---|---|---|---|
| 36572031_c2_1701 | 1782 | 8953 | 1302 | 433 | 1914 | 1.3e-197 |

Description sp:[LN:HFLK_ECOLI] [AC:P25662] [GN:HFLK:HFLA] [OR:Escherichia coli] [DE:HFLK
PROTEIN] [SP:P25662] [DB:swissprot] >sp:[LN:B43653] [AC:B43653:S56399:A65228]
[PN:probable integral membrane proteinase, hflK] [GN:hflK] [OR:Escherichia coli]
[EC:3.4.-.-] [DB:pir2] >gp:[GI:g537015] [LN:ECOUW93] [AC:U14003] [GN:hflK]
[OR:Escherichia coli] [DB:genpept-bct1] [DE:Escherichia coli K-12 chromosomal
region from 92.8 to 00.1 minutes.] [NT:CG Site No. 639; alternate gene name hflA;
putative] [LE:92866] [RE:94125] [DI:direct] >gp:[GI:g1790616] [LN:AE000489]
[AC:AE000489:U00096] [PN:protease specific for phage lambda cII] [GN:hflK]
[FN:enzyme; Degradation of proteins, peptides,] [OR:Escherichia coli]
[DB:genpept-bct2] [DE:Escherichia coli K-12 MG1655 section 379 of 400 of the
completegenome.] [NT:o419; 100 pct identical to HFLK_ECOLI SW: P25662;] [LE:9752]
[RE:11011] [DI:direct] >gp:[GI:g436157] [LN:ECOHFLA] [AC:U00005] [GN:hflK]
[OR:Escherichia coli] [SR:Escherichia coli K12] [DB:genpept-bct2] [DE:E. coli
hflA locus encoding the hflX, hflK and hflC genes, hfqgene, complete cds; miaA
gene, partial cds.] [NT:putative integral membrane protein required for]
[LE:2488] [RE:3747] [DI:direct]

| ORF Name | NT ID | AA ID | NT/LN | AA/LN | Score | P-value |
|---|---|---|---|---|---|---|
| 3923801_c3_2288 | 1783 | 8954 | 648 | 215 | 308 | 1.9e-27 |

Description gp:[GI:d1033350:g3426011] [LN:AB016803] [AC:AB016803] [OR:Deinococcus
radiodurans] [SR:Deinococcus radiodurans (strain:KD8301) DNA, clone_lib:pDC509]
[DB:genpept-bct1] [DE:Deinococcus radiodurans ppsA, orf509f, insertion sequence
IS8301,tnpB, tnpC, orf509d and orf509e genes, partial and complete cds.]
[NT:disrupted by IS8301 insertion; orf509f] [LE:1654:3756] [RE:2019:4115]
[DI:directJoin]

| ORF Name | NT ID | AA ID | NT/LN | AA/LN | Score | P-value |
|---|---|---|---|---|---|---|
| 3941088_c1_1477 | 1784 | 8955 | 1125 | 374 | 620 | 1.7e-60 |

Description sp:[LN:C70481] [AC:C70481] [PN:initiation factor eIF-2B alpha subunit] [GN:eif]
[OR:Aquifex aeolicus] [DB:pir2] >gp:[GI:g2984318] [LN:AE000773]
[AC:AE000773:AE000657] [PN:initiation factor eIF-2B alpha subunit] [GN:eif]
[OR:Aquifex aeolicus] [DB:genpept-bct2] [DE:Aquifex aeolicus section 105 of 109
of the complete genome.] [LE:9527] [RE:10897] [DI:complement]

| ORF Name | NT ID | AA ID | NT/LN | AA/LN | Score | P-value |
|---|---|---|---|---|---|---|
| 3947183_c2_1792 | 1785 | 8956 | 456 | 151 | 630 | 1.4e-61 |

Description sp:[LN:YJGK_ECOLI] [AC:P39335] [GN:YJGK] [OR:Escherichia coli] [DE:HYPOTHETICAL 17.3 KD PROTEIN IN PYRL-ARGI INTERGENIC REGION (O153B)] [SP:P39335] [DB:swissprot] >sp:[LN:S56477] [AC:S56477;G65237] [PN:hypothetical 17.3K protein (pyrL-argI intergenic region):hypothetical protein o153b] [GN:yjgK] [CL:hypothetical protein HI0227] [OR:Escherichia coli] [DB:pir1] >gp:[GI:g537093] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_o153b] [LE:165688] [RE:166149] [DI:direct] >gp:[GI:g1790701] [LN:AE000496] [AC:AE000496;U00096] [PN:orf, hypothetical protein] [GN:yjgK] [FN:orf; Unknown] [OR:Escherichia coli] [DB:genpept-bct2] [DE:Escherichia coli K-12 MG1655 section 386 of 400 of the completegenome.] [NT:o153b; 100 pct identical amino acid sequence and] [LE:708] [RE:1169] [DI:direct]

| ORF Name | NT ID | AA ID | NT/LN | AA/LN | Score | P-value |
|---|---|---|---|---|---|---|
| 395341_c3_2223 | 1786 | 8957 | 912 | 303 | 702 | 3.4e-69 |

Description sp:[LN:IOLH_BACSU] [AC:P42418] [GN:IOLH:B65A] [OR:Bacillus subtilis] [DE:IOLH PROTEIN] [SP:P42418] [DB:swissprot] >sp:[LN:H69645] [AC:H69645] [PN:myo-inositol catabolism iolH] [GN:iolH] [OR:Bacillus subtilis] [DB:pir2] >gp:[GI:d1003807;g709988] [LN:BACIOLO] [AC:D14399] [PN:hypothetical protein] [GN:B65A] [OR:Bacillus subtilis] [SR:Bacillus subtilis (strain:BGSC 1A1 (168 trpC2)) DNA] [DB:genpept-bct1] [DE:Bacillus subtilis 15 kb chromosome segment contains the iol operon.] [LE:8414] [RE:9283] [DI:direct] >gp:[GI:e1184694;g2636515] [LN:BSUB0021] [AC:Z99124;AL009126] [GN:iolH] [OR:Bacillus subtilis] [DB:genpept-bct1] [DE:Bacillus subtilis complete genome (section 21 of 21): from 3999281to 4214814.] [NT:alternate gene name: yxdG; myo-inositol catabolism] [LE:74406] [RE:75275] [DI:complement]

| ORF Name | NT ID | AA ID | NT/LN | AA/LN | Score | P-value |
|---|---|---|---|---|---|---|
| 3958137_c2_2069 | 1787 | 8958 | 1314 | 437 | 488 | 1.5e-80 |

Description sp:[LN:H64636] [AC:H64636] [PN:proline/betaine transporter] [OR:Helicobacter pylori] [DB:pir2]

| ORF Name | NT ID | AA ID | NT/LN | AA/LN | Score | P-value |
|---|---|---|---|---|---|---|
| 3958531_f1_348 | 1788 | 8959 | 795 | 264 | 144 | 3.1e-07 |

Description gp:[GI:e282242;g1679831] [LN:MAMAMIRM] [AC:X79027] [PN:unknown] [OR:Microbacterium ammoniaphilum] [DB:genpept-bct1] [DE:M.ammoniaphilum genes mamIR and mamIM.] [LE:3382] [RE:>4972] [DI:complement]

| ORF_Name | NT ID | AA ID | NT/LN | AA/LN | Score | P-value |
|---|---|---|---|---|---|---|
| 3961513_f2_531 | 1789 | 8960 | 549 | 182 | 714 | 1.8e-70 |

Description sp:[LN:RMECI] [AC:S56589:B28484:D65251:A25124] [PN:replication termination factor dnaT:primosomal protein i] [GN:dnaT] [CL:primosomal protein i] [OR:Escherichia coli] [DB:pir1] [MP:99 min] >gp:[GI:g145790] [LN:ECODNATC] [AC:J04030:J02785:M13005] [OR:Escherichia coli] [SR:E.coli (strain K12 C600) DNA [1]; clone pJK137 [2]] [DB:genpept-bct1] [DE:E.coli dna operon encoding normal and stable DNA replicationproteins P-14, dnaT, dnaC and P-18, complete cds.] [NT:prepriming protein I] [LE:523] [RE:1062] [DI:direct] >gp:[GI:g537205] [LN:ECOUW93] [AC:U14003] [GN:dnaT] [FN:DNA biosynthesis; primasomal protein i] [OR:Escherichia coli] [DB:genpept-bct1] [DE:Escherichia coli K-12 chromosomal region from 92.8 to 00.1 minutes.] [NT:CG Site No. 839] [LE:291810] [RE:292349] [DI:complement] >gp:[GI:g1790824] [LN:AE000507] [AC:AE000507:U00096] [PN:DNA biosynthesis; primosomal protein i] [GN:dnaT] [FN:factor; DNA - replication, repair,] [OR:Escherichia coli] [DB:genpept-bct2] [DE:Escherichia coli K-12 MG1655 section 397 of 400 of the completegenome.] [NT:f179; 99 pct identical amino acid sequence and] [LE:3927] [RE:4466] [DI:complement]

| ORF_Name | NT ID | AA ID | NT/LN | AA/LN | Score | P-value |
|---|---|---|---|---|---|---|
| 3995937_f3_1045 | 1790 | 8961 | 1263 | 420 | 1788 | 2.8e-184 |

Description sp:[LN:YJIM_ECOLI] [AC:P39384] [GN:YJIM] [OR:Escherichia coli] [DE:HYPOTHETICAL 43.6 KD PROTEIN IN IADA-MCRD INTERGENIC REGION (F390B)] [SP:P39384] [DB:swissprot] >sp:[LN:S56560] [AC:S56560:A65248] [PN:hypothetical 43.6K protein (iadA-mcrD intergenic region):hypothetical protein f390b] [GN:yjiM] [OR:Escherichia coli] [DB:pir2] >gp:[GI:g537176] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_f390b] [LE:255531] [RE:256703] [DI:complement] >gp:[GI:g1790792] [LN:AE000504] [AC:AE000504:U00096] [PN:orf, hypothetical protein] [GN:yjiM] [FN:orf; Unknown] [OR:Escherichia coli] [DB:genpept-bct2] [DE:Escherichia coli K-12 MG1655 section 394 of 400 of the completegenome.] [NT:f390b; 100 pct identical amino acid sequence and] [LE:2020] [RE:3192] [DI:complement]

| ORF_Name | NT ID | AA ID | NT/LN | AA/LN | Score | P-value |
|---|---|---|---|---|---|---|
| 4003413_c2_2012 | 1791 | 8962 | 1194 | 397 | 1492 | 6.6e-153 |

Description gp:[GI:g2425103] [LN:AF019891] [AC:AF019891] [PN:p-hydroxybenzoate hydroxylase] [GN:pobA] [OR:Azotobacter chroococcum] [DB:genpept-bct2] [EC:1.14.13.2] [DE:Azotobacter chroococcum p-hydroxybenzoate hydroxylase (pobA) gene,complete cds.] [NT:flavoprotein monooxygenase] [LE:125] [RE:1309] [DI:direct]

| ORF Name | NT ID | AA ID | NT/LN | AA/LN | Score | P-value |
|---|---|---|---|---|---|---|
| 4017343_c1_1591 | 1792 | 8963 | 450 | 149 | 731 | 2.9e-72 |

Description gp:[GI:d1010436:g940401] [LN:KPNMOAIP] [AC:D63524] [PN:MoaI protein] [GN:moaI]
[FN:putative DNA binding negative factor] [OR:Klebsiella aerogenes]
[SR:Klebsiella aerogenes (strain:W70) DNA] [DB:genpept-bct1] [DE:Klebsiella
aerogenes moaI gene for MoaI protein, complete cds.] [LE:288] [RE:728]
[DI:direct]

| ORF Name | NT ID | AA ID | NT/LN | AA/LN | Score | P-value |
|---|---|---|---|---|---|---|
| 4022252_f3_1293 | 1793 | 8964 | 351 | 116 | | |

Description

NO-HIT

| ORF Name | NT ID | AA ID | NT/LN | AA/LN | Score | P-value |
|---|---|---|---|---|---|---|
| 4026068_c2_1718 | 1794 | 8965 | 864 | 287 | 1359 | 8.1e-139 |

Description sp:[LN:SGAU_ECOLI] [AC:P39305] [GN:SGAU] [OR:Escherichia coli] [EC:5.-.-.-]
[DE:PUTATIVE HEXULOSE-6-PHOSPHATE ISOMERASE, (HUMPI)] [SP:P39305] [DB:swissprot]
>sp:[LN:S56422] [AC:S56422:H65230] [PN:hypothetical 32K protein (aidB-rpsF
intergenic region):hypothetical protein o284] [GN:yjfW] [CL:hypothetical protein
HI1026] [OR:Escherichia coli] [DB:pir2] >gp:[GI:g537038] [LN:ECOUW93] [AC:U14003]
[OR:Escherichia coli] [DB:genpept-bct1] [DE:Escherichia coli K-12 chromosomal
region from 92.8 to 00.1 minutes.] [NT:ORF_o284] [LE:113678] [RE:114532]
[DI:direct] >gp:[GI:g1790641] [LN:AE000491] [AC:AE000491:U00096] [PN:putative
hexulose-6-phosphate isomerase] [GN:sgaU] [FN:putative enzyme; Central
intermediary] [OR:Escherichia coli] [DB:genpept-bct2] [DE:Escherichia coli K-12
MG1655 section 381 of 400 of the completegenome.] [NT:o284; formerly designated
yjfW] [LE:6512] [RE:7366] [DI:direct]

| ORF Name | NT ID | AA ID | NT/LN | AA/LN | Score | P-value |
|---|---|---|---|---|---|---|
| 4035326_c2_1779 | 1795 | 8966 | 1383 | 460 | 1278 | 3.1e-130 |

Description sp:[LN:PTCC_BACSU] [AC:P46317] [GN:CELB:LICC] [OR:Bacillus subtilis] [DE:PERMEASE IIC COMPONENT) (PHOSPHOTRANSFERASE ENZYME II, C COMPONENT)] [SP:P46317] [DB:swissprot] >sp:[LN:F69651] [AC:F69651:S57760] [PN:PTS lichenan-specific enzyme IIC component licC:probable cellobiose phosphotransferase enzyme II''] [GN:licC] [CL:phosphotransferase system enzyme II factor II, phosphoenolpyruvate-dependent] [OR:Bacillus subtilis] [DB:pir2] >gp:[GI:g895749] [LN:BSCELABCD] [AC:Z49992] [PN:putative cellobiose phosphotransferase enzyme] [GN:celB] [OR:Bacillus subtilis] [DB:genpept-bct1] [DE:B.subtilis celA, celB, celC, celD and ywaA genes.] [NT:gtg start codon] [SP:P46317] [LE:2564] [RE:3922] [DI:direct] >gp:[GI:e1186357:g2636393] [LN:BSUB0020] [AC:Z99123:AL009126] [PN:phosphotransferase system (PTS)] [GN:licC] [FN:lichenan degradation products utilization] [OR:Bacillus subtilis] [DB:genpept-bct1] [DE:Bacillus subtilis complete genome (section 20 of 21): from 3798401to 4010550.] [NT:alternate gene name: celB] [SP:P46317] [LE:160586] [RE:161944] [DI:complement] >gp:[GI:d1012411:g1783267] [LN:D83026] [AC:D83026:D45911] [PN:cellobiose phosphotransferase enzyme II''] [GN:celB] [OR:Bacillus subtilis] [SR:Bacillus subtilis (strain:BGSC 1A1) DNA] [DB:genpept-bct1] [DE:Bacillus subtilis genome sequence covering lic-cel region.] [NT:putative] [LE:62521] [RE:63879] [DI:direct]

| ORF Name | NT ID | AA ID | NT/LN | AA/LN | Score | P-value |
|---|---|---|---|---|---|---|
| 4041693_c1_1318 | 1796 | 8967 | 477 | 158 | 698 | 9.0e-69 |

Description sp:[LN:PTXA_ECOLI] [AC:P39303] [GN:SGAA] [OR:Escherichia coli] [EC:2.7.1.69] [DE:(EC 2.7.1.69)] [SP:P39303] [DB:swissprot] >sp:[LN:F65230] [AC:F65230:S56420] [PN:hypothetical phosphotransferase enzyme II:hypothetical protein o158] [GN:ptxA] [CL:probable phosphotransferase protein yjfU:phosphotransferase system mannitol-specific enzyme II factor III homology] [OR:Escherichia coli] [DB:pir1] >gp:[GI:g2367359] [LN:AE000491] [AC:AE000491:U00096] [PN:putative PTS system enzyme II A component] [GN:ptxA] [FN:putative transport; Not classified] [OR:Escherichia coli] [DB:genpept-bct2] [DE:Escherichia coli K-12 MG1655 section 381 of 400 of the completegenome.] [NT:o154; formerly designated yjfU] [LE:5374] [RE:5838] [DI:direct]

| ORF Name | NT ID | AA ID | NT LN | AA LN | Score | P-value |
|---|---|---|---|---|---|---|
| 4070338_c3_2480 | 1797 | 8968 | 966 | 321 | 1535 | 1.8e-157 |

Description sp:[LN:S40535] [AC:S40535:H64720] [PN:transaldolase, B] [GN:talB] [OR:Escherichia coli] [EC:2.2.1.2] [DB:pir2] >gp:[GI:d1022679:g2337776] [LN:D13161] [AC:D13161] [PN:transaldolase] [GN:talB] [OR:Escherichia coli] [SR:Escherichia coli (strain:K-12, sub_strain:W3110) DNA] [DB:genpept-bct1] [EC:2.2.1.2] [DE:Escherichia coli talB gene for transaldolase, complete cds.] [LE:1] [RE:954] [DI:direct] >gp:[GI:d1001762:g216439] [LN:ECO110K] [AC:D10483:J01597:J01683:J01706:K01298:K01990:M10420:M10611:M12544] [OR:Escherichia coli] [SR:Escherichia coli (strain:K-12) DNA] [DB:genpept-bct1] [DE:E.coli K12 genome, 0-2.4min. region.] [NT:transaldolase homolog(SWISS:P15019)] [LE:7899] [RE:8852] [DI:direct] >gp:[GI:g1839303] [LN:S80045] [AC:S80045] [PN:transaldolase B] [GN:talB] [OR:Escherichia coli] [SR:Escherichia coli K-12] [DB:genpept-bct1] [DE:talB=transaldolase B [Escherichia coli, K-12, Genomic, 1139 nt].] [NT:This sequence comes from Fig. 1;] [LE:103] [RE:1056] [DI:direct] >gp:[GI:g1786189] [LN:AE000111] [AC:AE000111:U00096] [PN:transaldolase B] [GN:talB] [FN:enzyme; Central intermediary metabolism:] [OR:Escherichia coli] [DB:genpept-bct2] [EC:2.2.1.2] [DE:Escherichia coli K-12 MG1655 section 1 of 400 of the completegenome.] [NT:o317; 100 pct identical to TALB_ECOLI SW: P30148] [LE:8238] [RE:9191] [DI:direct]

| ORF Name | NT ID | AA ID | NT LN | AA LN | Score | P-value |
|---|---|---|---|---|---|---|
| 4103262_c2_1999 | 1798 | 8969 | 1035 | 344 | 388 | 6.4e-36 |

Description gp:[GI:g797332] [LN:ATU19620] [AC:U19620] [PN:MocD] [GN:mocD] [FN:conjugase which splits deoxyfructosyl glutamine] [OR:Agrobacterium tumefaciens] [DB:genpept-bct1] [DE:Agrobacterium tumefaciens plasmid pTi15955 moc operon, kinase(mocE), conjugase (mocD), repressor (mocR), mannopine oxidase(mocC), dehydratase (mocB), oxido-reductase (mocA), and repressor(mocR') genes, complete cds, and mannopine cyclase (agcA) gene,partial cds.] [LE:891] [RE:1913] [DI:complement]

| ORF Name | NT ID | AA ID | NT LN | AA LN | Score | P-value |
|---|---|---|---|---|---|---|
| 4114583_c2_1784 | 1799 | 8970 | 270 | 89 | | |

Description

NO-HIT

| ORF Name | NT ID | AA ID | NT LN | AA LN | Score | P-value |
|---|---|---|---|---|---|---|
| 4146068_f1_128 | 1800 | 8971 | 390 | 129 | 593 | 1.2e-57 |

Description gp:[GI:g5833398] [LN:AF144422] [AC:AF144422] [PN:HpaF] [GN:hpaF] [OR:Salmonella dublin] [DB:genpept-bct2] [DE:Salmonella dublin 4-hydroxyphenylacetate catabolic locus, completesequence.] [LE:4112] [RE:4492] [DI:complement]

| ORF Name | NT ID | AA ID | NT/LN | AA/LN | Score | P-value |
|---|---|---|---|---|---|---|
| 4146900_f3_1251 | 1801 | 8972 | 738 | 245 | 1042 | 3.2e-105 |

Description sp:[LN:S56444] [AC:S56444:F65233:JC1317:PC1146] [PN:protein-methionine-S-oxide reductase,:peptide methionine sulfoxide reductase] [GN:msrA] [CL:peptide methionine sulfoxide reductase] [OR:Escherichia coli] [EC:1.8.4.6] [DB:pir2] >gp:[GI:g147305] [LN:ECOPMSR] [AC:M89992] [PN:peptide methionine sulfoxide reductase] [OR:Escherichia coli] [SR:Escherichia coli (strain B) DNA] [DB:genpept-bct1] [DE:Escherichia coli peptide methionine sulfoxide reductase gene,complete cds.] [LE:241] [RE:879] [DI:direct] >gp:[GI:g537060] [LN:ECOUW93] [AC:U14003] [PN:peptide methionine sulfoxide reductase] [GN:pmsR] [OR:Escherichia coli] [DB:genpept-bct1] [DE:Escherichia coli K-12 chromosomal region from 92.8 to 00.1 minutes.] [NT:alternate gene name msrA] [LE:132369] [RE:133007] [DI:complement] >gp:[GI:g1790665] [LN:AE000493] [AC:AE000493:U00096] [PN:peptide methionine sulfoxide reductase] [GN:msrA] [FN:enzyme; Proteins - translation and] [OR:Escherichia coli] [DB:genpept-bct2] [DE:Escherichia coli K-12 MG1655 section 383 of 400 of the completegenome.] [NT:f212; 100 pct identical amino acid sequence and] [LE:3986] [RE:4624] [DI:complement]

| ORF Name | NT ID | AA ID | NT/LN | AA/LN | Score | P-value |
|---|---|---|---|---|---|---|
| 4176908_c1_1453 | 1802 | 8973 | 213 | 70 | 68 | 0.0099 |

Description sp:[LN:C71716] [AC:C71716] [PN:hypothetical protein RP075] [GN:RP075] [OR:Rickettsia prowazekii] [DB:pir2] >gp:[GI:e1342389:g3860645] [LN:RPXX01] [AC:AJ235270:AJ235269] [PN:unknown] [GN:RP075] [OR:Rickettsia prowazekii] [DB:genpept-bct1] [DE:Rickettsia prowazekii strain Madrid E, complete genome; segment1/4.] [LE:84904] [RE:85707] [DI:complement]

| ORF Name | NT ID | AA ID | NT/LN | AA/LN | Score | P-value |
|---|---|---|---|---|---|---|
| 4191502_c3_2344 | 1803 | 8974 | 924 | 307 | 400 | 3.4e-37 |

Description sp:[LN:SYR1_RHISN] [AC:P55619] [GN:SYRM1:Y4PN] [OR:Rhizobium sp] [SR:,strain NGR234] [DE:SYRM PROTEIN HOMOLOG 1 (SYMBIOTIC REGULATOR)] [SP:P55619] [DB:swissprot] >gp:[GI:g2182584] [LN:AE000091] [AC:AE000091:U00090] [PN:SyrM1] [GN:syrM1] [OR:Rhizobium sp. NGR234] [DB:genpept-bct2] [DE:Rhizobium sp. NGR234 plasmid pNGR234a, section 28 of 46 of thecomplete plasmid sequence.] [NT:SyrM protein homolog (symbiotic regulator; LysR] [LE:3486] [RE:4502] [DI:complement]

| ORF_Name | NT_ID | AA_ID | NT/LN | AA/LN | Score | P-value |
|---|---|---|---|---|---|---|
| 4191913_c2_1867 | 1804 | 8975 | 885 | 294 | 789 | 2.0e-78 |

Description sp:[LN:YKFA_ECOLI] [AC:P75678:P71287:Q47687] [GN:YKFA] [OR:Escherichia coli]
[DE:HYPOTHETICAL 32.0 KD PROTEIN IN PROA-PERR INTERGENIC REGION]
[SP:P75678:P71287:Q47687] [DB:swissprot] >gp:[GI:g1552820] [LN:ECU70214]
[AC:U70214] [OR:Escherichia coli] [DB:genpept-bct1] [DE:Escherichia coli
chromosome minutes 4-6.] [NT:similar to E. coli ORF_o289] [LE:98396] [RE:99259]
[DI:complement]

| ORF_Name | NT_ID | AA_ID | NT/LN | AA/LN | Score | P-value |
|---|---|---|---|---|---|---|
| 4197943_f2_571 | 1805 | 8976 | 900 | 299 | 1362 | 3.9e-139 |

Description gp:[GI:g757833] [LN:EC4HPADNA] [AC:Z37980] [PN:regulator of the 4HPA-hydroxylase
operon] [GN:hpaA] [OR:Escherichia coli] [DB:genpept-bct1] [DE:E.coli
hpa[G,R,E,D,F,H,I,X,A,B,C] genes.] [LE:8120] [RE:9007] [DI:direct]

| ORF_Name | NT_ID | AA_ID | NT/LN | AA/LN | Score | P-value |
|---|---|---|---|---|---|---|
| 4331293_f2_770 | 1806 | 8977 | 1428 | 475 | 2234 | 1.5e-231 |

Description sp:[LN:PTTB_ECOLI] [AC:P36672] [GN:TREB] [OR:Escherichia coli] [EC:2.7.1.69]
[DE:(EC 2.7.1.69) (EII-TRE)] [SP:P36672] [DB:swissprot] >sp:[LN:C65236]
[AC:C65236:S56466] [PN:phosphotransferase system trehalose permease] [GN:treB]
[CL:phosphotransferase system sucrose-specific enzyme II, factor II]
[OR:Escherichia coli] [DB:pir2] >gp:[GI:g2367362] [LN:AE000495]
[AC:AE000495:U00096] [PN:PTS system enzyme II, trehalose specific] [GN:treB]
[FN:transport; Transport of small molecules:] [OR:Escherichia coli]
[DB:genpept-bct2] [DE:Escherichia coli K-12 MG1655 section 385 of 400 of the
completegenome.] [NT:f473; 98 pct identical to PTTB_ECOLI SW: P36672] [LE:5401]
[RE:6822] [DI:complement]

| ORF Name | NT ID | AA ID | NT LN | AA LN | Score | P-value |
|---|---|---|---|---|---|---|
| 4335468_c1_1600 | 1807 | 8978 | 882 | 293 | 721 | 3.3e-71 |

Description sp:[LN:DGOK_ECOLI] [AC:P31459] [GN:DGOK] [OR:Escherichia coli] [EC:2.7.1.58]
[DE:GALACTONOKINASE] (2-OXO-3-DEOXYGALACTONATE KINASE)] [SP:P31459]
[DB:swissprot] >sp:[LN:F65171] [AC:F65171] [PN:hypothetical 31.4K protein
(ibpA-gyrB intergenic region)] [GN:yidV] [CL:Escherichia coli hypothetical 31.4K
protein (ibpA-gyrB intergenic region)] [OR:Escherichia coli] [DB:pir2]
>gp:[GI:g290542] [LN:ECOUW82] [AC:L10328] [GN:f292] [FN:unknown] [OR:Escherichia
coli] [SR:Escherichia coli K12 strain MG1655; lambda clones EC14-52]
[DB:genpept-bct1] [DE:E. coli; the region from 81.5 to 84.5 minutes.] [LE:62991]
[RE:63869] [DI:complement] >gp:[GI:g1790128] [LN:AE000446] [AC:AE000446:U00096]
[PN:2-oxo-3-deoxygalactonate kinase] [GN:dgoK] [FN:putative enzyme; Degradation
of small] [OR:Escherichia coli] [DB:genpept-bct2] [DE:Escherichia coli K-12
MG1655 section 336 of 400 of the completegenome.] [NT:f292; formerly designated
yidV] [LE:6671] [RE:7549] [DI:complement]

| ORF Name | NT ID | AA ID | NT LN | AA LN | Score | P-value |
|---|---|---|---|---|---|---|
| 4345077_c3_2429 | 1808 | 8979 | 354 | 117 | 259 | 3.0e-22 |

Description sp:[LN:YJJZ_ECOLI] [AC:P55914] [GN:YJJZ] [OR:Escherichia coli] [DE:HYPOTHETICAL
8.7 KD PROTEIN FHUF-HOLD INTERGENIC REGION] [SP:P55914] [DB:swissprot]

| ORF Name | NT ID | AA ID | NT LN | AA LN | Score | P-value |
|---|---|---|---|---|---|---|
| 4414193_c1_1696 | 1809 | 8980 | 924 | 307 | 1301 | 1.1e-132 |

Description sp:[LN:YAAF_ECOLI] [AC:P22564] [GN:YAAF] [OR:Escherichia coli] [DE:HYPOTHETICAL
32.6 KD PROTEIN IN LYTB-DAPB INTERGENIC REGION] [SP:P22564] [DB:swissprot]
>sp:[LN:JE0404] [AC:JE0404:S40553:F64723:S22291] [PN:probable glycosidase, yaaF]
[GN:yaaF] [CL:yaaF protein] [OR:Escherichia coli] [EC:3.2.-.-] [DB:pir2]
>gp:[GI:g41934] [LN:ECLSPDAP] [AC:X54945] [GN:ORF 3] [OR:Escherichia coli]
[DB:genpept-bct1] [DE:E. coli lsp-dapB interval.] [NT:product appears to be
membrane bound] [SP:P22564] [LE:1613] [RE:2527] [DI:direct]
>gp:[GI:d1001780:g216457] [LN:ECO110K]
[AC:D10483:J01597:J01683:J01706:K01298:K01990:M10420:M10611:M12544]
[OR:Escherichia coli] [SR:Escherichia coli (strain:K-12) DNA] [DB:genpept-bct1]
[DE:E.coli K12 genome, 0-2.4min. region.] [NT:hypothetical 32.6K
protein(PIR:JE0404)] [LE:26947] [RE:27861] [DI:direct] >gp:[GI:g1786213]
[LN:AE000113] [AC:AE000113:U00096] [PN:orf, hypothetical protein] [GN:yaaF]
[FN:orf; Unknown] [OR:Escherichia coli] [DB:genpept-bct2] [DE:Escherichia coli
K-12 MG1655 section 3 of 400 of the completegenome.] [NT:o304; 100 pct identical
to YAAF_ECOLI SW: P22564] [LE:6634] [RE:7548] [DI:direct]

| ORF Name | NT ID | AA ID | NT LN | AA LN | Score | P-value |
|---|---|---|---|---|---|---|
| 4425152_c1_1484 | 1810 | 8981 | 267 | 88 | 70 | 0.035 |

Description gp:[GI:g5669017] [LN:AF080584] [AC:AF080584] [PN:mucin MUC2] [OR:Mus musculus]
[SR:house mouse] [DB:genpept-rod] [DE:Mus musculus mucin MUC2 mRNA, partial cds.]
[LE:<1] [RE:>399] [DI:direct]

| ORF Name | NT ID | AA ID | NT LN | AA LN | Score | P-value |
|---|---|---|---|---|---|---|
| 4432686_c2_1870 | 1811 | 8982 | 891 | 296 | 1126 | 4.0e-114 |

Description sp:[LN:YAFZ_ECOLI] [AC:P77206:Q47686] [GN:YAFZ] [OR:Escherichia coli]
[DE:HYPOTHETICAL 31.7 KD PROTEIN IN PROA-PERR INTERGENIC REGION]
[SP:P77206:Q47686] [DB:swissprot] >sp:[LN:D64750] [AC:D64750] [PN:yafZ protein]
[GN:yafZ] [OR:Escherichia coli] [DB:pir2] >gp:[GI:g1552819] [LN:ECU70214]
[AC:U70214] [OR:Escherichia coli] [DB:genpept-bct1] [DE:Escherichia coli
chromosome minutes 4-6.] [NT:similar to E. coli ORF_o273] [LE:97483] [RE:98319]
[DI:complement] >gp:[GI:g1786446] [LN:AE000133] [AC:AE000133:U00096] [PN:orf,
hypothetical protein] [GN:yafZ] [FN:orf; Unknown] [OR:Escherichia coli]
[DB:genpept-bct2] [DE:Escherichia coli K-12 MG1655 section 23 of 400 of the
completegenome.] [NT:f278; 65 pct identical (1 gap) to 270 residues of] [LE:2978]
[RE:3814] [DI:complement]

| ORF Name | NT ID | AA ID | NT LN | AA LN | Score | P-value |
|---|---|---|---|---|---|---|
| 4491678_f2_466 | 1812 | 8983 | 726 | 241 | 1197 | 1.2e-121 |

Description sp:[LN:ARCA_ECOLI] [AC:P03026] [GN:ARCA:DYE:FEXA:SFRA:SEG:MSP:CPXC]
[OR:Escherichia coli] [DE:AEROBIC RESPIRATION CONTROL PROTEIN ARCA (DYE
RESISTANCE PROTEIN)] [SP:P03026] [DB:swissprot] >sp:[LN:JYECR]
[AC:A03561:S56625:H65255] [PN:dye resistance protein:aerobic respiration control
protein ArcA:protein dye negative regulator in aerobic pathways]
[GN:arcA:dye:fexA:msp:seg:sfrA] [CL:ompR protein:response regulator homology]
[OR:Escherichia coli] [DB:pir1] [MP:100 min] >gp:[GI:g145818] [LN:ECODYE]
[AC:M10044] [GN:dye] [OR:Escherichia coli] [SR:E.coli K12 DNA, clone pRB52]
[DB:genpept-bct1] [DE:E.coli dye gene coding for Dye protein, complete cds.]
[LE:98] [RE:814] [DI:direct] >gp:[GI:g537241] [LN:ECOUW93] [AC:U14003] [GN:dye]
[FN:negative regulator of genes in aerobic] [OR:Escherichia coli]
[DB:genpept-bct1] [DE:Escherichia coli K-12 chromosomal region from 92.8 to 00.1
minutes.] [NT:alternate gene names arcA, fexA, msp, seg, sfrA; CG] [LE:330423]
[RE:331139] [DI:complement] >gp:[GI:g1790863] [LN:AE000510] [AC:AE000510:U00096]
[PN:negative response regulator of genes in aerobic] [GN:arcA] [FN:regulator;
Global regulatory functions] [OR:Escherichia coli] [DB:genpept-bct2]
[DE:Escherichia coli K-12 MG1655 section 400 of 400 of the completegenome.]
[NT:f238; 100 pct identical to ARCA_ECOLI SW: P03026;] [LE:4247] [RE:4963]
[DI:complement]

| ORF_Name | NT_ID | AA_ID | NT/LN | AA/LN | Score | P-value |
|---|---|---|---|---|---|---|
| 4495418_c1_1423 | 1813 | 8984 | 369 | 122 | 263 | 4.8e-22 |

Description gp:[GI:g1041092] [LN:STMMSDA] [AC:L48550] [PN:methylmalonic acid semialdehyde dehydrogenase] [GN:msdA] [FN:catalyzes last step in valine catabolism to] [OR:Streptomyces coelicolor] [SR:Streptomyces coelicolor (strain A3(2)) DNA] [DB:genpept-bct1] [DE:Streptomyces coelicolor methylmalonic acid semialdehydedehydrogenase (msdA) gene, complete cds.] [LE:1342] [RE:2844] [DI:direct]

| ORF_Name | NT_ID | AA_ID | NT/LN | AA/LN | Score | P-value |
|---|---|---|---|---|---|---|
| 4540693_c2_1813 | 1814 | 8985 | 996 | 331 | 713 | 2.3e-70 |

Description sp:[LN:IOLD_BACSU] [AC:P42415] [GN:IOLD:E83D] [OR:Bacillus subtilis] [DE:IOLD PROTEIN] [SP:P42415] [DB:swissprot] >sp:[LN:D69645] [AC:D69645] [PN:myo-inositol catabolism iolD] [GN:iolD] [OR:Bacillus subtilis] [DB:pir2] >gp:[GI:d1003803:g709984] [LN:BACIOLO] [AC:D14399] [PN:hypothetical protein] [GN:E83D] [OR:Bacillus subtilis] [SR:Bacillus subtilis (strain:BGSC 1A1 (168 trpC2)) DNA] [DB:genpept-bct1] [DE:Bacillus subtilis 15 kb chromosome segment contains the iol operon.] [NT:homologous to acetolactate synthases] [LE:3351] [RE:5093] [DI:direct] >gp:[GI:e1184698:g2636519] [LN:BSUB0021] [AC:Z99124:AL009126] [GN:iolD] [OR:Bacillus subtilis] [DB:genpept-bct1] [DE:Bacillus subtilis complete genome (section 21 of 21): from 3999281to 4214814.] [NT:alternate gene name: yxdD; myo-inositol catabolism] [SP:P42415] [LE:78596] [RE:80338] [DI:complement]

| ORF_Name | NT_ID | AA_ID | NT/LN | AA/LN | Score | P-value |
|---|---|---|---|---|---|---|
| 4556318_f3_1257 | 1815 | 8986 | 567 | 188 | 761 | 1.9e-75 |

Description sp:[LN:YTFJ_ECOLI] [AC:P39187] [GN:YTFJ] [OR:Escherichia coli] [DE:PROTEIN YTFJ PRECURSOR] [SP:P39187] [DB:swissprot] >sp:[LN:S56441] [AC:S56441:C65233] [PN:18.2K protein (cysq-msra intergenic region precursor):hypothetical protein f184] [GN:ytfJ] [OR:Escherichia coli] [DB:pir2] >gp:[GI:g537057] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_f184] [LE:129539] [RE:130093] [DI:complement] >gp:[GI:g1790662] [LN:AE000493] [AC:AE000493:U00096] [PN:orf, hypothetical protein] [GN:ytfJ] [FN:orf; Unknown] [OR:Escherichia coli] [DB:genpept-bct2] [DE:Escherichia coli K-12 MG1655 section 383 of 400 of the completegenome.] [NT:f184; 100 pct identical amino acid sequence and] [LE:1156] [RE:1710] [DI:complement]

| ORF Name | NT ID | AA ID | NT LN | AA LN | Score | P-value |
|---|---|---|---|---|---|---|
| 4556566_c1_1366 | 1816 | 8987 | 1377 | 458 | 2275 | 7.0e-236 |

Description sp:[LN:MPL_ECOLI] [AC:P37773:P76804] [GN:MPL] [OR:Escherichia coli] [EC:6.3.2.-] [DE:LIGASE,] [SP:P37773:P76804] [DB:swissprot] >sp:[LN:S56459] [AC:S56459:D65235] [PN:hypothetical 48.5K protein (fbp-pmba intergenic region):hypothetical protein o457] [GN:yjfG] [OR:Escherichia coli] [DB:pir2] >gp:[GI:g537075] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_o457] [LE:146614] [RE:147987] [DI:direct] >gp:[GI:g1790680] [LN:AE000494] [AC:AE000494:U00096] [PN:putative ligase] [GN:yjfG] [FN:putative enzyme; Not classified] [OR:Escherichia coli] [DB:genpept-bct2] [DE:Escherichia coli K-12 MG1655 section 384 of 400 of the completegenome.] [NT:o457; 100 pct identical to 445 amino acids of] [LE:7469] [RE:8842] [DI:direct]

| ORF Name | NT ID | AA ID | NT LN | AA LN | Score | P-value |
|---|---|---|---|---|---|---|
| 4566943_f1_160 | 1817 | 8988 | 1422 | 473 | 2076 | 8.5e-215 |

Description sp:[LN:YJIR_ECOLI] [AC:P39389] [GN:YJIR] [OR:Escherichia coli] [DE:HYPOTHETICAL 53.0 KD PROTEIN IN IADA-MCRD INTERGENIC REGION (F470)] [SP:P39389] [DB:swissprot] >sp:[LN:S56565] [AC:S56565:F65248] [PN:hypothetical 53K protein (iadA-mcrD intergenic region):hypothetical protein f470] [GN:yjiR] [CL:hypothetical protein b1439] [OR:Escherichia coli] [DB:pir1] >gp:[GI:g537181] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_f470] [LE:260994] [RE:262406] [DI:complement] >gp:[GI:g1790797] [LN:AE000504] [AC:AE000504:U00096] [PN:putative regulator] [GN:yjiR] [FN:putative regulator; Not classified] [OR:Escherichia coli] [DB:genpept-bct2] [DE:Escherichia coli K-12 MG1655 section 394 of 400 of the completegenome.] [NT:f470; 100 pct identical amino acid sequence and] [LE:7483] [RE:8895] [DI:complement]

| ORF Name | NT ID | AA ID | NT LN | AA LN | Score | P-value |
|---|---|---|---|---|---|---|
| 4692780_c2_1875 | 1818 | 8989 | 1044 | 347 | 136 | 1.9e-06 |

Description sp:[LN:D70657] [AC:D70657] [PN:probable mrr] [GN:mrr] [OR:Mycobacterium tuberculosis] [DB:pir2] >gp:[GI:e290979:g1781074] [LN:MTCY159] [AC:Z83863:AL123456] [PN:mrr] [GN:mrr] [OR:Mycobacterium tuberculosis] [DB:genpept-bct1] [DE:Mycobacterium tuberculosis H37Rv complete genome; segment 111/162.] [NT:Rv2528c, (MTCY159.28), len: 306 aa. Probable mrr,] [LE:11799] [RE:12719] [DI:complement]

| ORF Name | NT ID | AA ID | NT LN | AA LN | Score | P-value |
|---|---|---|---|---|---|---|
| 4694462_c2_1866 | 1819 | 8990 | 936 | 311 | | |

Description

NO-HIT

648

| ORF Name | NT ID | AA ID | NT LN | AA LN | Score | P-value |
|---|---|---|---|---|---|---|
| 4699000_f3_1126 | 1820 | 8991 | 195 | 64 | | |

Description

NO-HIT

| ORF Name | NT ID | AA ID | NT LN | AA LN | Score | P-value |
|---|---|---|---|---|---|---|
| 4713503_f2_443 | 1821 | 8992 | 1206 | 401 | 102 | 4.7e-07 |

Description gp:[GI:e219264:g1487964] [LN:DMROTB] [AC:X95246] [PN:Rot57 protein] [GN:l(2)rot] [OR:Drosophila melanogaster] [SR:fruit fly] [DB:genpept-invl] [DE:D.melanogaster l(2)rot gene (strain bIf).] [NT:lethal(2)relative of tid] [LE:892] [RE:2526] [DI:direct]

| ORF Name | NT ID | AA ID | NT LN | AA LN | Score | P-value |
|---|---|---|---|---|---|---|
| 4725688_f1_254 | 1822 | 8993 | 2607 | 868 | | |

Description

NO-HIT

| ORF Name | NT ID | AA ID | NT LN | AA LN | Score | P-value |
|---|---|---|---|---|---|---|
| 4818753_c1_1356 | 1823 | 8994 | 354 | 117 | 512 | 4.6e-49 |

Description sp:[LN:YTFP_ECOLI] [AC:P39323] [GN:YTFP] [OR:Escherichia coli] [DE:HYPOTHETICAL 12.9 KD PROTEIN IN MSRA-CHPBI INTERGENIC REGION (O113)] [SP:P39323] [DB:swissprot] >sp:[LN:S56448] [AC:S56448:A65234] [PN:hypothetical 12.9K protein (msra-chpbi intergenic region):hypothetical protein o113] [GN:ytfP] [OR:Escherichia coli] [DB:pir2] >gp:[GI:g537064] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_o113] [LE:138726] [RE:139067] [DI:direct] >gp:[GI:g1790668] [LN:AE000493] [AC:AE000493:U00096] [PN:orf, hypothetical protein] [GN:ytfP] [FN:orf; Unknown] [OR:Escherichia coli] [DB:genpept-bct2] [DE:Escherichia coli K-12 MG1655 section 383 of 400 of the completegenome.] [NT:o113; 100 pct identical amino acid sequence and] [LE:10342] [RE:10683] [DI:direct]

| ORF Name | NT ID | AA ID | NT LN | AA LN | Score | P-value |
|---|---|---|---|---|---|---|
| 4870801_f3_1138 | 1824 | 8995 | 1191 | 396 | 123 | 3.3e-06 |

Description gp:[GI:g2072187] [LN:LLU94520] [AC:U94520] [PN:abortive phage resistance protein] [GN:abiLi] [FN:with AbiLii, causes abortive infection of phage] [OR:Lactococcus lactis] [DB:genpept-bct2] [DE:Lactococcus lactis plasmid pND861 abortive phage resistanceproteins (abiLi) and (abiLii) genes, complete cds.] [NT:AbiLi] [LE:550] [RE:1926] [DI:direct]

| ORF Name | NT ID | AA ID | NT/LN | AA/LN | Score | P-value |
|---|---|---|---|---|---|---|
| 4877327_c3_2488 | 1825 | 8996 | 1917 | 638 | 3099 | 0.0 |

Description gp:[GI:g1389758] [LN:STU58360] [AC:U58360] [PN:DnaK] [GN:dnaK] [OR:Salmonella typhimurium] [SR:Salmonella typhimurium strain=LT2] [DB:genpept-bct1] [DE:Salmonella typhimurium plasmid pRS1014 DnaK and DnaJ genes,complete cds.] [LE:472] [RE:2388] [DI:direct]

| ORF Name | NT ID | AA ID | NT/LN | AA/LN | Score | P-value |
|---|---|---|---|---|---|---|
| 4885438_f2_784 | 1826 | 8997 | 474 | 157 | 787 | 3.3e-78 |

Description sp:[LN:NRDG_ECOLI] [AC:P39329] [GN:NRDG] [OR:Escherichia coli] [EC:1.97.1.-] [DE:(EC 1.97.1.-)] [SP:P39329] [DB:swissprot] >sp:[LN:A55692] [AC:A55692:S56463:H65235] [PN:anaerobic ribonucleotide reductase activase,] [GN:nrdG] [CL:anaerobic ribonucleotide reductase activase] [OR:Escherichia coli] [EC:1.97.1.-] [DB:pir1] [MP:96 min] >gp:[GI:g619866] [LN:ECNRDGACT] [AC:Z46865] [PN:activase for anaerobic ribonucleoside] [GN:nrdG] [OR:Escherichia coli] [DB:genpept-bct1] [DE:E.coli nrdG gene for activase.] [SP:P39329] [LE:193] [RE:657] [DI:direct] >gp:[GI:g537079] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_f154] [LE:150729] [RE:151193] [DI:complement] >gp:[GI:g1790685] [LN:AE000495] [AC:AE000495:U00096] [PN:anaerobic ribonucleotide reductase activating] [GN:nrdG] [FN:enzyme; Central intermediary metabolism:] [OR:Escherichia coli] [DB:genpept-bct2] [DE:Escherichia coli K-12 MG1655 section 385 of 400 of the completegenome.] [NT:f154; 100 pct identical amino acid sequence and] [LE:542] [RE:1006] [DI:complement]

| ORF Name | NT ID | AA ID | NT/LN | AA/LN | Score | P-value |
|---|---|---|---|---|---|---|
| 4964061_c1_1699 | 1827 | 8998 | 837 | 278 | 1272 | 1.3e-129 |

Description sp:[LN:DAPB_ECOLI] [AC:P04036] [GN:DAPB] [OR:Escherichia coli] [EC:1.3.1.26] [DE:DIHYDRODIPICOLINATE REDUCTASE,] [SP:P04036] [DB:swissprot] >sp:[LN:RDECPD] [AC:A00375:S40554:G64723] [PN:dihydrodipicolinate reductase,] [GN:dapB] [CL:dihydrodipicolinate reductase] [OR:Escherichia coli] [EC:1.3.1.26] [DB:pir1] [MP:1 min] >gp:[GI:d1001781:g216458] [LN:ECO110K] [AC:D10483:J01597:J01683:J01706:K01298:K01990:M10420:M10611:M12544] [PN:dehydrodipicolinate reductase] [GN:dapB] [OR:Escherichia coli] [SR:Escherichia coli (strain:K-12) DNA] [DB:genpept-bct1] [EC:1.3.1.26] [DE:E.coli K12 genome, 0-2.4min. region.] [LE:28028] [RE:28849] [DI:direct] >gp:[GI:g145710] [LN:ECODAPB] [AC:M10611] [GN:dapB] [OR:Escherichia coli] [SR:E.coli K12 DNA, clone pDB17] [DB:genpept-bct1] [DE:E.coli dapB gene coding for dihydrodipicolinate reductase, completecds.] [NT:dihydropicolinate reductase] [LE:135] [RE:956] [DI:direct] >gp:[GI:g1786214] [LN:AE000113] [AC:AE000113:U00096] [PN:dihydrodipicolinate reductase] [GN:dapB] [FN:enzyme; Amino acid biosynthesis: Lysine] [OR:Escherichia coli] [DB:genpept-bct2] [EC:1.3.1.26] [DE:Escherichia coli K-12 MG1655 section 3 of 400 of the completegenome.] [NT:o273; 100 pct identical to DAPB_ECOLI SW: P04036] [LE:7715] [RE:8536] [DI:direct]

650

| ORF Name | NT ID | AA ID | NT LN | AA LN | Score | P-value |
|---|---|---|---|---|---|---|
| 4964666_f1_261 | 1828 | 8999 | 696 | 231 | 355 | 1.9e-38 |

Description sp:[LN:YADF_ECOLI] [AC:P36857:P75656] [GN:YADF] [OR:Escherichia coli]
[DE:HYPOTHETICAL 25.1 KD PROTEIN IN HPT-PAND INTERGENIC REGION]
[SP:P36857:P75656] [DB:swissprot] >sp:[LN:F64735] [AC:F64735:S45203] [PN:yadF
protein] [GN:yadF] [OR:Escherichia coli] [DB:pir2] >gp:[GI:g1786318]
[LN:AE000122] [AC:AE000122:U00096] [PN:putative carbonic anhdrase (EC 4.2.1.1)]
[GN:yadF] [FN:putative enzyme; Not classified] [OR:Escherichia coli]
[DB:genpept-bct2] [DE:Escherichia coli K-12 MG1655 section 12 of 400 of the
completegenome.] [NT:f220; residues 1-180 are 100 pct identical to] [LE:3304]
[RE:3966] [DI:complement]

| ORF Name | NT ID | AA ID | NT LN | AA LN | Score | P-value |
|---|---|---|---|---|---|---|
| 4976068_c1_1478 | 1829 | 9000 | 651 | 216 | 655 | 3.2e-64 |

Description sp:[LN:FUCA_ECOLI] [AC:P11550] [GN:FUCA:FUCC:PRD] [OR:Escherichia coli]
[EC:4.1.2.17] [DE:L-FUCULOSE PHOSPHATE ALDOLASE,] [SP:P11550] [DB:swissprot]
>sp:[LN:ADECFP] [AC:B33495:B32883:S04703:D65062:PV0013] [PN:L-fuculose-phosphate
aldolase,] [GN:fucA] [CL:L-ribulose-phosphate 4-epimerase] [OR:Escherichia coli]
[EC:4.1.2.17] [DB:pir1] [MP:60 min] >gp:[GI:g41503] [LN:ECFUCOSE] [AC:X15025]
[OR:Escherichia coli] [DB:genpept-bct1] [DE:Escherichia coli fucose operon.]
[NT:fucA ORF (AA 1-215)] [SP:P11550] [LE:1414] [RE:2061] [DI:complement]
>gp:[GI:g146042] [LN:ECOFUCAO] [AC:M31059] [OR:Escherichia coli] [SR:E.coli K12
DNA] [DB:genpept-bct1] [DE:E.coli NAD+-linked oxireductase (fucO) and
fuculose-1-phosphatealdolase (fucA) genes, complete cds, and L-fucose
utilizationprotein (fucP) gene, 5' end.] [NT:fuculose-1-phosphate aldolase
(fucA)] [LE:640] [RE:1287] [DI:direct] >gp:[GI:g882695] [LN:ECU29581] [AC:U29581]
[PN:fuculose-1-phosphate aldolase] [GN:fucA] [OR:Escherichia coli]
[DB:genpept-bct1] [EC:4.1.2.17] [DE:Escherichia coli K-12 genome; approximately
63 to 64 minutes.] [NT:CG Site no. 17701; alternate gene names fucC, prd;]
[LE:14596] [RE:15243] [DI:complement] >gp:[GI:g1789164] [LN:AE000363]
[AC:AE000363:U00096] [PN:L-fuculose-1-phosphate aldolase] [GN:fucA] [FN:enzyme;
Degradation of small molecules: Carbon] [OR:Escherichia coli] [DB:genpept-bct2]
[EC:4.1.2.17] [DE:Escherichia coli K-12 MG1655 section 253 of 400 of the
completegenome.] [NT:f215; 100 pct identical to FUCA_ECOLI SW: P11550 CG]
[LE:10754] [RE:11401] [DI:complement]

| ORF Name | NT ID | AA ID | NT LN | AA LN | Score | P-value |
|---|---|---|---|---|---|---|
| 5078503_f1_51 | 1830 | 9001 | 528 | 175 | 775 | 6.2e-77 |

Description sp:[LN:YJJX_ECOLI] [AC:P39411] [GN:YJJX] [OR:Escherichia coli] [DE:HYPOTHETICAL
18.6 KD PROTEIN IN TRPR-GPMB INTERGENIC REGION (F173)] [SP:P39411] [DB:swissprot]
>sp:[LN:S56618] [AC:S56618;A65255] [PN:yjjX protein:protein f173] [GN:yjjX]
[CL:Escherichia coli conserved yjjX protein] [OR:Escherichia coli] [DB:pir2]
>gp:[GI:g537234] [LN:ECOUW93] [AC:U14003] [OR:Escherichia coli] [DB:genpept-bct1]
[DE:Escherichia coli K-12 chromosomal region from 92.8 to 00.1 minutes.]
[NT:ORF_f173] [LE:324066] [RE:324587] [DI:complement] >gp:[GI:g1790855]
[LN:AE000509] [AC:AE000509;U00096] [PN:orf, hypothetical protein] [GN:yjjX]
[FN:orf; Unknown] [OR:Escherichia coli] [DB:genpept-bct2] [DE:Escherichia coli
K-12 MG1655 section 399 of 400 of the completegenome.] [NT:f173; 100 pct
identical amino acid sequence and] [LE:8421] [RE:8942] [DI:complement]

| ORF Name | NT ID | AA ID | NT LN | AA LN | Score | P-value |
|---|---|---|---|---|---|---|
| 508561_c2_1793 | 1831 | 9002 | 777 | 258 | 1073 | 1.6e-108 |

Description sp:[LN:MIAE_SALTY] [AC:Q08015] [GN:MIAE] [OR:Salmonella typhimurium] [EC:1.-.-.-]
[DE:TRNA-(MS[2]IO[6]A)-HYDROXYLASE,] [SP:Q08015] [DB:swissprot] >sp:[LN:S34361]
[AC:S34361] [PN:miaE protein] [OR:Salmonella typhimurium] [DB:pir2]
>gp:[GI:g312708] [LN:STMIAE] [AC:X73368] [PN:miaE] [OR:Salmonella typhimurium]
[DB:genpept-bct1] [DE:S.typhimurium genes miaE, argI (partial) and orf's.]
[SP:Q08015] [LE:1248] [RE:2060] [DI:direct]

| ORF Name | NT ID | AA ID | NT LN | AA LN | Score | P-value |
|---|---|---|---|---|---|---|
| 5087913_c2_1922 | 1832 | 9003 | 222 | 73 | | |

Description

NO-HIT

| ORF Name | NT ID | AA ID | NT LN | AA LN | Score | P-value |
|---|---|---|---|---|---|---|
| 5094193_c1_1317 | 1833 | 9004 | 318 | 105 | 496 | 2.3e-47 |

Description sp:[LN:PTXB_ECOLI] [AC:P39302] [GN:SGAB] [OR:Escherichia coli] [EC:2.7.1.69]
[DE:(EC 2.7.1.69)] [SP:P39302] [DB:swissprot] >sp:[LN:S56419] [AC:S56419;E65230]
[PN:hypothetical 10.9K protein (aidB-rpsF intergenic region):hypothetical protein
o101] [GN:yjfT] [OR:Escherichia coli] [DB:pir2] >gp:[GI:g537035] [LN:ECOUW93]
[AC:U14003] [OR:Escherichia coli] [DB:genpept-bct1] [DE:Escherichia coli K-12
chromosomal region from 92.8 to 00.1 minutes.] [NT:ORF_o101] [LE:112224]
[RE:112529] [DI:direct] >gp:[GI:g1790638] [LN:AE000491] [AC:AE000491;U00096]
[PN:orf, hypothetical protein] [GN:sgaB] [FN:orf; Unknown] [OR:Escherichia coli]
[DB:genpept-bct2] [DE:Escherichia coli K-12 MG1655 section 381 of 400 of the
completegenome.] [NT:o101; formerly designated yjfT] [LE:5059] [RE:5364]
[DI:direct]

| ORF Name | NT ID | AA ID | NT LN | AA LN | Score | P-value |
|---|---|---|---|---|---|---|
| 5098140_f3_1074 | 1834 | 9005 | 183 | 60 | | |

Description

NO-HIT

| ORF Name | NT ID | AA ID | NT LN | AA LN | Score | P-value |
|---|---|---|---|---|---|---|
| 5098877_c2_2082 | 1835 | 9006 | 510 | 169 | 820 | 1.1e-81 |

Description sp:[LN:LSPA_ENTAE] [AC:P13514] [GN:LSPA:LSP] [OR:Enterobacter aerogenes]
[SR:,Aerobacter aerogenes] [EC:3.4.23.36] [DE:PEPTIDASE) (SIGNAL PEPTIDASE II)
(SPASE II)] [SP:P13514] [DB:swissprot] >gp:[GI:g148358] [LN:ENTLSPG] [AC:M26713]
[OR:Enterobacter aerogenes] [SR:E.aerogenes DNA] [DB:genpept-bct1]
[DE:E.aerogenes signal peptidase II (lsp) gene, complete cds, and ileSprotein
gene, 3' end.] [NT:signal peptidase II] [LE:280] [RE:777] [DI:direct]

| ORF Name | NT ID | AA ID | NT LN | AA LN | Score | P-value |
|---|---|---|---|---|---|---|
| 5110286_c3_2348 | 1836 | 9007 | 1074 | 357 | 329 | 1.1e-29 |

Description sp:[LN:YIBH_ECOLI] [AC:P32107] [GN:YIBH] [OR:Escherichia coli] [DE:HYPOTHETICAL
42.0 KD PROTEIN IN RHSA-MTLA INTERGENIC REGION] [SP:P32107] [DB:swissprot]
>sp:[LN:S47818] [AC:S47818:G65159] [PN:hypothetical 42K protein (rhsA-mtlA
intergenic region):hypothetical protein f378b] [GN:yibH]
[CL:lipoyl/biotin-binding homology] [OR:Escherichia coli] [DB:pir2]
>gp:[GI:g466735] [LN:ECOUW76] [AC:U00039] [OR:Escherichia coli] [SR:Escherichia
coli (sub_strain MG1655, strain K-12) (library: lambda] [DB:genpept-bct1] [DE:E.
coli chromosomal region from 76.0 to 81.5 minutes.] [NT:alternate gene name yibH]
[LE:184495] [RE:185631] [DI:complement] >gp:[GI:g1790024] [LN:AE000437]
[AC:AE000437:U00096] [PN:putative membrane protein] [GN:yibH] [FN:putative
membrane; Not classified] [OR:Escherichia coli] [DB:genpept-bct2] [DE:Escherichia
coli K-12 MG1655 section 327 of 400 of the completegenome.] [NT:f378b; 99 pct
identical amino acid sequence and] [LE:8224] [RE:9360] [DI:complement]
>gp:[GI:g1857028] [LN:ECORHSA] [AC:L19044:M29716:M21761:M21765:M21766:J04224]
[PN:unknown] [OR:Escherichia coli] [DB:genpept-bct2] [DE:Escherichia coli core
protein RhsA (rhsA) gene, complete cds; andunknown genes.] [NT:similar to
Pseudomonas aeruginosa aprE protein;] [LE:9012] [RE:10148] [DI:complement]

| ORF Name | NT ID | AA ID | NT LN | AA LN | Score | P-value |
|---|---|---|---|---|---|---|
| 5114693_c1_1608 | 1837 | 9008 | 480 | 159 | 248 | 4.4e-21 |

Description gp:[GI:g5669855] [LN:AF130465] [AC:AF130465] [PN:mannose-specific
phosphotransferase system] [GN:manL] [OR:Streptococcus salivarius]
[DB:genpept-bct2] [DE:Streptococcus salivarius mannose phosphotransferase system
operon,complete sequence, and seryl-tRNA synthetase (serS) gene, partialcds.]
[NT:IIABman; 35.2 kDa low molecular weight form] [LE:364] [RE:1356] [DI:direct]

| ORF_Name | NT ID | AA ID | NT/LN | AA/LN | Score | P-value |
|---|---|---|---|---|---|---|
| 5135187_c3_2410 | 1838 | 9009 | 990 | 329 | 917 | 5.6e-92 |

Description sp:[LN:T14989] [AC:T14989] [PN:probable transposase] [GN:Y1072] [OR:Yersinia pestis] [DB:pir2] >gp:[GI:g5834755] [LN:YPPMT1] [AC:AL117211] [PN:hypothetical protein YPMT1.71] [GN:YPMT1.71] [OR:Yersinia pestis] [DB:genpept-bct1] [DE:Yersinia pestis plasmid pPMT1.] [NT:YPMT1.71, conserved hypothetical protein, len: 328] [LE:71857] [RE:72843] [DI:direct] >gp:[GI:g3883072] [LN:AF074611] [AC:AF074611] [PN:putative transposase] [GN:Y1072] [OR:Yersinia pestis] [DB:genpept-bct2] [DE:Yersinia pestis plasmid pMT-1, complete plasmid sequence.] [NT:f328; 78 pct identical to 313 amino acids of] [LE:59154] [RE:60140] [DI:complement]

| ORF_Name | NT ID | AA ID | NT/LN | AA/LN | Score | P-value |
|---|---|---|---|---|---|---|
| 5160807_c3_2271 | 1839 | 9010 | 420 | 139 | 418 | 4.2e-39 |

Description sp:[LN:YFJZ_ECOLI] [AC:P52141] [GN:YFJZ] [OR:Escherichia coli] [DE:HYPOTHETICAL 11.7 KD PROTEIN IN ALPA-GABD INTERGENIC REGION (O105)] [SP:P52141] [DB:swissprot] >sp:[LN:T08656] [AC:T08656:G65043] [PN:yfiZ protein] [GN:yfiZ] [OR:Escherichia coli] [DB:pir2] [MP:57 min] >gp:[GI:d1017245:g1800035] [LN:D90889] [AC:D90889:AB001340] [OR:Escherichia coli] [SR:Escherichia coli (strain:K12) DNA, clone_lib:Kohara lambda minise] [DB:genpept-bct1] [DE:E.coli genomic DNA, Kohara clone #442(59.7-60.0 min.).] [NT:similar to [SwissProt Accession Number P52141]] [LE:5106] [RE:5423] [DI:direct] >gp:[GI:g1033139] [LN:ECU36840] [AC:U36840] [OR:Escherichia coli] [DB:genpept-bct1] [DE:Escherichia coli K-12 genome, approximately 57 minutes.] [NT:ORF_o105] [LE:26070] [RE:26387] [DI:direct] >gp:[GI:g1788998] [LN:AE000349] [AC:AE000349:U00096] [PN:orf, hypothetical protein] [GN:yfjZ] [FN:orf; Unknown] [OR:Escherichia coli] [DB:genpept-bct2] [DE:Escherichia coli K-12 MG1655 section 239 of 400 of the completegenome.] [NT:o105; This 105 aa ORF is 66 pct identical (0 gaps)] [LE:9616] [RE:9933] [DI:direct]

| ORF Name | NT ID | AA ID | NT LN | AA LN | Score | P-value |
|---|---|---|---|---|---|---|
| 5179062_c3_2489 | 1840 | 9011 | 1143 | 380 | 1927 | 5.3e-199 |

Description sp:[LN:HHECDJ] [AC:A92572:A26298:S40537:G64721:A26299] [PN:heat shock protein dnaJ] [GN:dnaJ] [CL:heat shock protein dnaJ:dnaJ amino-terminal homology] [OR:Escherichia coli] [DB:pir1] [MP:0 min] >gp:[GI:d1001764:g216441] [LN:ECO110K] [AC:D10483:J01597:J01683:J01706:K01298:K01990:M10420:M10611:M12544] [PN:DnaJ] [GN:dnaJ] [OR:Escherichia coli] [SR:Escherichia coli (strain:K-12) DNA] [DB:genpept-bct1] [DE:E.coli K12 genome, 0-2.4min. region.] [LE:13817] [RE:14947] [DI:direct] >gp:[GI:g145769] [LN:ECODNAJ] [AC:M12565] [GN:dnaJ] [OR:Escherichia coli] [SR:E.coli DNA] [DB:genpept-bct1] [DE:E. coli K12 dnaJ gene encoding a heat shock protein, complete cds.] [NT:heat shock protein dnaJ] [LE:127] [RE:1257] [DI:direct] >gp:[GI:g1786197] [LN:AE000112] [AC:AE000112:U00096] [PN:chaperone with DnaK; heat shock protein] [GN:dnaJ] [FN:factor; Chaperones] [OR:Escherichia coli] [DB:genpept-bct2] [DE:Escherichia coli K-12 MG1655 section 2 of 400 of the completegenome.] [NT:o376; 100 pct identical to DNAJ_ECOLI SW: P08622] [LE:3630] [RE:4760] [DI:direct]

| ORF Name | NT ID | AA ID | NT LN | AA LN | Score | P-value |
|---|---|---|---|---|---|---|
| 5258465_f1_266 | 1841 | 9012 | 1323 | 440 | 379 | 5.7e-35 |

Description sp:[LN:E72292] [AC:E72292] [PN:glycerol-3-phosphate ABC transporter, periplasmic glycerol-3-phosphate-binding protein] [GN:TM1120] [CL:glycerol-3-phosphate-binding protein] [OR:Thermotoga maritima] [DB:pir2] >gp:[GI:g4981666] [LN:AE001770] [AC:AE001770:AE000512] [PN:glycerol-3-phosphate ABC transporter,] [GN:TM1120] [OR:Thermotoga maritima] [DB:genpept-bct2] [DE:Thermotoga maritima section 82 of 136 of the complete genome.] [NT:similar to SP:P10904 GB:U00039 GB:M33735 PID:43244] [LE:7791] [RE:9101] [DI:direct]

| ORF Name | NT ID | AA ID | NT LN | AA LN | Score | P-value |
|---|---|---|---|---|---|---|
| 5261717_c2_1707 | 1842 | 9013 | 768 | 255 | 1181 | 5.9e-120 |

Description sp:[LN:YJFH_ECOLI] [AC:P39290] [GN:YJFH] [OR:Escherichia coli] [EC:2.1.1.-] [DE:HYPOTHETICAL TRNA/RRNA METHYLTRANSFERASE YJFH,] [SP:P39290] [DB:swissprot] >sp:[LN:S56405] [AC:S56405:G65228] [PN:hypothetical 26.6K protein (vacB-aidB intergenic region):hypothetical protein o243] [GN:yjfH] [CL:conserved hypothetical protein HI0860] [OR:Escherichia coli] [DB:pir2] >gp:[GI:g537021] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_o243] [LE:100103] [RE:100834] [DI:direct] >gp:[GI:g1790623] [LN:AE000490] [AC:AE000490:U00096] [PN:orf, hypothetical protein] [GN:yjfH] [FN:orf; Unknown] [OR:Escherichia coli] [DB:genpept-bct2] [DE:Escherichia coli K-12 MG1655 section 380 of 400 of the completegenome.] [NT:o243; 100 pct identical amino acid sequence and] [LE:4959] [RE:5690] [DI:direct]

| ORF Name | NT ID | AA ID | NT LN | AA LN | Score | P-value |
|---|---|---|---|---|---|---|
| 5265713_c1_1668 | 1843 | 9014 | 939 | 312 | 1447 | 3.8e-148 |

Description sp:[LN:KHSE_ECOLI] [AC:P00547] [GN:THRB] [OR:Escherichia coli] [EC:2.7.1.39]
[DE:HOMOSERINE KINASE, (HK)] [SP:P00547] [DB:swissprot] >sp:[LN:KIECM]
[AC:S56630:C64720:A00658:S40532] [PN:homoserine kinase,] [GN:thrB] [CL:homoserine
kinase] [OR:Escherichia coli] [EC:2.7.1.39] [DB:pir1] [MP:0 min] >gp:[GI:g529240]
[LN:ECOTHRBUPD] [AC:L13601] [GN:thrB] [OR:Escherichia coli] [SR:Escherichia coli
(strain PC 0542) DNA] [DB:genpept-bct1] [EC:2.7.1.39] [DE:Escherichia coli thrB
gene sequence.] [NT:homoserine kinase] [LE:1] [RE:933] [DI:direct]
>gp:[GI:g537246] [LN:ECOUW93] [AC:U14003] [PN:homoserine kinase] [GN:thrB]
[OR:Escherichia coli] [DB:genpept-bct1] [EC:2.7.1.39] [DE:Escherichia coli K-12
chromosomal region from 92.8 to 00.1 minutes.] [NT:CG Site No. 110] [LE:335286]
[RE:336218] [DI:direct] >gp:[GI:g1786184] [LN:AE000111] [AC:AE000111:U00096]
[PN:homoserine kinase] [GN:thrB] [FN:enzyme; Amino acid biosynthesis: Threonine]
[OR:Escherichia coli] [DB:genpept-bct2] [EC:2.7.1.39] [DE:Escherichia coli K-12
MG1655 section 1 of 400 of the completegenome.] [NT:o310; 100 pct identical to
KHSE_ECOLI SW: P00547;] [LE:2801] [RE:3733] [DI:direct]

| ORF Name | NT ID | AA ID | NT LN | AA LN | Score | P-value |
|---|---|---|---|---|---|---|
| 5267215_f3_1292 | 1844 | 9015 | 195 | 64 | | |

Description

NO-HIT

| ORF Name | NT ID | AA ID | NT LN | AA LN | Score | P-value |
|---|---|---|---|---|---|---|
| 5468_c2_1804 | 1845 | 9016 | 1299 | 432 | 370 | 5.2e-34 |

Description gp:[GI:d1024290:g2626834] [LN:D86947] [AC:D86947] [PN:hydrophilic protein]
[OR:Pseudomonas aeruginosa] [SR:Pseudomonas aeruginosa (strain:PAO1) DNA]
[DB:genpept-bct1] [DE:Pseudomonas aeruginosa gene for chemotactic transducer,
completecds.] [NT:orf1] [LE:3119] [RE:4141] [DI:direct]

| ORF Name | NT ID | AA ID | NT LN | AA LN | Score | P-value |
|---|---|---|---|---|---|---|
| 554050_f3_1105 | 1846 | 9017 | 222 | 73 | | |

Description

NO-HIT

| ORF_Name | NT ID | AA ID | NT/LN | AA/LN | Score | P-value |
|---|---|---|---|---|---|---|
| 578577_c1_1597 | 1847 | 9018 | 1479 | 492 | 1119 | 2.2e-113 |

Description sp:[LN:NDAD_ALCXX] [AC:P72349:008051] [GN:DAN] [OR:Alcaligenes xylosoxydans xylosoxydans] [SR:,Achromobacter xylosoxidans] [EC:3.5.1.81] [DE:D-AMINOACYLASE, (N-ACYL-D-AMINO-ACID DEACYLASE)] [SP:P72349:008051] [DB:swissprot]

| ORF_Name | NT ID | AA ID | NT/LN | AA/LN | Score | P-value |
|---|---|---|---|---|---|---|
| 581503_f3_1252 | 1848 | 9019 | 1386 | 461 | 2054 | 1.8e-212 |

Description sp:[LN:YTFL_ECOLI] [AC:P39319] [GN:YTFL] [OR:Escherichia coli] [DE:HYPOTHETICAL 49.8 KD PROTEIN IN CYSQ-MSRA INTERGENIC REGION] [SP:P39319] [DB:swissprot] >sp:[LN:S56443] [AC:S56443:E65233] [PN:hypothetical 49.8K protein (cysq-msra intergenic region):hypothetical protein f447] [GN:ytfL] [CL:hypothetical protein HI0107] [OR:Escherichia coli] [DB:pir1] >gp:[GI:g537059] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_f447] [LE:130703] [RE:132046] [DI:complement] >gp:[GI:g1790664] [LN:AE000493] [AC:AE000493:U00096] [PN:putative transport protein] [GN:ytfL] [FN:putative transport; Not classified] [OR:Escherichia coli] [DB:genpept-bct2] [DE:Escherichia coli K-12 MG1655 section 383 of 400 of the completegenome.] [NT:f447; 100 pct identical amino acid sequence and] [LE:2320] [RE:3663] [DI:complement]

| ORF_Name | NT ID | AA ID | NT/LN | AA/LN | Score | P-value |
|---|---|---|---|---|---|---|
| 5863876_f2_843 | 1849 | 9020 | 756 | 251 | 716 | 1.1e-70 |

Description sp:[LN:S56431] [AC:S56431:A65232] [PN:hypothetical protein f224:hypothetical protein b4206] [OR:Escherichia coli] [DB:pir2] >gp:[GI:g537047] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_f224] [LE:118911] [RE:119585] [DI:complement] >gp:[GI:g1790651] [LN:AE000492] [AC:AE000492:U00096] [PN:orf, hypothetical protein] [GN:ytfB] [FN:orf; Unknown] [OR:Escherichia coli] [DB:genpept-bct2] [DE:Escherichia coli K-12 MG1655 section 382 of 400 of the completegenome.] [NT:f224] [LE:651] [RE:1325] [DI:complement]

| ORF Name | NT ID | AA ID | NT/LN | AA/LN | Score | P-value |
|---|---|---|---|---|---|---|
| 5957637_f1_198 | 1850 | 9021 | 405 | 134 | 297 | 2.8e-26 |

Description sp:[LN:YLCC_ECOLI] [AC:P77214] [GN:YLCC] [OR:Escherichia coli] [DE:HYPOTHETICAL
12.3 KD PROTEIN IN NFRB-PHEP INTERGENIC REGION PRECURSOR] [SP:P77214]
[DB:swissprot] >sp:[LN:C64790] [AC:C64790] [PN:yclC protein] [GN:yclC]
[OR:Escherichia coli] [DB:pir2] >gp:[GI:d1036193:g4062197] [LN:D90699]
[AC:D90699:AB001340] [OR:Escherichia coli] [SR:Escherichia coli(strain:K12) DNA,
clone:Kohara clone #162] [DB:genpept-bct1] [DE:Escherichia coli genomic DNA.
(12.6 - 12.9 min).] [NT:ORF_ID:o163#3] [LE:11546] [RE:11878] [DI:direct]
>gp:[GI:d1036199:g4062203] [LN:D90700] [AC:D90700:AB001340] [OR:Escherichia coli]
[SR:Escherichia coli(strain:K12) DNA, clone:Kohara clone #163] [DB:genpept-bct1]
[DE:Escherichia coli genomic DNA. (12.8 - 13.2 min).] [NT:ORF_ID:o163#3]
[LE:2469] [RE:2801] [DI:direct] >gp:[GI:g1778488] [LN:ECU82598] [AC:U82598]
[OR:Escherichia coli] [DB:genpept-bct1] [DE:Escherichia coli genomic sequence of
minutes 9 to 12.] [NT:hypothetical protein] [LE:37762] [RE:38094] [DI:direct]
>gp:[GI:g1786786] [LN:AE000162] [AC:AE000162:U00096] [PN:orf, hypothetical
protein] [GN:ylcC] [FN:orf; Unknown] [OR:Escherichia coli] [DB:genpept-bct2]
[DE:Escherichia coli K-12 MG1655 section 52 of 400 of the completegenome.]
[NT:o110; This 110 aa ORF is 25 pct identical (1 gap)] [LE:3908] [RE:4240]
[DI:direct]

| ORF Name | NT ID | AA ID | NT/LN | AA/LN | Score | P-value |
|---|---|---|---|---|---|---|
| 5959427_c2_1935 | 1851 | 9022 | 1113 | 370 | 259 | 3.0e-22 |

Description sp:[LN:G64905] [AC:G64905] [PN:sugar-binding protein homolog b1516 precursor]
[OR:Escherichia coli] [DB:pir2] >gp:[GI:g1787795] [LN:AE000249]
[AC:AE000249:U00096] [PN:putative LACI-type transcriptional regulator] [GN:b1516]
[FN:putative regulator; Not classified] [OR:Escherichia coli] [DB:genpept-bct2]
[DE:Escherichia coli K-12 MG1655 section 139 of 400 of the completegenome.]
[NT:o340; This 340 aa ORF is 25 pct identical (15 gaps)] [LE:4833] [RE:5855]
[DI:direct]

| ORF Name | NT ID | AA ID | NT/LN | AA/LN | Score | P-value |
|---|---|---|---|---|---|---|
| 5973568_f3_1015 | 1852 | 9023 | 1479 | 492 | 2492 | 7.1e-259 |

Description gp:[GI:g757827] [LN:EC4HPADNA] [AC:Z37980] [PN:5-carboxy-2-hydroxymuconate
semialdehyde] [GN:hpaE] [OR:Escherichia coli] [DB:genpept-bct1] [DE:E.coli
hpa[G,R,E,D,F,H,I,X,A,B,C] genes.] [LE:2137] [RE:3603] [DI:direct]

| ORF Name | NT ID | AA ID | NT/LN | AA/LN | Score | P-value |
|---|---|---|---|---|---|---|
| 6021015_f3_1244 | 1853 | 9024 | 681 | 226 | 900 | 3.5e-90 |

Description sp:[LN:PWEC] [AC:A27648:S56452:E65234] [PN:inorganic pyrophosphatase,:pyrophosphate phosphohydrolase] [GN:ppa] [CL:inorganic pyrophosphatase] [OR:Escherichia coli] [EC:3.6.1.1] [DB:pir1] [MP:100 min] >gp:[GI:g537068] [LN:ECOUW93] [AC:U14003] [GN:ppa] [FN:inorganic pyrophosphatase] [OR:Escherichia coli] [DB:genpept-bct1] [EC:3.6.1.1] [DE:Escherichia coli K-12 chromosomal region from 92.8 to 00.1 minutes.] [LE:139954] [RE:140484] [DI:complement] >gp:[GI:g1790673] [LN:AE000494] [AC:AE000494:U00096] [PN:inorganic pyrophosphatase] [GN:ppa] [FN:enzyme; Central intermediary metabolism: Pool,] [OR:Escherichia coli] [DB:genpept-bct2] [EC:3.6.1.1] [DE:Escherichia coli K-12 MG1655 section 384 of 400 of the completegenome.] [NT:f176; 100 pct identical amino acid sequence and] [LE:809] [RE:1339] [DI:complement] >gp:[GI:g450373] [LN:ECOPPA] [AC:M23550] [PN:inorganic pyrophosphatase] [GN:ppa] [OR:Escherichia coli] [DB:genpept-bct2] [EC:3.6.1.1] [DE:Escherichia coli inorganic pyrophosphatase (ppa) gene, completecds.] [LE:292] [RE:822] [DI:direct]

| ORF Name | NT ID | AA ID | NT/LN | AA/LN | Score | P-value |
|---|---|---|---|---|---|---|
| 6022003_c3_2173 | 1854 | 9025 | 207 | 68 | | |

Description

NO-HIT

| ORF Name | NT ID | AA ID | NT/LN | AA/LN | Score | P-value |
|---|---|---|---|---|---|---|
| 6027091_c1_1408 | 1855 | 9026 | 474 | 157 | 686 | 1.7e-67 |

Description sp:[LN:YJGD_SALTY] [AC:Q08019] [GN:YJGD] [OR:Salmonella typhimurium] [DE:15.6)] [SP:Q08019] [DB:swissprot] >sp:[LN:S34360] [AC:S34360] [PN:hypothetical protein 15.6] [OR:Salmonella typhimurium] [DB:pir2] >gp:[GI:g312707] [LN:STMIAE] [AC:X73368] [OR:Salmonella typhimurium] [DB:genpept-bct1] [DE:S.typhimurium genes miaE, argI (partial) and orf's.] [NT:ORF 15.6] [SP:Q08019] [LE:820] [RE:1236] [DI:direct]

| ORF Name | NT ID | AA ID | NT/LN | AA/LN | Score | P-value |
|---|---|---|---|---|---|---|
| 6048582_f2_570 | 1856 | 9027 | 1380 | 459 | 1623 | 8.6e-167 |

Description gp:[GI:g757832] [LN:EC4HPADNA] [AC:Z37980] [PN:hypothetical 4-hydroxyphenylacetate permease] [GN:hpaX] [OR:Escherichia coli] [DB:genpept-bct1] [DE:E.coli hpa[G,R,E,D,F,H,I,X,A,B,C] genes.] [LE:6734] [RE:8110] [DI:direct]

| ORF Name | NT ID | AA ID | NT/LN | AA/LN | Score | P-value |
|---|---|---|---|---|---|---|
| 6063256_f2_609 | 1857 | 9028 | 471 | 156 | 122 | 2.0e-07 |

Description sp:[LN:D71245] [AC:D71245] [PN:hypothetical protein PH0221] [GN:PH0221]
[OR:Pyrococcus horikoshii] [DB:pir2] >gp:[GI:d1030234:g3256608] [LN:AP000001]
[AC:AP000001:AB009465:AB009464:AB009466:AB009467:AB009468:AB009469] [PN:235aa
long hypothetical protein] [GN:PH0221] [OR:Pyrococcus horikoshii] [SR:Pyrococcus
horikoshii (strain:OT3) DNA] [DB:genpept-bct1] [DE:Pyrococcus horikoshii OT3
genomic DNA, 1-287000 nt. position (1/7).] [LE:194212] [RE:194919]
[DI:complement]

| ORF Name | NT ID | AA ID | NT/LN | AA/LN | Score | P-value |
|---|---|---|---|---|---|---|
| 6126712_f3_1009 | 1858 | 9029 | 1233 | 410 | 910 | 3.1e-91 |

Description gp:[GI:g5924061] [LN:AF158699] [AC:AF158699:U41162] [PN:D-serine deaminase]
[GN:dsd] [OR:Burkholderia cepacia] [DB:genpept-bct2] [DE:Burkholderia cepacia
D-serine deaminase (dsd), marR homolog, andmajor facilitator superfamily
transporter homolog (ORFD) genes,complete cds; and unknown gene.] [LE:508]
[RE:1806] [DI:direct]

| ORF Name | NT ID | AA ID | NT/LN | AA/LN | Score | P-value |
|---|---|---|---|---|---|---|
| 6141467_f2_678 | 1859 | 9030 | 630 | 209 | | |

Description

NO-HIT

| ORF Name | NT ID | AA ID | NT/LN | AA/LN | Score | P-value |
|---|---|---|---|---|---|---|
| 6251463_f2_658 | 1860 | 9031 | 201 | 66 | | |

Description

NO-HIT

| ORF Name | NT ID | AA ID | NT/LN | AA/LN | Score | P-value |
|---|---|---|---|---|---|---|
| 6270127_c3_2407 | 1861 | 9032 | 888 | 295 | 528 | 9.3e-51 |

Description sp:[LN:PTND_ECOLI] [AC:P08188] [GN:MANZ:PTSM:GPTB] [OR:Escherichia coli]
[DE:(EII-M-MAN)] [SP:P08188] [DB:swissprot] >sp:[LN:WQECMM] [AC:A30288:C64943]
[PN:phosphotransferase system enzyme II,, mannose-specific, factor IID:mannose
permease, factor II-M:protein-Npi-phosphohistidine--mannose phosphotransferase,
factor II-M:protein-Npi-phosphohistidine--sugar phosphotransferase,
mannose-specific enzyme II-M] [GN:manZ:ptsM] [CL:phosphotransferase system
mannose-specific enzyme II, factor II-M] [OR:Escherichia coli] [EC:2.7.1.69]
[DB:pir1] [MP:40 min] >gp:[GI:d1016355:g1736464] [LN:D90826] [AC:D90826:AB001340]
[PN:PTS system, Mannose-specific IID component] [GN:manZ, ptsM, gptB]
[OR:Escherichia coli] [SR:Escherichia coli (strain:K12) DNA, clone_lib:Kohara
lambda minise] [DB:genpept-bct1] [DE:E.coli genomic DNA, Kohara clone
335(40.9-41.3 min.).] [NT:ORF_ID:o335#1; similar to [SwissProt Accession]
[LE:5050] [RE:5910] [DI:direct] >gp:[GI:g147404] [LN:ECOPTSLPM] [AC:J02699]
[PN:mannose permease subunit II-M-Man] [GN:ptsM] [OR:Escherichia coli] [SR:E.coli
DNA, clone RP7029] [DB:genpept-bct1] [DE:E.coli ptsL, ptsP and ptsM genes
encoding mannose permease subunitsIII-man, II-P-man and II-M-man, complete cds.]
[LE:2214] [RE:3074] [DI:direct] >gp:[GI:g1788122] [LN:AE000276]
[AC:AE000276:U00096] [PN:PTS enzyme IID, mannose-specific] [GN:manZ]
[FN:transport; Transport of small molecules:] [OR:Escherichia coli]
[DB:genpept-bct2] [DE:Escherichia coli K-12 MG1655 section 166 of 400 of the
completegenome.] [NT:o286; 100 pct identical to PTND_ECOLI SW: P08188;] [LE:5570]
[RE:6430] [DI:direct]

| ORF Name | NT ID | AA ID | NT/LN | AA/LN | Score | P-value |
|---|---|---|---|---|---|---|
| 6364026_f1_339 | 1862 | 9033 | 198 | 65 | | |

Description

NO-HIT

| ORF Name | NT ID | AA ID | NT LN | AA LN | Score | P-value |
|---|---|---|---|---|---|---|
| 6444213_c2_2037 | 1863 | 9034 | 1392 | 463 | 2252 | 1.9e-233 |

Description sp:[LN:RADA_ECOLI] [AC:P24554] [GN:RADA:SMS] [OR:Escherichia coli] [DE:DNA REPAIR PROTEIN RADA (DNA REPAIR PROTEIN SMS)] [SP:P24554] [DB:swissprot] >sp:[LN:JC1417] [AC:JC1417:S56613:D65254:S18877] [PN:DNA repair protein sms:DNA repair protein radA] [GN:sms:radA] [CL:DNA repair protein sms] [OR:Escherichia coli] [DB:pir1] >gp:[GI:g537229] [LN:ECOUW93] [AC:U14003] [GN:sms] [OR:Escherichia coli] [DB:genpept-bct1] [DE:Escherichia coli K-12 chromosomal region from 92.8 to 00.1 minutes.] [LE:316744] [RE:318126] [DI:direct] >gp:[GI:g581233] [LN:ECSMSG] [AC:X63155:S45923] [GN:sms] [FN:unknown] [OR:Escherichia coli] [DB:genpept-bct1] [DE:E.coli sms gene.] [SP:P24554] [LE:64] [RE:1446] [DI:direct] >gp:[GI:g1790850] [LN:AE000509] [AC:AE000509:U00096] [PN:probable ATP-dependent protease] [GN:sms] [FN:putative enzyme; Degradation of proteins,] [OR:Escherichia coli] [DB:genpept-bct2] [DE:Escherichia coli K-12 MG1655 section 399 of 400 of the completegenome.] [NT:o460; 100 pct identical amino acid sequence and] [LE:1100] [RE:2482] [DI:direct] >gp:[GI:g1401238] [AC:U59449] [PN:RadA] [GN:radA] [OR:Escherichia coli] [DB:genpept-bct2] [DE:Escherichia coli radA gene, complete cds.] [NT:Sms] [LE:16] [RE:1398] [DI:direct]

| ORF Name | NT ID | AA ID | NT LN | AA LN | Score | P-value |
|---|---|---|---|---|---|---|
| 6489031_c3_2175 | 1864 | 9035 | 1056 | 351 | 742 | 2.0e-73 |

Description sp:[LN:CELF_BACSU] [AC:P46320] [GN:CELF:CELD:LICH] [OR:Bacillus subtilis] [EC:3.2.1.86] [DE:PROBABLE 6-PHOSPHO-BETA-GLUCOSIDASE,] [SP:P46320] [DB:swissprot] >sp:[LN:S57762] [AC:S57762:G69651] [PN:6-phospho-beta-glucosidase licH] [GN:licH] [OR:Bacillus subtilis] [DB:pir2] >gp:[GI:g895751] [LN:BSCELABCD] [AC:Z49992] [PN:putative 6-phospho-beta-glucosidase] [GN:celD] [OR:Bacillus subtilis] [DB:genpept-bct1] [DE:B.subtilis celA, celB, celC, celD and ywaA genes.] [SP:P46320] [LE:4270] [RE:5598] [DI:direct] >gp:[GI:e1186355:g2636391] [LN:BSUB0020] [AC:Z99123:AL009126] [PN:6-phospho-beta-glucosidase] [GN:licH] [FN:lichenan degradation products utilization] [OR:Bacillus subtilis] [DB:genpept-bct1] [EC:3.2.1.86] [DE:Bacillus subtilis complete genome (section 20 of 21): from 3798401to 4010550.] [NT:alternate gene name: celD, celF] [SP:P46320] [LE:158910] [RE:160238] [DI:complement]

| ORF Name | NT ID | AA ID | NT LN | AA LN | Score | P-value |
|---|---|---|---|---|---|---|
| 6531943_c2_2026 | 1865 | 9036 | 804 | 267 | 1007 | 1.6e-101 |

Description sp:[LN:YJJV_ECOLI] [AC:P39408:P78143] [GN:YJJV] [OR:Escherichia coli] [DE:HYPOTHETICAL 28.9 KD PROTEIN IN OSMY-DEOC INTERGENIC REGION] [SP:P39408:P78143] [DB:swissprot]

| ORF Name | NT ID | AA ID | NT LN | AA LN | Score | P-value |
|---|---|---|---|---|---|---|
| 6532318_f3_1046 | 1866 | 9037 | 777 | 258 | 1095 | 7.7e-111 |

Description sp:[LN:YJIL_ECOLI] [AC:P39383] [GN:YJIL] [OR:Escherichia coli] [DE:HYPOTHETICAL
27.4 KD PROTEIN IN IADA-MCRD INTERGENIC REGION (F257)] [SP:P39383] [DB:swissprot]
>sp:[LN:S56559] [AC:S56559:H65247] [PN:hypothetical 27.4K protein (iadA-mcrD
intergenic region):hypothetical protein f257] [GN:yjiL] [CL:hgdC protein]
[OR:Escherichia coli] [DB:pir2] >gp:[GI:g537175] [LN:ECOUW93] [AC:U14003]
[OR:Escherichia coli] [DB:genpept-bct1] [DE:Escherichia coli K-12 chromosomal
region from 92.8 to 00.1 minutes.] [NT:ORF_f257] [LE:254754] [RE:255527]
[DI:complement] >gp:[GI:g1790791] [LN:AE000504] [AC:AE000504:U00096] [PN:putative
enzyme] [GN:yjiL] [FN:putative enzyme; Not classified] [OR:Escherichia coli]
[DB:genpept-bct2] [DE:Escherichia coli K-12 MG1655 section 394 of 400 of the
completegenome.] [NT:f257; 100 pct identical amino acid sequence and] [LE:1243]
[RE:2016] [DI:complement]

| ORF Name | NT ID | AA ID | NT LN | AA LN | Score | P-value |
|---|---|---|---|---|---|---|
| 667025_c3_2276 | 1867 | 9038 | 276 | 91 | | |

Description

NO-HIT

| ORF Name | NT ID | AA ID | NT LN | AA LN | Score | P-value |
|---|---|---|---|---|---|---|
| 6744830_f2_514 | 1868 | 9039 | 1059 | 352 | 1608 | 3.3e-165 |

Description sp:[LN:YJJT_ECOLI] [AC:P39406] [GN:YJJT] [OR:Escherichia coli] [DE:HYPOTHETICAL
37.6 KD PROTEIN IN FHUF-HOLD INTERGENIC REGION (F343B)] [SP:P39406]
[DB:swissprot] >sp:[LN:S56595] [AC:S56595:B65252] [PN:hypothetical 37.6K protein
(dnaT-holD intergenic region):hypothetical protein f343b] [GN:yjjT]
[OR:Escherichia coli] [DB:pir2] >gp:[GI:g537211] [LN:ECOUW93] [AC:U14003]
[OR:Escherichia coli] [DB:genpept-bct1] [DE:Escherichia coli K-12 chromosomal
region from 92.8 to 00.1 minutes.] [NT:ORF_f343b] [LE:297501] [RE:298532]
[DI:complement] >gp:[GI:g1790830] [LN:AE000507] [AC:AE000507:U00096] [PN:putative
enzyme] [GN:yjjT] [FN:putative enzyme; Not classified] [OR:Escherichia coli]
[DB:genpept-bct2] [DE:Escherichia coli K-12 MG1655 section 397 of 400 of the
completegenome.] [NT:f343b; 100 pct identical amino acid sequence and] [LE:9618]
[RE:10649] [DI:complement]

| ORF Name | NT ID | AA ID | NT/LN | AA/LN | Score | P-value |
|---|---|---|---|---|---|---|
| 6757757_f1_221 | 1869 | 9040 | 492 | 163 | 412 | 1.8e-38 |

Description sp:[LN:T14710] [AC:T14710:T14979] [PN:probable transposase] [GN:Y1062]
[OR:Yersinia pestis] [DB:pir2] >gp:[GI:g5834763] [LN:YPPMT1] [AC:AL117211]
[PN:putative transposase] [GN:YPMT1.80c] [OR:Yersinia pestis] [DB:genpept-bct1]
[DE:Yersinia pestis plasmid pPMT1.] [NT:YPMT1.80c, probable transposase, len: 402
aa;] [LE:79777] [RE:80985] [DI:complement] >gp:[GI:g2996347] [LN:AF053947]
[AC:AF053947] [PN:transposase] [OR:Yersinia pestis] [DB:genpept-bct2]
[DE:Yersinia pestis plasmid pMT1, complete plasmid sequence.] [LE:79222]
[RE:80430] [DI:direct] >gp:[GI:g3883062] [LN:AF074611] [AC:AF074611]
[PN:transposase] [GN:Y1062] [OR:Yersinia pestis] [DB:genpept-bct2] [DE:Yersinia
pestis plasmid pMT-1, complete plasmid sequence.] [NT:o402; 100 pct identical (0
gaps) to 220 residues of] [LE:51013] [RE:52221] [DI:direct]

| ORF Name | NT ID | AA ID | NT/LN | AA/LN | Score | P-value |
|---|---|---|---|---|---|---|
| 6775883_c2_1989 | 1870 | 9041 | 468 | 155 | 217 | 8.4e-18 |

Description sp:[LN:Y854_PYRHO] [AC:O58584] [GN:PH0854:PHAL028] [OR:Pyrococcus horikoshii]
[DE:HYPOTHETICAL PROTEIN PH0854] [SP:O58584] [DB:swissprot] >sp:[LN:B71136]
[AC:B71136] [PN:hypothetical protein PH0854] [GN:PH0854] [CL:hypothetical protein
HI0719] [OR:Pyrococcus horikoshii] [DB:pir2] >gp:[GI:d1030891:g3257265]
[LN:AP000003] [AC:AP000003:AB009484:AB009485:AB009486:AB009487:AB009488:AB009489]
[PN:137aa long hypothetical protein] [GN:PH0854] [OR:Pyrococcus horikoshii]
[SR:Pyrococcus horikoshii (strain:OT3) DNA] [DB:genpept-bct1] [DE:Pyrococcus
horikoshii OT3 genomic DNA, 544001-777000 nt. position(3/7).] [NT:similar to
Swiss_Prot:P37552 percent identity:] [LE:218223] [RE:218636] [DI:complement]

| ORF Name | NT ID | AA ID | NT/LN | AA/LN | Score | P-value |
|---|---|---|---|---|---|---|
| 6929702_c2_1907 | 1871 | 9042 | 549 | 182 | 622 | 1.0e-60 |

Description sp:[LN:BLC_ECOLI] [AC:P39281] [GN:BLC] [OR:Escherichia coli] [DE:OUTER MEMBRANE
LIPOPROTEIN BLC PRECURSOR] [SP:P39281] [DB:swissprot] >sp:[LN:I84534]
[AC:I84534:S56377:C65225] [PN:outer membrane 19.9K lipoprotein (suge-ampc
intergenic region)] [GN:blc] [CL:lipocalin:lipocalin homology] [OR:Escherichia
coli] [DB:pir2] >gp:[GI:g536993] [LN:ECOUW93] [AC:U14003] [OR:Escherichia coli]
[DB:genpept-bct1] [DE:Escherichia coli K-12 chromosomal region from 92.8 to 00.1
minutes.] [NT:ORF_f177] [LE:68017] [RE:68550] [DI:complement] >gp:[GI:g1790592]
[LN:AE000487] [AC:AE000487:U00096] [PN:outer membrane lipoprotein (lipocalin)]
[GN:blc] [FN:membrane; Macromolecule synthesis,] [OR:Escherichia coli]
[DB:genpept-bct2] [DE:Escherichia coli K-12 MG1655 section 377 of 400 of the
completegenome.] [NT:f177; 100 pct identical amino acid sequence and] [LE:8679]
[RE:9212] [DI:complement] >gp:[GI:g717134] [LN:ECU21726] [AC:U21726]
[PN:lipocalin precursor] [GN:blc] [OR:Escherichia coli] [DB:genpept-bct2]
[DE:Escherichia coli lipocalin precursor (blc), SugE (sugE),entericidin B
precursor (ecnB), and entericidin A precursor (ecnA)genes, complete cds.]
[NT:Blc] [LE:59] [RE:592] [DI:direct]

| ORF Name | NT ID | AA ID | NT LN | AA LN | Score | P-value |
|---|---|---|---|---|---|---|
| 7073550_c1_1482 | 1872 | 9043 | 492 | 163 | | |

Description

NO-HIT

| ORF Name | NT ID | AA ID | NT LN | AA LN | Score | P-value |
|---|---|---|---|---|---|---|
| 7156706_c3_2424 | 1873 | 9044 | 219 | 72 | | |

Description

NO-HIT

| ORF Name | NT ID | AA ID | NT LN | AA LN | Score | P-value |
|---|---|---|---|---|---|---|
| 7220463_c3_2122 | 1874 | 9045 | 462 | 153 | 684 | 2.7e-67 |

Description sp:[LN:RL9_ECOLI] [AC:P02418] [GN:RPLI] [OR:Escherichia coli] [DE:50S RIBOSOMAL
PROTEIN L9] [SP:P02418] [DB:swissprot] >sp:[LN:R5EC9] [AC:F65231:S56428:A02802]
[PN:ribosomal protein L9] [GN:rplI] [CL:Escherichia coli ribosomal protein L9]
[OR:Escherichia coli] [DB:pir1] [MP:96 min] >gp:[GI:g537044] [LN:ECOUW93]
[AC:U14003] [PN:50S ribosomal subunit protein L9] [GN:rplI] [OR:Escherichia coli]
[DB:genpept-bct1] [DE:Escherichia coli K-12 chromosomal region from 92.8 to 00.1
minutes.] [NT:CG Site No. 257] [LE:116940] [RE:117389] [DI:direct]
>gp:[GI:g42848] [LN:ECRPSFRI] [AC:X04022] [OR:Escherichia coli] [DB:genpept-bct1]
[DE:E. coli genes rpsF, rpsR and rplI for ribosomal proteins S6, S18,L9.]
[NT:ribosome protein L9 (aa 1-149)] [SP:P02418] [LE:1439] [RE:1888] [DI:direct]
>gp:[GI:g1790647] [LN:AE000491] [AC:AE000491:U00096] [PN:50S ribosomal subunit
protein L9] [GN:rplI] [FN:structural component; Ribosomal proteins -]
[OR:Escherichia coli] [DB:genpept-bct2] [DE:Escherichia coli K-12 MG1655 section
381 of 400 of the completegenome.] [NT:o149; CG Site No. 257] [LE:9774]
[RE:10223] [DI:direct]

| ORF Name | NT ID | AA ID | NT LN | AA LN | Score | P-value |
|---|---|---|---|---|---|---|
| 7245140_f1_367 | 1875 | 9046 | 2028 | 675 | 592 | 1.5e-57 |

Description sp:[LN:BGAL_BACST] [AC:P19668] [GN:BGAB] [OR:Bacillus stearothermophilus]
[EC:3.2.1.23] [DE:BETA-GALACTOSIDASE I, (LACTASE)] [SP:P19668] [DB:swissprot]
>sp:[LN:A29836] [AC:A29836] [PN:beta-galactosidase, I] [CL:Bacillus
beta-galactosidase] [OR:Bacillus stearothermophilus] [EC:3.2.1.23] [DB:pir1]
>gp:[GI:g142578] [LN:BACBGAB] [AC:M13466] [OR:Bacillus stearothermophilus]
[SR:B.stearothermophilus DNA, clone pHG5] [DB:genpept-bct1]
[DE:B.stearothermophilus bgaB gene encoding beta-galactosidase I.]
[NT:beta-galactosidase I] [LE:448] [RE:2466] [DI:direct]

| ORF Name | NT ID | AA ID | NT/LN | AA/LN | Score | P-value |
|---|---|---|---|---|---|---|
| 7245268_f2_612 | 1876 | 9047 | 201 | 66 | | |

Description

NO-HIT

| ORF Name | NT ID | AA ID | NT/LN | AA/LN | Score | P-value |
|---|---|---|---|---|---|---|
| 7706_c3_2435 | 1877 | 9048 | 1650 | 549 | 2661 | 8.7e-277 |

Description gp:[GI:d1009725:g1072319] [LN:STYPRFC] [AC:D50496] [PN:peptide release factor 3/RF3] [GN:prfC] [OR:Salmonella typhimurium] [SR:Salmonella typhimurium (strain LT-2) DNA, clone pYK1] [DB:genpept-bct1] [DE:Salmonella typhimurium gene for peptide release factor 3/RF3,complete cds.] [LE:201] [RE:1790] [DI:direct]

| ORF Name | NT ID | AA ID | NT/LN | AA/LN | Score | P-value |
|---|---|---|---|---|---|---|
| 859456_c1_1358 | 1878 | 9049 | 294 | 97 | | |

Description

NO-HIT

| ORF Name | NT ID | AA ID | NT/LN | AA/LN | Score | P-value |
|---|---|---|---|---|---|---|
| 865630_f3_968 | 1879 | 9050 | 195 | 64 | | |

Description

NO-HIT

| ORF Name | NT ID | AA ID | NT/LN | AA/LN | Score | P-value |
|---|---|---|---|---|---|---|
| 865680_f3_969 | 1880 | 9051 | 456 | 151 | 457 | 3.1e-43 |

Description sp:[LN:FHUF_ECOLI] [AC:P39405] [GN:FHUF] [OR:Escherichia coli] [DE:FERRIC HYDROXAMATE TRANSPORT PROTEIN FHUF] [SP:P39405] [DB:swissprot] >sp:[LN:S56594] [AC:S56594:A65252] [PN:hypothetical 30.1K protein (dnaT-holD intergenic region):hypothetical protein f262b] [GN:yjjS] [CL:Escherichia coli hypothetical 30.1K protein (dnaT-holD intergenic region)] [OR:Escherichia coli] [DB:pir2] >gp:[GI:g537210] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_f262b] [LE:295707] [RE:296495] [DI:complement] >gp:[GI:g1790829] [LN:AE000507] [AC:AE000507:U00096] [PN:orf, hypothetical protein] [GN:fhuF] [FN:orf; Unknown] [OR:Escherichia coli] [DB:genpept-bct2] [DE:Escherichia coli K-12 MG1655 section 397 of 400 of the completegenome.] [NT:f262b; 100 pct identical amino acid sequence and] [LE:7824] [RE:8612] [DI:complement]

| ORF_Name | NT_ID | AA_ID | NT/LN | AA/LN | Score | P-value |
|---|---|---|---|---|---|---|
| 866561_c3_2258 | 1881 | 9052 | 189 | 62 | | |

Description

NO-HIT

| ORF_Name | NT_ID | AA_ID | NT/LN | AA/LN | Score | P-value |
|---|---|---|---|---|---|---|
| 897326_f1_336 | 1882 | 9053 | 588 | 195 | 873 | 2.6e-87 |

Description sp:[LN:YJGA_ECOLI] [AC:P26650] [GN:YJGA:X96] [OR:Escherichia coli] [DE:PROTEIN) (F183)] [SP:P26650] [DB:swissprot] >sp:[LN:S56460] [AC:S56460:E65235] [PN:hypothetical 21.4K protein (fbp-pmba intergenic region):x96 protein] [GN:yjgA] [OR:Escherichia coli] [DB:pir2] >gp:[GI:d1008502:g1732439] [LN:ECOTLDE2] [AC:D44452] [PN:21K protein] [OR:Escherichia coli] [SR:Escherichia coli (strain:K12, isolate:KP5254) DNA, clone:pKP1838] [DB:genpept-bct1] [DE:Escherichia coli DNA for TldE protein and 21K protein, completecds.] [LE:212] [RE:763] [DI:complement] >gp:[GI:g537076] [LN:ECOUW93] [AC:U14003] [GN:x96] [OR:Escherichia coli] [DB:genpept-bct1] [DE:Escherichia coli K-12 chromosomal region from 92.8 to 00.1 minutes.] [NT:alternate gene name yjgA] [LE:148143] [RE:148694] [DI:complement] >gp:[GI:g148266] [LN:ECOX96A] [AC:M95096] [PN:X96] [GN:x96] [OR:Escherichia coli] [SR:Escherichia coli (strain K-12) DNA] [DB:genpept-bct1] [DE:E.coli X96 gene, complete cds.] [LE:274] [RE:825] [DI:direct] >gp:[GI:g1790681] [LN:AE000494] [AC:AE000494:U00096] [PN:putative alpha helix protein] [GN:yjgA] [FN:phenotype; Not classified] [OR:Escherichia coli] [DB:genpept-bct2] [DE:Escherichia coli K-12 MG1655 section 384 of 400 of the completegenome.] [NT:f183; 100 pct identical amino acid sequence and] [LE:8998] [RE:9549] [DI:complement]

| ORF_Name | NT_ID | AA_ID | NT/LN | AA/LN | Score | P-value |
|---|---|---|---|---|---|---|
| 9772187_f2_777 | 1883 | 9054 | 786 | 261 | 217 | 8.4e-18 |

Description gp:[GI:g2935660] [LN:AF029673] [AC:AF029673] [PN:HexR] [GN:hexR] [FN:hex regulon repressor (includes zwf, eda, edd,] [OR:Pseudomonas aeruginosa] [DB:genpept-bct2] [DE:Pseudomonas aeruginosa HexR (hexR), glucose-6-phosphate1-dehydrogenase (zwf), 6-phosphogluconolactonase (pgl), and2-keto-3-deoxy-6-phosphogluconate aldolase (eda) genes, completecds.] [NT:similar to RpiR] [LE:76] [RE:933] [DI:complement]

| ORF Name | NT ID | AA ID | NT/LN | AA/LN | Score | P-value |
|---|---|---|---|---|---|---|
| 9781376_f2_771 | 1884 | 9055 | 1707 | 568 | 2507 | 1.8e-260 |

Description sp:[LN:TREC_ECOLI] [AC:P28904] [GN:TREC:OLGH] [OR:Escherichia coli] [EC:3.2.1.93]
[DE:PHOSPHOTREHALASE)] [SP:P28904] [DB:swissprot] >sp:[LN:S56465]
[AC:S56465:B65236] [PN:alpha,alpha-phosphotrehalase,:trehalose-6-phosphate
hydrolase] [GN:treC] [CL:alpha-glucosidase:alpha-amylase core homology]
[OR:Escherichia coli] [EC:3.2.1.93] [DB:pir2] >gp:[GI:g537081] [LN:ECOUW93]
[AC:U14003] [PN:trehalose-6-phosphate hydrolase] [GN:treC] [OR:Escherichia coli]
[DB:genpept-bct1] [DE:Escherichia coli K-12 chromosomal region from 92.8 to 00.1
minutes.] [NT:amylotrehalase] [LE:153883] [RE:155538] [DI:complement]
>gp:[GI:g1790687] [LN:AE000495] [AC:AE000495:U00096] [PN:trehalase 6-P hydrolase]
[GN:treC] [FN:enzyme; Degradation of small molecules: Carbon] [OR:Escherichia
coli] [DB:genpept-bct2] [EC:3.2.1.93] [DE:Escherichia coli K-12 MG1655 section
385 of 400 of the completegenome.] [NT:f551; 100 pct identical amino acid
sequence and] [LE:3696] [RE:5351] [DI:complement]

| ORF Name | NT ID | AA ID | NT/LN | AA/LN | Score | P-value |
|---|---|---|---|---|---|---|
| 9822538_f1_185 | 1885 | 9056 | 213 | 70 | 78 | 0.0088 |

Description sp:[LN:B71245] [AC:B71245] [PN:hypothetical protein PH0220] [GN:PH0220]
[OR:Pyrococcus horikoshii] [DB:pir2] >gp:[GI:d1030232:g3256606] [LN:AP000001]
[AC:AP000001:AB009465:AB009464:AB009466:AB009467:AB009468:AB009469] [PN:171aa
long hypothetical protein] [GN:PH0220] [OR:Pyrococcus horikoshii] [SR:Pyrococcus
horikoshii (strain:OT3) DNA] [DB:genpept-bct1] [DE:Pyrococcus horikoshii OT3
genomic DNA, 1-287000 nt. position (1/7).] [LE:192864] [RE:193379]
[DI:complement]

| ORF Name | NT ID | AA ID | NT/LN | AA/LN | Score | P-value |
|---|---|---|---|---|---|---|
| 9844833_c1_1329 | 1886 | 9057 | 771 | 256 | 1045 | 1.5e-105 |

Description sp:[LN:CYCA_ECOLI] [AC:P39312] [GN:CYCA:DAGA] [OR:Escherichia coli]
[DE:D-SERINE/D-ALANINE/GLYCINE TRANSPORTER] [SP:P39312] [DB:swissprot]
>sp:[LN:S56433] [AC:S56433:C65232] [PN:d-serine/d-alanine/glycine transporter]
[GN:cycA] [CL:arginine permease] [OR:Escherichia coli] [DB:pir2] >gp:[GI:g537049]
[LN:ECOUW93] [AC:U14003] [OR:Escherichia coli] [DB:genpept-bct1] [DE:Escherichia
coli K-12 chromosomal region from 92.8 to 00.1 minutes.] [NT:ORF_o470]
[LE:120696] [RE:122108] [DI:direct] >gp:[GI:g1790653] [LN:AE000492]
[AC:AE000492:U00096] [PN:transport of D-alanine, D-serine, and glycine] [GN:cycA]
[FN:transport; Transport of small molecules: Amino] [OR:Escherichia coli]
[DB:genpept-bct2] [DE:Escherichia coli K-12 MG1655 section 382 of 400 of the
completegenome.] [NT:o470; 100 pct identical amino acid sequence and] [LE:2436]
[RE:3848] [DI:direct]

| ORF Name | NT ID | AA ID | NT/LN | AA/LN | Score | P-value |
|---|---|---|---|---|---|---|
| 9847161_c2_1995 | 1887 | 9058 | 522 | 173 | 155 | 3.1e-11 |

Description gp:[GI:g1439527] [LN:LCU28163] [AC:U28163] [PN:EIIA-man] [GN:manA]
[OR:Lactobacillus curvatus] [DB:genpept-bct1] [DE:Lactobacillus curvatus
phosphoenolpyruvate:mannosephosphotransferase EIIA-man (manA), EIIB-man (manB),
and EIIC-man(manC) genes, complete cds and EIID-man (manD) gene, partial cds.]
[NT:mannose phosphotransferase system enzyme EII] [LE:65] [RE:505] [DI:direct]

| ORF Name | NT ID | AA ID | NT/LN | AA/LN | Score | P-value |
|---|---|---|---|---|---|---|
| 9869555_f2_624 | 1888 | 9059 | 276 | 91 | 129 | 1.2e-07 |

Description sp:[LN:YLCD_ECOLI] [AC:P77239] [GN:YLCD] [OR:Escherichia coli] [DE:HYPOTHETICAL
44.3 KD PROTEIN IN NFRB-PHEP INTERGENIC REGION PRECURSOR] [SP:P77239]
[DB:swissprot] >sp:[LN:D64790] [AC:D64790] [PN:yclD protein] [GN:yclD]
[OR:Escherichia coli] [DB:pir2] >gp:[GI:d1036194:g4062198] [LN:D90699]
[AC:D90699:AB001340] [PN:Membrane fusion protein MtrC precursor.] [GN:mtrC]
[OR:Escherichia coli] [SR:Escherichia coli(strain:K12) DNA, clone:Kohara clone
162] [DB:genpept-bct1] [DE:Escherichia coli genomic DNA. (12.6 - 12.9 min).]
[NT:ORF_ID:o163#4; similar to SwissProt Accession] [LE:11894] [RE:13117]
[DI:direct] >gp:[GI:d1036200:g4062204] [LN:D90700] [AC:D90700:AB001340]
[PN:Membrane fusion protein MtrC precursor.] [GN:mtrC] [OR:Escherichia coli]
[SR:Escherichia coli(strain:K12) DNA, clone:Kohara clone #163] [DB:genpept-bct1]
[DE:Escherichia coli genomic DNA. (12.8 - 13.2 min).] [NT:ORF_ID:o163#4; similar
to SwissProt Accession] [LE:2817] [RE:4040] [DI:direct] >gp:[GI:g1778489]
[LN:ECU82598] [AC:U82598] [OR:Escherichia coli] [DB:genpept-bct1] [DE:Escherichia
coli genomic sequence of minutes 9 to 12.] [NT:hypothetical protein] [LE:38110]
[RE:39333] [DI:direct] >gp:[GI:g1786787] [LN:AE000162] [AC:AE000162:U00096]
[PN:putative resistance protein] [GN:ylcD] [FN:putative transport; Drug/analog
sensitivity] [OR:Escherichia coli] [DB:genpept-bct1] [DE:Escherichia coli K-12
MG1655 section 52 of 400 of the completegenome.] [NT:o407; This 407 aa ORF is 24
pct identical (37 gaps)] [LE:4256] [RE:5479] [DI:direct]

| ORF Name | NT ID | AA ID | NT LN | AA LN | Score | P-value |
|---|---|---|---|---|---|---|
| 9885212_f1_263 | 1889 | 9060 | 756 | 251 | 305 | 4.0e-27 |

Description sp:[LN:UGPA_ECOLI] [AC:P10905] [GN:UGPA] [OR:Escherichia coli]
[DE:SN-GLYCEROL-3-PHOSPHATE TRANSPORT SYSTEM PERMEASE PROTEIN UGPA] [SP:P10905]
[DB:swissprot] >sp:[LN:MMECUA] [AC:S03781;S47671;G65141]
[PN:sn-Glycerol-3-phosphate transport system permease protein] [GN:ugpA]
[CL:inner membrane protein ugpA] [OR:Escherichia coli] [DB:pirl] [MP:76 min]
>gp:[GI:g466588] [LN:ECOUW76] [AC:U00039] [GN:ugpA] [FN:sn-Glycerol-3-phosphate
transport system] [OR:Escherichia coli] [SR:Escherichia coli (sub_strain MG1655,
strain K-12) (library: lambda] [DB:genpept-bct1] [DE:E. coli chromosomal region
from 76.0 to 81.5 minutes.] [NT:CG Site No. 40] [LE:4286] [RE:5173]
[DI:complement] >gp:[GI:g43247] [LN:ECUGP] [AC:X13141] [OR:Escherichia coli]
[DB:genpept-bct1] [DE:E. coli ugp locus DNA with genes ugpBACE.] [NT:ugpA protein
(AA 1-295)] [SP:P10905] [LE:1769] [RE:2656] [DI:direct] >gp:[GI:g1789861]
[LN:AE000421] [AC:AE000421;U00096] [PN:sn-glycerol 3-phosphate transport system,]
[GN:ugpA] [FN:transport; Transport of small molecules:] [OR:Escherichia coli]
[DB:genpept-bct2] [DE:Escherichia coli K-12 MG1655 section 311 of 400 of the
completegenome.] [NT:f295; 100 pct identical to UGPA_ECOLI SW: P10905;] [LE:5577]
[RE:6464] [DI:complement]

| ORF Name | NT ID | AA ID | NT LN | AA LN | Score | P-value |
|---|---|---|---|---|---|---|
| 9923542_f3_979 | 1890 | 9061 | 525 | 174 | 514 | 2.8e-49 |

Description sp:[LN:YJJA_ECOLI] [AC:P18390] [GN:YJJA] [OR:Escherichia coli] [DE:(PROTEIN P-18)
(F165)] [SP:P18390] [DB:swissprot] >sp:[LN:RMEC18] [AC:S56587;B65251;B31983]
[PN:primosomal operon 17.5K protein (mdob-dnac intergenic region):P18 protein]
[GN:yjjA] [CL:primosomal operon 18K protein] [OR:Escherichia coli] [DB:pirl]
[MP:99 min] >gp:[GI:g537203] [LN:ECOUW93] [AC:U14003] [PN:P18 protein] [GN:yjjA]
[OR:Escherichia coli] [DB:genpept-bct1] [DE:Escherichia coli K-12 chromosomal
region from 92.8 to 00.1 minutes.] [LE:290527] [RE:291024] [DI:complement]
>gp:[GI:g1790822] [LN:AE000507] [AC:AE000507;U00096] [PN:putative
glycoprotein/receptor] [GN:yjjA] [FN:putative factor; Not classified]
[OR:Escherichia coli] [DB:genpept-bct2] [DE:Escherichia coli K-12 MG1655 section
397 of 400 of the completegenome.] [NT:f165; 100 pct identical amino acid
sequence and] [LE:2644] [RE:3141] [DI:complement]

| ORF Name | NT ID | AA ID | NT LN | AA LN | Score | P-value |
|---|---|---|---|---|---|---|
| 9960952_f2_727 | 1891 | 9062 | 924 | 307 | 194 | 7.6e-14 |

Description sp:[LN:Y143_HAEIN] [AC:P44540] [GN:HI0143] [OR:Haemophilus influenzae]
[DE:HYPOTHETICAL PROTEIN HI0143] [SP:P44540] [DB:swissprot] >gp:[GI:g1573099]
[LN:U32700] [AC:U32700;L42023] [PN:conserved hypothetical protein] [GN:HI0143]
[OR:Haemophilus influenzae Rd] [DB:genpept-bct2] [DE:Haemophilus influenzae Rd
section 15 of 163 of the complete genome.] [NT:similar to GB:M81878 SP:P26833
PID:144859 percent] [LE:3533] [RE:4399] [DI:complement]

| ORF Name | NT ID | AA ID | NT LN | AA LN | Score | P-value |
|---|---|---|---|---|---|---|
| 10050942_c1_508 | 1892 | 9063 | 387 | 128 | 157 | 2.7e-10 |

Description gp:[GI:g5001993] [LN:AF134321] [AC:AF134321] [PN:chimeric AFGP/trypsinogen-like serine protease] [OR:Dissostichus mawsoni] [DB:genpept-vrt] [DE:Dissostichus mawsoni clone Dm7m chimeric AFGP/trypsinogen-likeserine protease precursor, gene, partial cds.] [LE:<4472:6286:6513:8227] [RE:5948:6384:6676:8363] [DI:directJoin]

| ORF Name | NT ID | AA ID | NT LN | AA LN | Score | P-value |
|---|---|---|---|---|---|---|
| 10667511_f2_173 | 1893 | 9064 | 906 | 301 | 1332 | 5.9e-136 |

Description sp:[LN:AMIA_ECOLI] [AC:P36548] [GN:AMIA] [OR:Escherichia coli] [EC:3.5.1.28] [DE:(EC 3.5.1.28)] [SP:P36548] [DB:swissprot] >sp:[LN:A36964] [AC:A36964:B65018] [PN:N-acetylmuramoyl-L-alanine amidase,] [GN:amiA] [OR:Escherichia coli] [EC:3.5.1.28] [DB:pir2] >gp:[GI:d1017047:g1799865] [LN:D90873] [AC:D90873:AB001340] [PN:PROBABLE N-ACETYLMURAMOYL-L-ALANINE AMIDASE (EC] [GN:amiA] [OR:Escherichia coli] [SR:Escherichia coli (strain:K12) DNA, clone_lib:Kohara lambda minise] [DB:genpept-bct1] [DE:E.coli genomic DNA, Kohara clone #420(54.9-55.2 min.).] [NT:similar to [SwissProt Accession Number P36548]] [LE:6290] [RE:7159] [DI:direct] >gp:[GI:g453968] [LN:ECHEMF] [AC:X75413] [OR:Escherichia coli] [DB:genpept-bct1] [DE:E.coli orf1, orf3 and hemF gene for coproporphyrinogen III oxidase.] [NT:orf1] [SP:P36548] [LE:439] [RE:1308] [DI:direct] >gp:[GI:g1788776] [LN:AE000331] [AC:AE000331:U00096] [PN:N-acetylmuramoyl-l-alanine amidase I] [GN:amiA] [FN:enzyme; Murein sacculus, peptidoglycan] [OR:Escherichia coli] [DB:genpept-bct2] [EC:3.5.1.28] [DE:Escherichia coli K-12 MG1655 section 221 of 400 of the completegenome.] [NT:o289; 100 pct identical to AMIA_ECOLI SW: P36548] [LE:82] [RE:951] [DI:direct]

| ORF Name | NT ID | AA ID | NT LN | AA LN | Score | P-value |
|---|---|---|---|---|---|---|
| 10744013_c3_732 | 1894 | 9065 | 579 | 192 | 784 | 6.9e-78 |

Description sp:[LN:G65017] [AC:G65017] [PN:hypothetical protein b2432] [OR:Escherichia coli] [DB:pir2] >gp:[GI:g1788772] [LN:AE000330] [AC:AE000330:U00096] [PN:orf, hypothetical protein] [GN:b2432] [FN:orf; Unknown] [OR:Escherichia coli] [DB:genpept-bct2] [DE:Escherichia coli K-12 MG1655 section 220 of 400 of the completegenome.] [NT:f191; This 191 aa ORF is 31 pct identical (12 gaps)] [LE:9205] [RE:9780] [DI:complement]

| ORF_Name | NT ID | AA ID | NT/LN | AA/LN | Score | P-value |
|---|---|---|---|---|---|---|
| 10839716_f3_322 | 1895 | 9066 | 2085 | 694 | 2988 | 0.0 |

Description sp:[LN:TKT2_ECOLI] [AC:P33570] [GN:TKTB] [OR:Escherichia coli] [EC:2.2.1.1]
[DE:TRANSKETOLASE 2, (TK 2)] [SP:P33570] [DB:swissprot] >sp:[LN:A48660]
[AC:A48660:H65021] [PN:transketolase, B:glycolaldehydetransferase
B:transketolase, 2] [GN:tktB] [CL:transketolase:thiamine pyrophosphate-binding
domain homology] [OR:Escherichia coli] [EC:2.2.1.1:2.2.1.1] [DB:pir1] [MP:53 min]
>gp:[GI:d1017069:g1799889] [LN:D90875] [AC:D90875:AB001340] [PN:transketolase (EC
2.2.1.1)] [OR:Escherichia coli] [SR:Escherichia coli (strain:K12) DNA,
clone_lib:Kohara lambda minise] [DB:genpept-bct1] [DE:E.coli genomic DNA, Kohara
clone #422(55.5-55.8 min.).] [NT:similar to [PIR Accession Number A48660]]
[LE:2729] [RE:4732] [DI:direct] >gp:[GI:d1002521:g460975] [LN:ECOTKTB]
[AC:D12473] [PN:transketolase] [GN:tktB] [OR:Escherichia coli] [SR:Escherichia
coli (strain:K-12) DNA, clone:pAI198] [DB:genpept-bct1] [EC:2.2.1.1]
[DE:Escherichia coli gene for transketolase, complete cds.] [LE:221] [RE:2224]
[DI:direct] >gp:[GI:g1788808] [LN:AE000333] [AC:AE000333:U00096]
[PN:transketolase 2 isozyme] [GN:tktB] [FN:enzyme; Central intermediary
metabolism;] [OR:Escherichia coli] [DB:genpept-bct2] [EC:2.2.1.1] [DE:Escherichia
coli K-12 MG1655 section 223 of 400 of the completegenome.] [NT:o667; 100 pct
identical to TKT2_ECOLI SW: P33570] [LE:3679] [RE:5682] [DI:direct]

| ORF_Name | NT ID | AA ID | NT/LN | AA/LN | Score | P-value |
|---|---|---|---|---|---|---|
| 11022280_c3_653 | 1896 | 9067 | 498 | 165 | 191 | 4.8e-15 |

Description sp:[LN:T09854] [AC:T09854] [PN:proline-rich cell wall protein] [OR:Gossypium
hirsutum] [SR:, upland cotton] [DB:pir2] >gp:[GI:g435039] [LN:COTCWPPR]
[AC:L17308] [PN:proline-rich cell wall protein] [OR:Gossypium hirsutum]
[SR:Gossypium hirsutum (strain Coker 312) fiber cDNA to mRNA] [DB:genpept-pln1]
[DE:Gossypium hirsutum proline-rich cell wall protein mRNA, completecds.] [LE:70]
[RE:714] [DI:direct]

| ORF_Name | NT ID | AA ID | NT/LN | AA/LN | Score | P-value |
|---|---|---|---|---|---|---|
| 11182083_c1_445 | 1897 | 9068 | 1083 | 360 | 1200 | 5.7e-122 |

Description sp:[LN:YPFG_ECOLI] [AC:P76559] [GN:YPFG] [OR:Escherichia coli] [DE:HYPOTHETICAL
38.7 KD PROTEIN IN TKTB-NARQ INTERGENIC REGION PRECURSOR] [SP:P76559]
[DB:swissprot] >sp:[LN:A65022] [AC:A65022] [PN:hypothetical protein b2466]
[OR:Escherichia coli] [DB:pir2] >gp:[GI:g1788809] [LN:AE000333]
[AC:AE000333:U00096] [PN:orf, hypothetical protein] [GN:b2466] [FN:orf; Unknown]
[OR:Escherichia coli] [DB:genpept-bct2] [DE:Escherichia coli K-12 MG1655 section
223 of 400 of the completegenome.] [NT:f347; This 347 aa ORF is 34 pct identical
(4 gaps)] [LE:5777] [RE:6820] [DI:complement]

| ORF Name | NT ID | AA ID | NT LN | AA LN | Score | P-value |
|---|---|---|---|---|---|---|
| 11803457_f3_275 | 1898 | 9069 | 1038 | 345 | 1100 | 2.3e-111 |

Description sp:[LN:PTSJ_SALTY] [AC:P40193] [GN:PTSJ] [OR:Salmonella typhimurium] [DE:PUTATIVE TRANSCRIPTIONAL REGULATORY PROTEIN PTSJ] [SP:P40193] [DB:swissprot] >gp:[GI:g507927] [LN:STU11243] [AC:U11243] [PN:PtsJ] [GN:ptsJ] [OR:Salmonella typhimurium] [DB:genpept-bct2] [DE:Salmonella typhimurium LT-2 region between crr and cysM,phosphotransferase system transcriptional regulator (ptsJ) gene andOrf287, Orf170, Orf120 and Orf179 genes, complete cds.] [NT:putative transcriptional regulator of the] [LE:1334] [RE:2626] [DI:direct]

| ORF Name | NT ID | AA ID | NT LN | AA LN | Score | P-value |
|---|---|---|---|---|---|---|
| 11901643_c1_471 | 1899 | 9070 | 702 | 233 | 876 | 1.2e-87 |

Description sp:[LN:H65018] [AC:H65018] [PN:ethanolamine ammonia-lyase, heavy chain] [GN:eutB] [OR:Escherichia coli] [EC:4.3.1.7] [DB:pir2] >gp:[GI:g1788782] [LN:AE000331] [AC:AE000331:U00096] [PN:ethanolamine ammonia-lyase, heavy chain] [GN:eutB] [FN:enzyme; Degradation of small molecules: Amines] [OR:Escherichia coli] [DB:genpept-bct2] [EC:4.3.1.7] [DE:Escherichia coli K-12 MG1655 section 221 of 400 of the completegenome.] [NT:f467; 100 pct identical to fragment EUTB_ECOLI] [LE:5048] [RE:6451] [DI:complement]

| ORF_Name | NT ID | AA ID | NT/LN | AA/LN | Score | P-value |
|---|---|---|---|---|---|---|
| 12228406_f2_230 | 1900 | 9071 | 474 | 157 | 809 | 1.6e-80 |

Description sp:[LN:BCP_ECOLI] [AC:P23480] [GN:BCP] [OR:Escherichia coli] [DE:BACTERIOFERRITIN
COMIGRATORY PROTEIN] [SP:P23480] [DB:swissprot] >sp:[LN:B49749]
[AC:B49749:G65023] [PN:bacterioferritin comigratory protein] [GN:bcp]
[CL:bacterioferritin comigratory protein:alkyl hydroperoxidase c22 protein
homology] [OR:Escherichia coli] [DB:pir2] >gp:[GI:d1017087:g1799908] [LN:D90876]
[AC:D90876:AB001340] [PN:bacterioferritin comigratory protein] [OR:Escherichia
coli] [SR:Escherichia coli (strain:K12) DNA, clone_lib:Kohara lambda minise]
[DB:genpept-bct1] [DE:E.coli genomic DNA, Kohara clone #423(55.7-56.1 min.).]
[NT:similar to [PIR Accession Number B49749]] [LE:11428] [RE:11898] [DI:direct]
>gp:[GI:d1017097:g1805539] [LN:D90877] [AC:D90877:AB001340] [PN:bacterioferritin
comigratory protein] [OR:Escherichia coli] [SR:Escherichia coli (strain:K12) DNA,
clone_lib:Kohara lambda minise] [DB:genpept-bct1] [DE:E.coli genomic DNA, Kohara
clone #424(55.9-56.3 min.).] [NT:similar to [PIR Accession Number B49749]]
[LE:4168] [RE:4638] [DI:direct] >gp:[GI:g1788825] [LN:AE000335]
[AC:AE000335:U00096] [PN:bacterioferritin comigratory protein] [GN:bcp]
[FN:phenotype; Not classified] [OR:Escherichia coli] [DB:genpept-bct2]
[DE:Escherichia coli K-12 MG1655 section 225 of 400 of the completegenome.]
[NT:o156; 100 pct identical to BCP_ECOLI SW: P23480] [LE:2784] [RE:3254]
[DI:direct] >gp:[GI:g2668495] [LN:ECOORF123] [AC:M63654:M37689]
[PN:bacterioferritin comigratory protein] [GN:bcp] [OR:Escherichia coli]
[DB:genpept-bct2] [DE:Escherichia coli P177 (o177), bacterioferritin comigratory
protein(bcp), putative hydrogenase-4 complex (hyfABCDEFGHIJR), andputative
formate transporter (focB) gene, complete cds and putativepermease P75 (perM)
gene partial cds.] [NT:similar to alkyl hydroperoxide reductase component]
[LE:545] [RE:1015] [DI:direct]

| ORF Name | NT ID | AA ID | NT/LN | AA/LN | Score | P-value |
|---|---|---|---|---|---|---|
| 12382931_f1_35 | 1901 | 9072 | 927 | 308 | 1498 | 1.5e-153 |

Description sp:[LN:HEM6_ECOLI] [AC:P36553] [GN:HEMF] [OR:Escherichia coli] [EC:1.3.3.3]
[DE:(COPROPORPHYRINOGENASE) (COPROGEN OXIDASE)] [SP:P36553] [DB:swissprot]
>sp:[LN:B36964] [AC:B36964:C65018] [PN:coproporphyrinogen oxidase, III, aerobic]
[GN:hemF] [CL:coproporphyrinogen oxidase] [OR:Escherichia coli] [EC:1.3.3.3]
[DB:pir1] >gp:[GI:d1017048:g1799866] [LN:D90873] [AC:D90873:AB001340]
[PN:COPROPORPHYRINOGEN III OXIDASE, AEROBIC (EC) [GN:hemF] [OR:Escherichia coli]
[SR:Escherichia coli (strain:K12) DNA, clone_lib:Kohara lambda minise]
[DB:genpept-bct1] [DE:E.coli genomic DNA, Kohara clone #420(54.9-55.2 min.).]
[NT:similar to [SwissProt Accession Number P36553]] [LE:7163] [RE:8062]
[DI:direct] >gp:[GI:d1017054:g1799873] [LN:D90874] [AC:D90874:AB001340]
[PN:COPROPORPHYRINOGEN III OXIDASE, AEROBIC (EC) [GN:hemF] [OR:Escherichia coli]
[SR:Escherichia coli (strain:K12) DNA, clone_lib:Kohara lambda minise]
[DB:genpept-bct1] [DE:E.coli genomic DNA, Kohara clone #421(55.1-55.5 min.).]
[NT:similar to [SwissProt Accession Number P36553]] [LE:59] [RE:958] [DI:direct]
>gp:[GI:g453969] [LN:ECHEMF] [AC:X75413] [PN:coproporphyrinogen oxidase]
[GN:hemF] [OR:Escherichia coli] [DB:genpept-bct1] [EC:1.3.3.3] [DE:E.coli orf1,
orf3 and hemF gene for coproporphyrinogen III oxidase.] [SP:P36553] [LE:1312]
[RE:2211] [DI:direct] >gp:[GI:g1788777] [LN:AE000331] [AC:AE000331:U00096]
[PN:coproporphyrinogen III oxidase] [GN:hemF] [FN:enzyme; Biosynthesis of
cofactors, carriers:] [OR:Escherichia coli] [DB:genpept-bct2] [EC:1.3.3.3]
[DE:Escherichia coli K-12 MG1655 section 221 of 400 of the completegenome.]
[NT:o299; 100 pct identical to HEM6_ECOLI SW: P36553] [LE:955] [RE:1854]
[DI:direct]

| ORF Name | NT ID | AA ID | NT/LN | AA/LN | Score | P-value |
|---|---|---|---|---|---|---|
| 12385200_c2_564 | 1902 | 9073 | 576 | 191 | 697 | 1.2e-68 |

Description sp:[LN:URAA_ECOLI] [AC:P33780] [GN:URAA] [OR:Escherichia coli] [DE:URACIL
PERMEASE (URACIL TRANSPORTER)] [SP:P33780] [DB:swissprot] >sp:[LN:A56265]
[AC:A56265:H65025:S34223] [PN:uracil transport protein uraA:uracil permease]
[GN:uraA] [CL:uracil transport protein uraA] [OR:Escherichia coli] [DB:pir2]
>gp:[GI:d1017114:g1805557] [LN:D90878] [AC:D90878:AB001340] [PN:uracil transport
protein uraA] [GN:uraA] [OR:Escherichia coli] [SR:Escherichia coli (strain:K12)
DNA, clone_lib:Kohara lambda minise] [DB:genpept-bct1] [DE:E.coli genomic DNA,
Kohara clone #425(56.2-56.5 min.).] [NT:similar to [PIR Accession Number A56265]]
[LE:6792] [RE:8081] [DI:complement] >gp:[GI:g313777] [LN:ECURAA] [AC:X73586]
[PN:uracil permease] [GN:uraA] [OR:Escherichia coli] [DB:genpept-bct1] [DE:E.coli
uraA gene for uracil permease.] [SP:P33780] [LE:49] [RE:1338] [DI:direct]
>gp:[GI:g1788843] [LN:AE000336] [AC:AE000336:U00096] [PN:uracil transport]
[GN:uraA] [FN:transport; Transport of small molecules:] [OR:Escherichia coli]
[DB:genpept-bct2] [DE:Escherichia coli K-12 MG1655 section 226 of 400 of the
completegenome.] [NT:f429; 100 pct identical to URAA_ECOLI SW: P33780] [LE:2914]
[RE:4203] [DI:complement]

| ORF Name | NT ID | AA ID | NT LN | AA LN | Score | P-value |
|---|---|---|---|---|---|---|
| 13085930_c2_607 | 1903 | 9074 | 933 | 310 | 1402 | 2.3e-143 |

Description gp:[GI:g3885923] [LN:AF093749] [AC:AF093749] [PN:ethanolamine ammonia lyase large subunit] [GN:eutB] [OR:Salmonella typhimurium] [DB:genpept-bct2] [DE:Salmonella typhimurium strain LT2 NADP+-linked malic enzyme (maeB),partial cds; insertion element IS200 transposase, complete cds; eutoperon, complete sequence; and unknown genes.] [LE:11827] [RE:13188] [DI:direct]

| ORF Name | NT ID | AA ID | NT LN | AA LN | Score | P-value |
|---|---|---|---|---|---|---|
| 1344026_c1_434 | 1904 | 9075 | 768 | 255 | 984 | 4.4e-99 |

Description sp:[LN:YPFH_ECOLI] [AC:P76561] [GN:YPFH] [OR:Escherichia coli] [DE:HYPOTHETICAL 25.7 KD PROTEIN IN DAPE-PURC INTERGENIC REGION] [SP:P76561] [DB:swissprot] >sp:[LN:H65022] [AC:H65022] [PN:hypothetical protein b2473] [OR:Escherichia coli] [DB:pir2] >gp:[GI:g1788817] [LN:AE000334] [AC:AE000334:U00096] [PN:orf, hypothetical protein] [GN:ypfH] [FN:orf; Unknown] [OR:Escherichia coli] [DB:genpept-bct2] [DE:Escherichia coli K-12 MG1655 section 224 of 400 of the completegenome.] [NT:f240] [LE:5589] [RE:6311] [DI:complement]

| ORF Name | NT ID | AA ID | NT LN | AA LN | Score | P-value |
|---|---|---|---|---|---|---|
| 13878136_c2_571 | 1905 | 9076 | 1116 | 371 | 1669 | 1.1e-171 |

Description sp:[LN:PERM_ECOLI] [AC:P77406:P71230] [GN:PERM] [OR:Escherichia coli] [DE:PUTATIVE PERMEASE PERM] [SP:P77406:P71230] [DB:swissprot] >sp:[LN:D65025] [AC:D65025] [PN:hypothetical protein b2493] [CL:Bacillus subtilis conserved hypothetical protein yueF] [OR:Escherichia coli] [DB:pir1] >gp:[GI:d1017111:g1805554] [LN:D90878] [AC:D90878:AB001340] [OR:Escherichia coli] [SR:Escherichia coli (strain:K12) DNA, clone_lib:Kohara lambda minise] [DB:genpept-bct1] [DE:E.coli genomic DNA, Kohara clone #425(56.2-56.5 min.).] [NT:similar to [SwissProt Accession Number P43970]] [LE:2731] [RE:3792] [DI:complement] >gp:[GI:g1788838] [LN:AE000335] [AC:AE000335:U00096] [PN:putative permease] [GN:perM] [FN:putative transport; Not classified] [OR:Escherichia coli] [DB:genpept-bct2] [DE:Escherichia coli K-12 MG1655 section 225 of 400 of the completegenome.] [NT:f353; This 353 aa ORF is 69 pct identical (0 gaps)] [LE:17126] [RE:18187] [DI:complement]

| ORF Name | NT ID | AA ID | NT/LN | AA/LN | Score | P-value |
|---|---|---|---|---|---|---|
| 14062552_c1_509 | 1906 | 9077 | 312 | 103 | 443 | 9.5e-42 |

Description sp:[LN:ZIPA_ECOLI] [AC:P77173] [GN:ZIPA] [OR:Escherichia coli] [DE:CELL DIVISION
PROTEIN ZIPA] [SP:P77173] [DB:swissprot] >gp:[GI:g1816523] [LN:ECU74650]
[AC:U74650] [PN:ZipA] [GN:zipA] [FN:ZipA is an integral inner-membrane protein]
[OR:Escherichia coli] [DB:genpept-bct1] [DE:Escherichia coli CysZ (cysZ) gene,
partial cds, ZipA (zipA) gene, complete cds and DNA ligase gene, partial cds.]
[LE:405] [RE:1391] [DI:direct]

| ORF Name | NT ID | AA ID | NT/LN | AA/LN | Score | P-value |
|---|---|---|---|---|---|---|
| 14112887_c2_594 | 1907 | 9078 | 378 | 125 | 530 | 5.7e-51 |

Description sp:[LN:E65021] [AC:E65021] [PN:hypothetical protein b2462] [OR:Escherichia coli]
[DB:pir2] >gp:[GI:g1788804] [LN:AE000332] [AC:AE000332:U00096] [PN:orf,
hypothetical protein] [GN:b2462] [FN:orf; Unknown] [OR:Escherichia coli]
[DB:genpept-bct2] [DE:Escherichia coli K-12 MG1655 section 222 of 400 of the
completegenome.] [NT:f135] [LE:12153] [RE:12560] [DI:complement]

| ORF Name | NT ID | AA ID | NT/LN | AA/LN | Score | P-value |
|---|---|---|---|---|---|---|
| 14254528_f3_270 | 1908 | 9079 | 294 | 97 | 415 | 8.8e-39 |

Description sp:[LN:PTHP_KLEPN] [AC:P16481] [GN:PTSH] [OR:Klebsiella pneumoniae]
[DE:PHOSPHOCARRIER PROTEIN HPR (HISTIDINE-CONTAINING PROTEIN)] [SP:P16481]
[DB:swissprot] >sp:[LN:S12749] [AC:S12749] [PN:phosphotransferase system
phosphohistidine-containing protein] [GN:ptsH] [CL:phosphotransferase system
phosphohistidine-containing protein:phosphotransferase system
phosphohistidine-containing protein homology] [OR:Klebsiella pneumoniae]
[DB:pir1] >gp:[GI:g43911] [LN:KPPTSH] [AC:X51452] [OR:Klebsiella pneumoniae]
[DB:genpept-bct1] [DE:Klebsiella pneumoniae ptsH gene for the protein kinase
(HPr) of thePEP:dependent carbohydrate phosphotransferase system (PTS).] [NT:ptsH
protein kinase (AA 1-85)] [SP:P16481] [LE:15] [RE:272] [DI:direct]

| ORF_Name | NT_ID | AA_ID | NT/LN | AA/LN | Score | P-value |
|---|---|---|---|---|---|---|
| 14257963_c3_711 | 1909 | 9080 | 303 | 100 | 464 | 5.6e-44 |

Description sp:[LN:CCHA_SALTY] [AC:P41791] [GN:CCHA] [OR:Salmonella typhimurium] [DE:CCHA
PROTEIN PRECURSOR] [SP:P41791] [DB:swissprot] >gp:[GI:g687643] [LN:STU18560]
[AC:U18560] [GN:cchA] [OR:Salmonella typhimurium] [DB:genpept-bct1]
[DE:Salmonella typhimurium ethanolamine utilization gene cluster,eutI', partial
cds, and cchA, cchB, eutE, eutJ, eutG and eutHgenes, complete cds.] [LE:774]
[RE:1064] [DI:direct] >gp:[GI:g3885916] [LN:AF093749] [AC:AF093749] [PN:putative
carboxysome structural protein] [GN:eutM] [OR:Salmonella typhimurium]
[DB:genpept-bct2] [DE:Salmonella typhimurium strain LT2 NADP+-linked malic enzyme
(maeB),partial cds; insertion element IS200 transposase, complete cds; eutoperon,
complete sequence; and unknown genes.] [NT:similar to Synechocystis PCC6803
carboxysome] [LE:4929] [RE:5219] [DI:direct]

| ORF_Name | NT_ID | AA_ID | NT/LN | AA/LN | Score | P-value |
|---|---|---|---|---|---|---|
| 14572133_f3_375 | 1910 | 9081 | 858 | 285 | | |

Description

NO-HIT

| ORF_Name | NT_ID | AA_ID | NT/LN | AA/LN | Score | P-value |
|---|---|---|---|---|---|---|
| 14585200_c1_415 | 1911 | 9082 | 873 | 290 | 1039 | 6.6e-105 |

Description sp:[LN:A65026] [AC:A65026:S23412] [PN:uracil phosphoribosyltransferase, upp]
[GN:upp] [CL:uracil phosphoribosyltransferase upp] [OR:Escherichia coli]
[EC:2.4.2.9] [DB:pir1] >gp:[GI:g1788844] [LN:AE000336] [AC:AE000336:U00096]
[PN:uracil phosphoribosyltransferase] [GN:upp] [FN:enzyme; Salvage of nucleosides
and nucleotides] [OR:Escherichia coli] [DB:genpept-bct2] [EC:2.4.2.9]
[DE:Escherichia coli K-12 MG1655 section 226 of 400 of the completegenome.]
[NT:f208; 100 pct identical to UPP_ECOLI SW: P25532] [LE:4289] [RE:4942]
[DI:complement]

| ORF_Name | NT_ID | AA_ID | NT/LN | AA/LN | Score | P-value |
|---|---|---|---|---|---|---|
| 14859843_f3_379 | 1912 | 9083 | 1656 | 551 | 536 | 1.3e-51 |

Description sp:[LN:D46449] [AC:D46449] [PN:TrbL] [OR:plasmid RK2] [DB:pir2] >gp:[GI:g152566]
[LN:RP4TRBAO] [AC:M93696] [GN:trbL] [OR:Plasmid RP4] [SR:Plasmid RP4 DNA]
[DB:genpept-bct1] [DE:Plasmid RP4 (trbA-trbO) genes, complete cds.] [LE:9709]
[RE:11295] [DI:direct]

| ORF_Name | NT_ID | AA_ID | NT/LN | AA/LN | Score | P-value |
|---|---|---|---|---|---|---|
| 14957942_c1_484 | 1913 | 9084 | 984 | 327 | 1409 | 4.1e-144 |

Description sp:[LN:F65017] [AC:F65017] [PN:hypothetical protein b2431] [OR:Escherichia coli]
[DB:pir2] >gp:[GI:g1788771] [LN:AE000330] [AC:AE000330:U00096] [PN:orf,
hypothetical protein] [GN:b2431] [FN:orf; Unknown] [OR:Escherichia coli]
[DB:genpept-bct2] [DE:Escherichia coli K-12 MG1655 section 220 of 400 of the
completegenome.] [NT:f308; This 308 aa ORF is 25 pct identical (21 gaps)]
[LE:8210] [RE:9136] [DI:complement]

| ORF_Name | NT_ID | AA_ID | NT/LN | AA/LN | Score | P-value |
|---|---|---|---|---|---|---|
| 14977200_c2_595 | 1914 | 9085 | 492 | 163 | 634 | 5.5e-62 |

Description gp:[GI:g3885912] [LN:AF093749] [AC:AF093749] [PN:unknown] [GN:eutP]
[OR:Salmonella typhimurium] [DB:genpept-bct2] [DE:Salmonella typhimurium strain
LT2 NADP+-linked malic enzyme (maeB),partial cds; insertion element IS200
transposase, complete cds; eutoperon, complete sequence; and unknown genes.]
[NT:contains ATP/GTP binding P-loop motif] [LE:1929] [RE:2408] [DI:direct]

| ORF_Name | NT_ID | AA_ID | NT/LN | AA/LN | Score | P-value |
|---|---|---|---|---|---|---|
| 15634678_c3_734 | 1915 | 9086 | 837 | 278 | 1352 | 4.5e-138 |

Description sp:[LN:CYST_ECOLI] [AC:P16701] [GN:CYSU:CYST] [OR:Escherichia coli] [DE:SULFATE
TRANSPORT SYSTEM PERMEASE PROTEIN CYST] [SP:P16701] [DB:swissprot]
>sp:[LN:QRECST] [AC:A35402:G65016:B35403] [PN:sulfate/thiosulfate transport
protein cysT:sulfate transport system permease protein cysT] [GN:cysU:cysT]
[CL:maltose transport protein malG] [OR:Escherichia coli] [DB:pir1] [MP:52 min]
>gp:[GI:d1017027:g1799843] [LN:D90871] [AC:D90871:AB001340] [PN:SULFATE TRANSPORT
SYSTEM PERMEASE PROTEIN CYST.] [GN:cysT] [OR:Escherichia coli] [SR:Escherichia
coli (strain:K12) DNA, clone_lib:Kohara lambda minise] [DB:genpept-bct1]
[DE:E.coli genomic DNA, Kohara clone #418(54.6-54.9 min.).] [NT:similar to
[SwissProt Accession Number P16701]] [LE:10047] [RE:10880] [DI:complement]
>gp:[GI:d1017036:g1799853] [LN:D90872] [AC:D90872:AB001340] [PN:SULFATE TRANSPORT
SYSTEM PERMEASE PROTEIN CYST.] [GN:cysT] [OR:Escherichia coli] [SR:Escherichia
coli (strain:K12) DNA, clone_lib:Kohara lambda minise] [DB:genpept-bct1]
[DE:E.coli genomic DNA, Kohara clone #419(54.7-55.1 min.).] [NT:similar to
[SwissProt Accession Number P16701]] [LE:4808] [RE:5641] [DI:complement]
>gp:[GI:g145659] [LN:ECOCYS] [AC:M32101:M38050] [GN:cysT] [OR:Escherichia coli]
[SR:E.coli K12 DNA] [DB:genpept-bct1] [DE:E.coli thiosulfate binding protein
(cysP), sulfate permease (cysT,cysW, cysA) and o-acetylserine (thiol)-lyase-B
(cysM) genes,complete cds.] [LE:1575] [RE:2408] [DI:direct] >gp:[GI:g1788764]
[LN:AE000330] [AC:AE000330:U00096] [PN:sulfate, thiosulfate transport system
permease T] [GN:cysU] [FN:transport; Transport of small molecules:]
[OR:Escherichia coli] [DB:genpept-bct2] [DE:Escherichia coli K-12 MG1655 section
220 of 400 of the completegenome.] [NT:f277; 93 pct identical to CYST_ECOLI SW:
P16701;] [LE:243] [RE:1076] [DI:complement]

| ORF Name | NT ID | AA ID | NT/LN | AA/LN | Score | P-value |
|---|---|---|---|---|---|---|
| 15667202_c3_678 | 1916 | 9087 | 894 | 297 | 414 | 1.1e-38 |

Description sp:[LN:F70203] [AC:F70203] [PN:xylose operon regulatory protein (xylR-2) homolog] [CL:glucose kinase:glucose kinase homology] [OR:Borrelia burgdorferi] [SR:, Lyme disease spirochete] [DB:pir2] >gp:[GI:g2688776] [LN:AE001181] [AC:AE001181:AE000783] [PN:xylose operon regulatory protein (xylR-2)] [GN:BB0831] [OR:Borrelia burgdorferi] [SR:Lyme disease spirochete] [DB:genpept-bct2] [DE:Borrelia burgdorferi (section 67 of 70) of the complete genome.] [NT:similar to PID:1001414 PID:1001409 percent] [LE:4164] [RE:5111] [DI:direct]

| ORF Name | NT ID | AA ID | NT/LN | AA/LN | Score | P-value |
|---|---|---|---|---|---|---|
| 15906527_c3_746 | 1917 | 9088 | 1350 | 449 | | |

Description

NO-HIT

| ORF Name | NT ID | AA ID | NT/LN | AA/LN | Score | P-value |
|---|---|---|---|---|---|---|
| 16036302_c3_670 | 1918 | 9089 | 2268 | 755 | 2379 | 6.6e-247 |

Description sp:[LN:F65026] [AC:F65026] [PN:hypothetical protein b2503] [OR:Escherichia coli] [DB:pir2] >gp:[GI:d1017122:g1805566] [LN:D90880] [AC:D90880:AB001340] [OR:Escherichia coli] [SR:Escherichia coli (strain:K12) DNA, clone_lib:Kohara lambda minise] [DB:genpept-bct1] [DE:E.coli genomic DNA, Kohara clone #427(56.5-56.9 min.).] [NT:similar to [SwissProt Accession Number Q04855]] [LE:1533] [RE:3776] [DI:complement] >gp:[GI:g1788849] [LN:AE000336] [AC:AE000336:U00096] [PN:putative cytochrome C-type biogenesis protein] [GN:b2503] [FN:putative enzyme; Not classified] [OR:Escherichia coli] [DB:genpept-bct2] [DE:Escherichia coli K-12 MG1655 section 226 of 400 of the completegenome.] [NT:f747; This 747 aa ORF is 31 pct identical (7 gaps)] [LE:10738] [RE:12981] [DI:complement]

| ORF Name | NT ID | AA ID | NT/LN | AA/LN | Score | P-value |
|---|---|---|---|---|---|---|
| 16489703_c3_709 | 1919 | 9090 | 720 | 239 | 1043 | 2.5e-105 |

Description gp:[GI:g3885913] [LN:AF093749] [AC:AF093749] [PN:unknown] [GN:eutQ] [OR:Salmonella typhimurium] [DB:genpept-bct2] [DE:Salmonella typhimurium strain LT2 NADP+-linked malic enzyme (maeB),partial cds; insertion element IS200 transposase, complete cds; eutoperon, complete sequence; and unknown genes.] [LE:2386] [RE:3075] [DI:direct]

| ORF Name | NT ID | AA ID | NT/LN | AA/LN | Score | P-value |
|---|---|---|---|---|---|---|
| 16620790_f1_51 | 1920 | 9091 | 1410 | 469 | | |

Description

NO-HIT

| ORF Name | NT ID | AA ID | NT/LN | AA/LN | Score | P-value |
|---|---|---|---|---|---|---|
| 16838215_c1_460 | 1921 | 9092 | 321 | 106 | 239 | 3.9e-20 |

Description sp:[LN:EUTI_SALTY] [AC:P41790] [GN:EUTI] [OR:Salmonella typhimurium]
[DE:ETHANOLAMINE UTILIZATION PROTEIN EUTI (FRAGMENT)] [SP:P41790] [DB:swissprot]
>gp:[GI:g687642] [LN:STU18560] [AC:U18560] [GN:eutI'] [OR:Salmonella typhimurium]
[DB:genpept-bct1] [DE:Salmonella typhimurium ethanolamine utilization gene
cluster,eutI', partial cds, and cchA, cchB, eutE, eutJ, eutG and eutHgenes,
complete cds.] [LE:<1] [RE:733] [DI:direct]

| ORF Name | NT ID | AA ID | NT/LN | AA/LN | Score | P-value |
|---|---|---|---|---|---|---|
| 19767500_f2_203 | 1922 | 9093 | 1110 | 369 | 1397 | 7.6e-143 |

Description sp:[LN:TALA_ECOLI] [AC:P78258:P80218] [GN:TALA] [OR:Escherichia coli]
[EC:2.2.1.2] [DE:TRANSALDOLASE A,] [SP:P78258:P80218] [DB:swissprot]
>sp:[LN:G65021] [AC:G65021] [PN:transaldolase, b2464] [OR:Escherichia coli]
[EC:2.2.1.2] [DB:pir2] >gp:[GI:d1022678:g2337774] [LN:D13159] [AC:D13159]
[PN:transaldolase] [GN:talA] [OR:Escherichia coli] [SR:Escherichia coli
(strain:K-12, sub_strain:W3110) DNA, clone:pAI235] [DB:genpept-bct1] [EC:2.2.1.2]
[DE:Escherichia coli talA gene for transaldolase, complete cds.] [LE:150]
[RE:1100] [DI:direct] >gp:[GI:d1017068:g1799888] [LN:D90875] [AC:D90875:AB001340]
[OR:Escherichia coli] [SR:Escherichia coli (strain:K12) DNA, clone_lib:Kohara
lambda minise] [DB:genpept-bct1] [DE:E.coli genomic DNA, Kohara clone
422(55.5-55.8 min.).] [NT:similar to [PIR Accession Number S40535]] [LE:1759]
[RE:2709] [DI:direct] >gp:[GI:g1788807] [LN:AE000333] [AC:AE000333:U00096]
[PN:transaldolase A] [GN:talA] [FN:enzyme; Central intermediary metabolism;]
[OR:Escherichia coli] [DB:genpept-bct2] [DE:Escherichia coli K-12 MG1655 section
223 of 400 of the completegenome.] [NT:o316; residues 11-309 are 66 pct identical
to] [LE:2709] [RE:3659] [DI:direct]

| ORF Name | NT ID | AA ID | NT/LN | AA/LN | Score | P-value |
|---|---|---|---|---|---|---|
| 2085002_f1_22 | 1923 | 9094 | 225 | 74 | 114 | 9.0e-06 |

Description gp:[GI:e1518506:g5578863] [LN:SC5F7] [AC:AL096872] [PN:putative dihydrolipoamide
succinyltransferase] [GN:SC5F7.20] [OR:Streptomyces coelicolor A3(2)]
[DB:genpept-bct1] [DE:Streptomyces coelicolor cosmid 5F7.] [NT:SC5F7.20, sucB,
possible dihydrolipoamide] [LE:18813] [RE:20585] [DI:direct]

| ORF_Name | NT ID | AA ID | NT/LN | AA/LN | Score | P-value |
|---|---|---|---|---|---|---|
| 22160881_f3_278 | 1924 | 9095 | 246 | 81 | 112 | 1.1e-06 |

Description sp:[LN:A72556] [AC:A72556] [PN:hypothetical protein APE1733] [GN:APE1733] [OR:Aeropyrum pernix] [DB:pir2] >gp:[GI:d1044520:g5105421] [LN:AP000062] [AC:AP000062] [PN:145aa long hypothetical protein] [GN:APE1733] [OR:Aeropyrum pernix] [SR:Aeropyrum pernix (strain:K1) DNA] [DB:genpept-bct1] [DE:Aeropyrum pernix genomic DNA, section 5/7.] [NT:motif=prokaryotic membrane lipoprotein lipid] [LE:112066] [RE:112503] [DI:complement]

| ORF_Name | NT ID | AA ID | NT/LN | AA/LN | Score | P-value |
|---|---|---|---|---|---|---|
| 22300962_f3_374 | 1925 | 9096 | 675 | 224 | | |

Description

NO-HIT

| ORF_Name | NT ID | AA ID | NT/LN | AA/LN | Score | P-value |
|---|---|---|---|---|---|---|
| 22317637_f2_254 | 1926 | 9097 | 204 | 67 | | |

Description

NO-HIT

| ORF_Name | NT ID | AA ID | NT/LN | AA/LN | Score | P-value |
|---|---|---|---|---|---|---|
| 22677042_c3_725 | 1927 | 9098 | 564 | 187 | 633 | 7.0e-62 |

Description gp:[GI:g3885926] [LN:AF093749] [AC:AF093749] [PN:putative carboxysome structural protein] [GN:eutK] [OR:Salmonella typhimurium] [DB:genpept-bct2] [DE:Salmonella typhimurium strain LT2 NADP+-linked malic enzyme (maeB),partial cds; insertion element IS200 transposase, complete cds; eutoperon, complete sequence; and unknown genes.] [NT:similar to Synechocystis PCC6803 carboxysome] [LE:14785] [RE:15279] [DI:direct]

| ORF_Name | NT ID | AA ID | NT/LN | AA/LN | Score | P-value |
|---|---|---|---|---|---|---|
| 22895781_c2_603 | 1928 | 9099 | 1236 | 411 | 1702 | 3.7e-175 |

Description sp:[LN:D65020] [AC:D65020] [PN:ethanolamine utilization protein EutG] [GN:eutG] [CL:lactaldehyde reductase:lactaldehyde reductase homology] [OR:Escherichia coli] [DB:pir2] >gp:[GI:g1788795] [LN:AE000332] [AC:AE000332:U00096] [PN:ethanolamine utilization; homolog of Salmonella] [GN:eutG] [FN:putative enzyme; Degradation of small] [OR:Escherichia coli] [DB:genpept-bct2] [DE:Escherichia coli K-12 MG1655 section 222 of 400 of the completegenome.] [NT:f404; 80 pct identical (4 gaps) to 394 residues] [LE:5007] [RE:6221] [DI:complement]

| ORF Name | NT ID | AA ID | NT LN | AA LN | Score | P-value |
|---|---|---|---|---|---|---|
| 22899181_c2_597 | 1929 | 9100 | 1053 | 350 | 1094 | 9.8e-111 |

Description gp:[GI:g3885914] [LN:AF093749] [AC:AF093749] [PN:cobalamin adenosyl transferase] [GN:eutT] [OR:Salmonella typhimurium] [DB:genpept-bct2] [DE:Salmonella typhimurium strain LT2 NADP+-linked malic enzyme (maeB),partial cds; insertion element IS200 transposase, complete cds; eutoperon, complete sequence; and unknown genes.] [LE:3072] [RE:3875] [DI:direct]

| ORF Name | NT ID | AA ID | NT LN | AA LN | Score | P-value |
|---|---|---|---|---|---|---|
| 22907768_c2_635 | 1930 | 9101 | 768 | 255 | 544 | 1.9e-52 |

Description sp:[LN:ZIPA_ECOLI] [AC:P77173] [GN:ZIPA] [OR:Escherichia coli] [DE:CELL DIVISION PROTEIN ZIPA] [SP:P77173] [DB:swissprot] >gp:[GI:g1816523] [LN:ECU74650] [AC:U74650] [PN:ZipA] [GN:zipA] [FN:ZipA is an integral inner-membrane protein] [OR:Escherichia coli] [DB:genpept-bct1] [DE:Escherichia coli CysZ (cysZ) gene, partial cds, ZipA (zipA) gene,complete cds and DNA ligase gene, partial cds.] [LE:405] [RE:1391] [DI:direct]

| ORF Name | NT ID | AA ID | NT LN | AA LN | Score | P-value |
|---|---|---|---|---|---|---|
| 23644566_f2_153 | 1931 | 9102 | 822 | 273 | 1231 | 3.0e-125 |

Description sp:[LN:BVEBCZ] [AC:A28181] [PN:cysZ protein] [GN:cysZ] [CL:cysZ protein] [OR:Salmonella typhimurium] [DB:pir1] [MP:49 min] >gp:[GI:g153934] [LN:STYCYSPTS] [AC:M21450] [OR:Salmonella typhimurium] [SR:S.typhimurium (strain LT2) DNA, clone pRSM28] [DB:genpept-bct1] [DE:S.typhimurium cysZ, cysK, ptsH, and ptsI genes, complete cds.] [NT:cysZ protein] [LE:219] [RE:1091] [DI:direct]

| ORF Name | NT ID | AA ID | NT LN | AA LN | Score | P-value |
|---|---|---|---|---|---|---|
| 24267200_f2_216 | 1932 | 9103 | 375 | 124 | 481 | 8.9e-46 |

Description sp:[LN:YFFB_ECOLI] [AC:P24178] [GN:YFFB] [OR:Escherichia coli] [DE:HYPOTHETICAL
13.6 KD PROTEIN IN ACRD-DAPE INTERGENIC REGION] [SP:P24178] [DB:swissprot]
>sp:[LN:B42959] [AC:B42959:F65022:S26998] [PN:14K hypothetical protein (5' of
dapE)] [GN:yffB] [CL:hypothetical protein yjbD] [OR:Escherichia coli] [DB:pir1]
[MP:53 min] >gp:[GI:d1017074:g1799894] [LN:D90875] [AC:D90875:AB001340]
[OR:Escherichia coli] [SR:Escherichia coli (strain:K12) DNA, clone_lib:Kohara
lambda minise] [DB:genpept-bct1] [DE:E.coli genomic DNA, Kohara clone
422(55.5-55.8 min.).] [NT:similar to [PIR Accession Number B42959]] [LE:14340]
[RE:14696] [DI:direct] >gp:[GI:d1017078:g1799899] [LN:D90876]
[AC:D90876:AB001340] [OR:Escherichia coli] [SR:Escherichia coli (strain:K12) DNA,
clone_lib:Kohara lambda minise] [DB:genpept-bct1] [DE:E.coli genomic DNA, Kohara
clone #423(55.7-56.1 min.).] [NT:similar to [PIR Accession Number B42959]]
[LE:2196] [RE:2552] [DI:direct] >gp:[GI:g41233] [LN:ECDAPE] [AC:X57403:S41761]
[OR:Escherichia coli] [DB:genpept-bct1] [DE:Escherichia coli dapE gene for
succinyldiaminopimelatedesuccinylase.] [NT:orf] [SP:P24178] [LE:663] [RE:1019]
[DI:direct] >gp:[GI:g1788815] [LN:AE000334] [AC:AE000334:U00096] [PN:orf,
hypothetical protein] [GN:yffB] [FN:orf; Unknown] [OR:Escherichia coli]
[DB:genpept-bct2] [DE:Escherichia coli K-12 MG1655 section 224 of 400 of the
completegenome.] [NT:o118; 100 pct identical to YFFB_ECOLI SW: P24178] [LE:3764]
[RE:4120] [DI:direct]

| ORF Name | NT ID | AA ID | NT LN | AA LN | Score | P-value |
|---|---|---|---|---|---|---|
| 24350905_c3_680 | 1933 | 9104 | 786 | 261 | 1069 | 4.4e-108 |

Description sp:[LN:URAA_ECOLI] [AC:P33780] [GN:URAA] [OR:Escherichia coli] [DE:URACIL
PERMEASE (URACIL TRANSPORTER)] [SP:P33780] [DB:swissprot] >sp:[LN:A56265]
[AC:A56265:H65025:S34223] [PN:uracil transport protein uraA:uracil permease]
[GN:uraA] [CL:uracil transport protein uraA] [OR:Escherichia coli] [DB:pir2]
>gp:[GI:d1017114:g1805557] [LN:D90878] [AC:D90878:AB001340] [PN:uracil transport
protein uraA] [GN:uraA] [OR:Escherichia coli] [SR:Escherichia coli (strain:K12)
DNA, clone_lib:Kohara lambda minise] [DB:genpept-bct1] [DE:E.coli genomic DNA,
Kohara clone #425(56.2-56.5 min.).] [NT:similar to [PIR Accession Number A56265]]
[LE:6792] [RE:8081] [DI:complement] >gp:[GI:g313777] [LN:ECURAA] [AC:X73586]
[PN:uracil permease] [GN:uraA] [OR:Escherichia coli] [DB:genpept-bct1] [DE:E.coli
uraA gene for uracil permease.] [SP:P33780] [LE:49] [RE:1338] [DI:direct]
>gp:[GI:g1788843] [LN:AE000336] [AC:AE000336:U00096] [PN:uracil transport]
[GN:uraA] [FN:transport; Transport of small molecules:] [OR:Escherichia coli]
[DB:genpept-bct2] [DE:Escherichia coli K-12 MG1655 section 226 of 400 of the
completegenome.] [NT:f429; 100 pct identical to URAA_ECOLI SW: P33780] [LE:2914]
[RE:4203] [DI:complement]

| ORF Name | NT ID | AA ID | NT/LN | AA/LN | Score | P-value |
|---|---|---|---|---|---|---|
| 24415962_c1_428 | 1934 | 9105 | 717 | 238 | 1170 | 8.7e-119 |

Description sp:[LN:PUR7_ECOLI] [AC:P21155] [GN:PURC] [OR:Escherichia coli] [EC:6.3.2.6]
[DE:(SAICAR SYNTHETASE)] [SP:P21155] [DB:swissprot] >sp:[LN:C36146]
[AC:C36146:S25427:C65023] [PN:phosphoribosylaminoimidazolesuccinocarboxamide
synthase,:SAICAR synthetase] [GN:purC]
[CL:phosphoribosylaminoimidazolesuccinocarboxamide synthase] [OR:Escherichia
coli] [EC:6.3.2.6] [DB:pir1] >gp:[GI:d1017082:g1799903] [LN:D90876]
[AC:D90876:AB001340] [PN:phosphoribosylaminoimidazolesuccinocarboxamide]
[OR:Escherichia coli] [SR:Escherichia coli (strain:K12) DNA, clone_lib:Kohara
lambda minise] [DB:genpept-bct1] [DE:E.coli genomic DNA, Kohara clone
423(55.7-56.1 min.).] [NT:similar to [PIR Accession Number C36146]] [LE:7855]
[RE:8568] [DI:complement] >gp:[GI:d1017092:g1805534] [LN:D90877]
[AC:D90877:AB001340] [PN:phosphoribosylaminoimidazolesuccinocarboxamide]
[OR:Escherichia coli] [SR:Escherichia coli (strain:K12) DNA, clone_lib:Kohara
lambda minise] [DB:genpept-bct1] [DE:E.coli genomic DNA, Kohara clone
424(55.9-56.3 min.).] [NT:similar to [PIR Accession Number C36146]] [LE:595]
[RE:1308] [DI:complement] >gp:[GI:g147410] [LN:ECOPURCA] [AC:M33928] [GN:purC]
[OR:Escherichia coli] [SR:E.coli (strain K12) DNA] [DB:genpept-bct1] [DE:E.coli
5-phosphoribosyl 5-aminoimidazole 4-N-succinocarboxamidesynthetase (SAICAR) and
dapX gene, complete cds.] [NT:5'-phosphoribosyl-5-aminoimidazole-4-] [LE:1281]
[RE:1994] [DI:direct] >gp:[GI:g1788820] [LN:AE000334] [AC:AE000334:U00096]
[PN:phosphoribosylaminoimidazole-succinocarboxamide] [GN:purC] [FN:enzyme; Purine
ribonucleotide biosynthesis] [OR:Escherichia coli] [DB:genpept-bct2] [EC:6.3.2.6]
[DE:Escherichia coli K-12 MG1655 section 224 of 400 of the completegenome.]
[NT:f237; 100 pct identical to PUR7_ECOLI SW: P21155] [LE:9422] [RE:10135]
[DI:complement]

| ORF Name | NT ID | AA ID | NT/LN | AA/LN | Score | P-value |
|---|---|---|---|---|---|---|
| 24627216_f1_119 | 1935 | 9106 | 1881 | 626 | 273 | 3.1e-21 |

Description sp:[LN:F70651] [AC:F70651] [PN:probable atsF protein] [GN:atsF] [OR:Mycobacterium
tuberculosis] [DB:pir2] >gp:[GI:e1299857:g3261693] [LN:MTCY22D7]
[AC:Z83866:AL123456] [PN:atsF] [GN:atsF] [OR:Mycobacterium tuberculosis]
[DB:genpept-bct1] [DE:Mycobacterium tuberculosis H37Rv complete genome; segment
133/162.] [NT:Rv3077, (MTCY22D7.04c), len: 603. atsF, some] [LE:25361] [RE:27172]
[DI:direct]

| ORF_Name | NT_ID | AA_ID | NT/LN | AA/LN | Score | P-value |
|---|---|---|---|---|---|---|
| 24644062_c1_463 | 1936 | 9107 | 1410 | 469 | 2224 | 1.8e-230 |

Description sp:[LN:EUTE_SALTY] [AC:P41793] [GN:EUTE] [OR:Salmonella typhimurium]
[DE:ETHANOLAMINE UTILIZATION PROTEIN EUTE] [SP:P41793] [DB:swissprot]
>gp:[GI:g687645] [LN:STU18560] [AC:U18560] [GN:eutE] [OR:Salmonella typhimurium]
[DB:genpept-bct1] [DE:Salmonella typhimurium ethanolamine utilization gene
cluster,eutI', partial cds, and cchA, cchB, eutE, eutJ, eutG and eutHgenes,
complete cds.] [LE:1475] [RE:2878] [DI:direct] >gp:[GI:g3885918] [LN:AF093749]
[AC:AF093749] [PN:aldehyde oxidoreductase] [GN:eutE] [OR:Salmonella typhimurium]
[DB:genpept-bct2] [DE:Salmonella typhimurium strain LT2 NADP+-linked malic enzyme
(maeB),partial cds; insertion element IS200 transposase, complete cds; eutoperon,
complete sequence; and unknown genes.] [NT:similar to Escherichia coli AdhE
aldehyde] [LE:5630] [RE:7033] [DI:direct]

| ORF_Name | NT_ID | AA_ID | NT/LN | AA/LN | Score | P-value |
|---|---|---|---|---|---|---|
| 24646062_c2_600 | 1937 | 9108 | 351 | 116 | 417 | 5.4e-39 |

Description sp:[LN:CCHB_SALTY] [AC:P41792] [GN:CCHB] [OR:Salmonella typhimurium] [DE:CCHB
PROTEIN] [SP:P41792] [DB:swissprot] >gp:[GI:g687644] [LN:STU18560] [AC:U18560]
[GN:cchB] [OR:Salmonella typhimurium] [DB:genpept-bct1] [DE:Salmonella
typhimurium ethanolamine utilization gene cluster,eutI', partial cds, and cchA,
cchB, eutE, eutJ, eutG and eutHgenes, complete cds.] [LE:1164] [RE:1463]
[DI:direct] >gp:[GI:g3885917] [LN:AF093749] [AC:AF093749] [PN:putative
carboxysome structural protein] [GN:eutN] [OR:Salmonella typhimurium]
[DB:genpept-bct2] [DE:Salmonella typhimurium strain LT2 NADP+-linked malic enzyme
(maeB),partial cds; insertion element IS200 transposase, complete cds; eutoperon,
complete sequence; and unknown genes.] [NT:similar to Synechococcus carboxysome
structural] [LE:5319] [RE:5618] [DI:direct]

| ORF_Name | NT_ID | AA_ID | NT/LN | AA/LN | Score | P-value |
|---|---|---|---|---|---|---|
| 24651580_c2_614 | 1938 | 9109 | 456 | 151 | 564 | 1.4e-54 |

Description sp:[LN:H65017] [AC:H65017] [PN:hypothetical protein b2433] [OR:Escherichia coli]
[DB:pir2] >gp:[GI:g1788773] [LN:AE000330] [AC:AE000330:U00096] [PN:orf,
hypothetical protein] [GN:b2433] [FN:orf; Unknown] [OR:Escherichia coli]
[DB:genpept-bct2] [DE:Escherichia coli K-12 MG1655 section 220 of 400 of the
completegenome.] [NT:f151; This 151 aa ORF is 29 pct identical (9 gaps)]
[LE:9841] [RE:10296] [DI:complement]

| ORF_Name | NT_ID | AA_ID | NT LN | AA LN | Score | P-value |
|---|---|---|---|---|---|---|
| 24730261_c3_742 | 1939 | 9110 | 921 | 306 | 1075 | 1.0e-108 |

Description sp:[LN:PDXK_SALTY] [AC:P40192] [GN:PDXK] [OR:Salmonella typhimurium]
[EC:2.7.1.35] [DE:KINASE) (PYRIDOXAMINE KINASE) (PN/PL/PM KINASE)] [SP:P40192]
[DB:swissprot] >gp:[GI:g507926] [LN:STU11243] [AC:U11243] [OR:Salmonella
typhimurium] [DB:genpept-bct2] [DE:Salmonella typhimurium LT-2 region between crr
and cysM,phosphotransferase system transcriptional regulator (ptsJ) gene
andOrf287, Orf170, Orf120 and Orf179 genes, complete cds.] [NT:Orf287] [LE:388]
[RE:1251] [DI:complement]

| ORF_Name | NT_ID | AA_ID | NT LN | AA LN | Score | P-value |
|---|---|---|---|---|---|---|
| 24797677_c3_675 | 1940 | 9111 | 210 | 69 | | |

Description

NO-HIT

| ORF_Name | NT_ID | AA_ID | NT LN | AA LN | Score | P-value |
|---|---|---|---|---|---|---|
| 25438783_c1_418 | 1941 | 9112 | 720 | 239 | 1159 | 1.3e-117 |

Description sp:[LN:YFGE_ECOLI] [AC:P76570:P76979] [GN:YFGE] [OR:Escherichia coli]
[DE:HYPOTHETICAL 28.4 KD PROTEIN IN FOCB-URAA INTERGENIC REGION]
[SP:P76570:P76979] [DB:swissprot] >sp:[LN:G65025] [AC:G65025] [PN:hypothetical
protein b2496] [OR:Escherichia coli] [DB:pir2] >gp:[GI:g1788842] [LN:AE000336]
[AC:AE000336:U00096] [PN:putative DNA replication factor] [GN:b2496] [FN:putative
factor; Not classified] [OR:Escherichia coli] [DB:genpept-bct2] [DE:Escherichia
coli K-12 MG1655 section 226 of 400 of the completegenome.] [NT:f248; residues
73-246 are 51 pct identical to] [LE:2118] [RE:2864] [DI:complement]

| ORF_Name | NT_ID | AA_ID | NT LN | AA LN | Score | P-value |
|---|---|---|---|---|---|---|
| 25603437_c3_707 | 1942 | 9113 | 2283 | 760 | 3601 | 0.0 |

Description sp:[LN:F65021] [AC:F65021] [PN:hypothetical protein b2463] [OR:Escherichia coli]
[DB:pir2] >gp:[GI:g1788806] [LN:AE000333] [AC:AE000333:U00096] [PN:putative
multimodular enzyme] [GN:b2463] [FN:putative enzyme; Not classified]
[OR:Escherichia coli] [DB:genpept-bct2] [DE:Escherichia coli K-12 MG1655 section
223 of 400 of the completegenome.] [NT:f759; This 759 aa ORF is 68 pct identical
(1 gap)] [LE:141] [RE:2420] [DI:complement]

| ORF_Name | NT_ID | AA_ID | NT/LN | AA/LN | Score | P-value |
|---|---|---|---|---|---|---|
| 25911262_F1_108 | 1943 | 9114 | 1086 | 361 | 1681 | 6.1e-173 |

Description sp:[LN:AJECPC] [AC:A25955:B65026] [PN:phosphoribosylformylglycinamidine
cyclo-ligase,:5'-phosphoribosyl-5-aminoimidazole synthetase] [GN:purM]
[CL:phosphoribosylformylglycinamidine
cyclo-ligase:phosphoribosylformylglycinamidine cyclo-ligase homology]
[OR:Escherichia coli] [EC:6.3.3.1] [DB:pir1] [MP:54 min]
>gp:[GI:d1017116:g1805559] [LN:D90878] [AC:D90878:AB001340]
[PN:PHOSPHORIBOSYLFORMYLGLYCINAMIDINE CYCLO-LIGASE] [GN:purG] [OR:Escherichia
coli] [SR:Escherichia coli (strain:K12) DNA, clone_lib:Kohara lambda minise]
[DB:genpept-bct1] [DE:E.coli genomic DNA, Kohara clone #425(56.2-56.5 min.).]
[NT:similar to [SwissProt Accession Number P08178]] [LE:9118] [RE:10155]
[DI:direct] >gp:[GI:g147425] [LN:ECOPURMN] [AC:M13747:M17287]
[PN:5'-phosphoribosyl-5-aminoimidazole synthetase] [GN:purM] [OR:Escherichia
coli] [SR:Escherichia coli (strain K-12) (clone: pLC1-41 and pJS16) DNA]
[DB:genpept-bct1] [EC:6.3.3.1] [DE:E.coli purM gene encoding
5'-phosphoribosyl-5-aminoimidazolesynthetase, and purN gene, complete cds.]
[LE:780] [RE:1817] [DI:direct] >gp:[GI:g1788845] [LN:AE000336]
[AC:AE000336:U00096] [PN:phosphoribosylaminoimidazole synthetase = AIR] [GN:purM]
[FN:enzyme; Purine ribonucleotide biosynthesis] [OR:Escherichia coli]
[DB:genpept-bct2] [EC:6.3.3.1] [DE:Escherichia coli K-12 MG1655 section 226 of
400 of the completegenome.] [NT:o345; 99 pct identical to PUR5_ECOLI SW: P08178]
[LE:5240] [RE:6277] [DI:direct]

| ORF_Name | NT_ID | AA_ID | NT/LN | AA/LN | Score | P-value |
|---|---|---|---|---|---|---|
| 2603953_c2_519 | 1944 | 9115 | 210 | 69 | | |

Description

NO-HIT

| ORF_Name | NT_ID | AA_ID | NT/LN | AA/LN | Score | P-value |
|---|---|---|---|---|---|---|
| 26367260_c2_631 | 1945 | 9116 | 345 | 114 | 382 | 2.8e-35 |

Description sp:[LN:S04160] [AC:S04160] [PN:hypothetical protein K] [OR:Salmonella
typhimurium] [DB:pir2] >gp:[GI:g47846] [LN:STPTSOP] [AC:X14737] [OR:Salmonella
typhimurium] [DB:genpept-bct1] [DE:Salmonella typhimurium pts operon partial
sequence.] [NT:unidentified ORF (97 AA)] [LE:149] [RE:442] [DI:complement]

| ORF Name | NT ID | AA ID | NT LN | AA LN | Score | P-value |
|---|---|---|---|---|---|---|
| 26597161_c1_473 | 1946 | 9117 | 906 | 301 | 1362 | 3.9e-139 |

Description gp:[GI:g3885924] [LN:AF093749] [AC:AF093749] [PN:ethanolamine ammonia lyase small subunit] [GN:eutC] [OR:Salmonella typhimurium] [DB:genpept-bct2] [DE:Salmonella typhimurium strain LT2 NADP+-linked malic enzyme (maeB),partial cds; insertion element IS200 transposase, complete cds; eutoperon, complete sequence; and unknown genes.] [LE:13207] [RE:14103] [DI:direct]

| ORF Name | NT ID | AA ID | NT LN | AA LN | Score | P-value |
|---|---|---|---|---|---|---|
| 26597812_f1_115 | 1947 | 9118 | 1239 | 412 | 143 | 8.6e-07 |

Description sp:[LN:MHPT_ECOLI] [AC:P77589:P77037] [GN:MHPT] [OR:Escherichia coli]
[DE:PUTATIVE 3-HYDROXYPHENYLPROPIONIC ACID TRANSPORTER] [SP:P77589:P77037]
[DB:swissprot] >sp:[LN:A64763] [AC:A64763] [PN:probable transport protein mhpT]
[GN:mhpT] [OR:Escherichia coli] [DB:pir2] >gp:[GI:g1786549] [LN:AE000142]
[AC:AE000142:U00096] [PN:putative transport protein] [GN:mhpT] [FN:putative
transport; Not classified] [OR:Escherichia coli] [DB:genpept-bct2]
[DE:Escherichia coli K-12 MG1655 section 32 of 400 of the completegenome.]
[NT:o418; This 418 aa ORF is 21 pct identical (13 gaps)] [LE:6872] [RE:8128]
[DI:direct] >gp:[GI:g1657549] [LN:ECU73857] [AC:U73857] [OR:Escherichia coli]
[DB:genpept-bct2] [DE:Escherichia coli chromosome minutes 6-8.] [NT:similar to P.
putida pcaK] [LE:83003] [RE:84259] [DI:direct]

| ORF Name | NT ID | AA ID | NT LN | AA LN | Score | P-value |
|---|---|---|---|---|---|---|
| 26614562_f3_356 | 1948 | 9119 | 702 | 233 | 920 | 2.7e-92 |

Description sp:[LN:PUR3_ECOLI] [AC:P08179] [GN:PURN] [OR:Escherichia coli] [EC:2.1.2.2]
[DE:TRANSFORMYLASE) (5'-PHOSPHORIBOSYLGLYCINAMIDE TRANSFORMYLASE)] [SP:P08179]
[DB:swissprot] >sp:[LN:XYECGF] [AC:A28486:C65026] [PN:phosphoribosylglycinamide
formyltransferase,] [GN:purN] [CL:phosphoribosylglycinamide
formyltransferase:phosphoribosylglycinamide formyltransferase homology]
[OR:Escherichia coli] [EC:2.1.2.2] [DB:pir1] [MP:54 min]
>gp:[GI:d1017117:g1805560] [LN:D90878] [AC:D90878:AB001340]
[PN:phosphoribosylglycinamide formyltransferase (EC) [GN:purN] [OR:Escherichia
coli] [SR:Escherichia coli (strain:K12) DNA, clone_lib:Kohara lambda minise]
[DB:genpept-bct1] [DE:E.coli genomic DNA, Kohara clone #425(56.2-56.5 min.).]
[NT:similar to [PIR Accession Number A28486]] [LE:10155] [RE:10793] [DI:direct]
>gp:[GI:g147426] [LN:ECOPURMN] [AC:M13747:M17287] [GN:purN] [OR:Escherichia coli]
[SR:Escherichia coli (strain K-12) (clone: pLC1-41 and pJS16) DNA]
[DB:genpept-bct1] [DE:E.coli purM gene encoding
5'-phosphoribosyl-5-aminoimidazolesynthetase, and purN gene, complete cds.]
[LE:1817] [RE:2455] [DI:direct] >gp:[GI:g1788846] [LN:AE000336]
[AC:AE000336:U00096] [PN:phosphoribosylglycinamide formyltransferase 1] [GN:purN]
[FN:enzyme; Purine ribonucleotide biosynthesis] [OR:Escherichia coli]
[DB:genpept-bct2] [EC:2.1.2.2] [DE:Escherichia coli K-12 MG1655 section 226 of
400 of the completegenome.] [NT:o212; 99 pct identical to PUR3_ECOLI SW: P08179]
[LE:6277] [RE:6915] [DI:direct]

| ORF_Name | NT ID | AA ID | NT/LN | AA/LN | Score | P-value |
|---|---|---|---|---|---|---|
| 26773391_f1_81 | 1949 | 9120 | 222 | 73 | 329 | 1.1e-29 |

Description gp:[GI:d1017076:g1799896] [LN:D90875] [AC:D90875:AB001340] [OR:Escherichia coli]
[SR:Escherichia coli (strain:K12) DNA, clone_lib:Kohara lambda minise]
[DB:genpept-bct1] [DE:E.coli genomic DNA, Kohara clone #422(55.5-55.8 min.).]
[NT:similar to [PIR Accession Number D42959]] [LE:15855] [RE:16055] [DI:direct]
>gp:[GI:d1017080:g1799901] [LN:D90876] [AC:D90876:AB001340] [OR:Escherichia coli]
[SR:Escherichia coli (strain:K12) DNA, clone_lib:Kohara lambda minise]
[DB:genpept-bct1] [DE:E.coli genomic DNA, Kohara clone #423(55.7-56.1 min.).]
[NT:similar to [PIR Accession Number D42959]] [LE:3711] [RE:3911] [DI:direct]

| ORF_Name | NT ID | AA ID | NT/LN | AA/LN | Score | P-value |
|---|---|---|---|---|---|---|
| 26802007_f3_346 | 1950 | 9121 | 1542 | 513 | 2128 | 2.6e-220 |

Description sp:[LN:E65025] [AC:E65025] [PN:hypothetical protein b2494] [OR:Escherichia coli]
[DB:pir2] >gp:[GI:g1788840] [LN:AE000336] [AC:AE000336:U00096] [PN:orf,
hypothetical protein] [GN:b2494] [FN:orf; Unknown] [OR:Escherichia coli]
[DB:genpept-bct2] [DE:Escherichia coli K-12 MG1655 section 226 of 400 of the
completegenome.] [NT:o487; This 487 aa ORF is 25 pct identical (24 gaps)]
[LE:137] [RE:1600] [DI:direct]

| ORF_Name | NT ID | AA ID | NT/LN | AA/LN | Score | P-value |
|---|---|---|---|---|---|---|
| 29297150_f3_372 | 1951 | 9122 | 381 | 126 | | |

Description

NO-HIT

| ORF_Name | NT ID | AA ID | NT/LN | AA/LN | Score | P-value |
|---|---|---|---|---|---|---|
| 29303877_f3_274 | 1952 | 9123 | 288 | 95 | 207 | 4.3e-16 |

Description sp:[LN:PTSJ_SALTY] [AC:P40193] [GN:PTSJ] [OR:Salmonella typhimurium] [DE:PUTATIVE
TRANSCRIPTIONAL REGULATORY PROTEIN PTSJ] [SP:P40193] [DB:swissprot]
>gp:[GI:g507927] [LN:STU11243] [AC:U11243] [PN:PtsJ] [GN:ptsJ] [OR:Salmonella
typhimurium] [DB:genpept-bct2] [DE:Salmonella typhimurium LT-2 region between crr
and cysM,phosphotransferase system transcriptional regulator (ptsJ) gene
andOrf287, Orf170, Orf120 and Orf179 genes, complete cds.] [NT:putative
transcriptional regulator of the] [LE:1334] [RE:2626] [DI:direct]

| ORF_Name | NT ID | AA ID | NT/LN | AA/LN | Score | P-value |
|---|---|---|---|---|---|---|
| 29313206_f2_152 | 1953 | 9124 | 624 | 207 | 168 | 1.3e-12 |

Description sp:[LN:S19114] [AC:S19114] [PN:cgcr-1 protein] [OR:Chlamydomonas reinhardtii]
[DB:pir2]

| ORF_Name | NT ID | AA ID | NT/LN | AA/LN | Score | P-value |
|---|---|---|---|---|---|---|
| 29384630_f2_217 | 1954 | 9125 | 1131 | 376 | 1817 | 2.4e-187 |

Description sp:[LN:DAPE_ECOLI] [AC:P24176] [GN:DAPE:MSGB] [OR:Escherichia coli] [EC:3.5.1.18]
[DE:SUCCINYL-DIAMINOPIMELATE DESUCCINYLASE, (SDAP)] [SP:P24176] [DB:swissprot]
>sp:[LN:A42959] [AC:A42959:A42958:G65022:S26999] [PN:succinyl-diaminopimelate
desuccinylase,:N-succinyl-L-diaminopimelic acid desuccinylase:SDAP-deacylase]
[GN:dapE:msgB] [OR:Escherichia coli] [EC:3.5.1.18] [DB:pir2] [MP:15 min]
>gp:[GI:d1017075:g1799895] [LN:D90875] [AC:D90875:AB001340]
[PN:succinyl-diaminopimelate desuccinylase (EC)] [GN:dapE] [OR:Escherichia coli]
[SR:Escherichia coli (strain:K12) DNA, clone_lib:Kohara lambda minise]
[DB:genpept-bct1] [DE:E.coli genomic DNA, Kohara clone #422(55.5-55.8 min.).]
[NT:similar to [PIR Accession Number A42959]] [LE:14700] [RE:15827] [DI:direct]
>gp:[GI:d1017079:g1799900] [LN:D90876] [AC:D90876:AB001340]
[PN:succinyl-diaminopimelate desuccinylase (EC)] [GN:dapE] [OR:Escherichia coli]
[SR:Escherichia coli (strain:K12) DNA, clone_lib:Kohara lambda minise]
[DB:genpept-bct1] [DE:E.coli genomic DNA, Kohara clone #423(55.7-56.1 min.).]
[NT:similar to [PIR Accession Number A42959]] [LE:2556] [RE:3683] [DI:direct]
>gp:[GI:g41234] [LN:ECDAPE] [AC:X57403:S41761] [PN:succinyldiaminopimelate
desuccinylase] [GN:dapE] [OR:Escherichia coli] [DB:genpept-bct1] [EC:3.5.1.18]
[DE:Escherichia coli dapE gene for succinyldiaminopimelatedesuccinylase.]
[SP:P24176] [LE:1023] [RE:2150] [DI:direct] >gp:[GI:g253061] [LN:S41760]
[AC:S41760] [PN:N-succinyl-L-diaminopimelic acid desuccinylase] [GN:msgB/dapE]
[OR:Escherichia coli] [DB:genpept-bct1] [DE:msgB/dapE=multicopy suppressor of
grpE [Escherichia coli, Genomic,1555 nt].] [NT:Method: conceptual translation
with partial peptide] [LE:326] [RE:1453] [DI:direct] >gp:[GI:g1788816]
[LN:AE000334] [AC:AE000334:U00096] [PN:N-succinyl-diaminopimelate deacylase]
[GN:dapE] [FN:enzyme; Amino acid biosynthesis: Lysine] [OR:Escherichia coli]
[DB:genpept-bct2] [EC:3.5.1.18] [DE:Escherichia coli K-12 MG1655 section 224 of
400 of the completegenome.] [NT:o375; 99 pct identical to DAPE_ECOLI SW: P24176]
[LE:4124] [RE:5251] [DI:direct]

| ORF_Name | NT ID | AA ID | NT/LN | AA/LN | Score | P-value |
|---|---|---|---|---|---|---|
| 29535128_f2_229 | 1955 | 9126 | 1218 | 405 | 861 | 4.8e-86 |

Description sp:[LN:F65023] [AC:F65023] [PN:gcvR protein] [GN:gcvR] [OR:Escherichia coli]
[DB:pir2] >gp:[GI:d1017085:g1799906] [LN:D90876] [AC:D90876:AB001340] [PN:GCV
OPERON TRANSCRIPTIONAL REGULATOR.] [GN:gcvR] [OR:Escherichia coli]
[SR:Escherichia coli (strain:K12) DNA, clone_lib:Kohara lambda minise]
[DB:genpept-bct1] [DE:E.coli genomic DNA, Kohara clone #423(55.7-56.1 min.).]
[NT:similar to [SwissProt Accession Number P23483]] [LE:10790] [RE:11428]
[DI:direct] >gp:[GI:d1017095:g1805537] [LN:D90877] [AC:D90877:AB001340] [PN:GCV
OPERON TRANSCRIPTIONAL REGULATOR.] [GN:gcvR] [OR:Escherichia coli]
[SR:Escherichia coli (strain:K12) DNA, clone_lib:Kohara lambda minise]
[DB:genpept-bct1] [DE:E.coli genomic DNA, Kohara clone #424(55.9-56.3 min.).]
[NT:similar to [SwissProt Accession Number P23483]] [LE:3530] [RE:4168]
[DI:direct] >gp:[GI:g1788824] [LN:AE000335] [AC:AE000335:U00096]
[PN:transcriptional regulation of gcv operon] [GN:gcvR] [FN:regulator; Central
intermediary metabolism:] [OR:Escherichia coli] [DB:genpept-bct2] [DE:Escherichia
coli K-12 MG1655 section 225 of 400 of the completegenome.] [NT:o212; residues
37-174 are 100 pct identical] [LE:2146] [RE:2784] [DI:direct]

| ORF_Name | NT_ID | AA_ID | NT LN | AA LN | Score | P-value |
|---|---|---|---|---|---|---|
| 29537942_c3_736 | 1956 | 9127 | 1155 | 384 | 1783 | 9.5e-184 |

Description sp:[LN:CYSA_ECOLI] [AC:P16676:P77693] [GN:CYSA] [OR:Escherichia coli] [DE:SULFATE
TRANSPORT ATP-BINDING PROTEIN CYSA] [SP:P16676:P77693] [DB:swissprot]
>sp:[LN:QRECSA] [AC:E65016:C35402] [PN:sulfate transport ATP-binding protein
cysA:nucleotide-binding protein cysA] [GN:cysA] [CL:inner membrane protein
malK:ATP-binding cassette homology] [OR:Escherichia coli] [DB:pir1] [MP:52 min]
>gp:[GI:d1017025:g1799841] [LN:D90871] [AC:D90871:AB001340]
[PN:sulfate/thiosulfate transport protein cysA] [GN:cysA] [OR:Escherichia coli]
[SR:Escherichia coli (strain:K12) DNA, clone_lib:Kohara lambda minise]
[DB:genpept-bct1] [DE:E.coli genomic DNA, Kohara clone #418(54.6-54.9 min.).]
[NT:similar to [PIR Accession Number C35402]] [LE:8085] [RE:9182] [DI:complement]
>gp:[GI:d1017034:g1799851] [LN:D90872] [AC:D90872:AB001340]
[PN:sulfate/thiosulfate transport protein cysA] [GN:cysA] [OR:Escherichia coli]
[SR:Escherichia coli (strain:K12) DNA, clone_lib:Kohara lambda minise]
[DB:genpept-bct1] [DE:E.coli genomic DNA, Kohara clone #419(54.7-55.1 min.).]
[NT:similar to [PIR Accession Number C35402]] [LE:2846] [RE:3943] [DI:complement]
>gp:[GI:g1788761] [LN:AE000329] [AC:AE000329:U00096] [PN:ATP-binding component of
sulfate permease A] [GN:cysA] [FN:transport; Transport of small molecules:]
[OR:Escherichia coli] [DB:genpept-bct2] [DE:Escherichia coli K-12 MG1655 section
219 of 400 of the completegenome.] [NT:f365; 99 pct identical to CYSA_ECOLI SW:
P16676] [LE:9536] [RE:10633] [DI:complement]

| ORF_Name | NT_ID | AA_ID | NT LN | AA LN | Score | P-value |
|---|---|---|---|---|---|---|
| 29770305_f3_281 | 1957 | 9128 | 312 | 103 | 104 | 7.9e-06 |

Description sp:[LN:B72786] [AC:B72786] [PN:hypothetical protein APE0271] [GN:APE0271]
[OR:Aeropyrum pernix] [DB:pir2] >gp:[GI:d1042964:g5103667] [LN:AP000058]
[AC:AP000058] [PN:137aa long hypothetical protein] [GN:APE0271] [OR:Aeropyrum
pernix] [SR:Aeropyrum pernix (strain:K1) DNA] [DB:genpept-bct1] [DE:Aeropyrum
pernix genomic DNA, section 1/7.] [LE:196840] [RE:197253] [DI:direct]

| ORF_Name | NT_ID | AA_ID | NT LN | AA LN | Score | P-value |
|---|---|---|---|---|---|---|
| 29859390_f3_360 | 1958 | 9129 | 297 | 98 | 248 | 4.4e-21 |

Description sp:[LN:G65026] [AC:G65026] [PN:hypothetical protein b2504] [OR:Escherichia coli]
[DB:pir2] >gp:[GI:g1788851] [LN:AE000337] [AC:AE000337:U00096] [PN:orf,
hypothetical protein] [GN:b2504] [FN:orf; Unknown] [OR:Escherichia coli]
[DB:genpept-bct2] [DE:Escherichia coli K-12 MG1655 section 227 of 400 of the
completegenome.] [NT:o63; This 63 aa ORF is 40 pct identical (1 gap)] [LE:206]
[RE:397] [DI:direct]

| ORF Name | NT ID | AA ID | NT LN | AA LN | Score | P-value |
|---|---|---|---|---|---|---|
| 29925415_c2_637 | 1959 | 9130 | 240 | 79 | 304 | 5.1e-27 |

Description sp:[LN:YPEB_ECOLI] [AC:P56604] [GN:YPEB] [OR:Escherichia coli] [DE:HYPOTHETICAL 8.4 KD PROTEIN IN XAPB-LIG INTERGENIC REGION] [SP:P56604] [DB:swissprot]

| ORF Name | NT ID | AA ID | NT LN | AA LN | Score | P-value |
|---|---|---|---|---|---|---|
| 30332515_c1_404 | 1960 | 9131 | 357 | 118 | | |

Description

NO-HIT

| ORF Name | NT ID | AA ID | NT LN | AA LN | Score | P-value |
|---|---|---|---|---|---|---|
| 31509783_c2_641 | 1961 | 9132 | 795 | 264 | 1233 | 1.8e-125 |

Description sp:[LN:SYE_ECOLI] [AC:P04805] [GN:GLTX] [OR:Escherichia coli] [EC:6.1.1.17]
[DE:(GLURS)] [SP:P04805] [DB:swissprot] >sp:[LN:SYECET] [AC:A25956:I41069:C65014]
[PN:glutamate--tRNA ligase,:glutamyl-tRNA synthetase] [GN:gltX]
[CL:glutamate--tRNA ligase:glutamine--tRNA ligase homology] [OR:Escherichia coli]
[EC:6.1.1.17] [DB:pir1] [MP:52 min] >gp:[GI:d1017000:g1799814] [LN:D90869]
[AC:D90869:AB001340] [PN:glutamate--tRNA ligase (EC 6.1.1.17)] [GN:gltX]
[OR:Escherichia coli] [SR:Escherichia coli (strain:K12) DNA, clone_lib:Kohara
lambda minise] [DB:genpept-bct1] [DE:E.coli genomic DNA, Kohara clone
416(54.1-54.5 min.).] [NT:similar to [PIR Accession Number A25956]] [LE:12101]
[RE:13516] [DI:complement] >gp:[GI:g41596] [LN:ECGLTXVA]
[AC:X63976:X55757:X63977] [PN:glutamyl-tRNA synthetase] [GN:gltX] [OR:Escherichia
coli] [DB:genpept-bct1] [DE:Escherichia coli K12 valU, gltX and alaW region.]
[SP:P04805] [LE:1877] [RE:3292] [DI:direct] >gp:[GI:g148256] [LN:ECOUXW]
[AC:M13687] [PN:glutamyl-tRNA synthetase] [GN:gltX] [OR:Escherichia coli]
[SR:Escherichia coli (sub_strain N99, strain K-12) DNA] [DB:genpept-bct1]
[DE:Escherichia coli alaW (transfer RNA-Ala), valU (transfer RNA-Valand transfer
RNA-Lys) operons and glutamyl-tRNA synthetase (gltX)gene, complete cds.]
[LE:1877] [RE:3292] [DI:direct] >gp:[GI:g1788743] [LN:AE000328]
[AC:AE000328:U00096] [PN:glutamate tRNA synthetase, catalytic subunit] [GN:gltX]
[FN:enzyme; Aminoacyl tRNA synthetases, tRNA] [OR:Escherichia coli]
[DB:genpept-bct2] [DE:Escherichia coli K-12 MG1655 section 218 of 400 of the
completegenome.] [NT:f471; 100 pct identical to SYE_ECOLI SW: P04805] [LE:946]
[RE:2361] [DI:complement]

| ORF Name | NT ID | AA ID | NT LN | AA LN | Score | P-value |
|---|---|---|---|---|---|---|
| 31744651_c3_750 | 1962 | 9133 | 291 | 96 | 100 | 6.4e-05 |

Description sp:[LN:SFR7_HUMAN] [AC:Q16629] [GN:SFRS7] [OR:Homo sapiens] [SR:,Human]
[DE:SPLICING FACTOR, ARGININE/SERINE-RICH 7 (SPLICING FACTOR 9G8)] [SP:Q16629]
[DB:swissprot] >sp:[LN:A57198] [AC:A57198:S46319] [PN:splicing factor,
arginine/serine-rich 7:splicing factor 9G8] [GN:SFRS7:9G8] [CL:unassigned
ribonucleoprotein repeat-containing proteins:ribonucleoprotein repeat homology]
[OR:Homo sapiens] [SR:, man] [DB:pir2] [MP:2p22-2p21] >gp:[GI:g506402]
[LN:HUM9G8SF] [AC:L22253] [PN:9G8 splicing factor] [OR:Homo sapiens] [SR:Homo
sapiens (library: lambda ZAP-II) cDNA to mRNA] [DB:genpept-pri2] [DE:Homo sapiens
9G8 splicing factor mRNA, complete cds.] [LE:106] [RE:822] [DI:direct]
>gp:[GI:g950424] [LN:HUMSFRS] [AC:L41887] [PN:splicing factor,
arginine/serine-rich 7] [GN:SFRS7] [OR:Homo sapiens] [SR:Homo sapiens DNA]
[DB:genpept-pri2] [DE:Homo sapiens splicing factor, arginine/serine-rich 7
(SFRS7) gene,complete cds.] [NT:35 kDa protein] [LE:520:1582:2071:3123:3619]
[RE:547:1762:2247:3197:3729] [DI:directJoin]

| ORF Name | NT ID | AA ID | NT LN | AA LN | Score | P-value |
|---|---|---|---|---|---|---|
| 31833326_f3_283 | 1963 | 9134 | 210 | 69 | 165 | 2.7e-12 |

Description sp:[LN:YCJD_ECOLI] [AC:P45736:P71233] [GN:YCJD] [OR:Escherichia coli]
[DE:HYPOTHETICAL 14.0 KD PROTEIN IN FABI-SAPF INTERGENIC REGION]
[SP:P45736:P71233] [DB:swissprot] >sp:[LN:D64877] [AC:D64877] [PN:ycjD protein]
[GN:ycjD] [CL:hypothetical protein HI0925] [OR:Escherichia coli] [DB:pir2]
>gp:[GI:d1015558:g1742102] [LN:D90766] [AC:D90766:AB001340] [GN:ycjD]
[OR:Escherichia coli] [SR:Escherichia coli (strain:K12) DNA, clone_lib:Kohara
lambda minise] [DB:genpept-bct1] [DE:E.coli genomic DNA, Kohara clone
255(28.8-29.2 min.).] [NT:ORF_ID:o255#17; similar to [SwissProt Accession]
[LE:13675] [RE:14028] [DI:complement] >gp:[GI:d1015566:g1742111] [LN:D90767]
[AC:D90767:AB001340] [GN:ycjD] [OR:Escherichia coli] [SR:Escherichia coli
(strain:K12) DNA, clone_lib:Kohara lambda minise] [DB:genpept-bct1] [DE:E.coli
genomic DNA, Kohara clone #256(29.0-29.4 min.).] [NT:ORF_ID:o255#17; similar to
[SwissProt Accession] [LE:7070] [RE:7423] [DI:complement] >gp:[GI:g1787546]
[LN:AE000227] [AC:AE000227:U00096] [PN:orf, hypothetical protein] [GN:ycjD]
[FN:orf; Unknown] [OR:Escherichia coli] [DB:genpept-bct2] [DE:Escherichia coli
K-12 MG1655 section 117 of 400 of the completegenome.] [NT:f117; 100 pct
identical to YCJD_ECOLI SW: P45736] [LE:2491] [RE:2844] [DI:complement]

| ORF Name | NT ID | AA ID | NT LN | AA LN | Score | P-value |
|---|---|---|---|---|---|---|
| 31891591_c3_710 | 1964 | 9135 | 972 | 323 | 1192 | 4.0e-121 |

Description gp:[GI:g3885915] [LN:AF093749] [AC:AF093749] [PN:putative phosphotransacetylase
non-catalytic] [GN:eutD] [OR:Salmonella typhimurium] [DB:genpept-bct2]
[DE:Salmonella typhimurium strain LT2 NADP+-linked malic enzyme (maeB),partial
cds; insertion element IS200 transposase, complete cds; eutoperon, complete
sequence; and unknown genes.] [LE:3872] [RE:4888] [DI:direct]

| ORF Name | NT ID | AA ID | NT LN | AA LN | Score | P-value |
|---|---|---|---|---|---|---|
| 32500293_c2_574 | 1965 | 9136 | 447 | 148 | 118 | 9.3e-06 |

Description gp:[GI:d1023243:g2443342] [LN:D88764] [AC:D88764] [PN:alpha 2 type I collagen] [GN:Rana COL1A2] [OR:Rana catesbeiana] [SR:Rana catesbeiana larva tail cDNA to mRNA] [DB:genpept-vrt] [DE:Rana catesbeiana mRNA for alpha 2 type I collagen, complete cds.] [LE:128] [RE:4195] [DI:direct]

| ORF Name | NT ID | AA ID | NT LN | AA LN | Score | P-value |
|---|---|---|---|---|---|---|
| 32550266_c3_696 | 1966 | 9137 | 1242 | 413 | 108 | 5.7e-05 |

Description sp:[LN:T13167] [AC:T13167] [PN:Lola-like protein] [OR:Drosophila hydei] [DB:pir2] >gp:[GI:e353335:g2467112] [LN:DHLOLA] [AC:Y14994] [PN:Lola-like protein] [GN:9.2.1AB (lola-like)] [OR:Drosophila hydei] [DB:genpept-invl] [DE:Drosophila hydei mRNA for Lola-like protein.] [LE:229] [RE:3261] [DI:direct]

| ORF Name | NT ID | AA ID | NT LN | AA LN | Score | P-value |
|---|---|---|---|---|---|---|
| 32556957_c3_751 | 1967 | 9138 | 246 | 81 | 131 | 4.9e-08 |

Description sp:[LN:C65015] [AC:C65015] [PN:hypothetical protein b2412] [OR:Escherichia coli] [DB:pir2] >gp:[GI:d1017012:g1799827] [LN:D90870] [AC:D90870:AB001340] [OR:Escherichia coli] [SR:Escherichia coli (strain:K12) DNA, clone_lib:Kohara lambda minise] [DB:genpept-bct1] [DE:E.coli genomic DNA, Kohara clone #417(54.4-54.6 min.).] [NT:similar to [SwissProt Accession Number P44113]] [LE:9574] [RE:10560] [DI:complement] >gp:[GI:g1788752] [LN:AE000329] [AC:AE000329:U00096] [PN:cell division protein involved in FtsZ ring] [GN:zipA] [FN:membrane; Cell division] [OR:Escherichia coli] [DB:genpept-bct1] [DE:Escherichia coli K-12 MG1655 section 219 of 400 of the completegenome.] [NT:f328 was f159 and f169; ??? pct identical (2 gaps)] [LE:66] [RE:1052] [DI:complement]

| ORF Name | NT ID | AA ID | NT LN | AA LN | Score | P-value |
|---|---|---|---|---|---|---|
| 32697705_f2_160 | 1968 | 9139 | 438 | 145 | 388 | 6.4e-36 |

Description sp:[LN:YYBH_BACSU] [AC:P37496] [GN:YYBH] [OR:Bacillus subtilis] [DE:HYPOTHETICAL 14.6 KD PROTEIN IN COTF-TETB INTERGENIC REGION] [SP:P37496] [DB:swissprot] >sp:[LN:S65989] [AC:S65989:C70087] [PN:hypothetical protein yybH] [GN:yybH] [CL:Bacillus subtilis hypothetical protein yybH] [OR:Bacillus subtilis] [DB:pir2] >gp:[GI:d1005737:g467349] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:25752] [RE:26141] [DI:complement] >gp:[GI:e1184790:g2636611] [LN:BSUB0021] [AC:Z99124:AL009126] [GN:yybH] [FN:unknown] [OR:Bacillus subtilis] [DB:genpept-bct1] [DE:Bacillus subtilis complete genome (section 21 of 21): from 3999281to 4214814.] [SP:P37496] [LE:177684] [RE:178073] [DI:complement]

| ORF Name | NT ID | AA ID | NT/LN | AA/LN | Score | P-value |
|---|---|---|---|---|---|---|
| 3314513_f2_233 | 1969 | 9140 | 1053 | 350 | 971 | 1.1e-97 |

Description sp:[LN:YTL2_SALTY] [AC:P37415] [OR:Salmonella typhimurium] [DE:HYPOTHETICAL 35.3 KD PROTEIN NEAR TLPA OPERON] [SP:P37415] [DB:swissprot] >sp:[LN:S41385] [AC:S41385] [PN:hypothetical yadD homolog] [OR:Salmonella typhimurium] [DB:pir2] >gp:[GI:g444033] [LN:ST1530KP] [AC:Z29513] [PN:30 kDa protein similar to E. coli yadD and yhgA] [OR:Salmonella typhimurium] [DB:genpept-bct1] [DE:S.typhimurium (LT2) DNA for 15kDa and 30kDa proteins.] [SP:P37415] [LE:1675] [RE:2616] [DI:complement]

| ORF Name | NT ID | AA ID | NT/LN | AA/LN | Score | P-value |
|---|---|---|---|---|---|---|
| 3364090_c3_651 | 1970 | 9141 | 204 | 67 | | |

Description

NO-HIT

| ORF Name | NT ID | AA ID | NT/LN | AA/LN | Score | P-value |
|---|---|---|---|---|---|---|
| 33675326_f2_192 | 1971 | 9142 | 1599 | 532 | 156 | 7.4e-08 |

Description sp:[LN:I47141] [AC:I47141:S55315] [PN:gastric mucin (clone PGM-2A)] [OR:Sus scrofa domestica] [SR:, domestic pig] [DB:pir2]

| ORF Name | NT ID | AA ID | NT/LN | AA/LN | Score | P-value |
|---|---|---|---|---|---|---|
| 34039836_c3_716 | 1972 | 9143 | 1248 | 415 | 1940 | 2.2e-200 |

Description gp:[GI:d1017059:g1799878] [LN:D90874] [AC:D90874:AB001340] [PN:ETHANOLAMINE UTILIZATION PROTEIN EUTH (PUTATIVE)] [GN:EUTH] [OR:Escherichia coli] [SR:Escherichia coli (strain:K12) DNA, clone_lib:Kohara lambda minise] [DB:genpept-bct1] [DE:E.coli genomic DNA, Kohara clone #421(55.1-55.5 min.).] [NT:similar to [SwissProt Accession Number P41796];] [LE:6925] [RE:>8166] [DI:complement]

| ORF Name | NT ID | AA ID | NT/LN | AA/LN | Score | P-value |
|---|---|---|---|---|---|---|
| 34414686_f3_368 | 1973 | 9144 | 1185 | 394 | 467 | 1.9e-88 |

Description gp:[GI:g145390] [LN:ECOASLAB] [AC:M90498] [PN:putative arylsulfatase regulator] [GN:aslB] [OR:Escherichia coli] [DB:genpept-bct2] [DE:Escherichia coli putative arylsulfatase regulator (aslB) andputative arylsulfatase (aslA) genes, complete cds.] [LE:97] [RE:1332] [DI:direct]

| ORF_Name | NT ID | AA ID | NT/LN | AA/LN | Score | P-value |
|---|---|---|---|---|---|---|
| 34495956_c2_518 | 1974 | 9145 | 1110 | 369 | 1075 | 1.0e-108 |

Description sp:[LN:JH0131] [AC:JH0131:PS0294] [PN:DNA-binding protein repC precursor] [GN:repC] [OR:Escherichia coli] [DB:pir2] >gp:[GI:g152587] [LN:RSFRMRA] [AC:M28829] [PN:replication protein C] [OR:Plasmid RSF1010] [SR:Plasmid RSF1010, grown in E.coli (strain K-12), DNA] [DB:genpept-bct1] [DE:Plasmid RSF1010, complete sequence.] [LE:6716] [RE:7567] [DI:direct] >gp:[GI:g4262410] [LN:AF100173] [AC:AF100173] [PN:replication protein C] [GN:repC] [OR:Cloning vector pVZ209] [DB:genpept-syn] [DE:Cloning vector pVZ209 complete sequence.] [LE:8285] [RE:9136] [DI:direct] >gp:[GI:g4323368] [LN:AF100174] [AC:AF100174] [PN:replication protein C] [GN:repC] [OR:Cloning vector pVZ323] [DB:genpept-syn] [DE:Cloning vector pVZ323 complete sequence.] [LE:6465] [RE:7316] [DI:direct] >gp:[GI:g4323379] [LN:AF100175] [AC:AF100175] [PN:replication protein C] [GN:repC] [OR:Cloning vector pVZ322] [DB:genpept-syn] [DE:Cloning vector pVZ322 complete sequence.] [LE:7320] [RE:8171] [DI:direct] >gp:[GI:g4323390] [LN:AF100176] [AC:AF100176] [PN:replication protein C] [GN:repC] [OR:Cloning vector pVZ321] [DB:genpept-syn] [DE:Cloning vector pVZ321 complete sequence.] [LE:6465] [RE:7316] [DI:direct] >gp:[GI:g4323401] [LN:AF100177] [AC:AF100177] [PN:replication protein C] [GN:repC] [OR:Cloning vector pVZ324] [DB:genpept-syn] [DE:Cloning vector pVZ324 complete sequence.] [LE:6465] [RE:7316] [DI:direct] >gp:[GI:g4323411] [LN:AF100178] [AC:AF100178] [PN:replication protein C] [GN:repC] [OR:Cloning vector pVZ361] [DB:genpept-syn] [DE:Cloning vector pVZ361 complete sequence.] [LE:9323] [RE:10174] [DI:direct]

| ORF_Name | NT ID | AA ID | NT/LN | AA/LN | Score | P-value |
|---|---|---|---|---|---|---|
| 35585026_f2_259 | 1975 | 9146 | 348 | 115 | | |

Description

NO-HIT

| ORF_Name | NT ID | AA ID | NT/LN | AA/LN | Score | P-value |
|---|---|---|---|---|---|---|
| 35604083_f1_8 | 1976 | 9147 | 231 | 76 | 210 | 4.6e-17 |

Description sp:[LN:CHHC_BOMMO] [AC:P20730] [OR:Bombyx mori] [SR:,Silk moth] [DE:CHORION CLASS HIGH-CYSTEINE HCB PROTEIN 13 PRECURSOR (HC-B.13)] [SP:P20730] [DB:swissprot] >sp:[LN:A23219] [AC:A23219] [PN:high-cysteine chorion protein B 13] [CL:chorion class A protein pc292] [OR:Bombyx mori] [SR:, silkworm] [DB:pir2]

| ORF_Name | NT ID | AA ID | NT/LN | AA/LN | Score | P-value |
|---|---|---|---|---|---|---|
| 35658312_c2_606 | 1977 | 9148 | 1446 | 481 | 2085 | 9.5e-216 |

Description gp:[GI:g3885922] [LN:AF093749] [AC:AF093749] [PN:putative chaperonin] [GN:eutA]
[OR:Salmonella typhimurium] [DB:genpept-bct2] [DE:Salmonella typhimurium strain
LT2 NADP+-linked malic enzyme (maeB),partial cds; insertion element IS200
transposase, complete cds; eutoperon, complete sequence; and unknown genes.]
[NT:similar to Escherichia coli DnaK] [LE:10412] [RE:11815] [DI:direct]

| ORF_Name | NT ID | AA ID | NT/LN | AA/LN | Score | P-value |
|---|---|---|---|---|---|---|
| 35831926_c2_620 | 1978 | 9149 | 987 | 328 | 1387 | 8.8e-142 |

Description sp:[LN:CYSW_ECOLI] [AC:P16702:P76534] [GN:CYSW] [OR:Escherichia coli] [DE:SULFATE
TRANSPORT SYSTEM PERMEASE PROTEIN CYSW] [SP:P16702:P76534] [DB:swissprot]
>gp:[GI:d1017026:g1799842] [LN:D90871] [AC:D90871:AB001340]
[PN:sulfate/thiosulfate transport protein cysW] [GN:cysW] [OR:Escherichia coli]
[SR:Escherichia coli (strain:K12) DNA, clone_lib:Kohara lambda minise]
[DB:genpept-bct1] [DE:E.coli genomic DNA, Kohara clone #418(54.6-54.9 min.).]
[NT:similar to [PIR Accession Number B35402]] [LE:9172] [RE:10047]
[DI:complement] >gp:[GI:d1017035:g1799852] [LN:D90872] [AC:D90872:AB001340]
[PN:sulfate/thiosulfate transport protein cysW] [GN:cysW] [OR:Escherichia coli]
[SR:Escherichia coli (strain:K12) DNA, clone_lib:Kohara lambda minise]
[DB:genpept-bct1] [DE:E.coli genomic DNA, Kohara clone #419(54.7-55.1 min.).]
[NT:similar to [PIR Accession Number B35402]] [LE:3933] [RE:4808] [DI:complement]
>gp:[GI:g145660] [LN:ECOCYS] [AC:M32101:M38050] [PN:sulfate permease] [GN:cysW]
[OR:Escherichia coli] [SR:E.coli K12 DNA] [DB:genpept-bct1] [DE:E.coli
thiosulfate binding protein (cysP), sulfate permease (cysT,cysW, cysA) and
o-acetylserine (thiol)-lyase-B (cysM) genes,complete cds.] [NT:sulfate permease
(cysW)] [LE:2408] [RE:3283] [DI:direct]

| ORF_Name | NT ID | AA ID | NT/LN | AA/LN | Score | P-value |
|---|---|---|---|---|---|---|
| 36052267_f2_214 | 1979 | 9150 | 3168 | 1055 | 4803 | 0.0 |

Description sp:[LN:ACRD_ECOLI] [AC:P24177:P77178:Q46715] [GN:ACRD] [OR:Escherichia coli]
[DE:ACRIFLAVIN RESISTANCE PROTEIN D] [SP:P24177:P77178:Q46715] [DB:swissprot]
>sp:[LN:E65022] [AC:E65022:C42959:S26997] [PN:acriflavin resistance protein acrD]
[GN:acrD] [CL:acriflavin resistance protein] [OR:Escherichia coli] [DB:pir2]
>gp:[GI:d1017073:g1799893] [LN:D90875] [AC:D90875:AB001340] [PN:envD gene product
homolog] [OR:Escherichia coli] [SR:Escherichia coli (strain:K12) DNA,
clone_lib:Kohara lambda minise] [DB:genpept-bct1] [DE:E.coli genomic DNA, Kohara
clone #422(55.5-55.8 min.).] [NT:similar to [PIR Accession Number C42959]]
[LE:10688] [RE:13801] [DI:direct] >gp:[GI:g1788814] [LN:AE000334]
[AC:AE000334:U00096] [PN:sensitivity to acriflavine, integral membrane] [GN:acrD]
[FN:putative transport; Drug/analog sensitivity] [OR:Escherichia coli]
[DB:genpept-bct2] [DE:Escherichia coli K-12 MG1655 section 224 of 400 of the
completegenome.] [NT:o1037; 1027 residues are 99 pct identical (1 gap)] [LE:112]
[RE:3225] [DI:direct]

| ORF_Name | NT ID | AA ID | NT/LN | AA/LN | Score | P-value |
|---|---|---|---|---|---|---|
| 36053410_c3_689 | 1980 | 9151 | 900 | 299 | 1307 | 2.6e-133 |

Description sp:[LN:B65023] [AC:B65023] [PN:hypothetical protein b2475] [OR:Escherichia coli]
[DB:pir2] >gp:[GI:g1788819] [LN:AE000334] [AC:AE000334:U00096] [PN:orf,
hypothetical protein] [GN:b2475] [FN:orf; Unknown] [OR:Escherichia coli]
[DB:genpept-bct2] [DE:Escherichia coli K-12 MG1655 section 224 of 400 of the
completegenome.] [NT:f287; This 287 aa ORF is 28 pct identical (6 gaps)]
[LE:8391] [RE:9254] [DI:complement]

| ORF_Name | NT ID | AA ID | NT/LN | AA/LN | Score | P-value |
|---|---|---|---|---|---|---|
| 36222256_c3_726 | 1981 | 9152 | 1098 | 365 | 1614 | 7.7e-166 |

Description sp:[LN:YFEG_ECOLI] [AC:P36547:P77451] [GN:YFEG] [OR:Escherichia coli] [DE:(ORF3)]
[SP:P36547:P77451] [DB:swissprot] >sp:[LN:D65018] [AC:D65018:C36964]
[PN:hypothetical transcription regulator hemF 3'-region] [GN:yfeG]
[OR:Escherichia coli] [DB:pir2] >gp:[GI:d1017049:g1799867] [LN:D90873]
[AC:D90873:AB001340] [GN:yfeG] [OR:Escherichia coli] [SR:Escherichia coli
(strain:K12) DNA, clone_lib:Kohara lambda minise] [DB:genpept-bct1] [DE:E.coli
genomic DNA, Kohara clone #420(54.9-55.2 min.).] [NT:similar to [SwissProt
Accession Number P36547]] [LE:8068] [RE:9120] [DI:complement]
>gp:[GI:d1017055:g1799874] [LN:D90874] [AC:D90874:AB001340] [GN:yfeG]
[OR:Escherichia coli] [SR:Escherichia coli (strain:K12) DNA, clone_lib:Kohara
lambda minise] [DB:genpept-bct1] [DE:E.coli genomic DNA, Kohara clone
421(55.1-55.5 min.).] [NT:similar to [SwissProt Accession Number P36547]]
[LE:964] [RE:2016] [DI:complement] >gp:[GI:g1788778] [LN:AE000331]
[AC:AE000331:U00096] [PN:putative ARAC-type regulatory protein] [GN:yfeG]
[FN:putative regulator; Not classified] [OR:Escherichia coli] [DB:genpept-bct2]
[DE:Escherichia coli K-12 MG1655 section 221 of 400 of the completegenome.]
[NT:f350; 99 pct identical to YFEG_ECOLI SW: P36547] [LE:1860] [RE:2912]
[DI:complement]

| ORF_Name | NT ID | AA ID | NT/LN | AA/LN | Score | P-value |
|---|---|---|---|---|---|---|
| 36366083_f3_357 | 1982 | 9153 | 2067 | 688 | 3329 | 0.0 |

Description gp:[GI:g3550417] [LN:AF085682] [AC:AF085682] [PN:polyphosphate kinase] [GN:ppk]
[OR:Salmonella typhimurium] [DB:genpept-bct2] [DE:Salmonella typhimurium
polyphosphate kinase (ppk) andexopolyphosphatase (ppx) genes, complete cds.]
[LE:432] [RE:2498] [DI:direct]

| ORF Name | NT ID | AA ID | NT LN | AA LN | Score | P-value |
|---|---|---|---|---|---|---|
| 36375068_c1_388 | 1983 | 9154 | 1263 | 420 | 520 | 6.6e-50 |

Description gp:[GI:g5532446] [LN:AF141323] [AC:AF141323] [PN:Int] [GN:int] [OR:Shigella
flexneri] [DB:genpept-bct2] [DE:Shigella flexneri SHI-2 pathogenicity island,
complete sequence.] [NT:CP4 phage family integrase] [LE:285] [RE:1469]
[DI:direct]

| ORF Name | NT ID | AA ID | NT LN | AA LN | Score | P-value |
|---|---|---|---|---|---|---|
| 3907777_f1_3 | 1984 | 9155 | 1059 | 352 | 1549 | 6.0e-159 |

Description gp:[GI:d1017009:g1799824] [LN:D90870] [AC:D90870:AB001340] [GN:yfeH]
[OR:Escherichia coli] [SR:Escherichia coli (strain:K12) DNA, clone_lib:Kohara
lambda minise] [DB:genpept-bct1] [DE:E.coli genomic DNA, Kohara clone
417(54.4-54.6 min.).] [NT:similar to [SwissProt Accession Number P39836];]
[LE:<6248] [RE:7270] [DI:direct]

| ORF Name | NT ID | AA ID | NT LN | AA LN | Score | P-value |
|---|---|---|---|---|---|---|
| 3964643_f2_154 | 1985 | 9156 | 1737 | 578 | 2778 | 3.5e-289 |

Description sp:[LN:PT1_SALTY] [AC:P12654] [GN:PTSI] [OR:Salmonella typhimurium] [EC:2.7.3.9]
[DE:(PHOSPHOTRANSFERASE SYSTEM, ENZYME I)] [SP:P12654] [DB:swissprot]
>sp:[LN:WQEBPI] [AC:A41027:D28181] [PN:phosphotransferase system enzyme I,:enzyme
I of the phosphotransferase system (cf. EC 2.7.1.69):phosphoenolpyruvate--protein
phosphotransferase] [GN:ptsI] [CL:phosphotransferase system enzyme
I:phosphotransferase system enzyme I homology] [OR:Salmonella typhimurium]
[EC:2.7.3.9] [DB:pir1] [MP:49 min] >gp:[GI:g153957] [LN:STYENZI] [AC:M76176]
[PN:enzyme I] [GN:ptsI] [FN:Bacterial Phosphotransferase System] [OR:Salmonella
typhimurium] [SR:Salmonella typhimurium (strain LT2) DNA] [DB:genpept-bct1]
[EC:2.7.3.9] [DE:S.typhimurium enzyme I (ptsI) gene, complete cds.] [NT:putative]
[LE:1] [RE:1728] [DI:direct]

| ORF Name | NT ID | AA ID | NT LN | AA LN | Score | P-value |
|---|---|---|---|---|---|---|
| 4026693_c3_679 | 1986 | 9157 | 1443 | 480 | 1688 | 1.1e-173 |

Description sp:[LN:JE0395] [AC:JE0395] [PN:phospho-beta-galactosidase I] [CL:Agrobacterium
beta-glucosidase] [OR:Lactobacillus gasseri] [DB:pir2] >gp:[GI:d1020901:g2114112]
[LN:AB003927] [AC:AB003927] [PN:phospho-beta-galactosidase 1] [GN:pbg1]
[OR:Lactobacillus gasseri] [SR:Lactobacillus gasseri (strain:JCM1031) DNA]
[DB:genpept-bct1] [DE:Lactobacillus gasseri DNA for phospho-beta-galactosidase
1,complete cds.] [LE:1] [RE:1449] [DI:direct]

| ORF Name | NT ID | AA ID | NT LN | AA LN | Score | P-value |
|---|---|---|---|---|---|---|
| 4111340_c1_510 | 1987 | 9158 | 2025 | 674 | 3159 | 0.0 |

Description sp:[LN:DNLJ_ECOLI] [AC:P15042] [GN:LIGA:LIG:DNAL:PDEC:LOP] [OR:Escherichia coli]
[EC:6.5.1.2] [DE:DNA LIGASE, (POLYDEOXYRIBONUCLEOTIDE SYNTHASE [NAD+])]
[SP:P15042] [DB:swissprot] >sp:[LN:LQECC6] [AC:B65015:JS0139] [PN:DNA ligase
(NAD+),:polydeoxyribonucleotide synthase (NAD+)] [GN:lig]
[CL:polydeoxyribonucleotide synthase (NAD+)] [OR:Escherichia coli] [EC:6.5.1.2]
[DB:pir1] [MP:52 min] >gp:[GI:g146613] [LN:ECOLIG] [AC:M24278] [GN:lig]
[OR:Escherichia coli] [SR:E.coli (strain K12) DNA] [DB:genpept-bct1] [DE:E.coli
DNA ligase (lig) gene, complete cds.] [NT:DNA ligase (EC 6.5.1.2)] [LE:246]
[RE:2261] [DI:direct] >gp:[GI:g1788750] [LN:AE000328] [AC:AE000328:U00096]
[PN:DNA ligase] [GN:lig] [FN:enzyme; DNA - replication, repair,] [OR:Escherichia
coli] [DB:genpept-bct2] [EC:6.5.1.2] [DE:Escherichia coli K-12 MG1655 section 218
of 400 of the completegenome.] [NT:f671; 100 pct identical to DNLJ_ECOLI SW:
P15042] [LE:9850] [RE:11865] [DI:complement]

| ORF Name | NT ID | AA ID | NT LN | AA LN | Score | P-value |
|---|---|---|---|---|---|---|
| 4304543_c3_754 | 1988 | 9159 | 441 | 146 | 755 | 8.2e-75 |

Description sp:[LN:SYE_ECOLI] [AC:P04805] [GN:GLTX] [OR:Escherichia coli] [EC:6.1.1.17]
[DE:(GLURS)] [SP:P04805] [DB:swissprot] >sp:[LN:SYECET] [AC:A25956:I41069:C65014]
[PN:glutamate--tRNA ligase,:glutamyl-tRNA synthetase] [GN:gltX]
[CL:glutamate--tRNA ligase:glutamine--tRNA ligase homology] [OR:Escherichia coli]
[EC:6.1.1.17] [DB:pir1] [MP:52 min] >gp:[GI:d1017000:g1799814] [LN:D90869]
[AC:D90869:AB001340] [PN:glutamate--tRNA ligase (EC 6.1.1.17)] [GN:gltX]
[OR:Escherichia coli] [SR:Escherichia coli (strain:K12) DNA, clone_lib:Kohara
lambda minise] [DB:genpept-bct1] [DE:E.coli genomic DNA, Kohara clone
416(54.1-54.5 min.).] [NT:similar to [PIR Accession Number A25956]] [LE:12101]
[RE:13516] [DI:complement] >gp:[GI:g41596] [LN:ECGLTXVA]
[AC:X63976:X55757:X63977] [PN:glutamyl-tRNA synthetase] [GN:gltX] [OR:Escherichia
coli] [DB:genpept-bct1] [DE:Escherichia coli K12 valU, gltX and alaW region.]
[SP:P04805] [LE:1877] [RE:3292] [DI:direct] >gp:[GI:g148256] [LN:ECOUXW]
[AC:M13687] [PN:glutamyl-tRNA synthetase] [GN:gltX] [OR:Escherichia coli]
[SR:Escherichia coli (sub_strain N99, strain K-12) DNA] [DB:genpept-bct1]
[DE:Escherichia coli alaW (transfer RNA-Ala), valU (transfer RNA-Valand transfer
RNA-Lys) operons and glutamyl-tRNA synthetase (gltX)gene, complete cds.]
[LE:1877] [RE:3292] [DI:direct] >gp:[GI:g1788743] [LN:AE000328]
[AC:AE000328:U00096] [PN:glutamate tRNA synthetase, catalytic subunit] [GN:gltX]
[FN:enzyme; Aminoacyl tRNA synthetases, tRNA] [OR:Escherichia coli]
[DB:genpept-bct2] [DE:Escherichia coli K-12 MG1655 section 218 of 400 of the
completegenome.] [NT:f471; 100 pct identical to SYE_ECOLI SW: P04805] [LE:946]
[RE:2361] [DI:complement]

| ORF Name | NT ID | AA ID | NT/LN | AA/LN | Score | P-value |
|---|---|---|---|---|---|---|
| 4333568_c1_474 | 1989 | 9160 | 669 | 222 | 1058 | 6.4e-107 |

Description gp:[GI:g3885925] [LN:AF093749] [AC:AF093749] [PN:putative carboxysome structural protein] [GN:eutL] [OR:Salmonella typhimurium] [DB:genpept-bct2] [DE:Salmonella typhimurium strain LT2 NADP+-linked malic enzyme (maeB),partial cds; insertion element IS200 transposase, complete cds; eutoperon, complete sequence; and unknown genes.] [NT:similar to Synechocystis PCC6803 CcmK class] [LE:14113] [RE:14772] [DI:direct]

| ORF Name | NT ID | AA ID | NT/LN | AA/LN | Score | P-value |
|---|---|---|---|---|---|---|
| 4337588_c2_532 | 1990 | 9161 | 387 | 128 | 183 | 3.4e-14 |

Description sp:[LN:A34172] [AC:A34172:S23002:A36042] [PN:traJ protein] [GN:traJ] [OR:Escherichia coli] [DB:pir2] >gp:[GI:g42785] [LN:ECRP4] [AC:X54459:S87583] [GN:traJ] [OR:Escherichia coli] [DB:genpept-bct1] [DE:E. coli plasmid RP4 traF (5'end), traG, traH, traI, traJ, traK,traL and traM genes of the transfer region.] [SP:P17909] [LE:4233] [RE:4604] [DI:complement] >gp:[GI:g455354] [LN:RP4TRAJ] [AC:J04942] [PN:relaxosome protein] [GN:traJ] [OR:Plasmid RP4] [SR:Plasmid RP4 DNA] [DB:genpept-bct1] [DE:Plasmid RP4 (from E.coli) relaxosome protein (traJ) gene, completecds.] [LE:25] [RE:396] [DI:complement] >gp:[GI:g886847] [LN:BINHYGDNA] [AC:Z37515] [PN:TraJ] [GN:traJ] [FN:relaxosome protein] [OR:synthetic construct] [DB:genpept-syn] [DE:Binary vector BinHygTOp aph4, tetA, tetR, traJ, insB, insA, aphA-3and trfA genes.] [LE:5558] [RE:5929] [DI:direct]

| ORF Name | NT ID | AA ID | NT/LN | AA/LN | Score | P-value |
|---|---|---|---|---|---|---|
| 4339088_f2_155 | 1991 | 9162 | 519 | 172 | 841 | 6.3e-84 |

Description sp:[LN:WQEB3T] [AC:A03405] [PN:phosphotransferase system enzyme II,, glucose-specific, factor III] [GN:crr] [CL:phosphotransferase system glucose-specific enzyme II, factor III:phosphotransferase system glucose-specific enzyme II, factor III homology] [OR:Salmonella typhimurium] [EC:2.7.1.69] [DB:pir1] [MP:48] >gp:[GI:g47658] [LN:STCRR] [AC:X05210] [OR:Salmonella typhimurium] [DB:genpept-bct1] [DE:Salmonella typhimurium crr gene for III(Glc) of PEP:glucosephosphotransferase system.] [NT:III(Glc) (crr) (AA 1 - 169)] [SP:P02908] [LE:206] [RE:715] [DI:direct]

| ORF Name | NT ID | AA ID | NT LN | AA LN | Score | P-value |
|---|---|---|---|---|---|---|
| 4394455_c3_690 | 1992 | 9163 | 2013 | 670 | 2196 | 1.6e-227 |

Description sp:[LN:YPFI_ECOLI] [AC:P76562:P76972] [GN:YPFI] [OR:Escherichia coli]
[DE:HYPOTHETICAL 74.9 KD PROTEIN IN DAPE-PURC INTERGENIC REGION]
[SP:P76562:P76972] [DB:swissprot] >sp:[LN:A65023] [AC:A65023] [PN:hypothetical
protein b2474] [OR:Escherichia coli] [DB:pir2] >gp:[GI:g1788818] [LN:AE000334]
[AC:AE000334:U00096] [PN:orf, hypothetical protein] [GN:ypfI] [FN:orf; Unknown]
[OR:Escherichia coli] [DB:genpept-bct2] [DE:Escherichia coli K-12 MG1655 section
224 of 400 of the completegenome.] [NT:f671; This 671 aa ORF is 38 pct identical
(13 gaps)] [LE:6361] [RE:8376] [DI:complement]

| ORF Name | NT ID | AA ID | NT LN | AA LN | Score | P-value |
|---|---|---|---|---|---|---|
| 4395443_f3_347 | 1993 | 9164 | 369 | 122 | 473 | 6.3e-45 |

Description sp:[LN:YFGD_ECOLI] [AC:P76569:P76978] [GN:YFGD] [OR:Escherichia coli]
[DE:HYPOTHETICAL 13.4 KD PROTEIN IN FOCB-URAA INTERGENIC REGION]
[SP:P76569:P76978] [DB:swissprot] >sp:[LN:F65025] [AC:F65025] [PN:hypothetical
protein b2495] [OR:Escherichia coli] [DB:pir2] >gp:[GI:g1788841] [LN:AE000336]
[AC:AE000336:U00096] [PN:putative oxidoreductase] [GN:b2495] [FN:putative enzyme;
Not classified] [OR:Escherichia coli] [DB:genpept-bct2] [DE:Escherichia coli K-12
MG1655 section 226 of 400 of the completegenome.] [NT:o119; This 119 aa ORF is 50
pct identical (0 gaps)] [LE:1621] [RE:1980] [DI:direct]

| ORF Name | NT ID | AA ID | NT LN | AA LN | Score | P-value |
|---|---|---|---|---|---|---|
| 4401943_c3_688 | 1994 | 9165 | 888 | 295 | 1342 | 5.1e-137 |

Description sp:[LN:DAPA_ECOLI] [AC:P05640:P78223] [GN:DAPA] [OR:Escherichia coli]
[EC:4.2.1.52] [DE:DIHYDRODIPICOLINATE SYNTHASE, (DHDPS)] [SP:P05640:P78223]
[DB:swissprot] >sp:[LN:SYECDP] [AC:E65023:A30381:S27165:A36146:Q00342]
[PN:dihydrodipicolinate synthase,] [GN:dapA] [CL:N-acetylneuraminate lyase]
[OR:Escherichia coli] [EC:4.2.1.52] [DB:pir1] [MP:53 min]
>gp:[GI:d1017084:g1799905] [LN:D90876] [AC:D90876:AB001340]
[PN:dihydrodipicolinate synthase (EC 4.2.1.52)] [GN:dapA] [OR:Escherichia coli]
[SR:Escherichia coli (strain:K12) DNA, clone_lib:Kohara lambda minise]
[DB:genpept-bct1] [DE:E.coli genomic DNA, Kohara clone #423(55.7-56.1 min.).]
[NT:similar to [PIR Accession Number A30381]] [LE:9832] [RE:10710]
[DI:complement] >gp:[GI:d1017094:g1805536] [LN:D90877] [AC:D90877:AB001340]
[PN:dihydrodipicolinate synthase (EC 4.2.1.52)] [GN:dapA] [OR:Escherichia coli]
[SR:Escherichia coli (strain:K12) DNA, clone_lib:Kohara lambda minise]
[DB:genpept-bct1] [DE:E.coli genomic DNA, Kohara clone #424(55.9-56.3 min.).]
[NT:similar to [PIR Accession Number A30381]] [LE:2572] [RE:3450] [DI:complement]
>gp:[GI:g1788823] [LN:AE000335] [AC:AE000335:U00096] [PN:dihydrodipicolinate
synthase] [GN:dapA] [FN:enzyme; Amino acid biosynthesis: Lysine] [OR:Escherichia
coli] [DB:genpept-bct2] [EC:4.2.1.52] [DE:Escherichia coli K-12 MG1655 section
225 of 400 of the completegenome.] [NT:f292; 97 pct identical to DAPA_ECOLI SW:
P05640] [LE:1188] [RE:2066] [DI:complement]

| ORF Name | NT ID | AA ID | NT LN | AA LN | Score | P-value |
|---|---|---|---|---|---|---|
| 4433318_f1_11 | 1995 | 9166 | 981 | 326 | 1571 | 2.8e-161 |

Description sp:[LN:SYECAC] [AC:E65015:F28181:S03094:JU0109:S78621] [PN:cysteine synthase, A:O-acetylserine (thiol)-lyase A:O-acetylserine sulfhydrolase A:protein SSI5] [GN:cysK] [CL:threonine dehydratase] [OR:Escherichia coli] [EC:4.2.99.8] [DB:pirl] [MP:52 min] >gp:[GI:g41201] [LN:ECCYSK] [AC:X12615] [PN:O-acetylserine sulfhydrylase (AA 1 - 323)] [OR:Escherichia coli] [DB:genpept-bct1] [DE:E. coli cysK gene for O-acetylserine sulfhydrylase.] [SP:P11096] [LE:777] [RE:1748] [DI:direct] >gp:[GI:g1788754] [LN:AE000329] [AC:AE000329:U00096] [PN:cysteine synthase A, O-acetylserine] [GN:cysK] [FN:enzyme; Amino acid biosynthesis: Cysteine] [OR:Escherichia coli] [DB:genpept-bct2] [EC:4.2.99.8] [DE:Escherichia coli K-12 MG1655 section 219 of 400 of the completegenome.] [NT:o323; 99 pct identical to 322 aa protein] [LE:2228] [RE:3199] [DI:direct]

| ORF Name | NT ID | AA ID | NT LN | AA LN | Score | P-value |
|---|---|---|---|---|---|---|
| 4494093_c1_464 | 1996 | 9167 | 849 | 282 | 1329 | 1.2e-135 |

Description sp:[LN:EUTJ_SALTY] [AC:P41794] [GN:EUTJ] [OR:Salmonella typhimurium] [DE:ETHANOLAMINE UTILIZATION PROTEIN EUTJ] [SP:P41794] [DB:swissprot] >gp:[GI:g687646] [LN:STU18560] [AC:U18560] [GN:eutJ] [OR:Salmonella typhimurium] [DB:genpept-bct1] [DE:Salmonella typhimurium ethanolamine utilization gene cluster,eutI', partial cds, and cchA, cchB, eutE, eutJ, eutG and eutHgenes, complete cds.] [LE:2889] [RE:3728] [DI:direct] >gp:[GI:g3885919] [LN:AF093749] [AC:AF093749] [PN:putative chaperonin] [GN:eutJ] [OR:Salmonella typhimurium] [DB:genpept-bct2] [DE:Salmonella typhimurium strain LT2 NADP+-linked malic enzyme (maeB),partial cds; insertion element IS200 transposase, complete cds; eutoperon, complete sequence; and unknown genes.] [NT:similar to Eshcerichia coli DnaK] [LE:7044] [RE:7883] [DI:direct]

| ORF Name | NT ID | AA ID | NT LN | AA LN | Score | P-value |
|---|---|---|---|---|---|---|
| 4790881_f3_358 | 1997 | 9168 | 1536 | 511 | 2302 | 9.6e-239 |

Description gp:[GI:g3550418] [LN:AF085682] [AC:AF085682] [PN:exopolyphosphatase] [GN:ppx] [OR:Salmonella typhimurium] [DB:genpept-bct2] [DE:Salmonella typhimurium polyphosphate kinase (ppk) andexopolyphosphatase (ppx) genes, complete cds.] [LE:2503] [RE:4044] [DI:direct]

| ORF Name | NT ID | AA ID | NT LN | AA LN | Score | P-value |
|---|---|---|---|---|---|---|
| 4817593_c1_486 | 1998 | 9169 | 1026 | 341 | 1670 | 9.0e-172 |

Description sp:[LN:CYSP_ECOLI] [AC:P16700] [GN:CYSP] [OR:Escherichia coli]
[DE:THIOSULFATE-BINDING PROTEIN PRECURSOR] [SP:P16700] [DB:swissprot]
>sp:[LN:JGECT] [AC:A35403:H65016] [PN:thiosulfate-binding protein cysP precursor]
[GN:cysP] [CL:sulfate-binding protein] [OR:Escherichia coli] [DB:pir1] [MP:52
min] >gp:[GI:d1017028:g1799844] [LN:D90871] [AC:D90871:AB001340]
[PN:thiosulfate-binding protein cysP precursor] [GN:cysP] [OR:Escherichia coli]
[SR:Escherichia coli (strain:K12) DNA, clone_lib:Kohara lambda minise]
[DB:genpept-bct1] [DE:E.coli genomic DNA, Kohara clone #418(54.6-54.9 min.).]
[NT:similar to [PIR Accession Number A35403]] [LE:10880] [RE:11896]
[DI:complement] >gp:[GI:d1017037:g1799854] [LN:D90872] [AC:D90872:AB001340]
[PN:thiosulfate-binding protein cysP precursor] [GN:cysP] [OR:Escherichia coli]
[SR:Escherichia coli (strain:K12) DNA, clone_lib:Kohara lambda minise]
[DB:genpept-bct1] [DE:E.coli genomic DNA, Kohara clone #419(54.7-55.1 min.).]
[NT:similar to [PIR Accession Number A35403]] [LE:5641] [RE:6657] [DI:complement]
>gp:[GI:g145658] [LN:ECOCYS] [AC:M32101:M38050] [PN:thiosulfate binding protein]
[GN:cysP] [OR:Escherichia coli] [SR:E.coli K12 DNA] [DB:genpept-bct1] [DE:E.coli
thiosulfate binding protein (cysP), sulfate permease (cysT,cysW, cysA) and
o-acetylserine (thiol)-lyase-B (cysM) genes,complete cds.] [LE:559] [RE:1575]
[DI:direct] >gp:[GI:g1788765] [LN:AE000330] [AC:AE000330.:U00096] [PN:thiosulfate
binding protein] [GN:cysP] [FN:transport; Transport of small molecules:]
[OR:Escherichia coli] [DB:genpept-bct2] [DE:Escherichia coli K-12 MG1655 section
220 of 400 of the completegenome.] [NT:f338; 100 pct identical to CYSP_ECOLI SW:
P16700] [LE:1076] [RE:2092] [DI:complement]

| ORF Name | NT ID | AA ID | NT LN | AA LN | Score | P-value |
|---|---|---|---|---|---|---|
| 5079818_c1_427 | 1999 | 9170 | 1044 | 347 | 1503 | 4.5e-154 |

Description sp:[LN:D65023] [AC:D65023:S25426:B36146] [PN:lipoprotein-34 precursor:lipoprotein
nlpB] [GN:nlpB] [OR:Escherichia coli] [DB:pir2] >gp:[GI:g1788822] [LN:AE000335]
[AC:AE000335:U00096] [PN:lipoprotein-34] [GN:nlpB] [FN:membrane; Macromolecule
synthesis,] [OR:Escherichia coli] [DB:genpept-bct2] [DE:Escherichia coli K-12
MG1655 section 225 of 400 of the completegenome.] [NT:f345; 100 pct identical to
NLPB_ECOLI SW: P21167] [LE:137] [RE:1174] [DI:complement]

| ORF Name | NT ID | AA ID | NT LN | AA LN | Score | P-value |
|---|---|---|---|---|---|---|
| 5085843_c3_662 | 2000 | 9171 | 207 | 68 | | |

Description

NO-HIT

| ORF Name | NT ID | AA ID | NT LN | AA LN | Score | P-value |
|---|---|---|---|---|---|---|
| 5136340_c1_515 | 2001 | 9172 | 195 | 64 | 71 | 0.025 |

Description sp:[LN:C72375] [AC:C72375] [PN:hypothetical protein] [GN:TM0450] [OR:Thermotoga maritima] [DB:pir2] >gp:[GI:g4980956] [LN:AE001723] [AC:AE001723:AE000512] [PN:hypothetical protein] [GN:TM0450] [OR:Thermotoga maritima] [DB:genpept-bct2] [DE:Thermotoga maritima section 35 of 136 of the complete genome.] [NT:similar to percent identity: 0.00; identified by] [LE:4635] [RE:4937] [DI:complement]

| ORF Name | NT ID | AA ID | NT LN | AA LN | Score | P-value |
|---|---|---|---|---|---|---|
| 5212877_c1_390 | 2002 | 9173 | 870 | 289 | 1161 | 7.8e-118 |

Description sp:[LN:A36134] [AC:A36134] [PN:RepA protein] [CL:regulatory protein RepI] [OR:Escherichia coli] [DB:pir2] >gp:[GI:g154647] [LN:TFEPTFFC2] [AC:M73777:M35249] [PN:replication protein A] [GN:repA] [OR:Plasmid pTF-FC2] [SR:Plasmid pTF-FC2 DNA] [DB:genpept-bct1] [DE:Plasmid pTF-FC2 replication protein A and C (repA and repC) genes,complete cds.] [LE:852] [RE:1724] [DI:direct]

| ORF Name | NT ID | AA ID | NT LN | AA LN | Score | P-value |
|---|---|---|---|---|---|---|
| 5273427_c2_640 | 2003 | 9174 | 936 | 311 | 1231 | 3.0e-125 |

Description sp:[LN:YFER_ECOLI] [AC:P77500] [GN:YFER] [OR:Escherichia coli] [DE:HYPOTHETICAL TRANSCRIPTIONAL REGULATOR IN XAPA-LIG INTERGENIC REGION] [SP:P77500] [DB:swissprot] >sp:[LN:H65014] [AC:H65014] [PN:hypothetical protein b2409] [CL:hypothetical protein b2409] [OR:Escherichia coli] [DB:pir2] >gp:[GI:d1017008:g1799823] [LN:D90870] [AC:D90870:AB001340] [GN:YYBE] [OR:Escherichia coli] [SR:Escherichia coli (strain:K12) DNA, clone_lib:Kohara lambda minise] [DB:genpept-bct1] [DE:E.coli genomic DNA, Kohara clone #417(54.4-54.6 min.).] [NT:similar to [SwissProt Accession Number P37499]] [LE:5256] [RE:6182] [DI:complement] >gp:[GI:g1788748] [LN:AE000328] [AC:AE000328:U00096] [PN:putative transcriptional regulator LYSR-type] [GN:yfeR] [FN:putative regulator; Not classified] [OR:Escherichia coli] [DB:genpept-bct2] [DE:Escherichia coli K-12 MG1655 section 218 of 400 of the completegenome.] [NT:f308] [LE:7619] [RE:8545] [DI:complement]

| ORF Name | NT ID | AA ID | NT LN | AA LN | Score | P-value |
|---|---|---|---|---|---|---|
| 6289053_c1_492 | 2004 | 9175 | 921 | 306 | 1486 | 2.8e-152 |

Description sp:[LN:CYSM_SALTY] [AC:P29848] [GN:CYSM] [OR:Salmonella typhimurium]
[EC:4.2.99.8] [DE:(O-ACETYLSERINE (THIOL)-LYASE B) (CSASE B)] [SP:P29848]
[DB:swissprot] >sp:[LN:S29567] [AC:S29567] [PN:cysteine synthase,] [CL:threonine
dehydratase] [OR:Salmonella typhimurium] [EC:4.2.99.8] [DB:pir2] >gp:[GI:g581757]
[LN:STCYSM] [AC:X59595] [PN:cysteine synthase] [GN:cysM] [OR:Salmonella
typhimurium] [DB:genpept-bct1] [EC:4.2.99.8] [DE:S.typhimurium cysM gene for
cysteine synthase.] [SP:P29848] [LE:423] [RE:1334] [DI:direct]

| ORF Name | NT ID | AA ID | NT LN | AA LN | Score | P-value |
|---|---|---|---|---|---|---|
| 6542260_c1_444 | 2005 | 9176 | 630 | 209 | 790 | 1.6e-78 |

Description sp:[LN:YFFH_ECOLI] [AC:P37128:P77255] [GN:YFFH] [OR:Escherichia coli]
[DE:HYPOTHETICAL 21.7 KD PROTEIN IN TKTB-NARQ INTERGENIC REGION]
[SP:P37128:P77255] [DB:swissprot] >sp:[LN:B65022] [AC:B65022] [PN:yffH protein]
[GN:yffH] [CL:yffH protein:mutT domain homology] [OR:Escherichia coli] [DB:pir1]
>gp:[GI:d1017070:g1799890] [LN:D90875] [AC:D90875:AB001340] [GN:yffH]
[OR:Escherichia coli] [SR:Escherichia coli (strain:K12) DNA, clone_lib:Kohara
lambda minise] [DB:genpept-bct1] [DE:E.coli genomic DNA, Kohara clone
422(55.5-55.8 min.).] [NT:similar to [SwissProt Accession Number P37128]]
[LE:5996] [RE:6571] [DI:complement] >gp:[GI:g1788810] [LN:AE000333]
[AC:AE000333:U00096] [PN:orf, hypothetical protein] [GN:yffH] [FN:orf; Unknown]
[OR:Escherichia coli] [DB:genpept-bct2] [DE:Escherichia coli K-12 MG1655 section
223 of 400 of the completegenome.] [NT:f192; 100 pct identical to fragment
YFFH_ECOLI] [LE:6946] [RE:7521] [DI:complement]

| ORF Name | NT ID | AA ID | NT LN | AA LN | Score | P-value |
|---|---|---|---|---|---|---|
| 7069456_c1_482 | 2006 | 9177 | 447 | 148 | 708 | 7.9e-70 |

Description sp:[LN:A65018] [AC:A65018] [PN:hypothetical protein b2434] [OR:Escherichia coli]
[DB:pir2] >gp:[GI:g1788774] [LN:AE000330] [AC:AE000330:U00096] [PN:orf,
hypothetical protein] [GN:b2434] [FN:orf; Unknown] [OR:Escherichia coli]
[DB:genpept-bct2] [DE:Escherichia coli K-12 MG1655 section 220 of 400 of the
completegenome.] [NT:f178; This 178 aa ORF is 26 pct identical (11 gaps)]
[LE:10277] [RE:10813] [DI:complement]

| ORF Name | NT ID | AA ID | NT LN | AA LN | Score | P-value |
|---|---|---|---|---|---|---|
| 7160206_c2_543 | 2007 | 9178 | 1032 | 343 | 329 | 1.1e-29 |

Description sp:[LN:E69905] [AC:E69905] [PN:transcription regulator LysR family homolog yofA]
[GN:yofA] [CL:Pseudomonas putida regulatory protein catR] [OR:Bacillus subtilis]
[DB:pir2] >gp:[GI:e1183500:g2634225] [LN:BSUB0010] [AC:Z99113:AL009126] [GN:yofA]
[FN:unknown] [OR:Bacillus subtilis] [DB:genpept-bct1] [DE:Bacillus subtilis
complete genome (section 10 of 21): from 1781201to 2014980.] [NT:similar to
transcriptional regulator (LysR family)] [LE:224597] [RE:225454] [DI:complement]
>gp:[GI:e1185315:g2634236] [LN:BSUB0011] [AC:Z99114:AL009126] [GN:yofA]
[FN:unknown] [OR:Bacillus subtilis] [DB:genpept-bct1] [DE:Bacillus subtilis
complete genome (section 11 of 21): from 2000171to 2207900.] [NT:similar to
transcriptional regulator (LysR family)] [LE:5627] [RE:6484] [DI:complement]

| ORF Name | NT ID | AA ID | NT LN | AA LN | Score | P-value |
|---|---|---|---|---|---|---|
| 7235936_c1_389 | 2008 | 9179 | 249 | 82 | 86 | 0.00064 |

Description sp:[LN:Y9K_BPP4] [AC:P12552] [OR:Bacteriophage P4] [DE:HYPOTHETICAL 9.7 KD
PROTEIN (ORF88) (PUTATIVE DNA-BINDING PROTEIN)] [SP:P12552] [DB:swissprot]
>sp:[LN:JW0029] [AC:JW0029] [PN:hypothetical 9.7K protein:orf88 protein:orf88
protein] [CL:Escherichia coli prophage cp4-57 regulatory protein alpA]
[OR:satellite phage P4] [DB:pir2] >gp:[GI:g15163] [LN:MYP4CG] [AC:X51522]
[OR:Bacteriophage P4] [DB:genpept-phg] [DE:Bacteriophage P4 complete DNA genome.]
[NT:ORF88 product (AA 1-88) (put. DNA-binding protein)] [SP:P12552] [LE:8764]
[RE:9030] [DI:complement] >gp:[GI:g15171] [LN:MYP4ER] [AC:X02534:M11913:M11914]
[OR:Bacteriophage P4] [DB:genpept-phg] [DE:Bacteriophage P4 (E.coli) essential
region DNA ( early genes).] [NT:unidentified reading frame (aa 1-88)] [SP:P12552]
[LE:2041] [RE:2307] [DI:direct]

| ORF Name | NT ID | AA ID | NT LN | AA LN | Score | P-value |
|---|---|---|---|---|---|---|
| 7242186_f2_255 | 2009 | 9180 | 810 | 269 | 292 | 9.5e-26 |

Description sp:[LN:TRBJ_RHISN] [AC:P55400] [GN:TRBJ:Y4DA] [OR:Rhizobium sp] [SR:,strain
NGR234] [DE:PROBABLE CONJUGAL TRANSFER PROTEIN TRBJ] [SP:P55400] [DB:swissprot]
>gp:[GI:g2182343] [LN:AE000068] [AC:AE000068:U00090] [PN:TrbJ] [GN:trbJ]
[OR:Rhizobium sp. NGR234] [DB:genpept-bct2] [DE:Rhizobium sp. NGR234 plasmid
pNGR234a, section 5 of 46 of thecomplete plasmid sequence.] [NT:probable conjugal
transfer protein] [LE:13320] [RE:14123] [DI:direct]

| ORF Name | NT ID | AA ID | NT LN | AA LN | Score | P-value |
|---|---|---|---|---|---|---|
| 911308_c3_700 | 2010 | 9181 | 2028 | 675 | 2692 | 4.5e-280 |

Description gp:[GI:d1017071:g1799891] [LN:D90875] [AC:D90875:AB001340] [GN:yffG]
[OR:Escherichia coli] [SR:Escherichia coli (strain:K12) DNA, clone_lib:Kohara
lambda minise] [DB:genpept-bct1] [DE:E.coli genomic DNA, Kohara clone
422(55.5-55.8 min.).] [NT:similar to [SwissProt Accession Number P37127];]
[LE:6639] [RE:>8654] [DI:complement]

| ORF Name | NT ID | AA ID | NT LN | AA LN | Score | P-value |
|---|---|---|---|---|---|---|
| 985965_c2_535 | 2011 | 9182 | 1770 | 589 | | |

Description

NO-HIT

| ORF Name | NT ID | AA ID | NT LN | AA LN | Score | P-value |
|---|---|---|---|---|---|---|
| 10410666_f2_178 | 2012 | 9183 | 348 | 115 | 403 | 1.6e-37 |

Description sp:[LN:YGHW_ECOLI] [AC:Q46848] [GN:YGHW] [OR:Escherichia coli] [DE:HYPOTHETICAL
10.9 KD PROTEIN IN HYBA-EXBD INTERGENIC REGION] [SP:Q46848] [DB:swissprot]
>sp:[LN:D65086] [AC:D65086] [PN:hypothetical protein b2998] [OR:Escherichia coli]
[DB:pir2] >gp:[GI:g882527] [LN:ECU28377] [AC:U28377] [OR:Escherichia coli]
[DB:genpept-bct1] [DE:Escherichia coli K-12 genome; approximately 65 to 68
minutes.] [NT:ORF_f95] [LE:100838] [RE:101125] [DI:complement] >gp:[GI:g1789372]
[LN:AE000382] [AC:AE000382:U00096] [PN:orf, hypothetical protein] [GN:b2998]
[FN:orf; Unknown] [OR:Escherichia coli] [DB:genpept-bct2] [DE:Escherichia coli
K-12 MG1655 section 272 of 400 of the completegenome.] [NT:f95; This 95 aa ORF is
27 pct identical (8 gaps)] [LE:7880] [RE:8167] [DI:complement]

| ORF Name | NT ID | AA ID | NT LN | AA LN | Score | P-value |
|---|---|---|---|---|---|---|
| 10969202_c1_278 | 2013 | 9184 | 1377 | 458 | 960 | 1.6e-96 |

Description gp:[GI:g765097] [LN:ERWCRTS] [AC:M87280:M99707] [OR:Erwinia herbicola]
[SR:Erwinia herbicola (strain Eho10) DNA] [DB:genpept-bct1] [DE:Erwinia herbicola
geranylgeranyl pyrophosphate synthase (crtE),zeaxanthin glucosyl transferase
(crtX), lycopene cyclase (crtY),phytoene dehydogenase (crtI), phytoene synthase
(crtB), andbeta-carotene hydroxylase (crtZ) genes, complete cds.]
[NT:transcription must start in the vector; putative] [LE:10916] [RE:>12753]
[DI:complement]

| ORF Name | NT ID | AA ID | NT/LN | AA/LN | Score | P-value |
|---|---|---|---|---|---|---|
| 11017132_c1_350 | 2014 | 9185 | 1308 | 435 | 1890 | 4.4e-195 |

Description sp:[LN:CCA_ECOLI] [AC:P06961] [GN:CCA] [OR:Escherichia coli] [EC:2.7.7.25]
[DE:(TRNA CCA-PYROPHOSPHORYLASE) (CCA-ADDING ENZYME)] [SP:P06961] [DB:swissprot]
>sp:[LN:RNECTA] [AC:A25215:F65093] [PN:tRNA adenylyltransferase,:tRNA
CCA-pyrophosphorylase:tRNA nucleotidyltransferase] [GN:cca] [CL:Escherichia coli
tRNA adenylyltransferase] [OR:Escherichia coli] [EC:2.7.7.25] [DB:pir1] [MP:67
min] >gp:[GI:g145468] [LN:ECOCCA] [AC:M12788] [PN:tRNA nucleotidyltransferase]
[GN:cca] [OR:Escherichia coli] [SR:E.coli DNA, clones lambda-c[1,4,11]]
[DB:genpept-bct1] [EC:2.7.7.25] [DE:E.coli cca gene encoding tRNA
nucleotidyltransferase, complete cds.] [LE:450] [RE:1688] [DI:direct]
>gp:[GI:g882578] [LN:ECU28379] [AC:U28379] [GN:cca] [PN:tRNA
nucleotidyltransferase] [OR:Escherichia coli] [DB:genpept-bct1] [EC:2.7.7.25]
[DE:Escherichia coli K-12 genome; approximately 68 minutes.] [NT:CG Site No. 933]
[LE:6686] [RE:7924] [DI:direct] >gp:[GI:g1789436] [LN:AE000387]
[AC:AE000387:U00096] [PN:tRNA nucleotidyl transferase] [GN:cca] [FN:enzyme;
Aminoacyl tRNA synthetases, tRNA] [OR:Escherichia coli] [DB:genpept-bct2]
[EC:2.7.7.25] [DE:Escherichia coli K-12 MG1655 section 277 of 400 of the
completegenome.] [NT:o412; 100 pct identical to CCA_ECOLI SW: P06961; CG]
[LE:6811] [RE:8049] [DI:direct]

| ORF Name | NT ID | AA ID | NT/LN | AA/LN | Score | P-value |
|---|---|---|---|---|---|---|
| 11815805_f3_270 | 2015 | 9186 | 1146 | 381 | 176 | 7.9e-13 |

Description sp:[LN:H72594] [AC:H72594] [PN:hypothetical protein APE1225] [GN:APE1225]
[OR:Aeropyrum pernix] [DB:pir2] >gp:[GI:d1044000:g5104900] [LN:AP000061]
[AC:AP000061] [PN:217aa long hypothetical protein] [GN:APE1225] [OR:Aeropyrum
pernix] [SR:Aeropyrum pernix (strain:K1) DNA] [DB:genpept-bct1] [DE:Aeropyrum
pernix genomic DNA, section 4/7.] [LE:57908] [RE:58561] [DI:complement]

| ORF Name | NT ID | AA ID | NT/LN | AA/LN | Score | P-value |
|---|---|---|---|---|---|---|
| 11875431_c3_487 | 2016 | 9187 | 663 | 220 | 501 | 6.8e-48 |

Description gp:[GI:g4105359] [LN:AF045240] [AC:AF045240] [PN:unknown] [OR:Staphylococcus
epidermidis] [DB:genpept-bct2] [DE:Staphylococcus epidermidis plasmid pIP1629
mobilization protein(mobC1), (orf69-1), (mobA1), (mobB1), and (orf38-1) genes,
andreplication protein (rep1) gene, complete cds.] [NT:orf200] [LE:5170]
[RE:5772] [DI:direct] >gp:[GI:g4105367] [LN:AF045241] [AC:AF045241] [PN:unknown]
[OR:Staphylococcus epidermidis] [DB:genpept-bct2] [DE:Staphylococcus epidermidis
plasmid pIP1630, mobilization protein(mobC1), (orf69-1), (mobA1), (mobB1), and
(orf38-1) genes, andreplication protein (rep1) gene, complete cds.] [NT:orf200]
[LE:4794] [RE:5396] [DI:direct]

| ORF Name | NT ID | AA ID | NT/LN | AA/LN | Score | P-value |
|---|---|---|---|---|---|---|
| 11882677_c2_450 | 2017 | 9188 | 783 | 260 | 630 | 1.4e-61 |

Description sp:[LN:YGIH_ECOLI] [AC:P31056] [GN:YGIH] [OR:Escherichia coli] [DE:HYPOTHETICAL
22.2 KD PROTEIN IN BACA-TTDA INTERGENIC REGION (O205)] [SP:P31056] [DB:swissprot]
>sp:[LN:A65094] [AC:A65094] [PN:ygiH protein] [GN:ygiH] [CL:Escherichia coli ygiH
protein] [OR:Escherichia coli] [DB:pir1] >gp:[GI:g882581] [LN:ECU28379]
[AC:U28379] [OR:Escherichia coli] [DB:genpept-bct1] [DE:Escherichia coli K-12
genome; approximately 68 minutes.] [NT:alternate name ygiH; ORF_o205] [LE:9489]
[RE:10106] [DI:direct] >gp:[GI:g1789439] [LN:AE000387] [AC:AE000387:U00096]
[PN:orf, hypothetical protein] [GN:ygiH] [FN:orf; Unknown] [OR:Escherichia coli]
[DB:genpept-bct2] [DE:Escherichia coli K-12 MG1655 section 277 of 400 of the
completegenome.] [NT:o205; N-ter of this 205 aa ORF is 100 pct identical]
[LE:9614] [RE:10231] [DI:direct]

| ORF Name | NT ID | AA ID | NT/LN | AA/LN | Score | P-value |
|---|---|---|---|---|---|---|
| 12791465_c3_557 | 2018 | 9189 | 243 | 80 | 351 | 5.3e-32 |

Description sp:[LN:YGIH_ECOLI] [AC:P31056] [GN:YGIH] [OR:Escherichia coli] [DE:HYPOTHETICAL
22.2 KD PROTEIN IN BACA-TTDA INTERGENIC REGION (O205)] [SP:P31056] [DB:swissprot]
>sp:[LN:A65094] [AC:A65094] [PN:ygiH protein] [GN:ygiH] [CL:Escherichia coli ygiH
protein] [OR:Escherichia coli] [DB:pir1] >gp:[GI:g882581] [LN:ECU28379]
[AC:U28379] [OR:Escherichia coli] [DB:genpept-bct1] [DE:Escherichia coli K-12
genome; approximately 68 minutes.] [NT:alternate name ygiH; ORF_o205] [LE:9489]
[RE:10106] [DI:direct] >gp:[GI:g1789439] [LN:AE000387] [AC:AE000387:U00096]
[PN:orf, hypothetical protein] [GN:ygiH] [FN:orf; Unknown] [OR:Escherichia coli]
[DB:genpept-bct2] [DE:Escherichia coli K-12 MG1655 section 277 of 400 of the
completegenome.] [NT:o205; N-ter of this 205 aa ORF is 100 pct identical]
[LE:9614] [RE:10231] [DI:direct]

| ORF Name | NT ID | AA ID | NT/LN | AA/LN | Score | P-value |
|---|---|---|---|---|---|---|
| 12976040_c3_537 | 2019 | 9190 | 822 | 273 | 1033 | 2.9e-104 |

Description sp:[LN:YGIB_ECOLI] [AC:P24195] [GN:YGIB] [OR:Escherichia coli] [DE:(O234)]
[SP:P24195] [DB:swissprot] >sp:[LN:S22360] [AC:S22360:C65091] [PN:hypothetical
protein D] [GN:ygiB] [OR:Escherichia coli] [DB:pir2] >gp:[GI:g146677]
[LN:ECOLUXH] [AC:M77129] [OR:Escherichia coli] [SR:Escherichia coli (strain K-12)
DNA] [DB:genpept-bct1] [DE:E.coli luxH gene, complete cds; ORFA-ORFD, complete
cds.] [NT:ORFD] [LE:118] [RE:822] [DI:direct] >gp:[GI:g882567] [LN:ECU28377]
[AC:U28377] [OR:Escherichia coli] [DB:genpept-bct1] [DE:Escherichia coli K-12
genome; approximately 65 to 68 minutes.] [NT:ORF_o234; alternate name ygiB; orfD
of M77129] [LE:134099] [RE:134803] [DI:direct] >gp:[GI:g1789415] [LN:AE000385]
[AC:AE000385:U00096] [PN:orf, hypothetical protein] [GN:ygiB] [FN:orf; Unknown]
[OR:Escherichia coli] [DB:genpept-bct2] [DE:Escherichia coli K-12 MG1655 section
275 of 400 of the completegenome.] [NT:o234; 100 pct identical to YGIB_ECOLI SW:
P24195] [LE:7371] [RE:8075] [DI:direct]

| ORF Name | NT ID | AA ID | NT/LN | AA/LN | Score | P-value |
|---|---|---|---|---|---|---|
| 13671893_f2_137 | 2020 | 9191 | 621 | 206 | 880 | 4.7e-88 |

Description sp:[LN:RIBB_ECOLI] [AC:P24199] [GN:RIBB:HTRP] [OR:Escherichia coli]
[DE:3,4-DIHYDROXY-2-BUTANONE 4-PHOSPHATE SYNTHASE (DHBP SYNTHASE)] [SP:P24199]
[DB:swissprot] >gp:[GI:g455174] [LN:ECOLUXH] [AC:M77129] [GN:luxH]
[OR:Escherichia coli] [SR:Escherichia coli (strain K-12) DNA] [DB:genpept-bct1]
[DE:E.coli luxH gene, complete cds; ORFA-ORFD, complete cds.] [LE:4220] [RE:4873]
[DI:complement] >gp:[GI:g49100] [LN:ECRIBB] [AC:X66720:S37783]
[PN:3,4-dihydroxy-2-butanone 4-phosphate synthase] [GN:ribB] [OR:Escherichia
coli] [DB:genpept-bct1] [DE:E.coli ribB gene for 3,4-dihydroxy-2-butanone
4-phosphate synthase.] [SP:P24199] [LE:638] [RE:1291] [DI:direct]
>gp:[GI:g882571] [LN:ECU28377] [AC:U28377] [PN:3,4-dihydroxy-2-butanone
4-phosphate synthase] [GN:ribB] [FN:block before 6,7-dimethyl-8-ribityllumazine]
[OR:Escherichia coli] [DB:genpept-bct1] [DE:Escherichia coli K-12 genome;
approximately 65 to 68 minutes.] [NT:CG Site No. 286; alternate names htrP, luxH]
[LE:138201] [RE:138854] [DI:complement] >gp:[GI:g1789420] [LN:AE000386]
[AC:AE000386:U00096] [PN:3,4 dihydroxy-2-butanone-4-phosphate synthase] [GN:ribB]
[FN:enzyme; Biosynthesis of cofactors, carriers:] [OR:Escherichia coli]
[DB:genpept-bct2] [DE:Escherichia coli K-12 MG1655 section 276 of 400 of the
completegenome.] [NT:f217; 100 pct identical to RIBB_ECOLI SW: P24199;] [LE:1351]
[RE:2004] [DI:complement]

| ORF Name | NT ID | AA ID | NT/LN | AA/LN | Score | P-value |
|---|---|---|---|---|---|---|
| 14867160_c1_276 | 2021 | 9192 | 192 | 63 | | |

Description

NO-HIT

| ORF Name | NT ID | AA ID | NT/LN | AA/LN | Score | P-value |
|---|---|---|---|---|---|---|
| 14885165_c2_378 | 2022 | 9193 | 297 | 98 | 504 | 3.3e-48 |

Description sp:[LN:IEECE9] [AC:D93826:D93117:S40544:A04462] [PN:hypothetical protein, 11K]
[CL:Escherichia coli insertion sequence IS1 hypothetical 11K protein]
[OR:Escherichia coli] [DB:pir1]

| ORF Name | NT ID | AA ID | NT/LN | AA/LN | Score | P-value |
|---|---|---|---|---|---|---|
| 15133557_c3_474 | 2023 | 9194 | 231 | 76 | 106 | 4.9e-06 |

Description gp:[GI:g5532459] [LN:AF141323] [AC:AF141323] [PN:ShiE] [GN:shiE] [OR:Shigella
flexneri] [DB:genpept-bct2] [DE:Shigella flexneri SHI-2 pathogenicity island,
complete sequence.] [LE:12113] [RE:12643] [DI:direct]

| ORF Name | NT ID | AA ID | NT LN | AA LN | Score | P-value |
|---|---|---|---|---|---|---|
| 16072206_c3_570 | 2024 | 9195 | 759 | 252 | 902 | 2.2e-90 |

Description sp:[LN:PRIM_ECOLI] [AC:P02923:P02922] [GN:DNAG:DNAP:PARB] [OR:Escherichia coli] [EC:2.7.7.-] [DE:DNA PRIMASE,] [SP:P02923:P02922] [DB:swissprot] >sp:[LN:RYEC2] [AC:A03423:H65094:A03422:I77532] [PN:DNA primase,] [GN:dnaG] [CL:DNA primase] [OR:Escherichia coli] [EC:2.7.7.-] [DB:pirl] [MP:67 min] >gp:[GI:g1617301] [LN:ECDNAG] [AC:V00274] [PN:DNA primase] [OR:Escherichia coli] [DB:genpept-bct1] [DE:E. coli dnaG gene.] [SP:P02923] [LE:182] [RE:1927] [DI:direct] >gp:[GI:g147755] [LN:ECORPSRPO] [AC:J01687] [GN:dnaG] [OR:Escherichia coli] [SR:Escherichia coli K12 and HB101 DNA] [DB:genpept-bct1] [DE:E.coli rpsU-dnaG-rpoD operon with genes coding for ribosomalprotein S21, DNA primase and RNA polymerase sigma-subunit.] [NT:DNA primase] [LE:1041] [RE:2786] [DI:direct] >gp:[GI:g882589] [LN:ECU28379] [AC:U28379] [GN:dnaG] [FN:DNA biosynthesis; primase] [OR:Escherichia coli] [DB:genpept-bct1] [DE:Escherichia coli K-12 genome; approximately 68 minutes.] [NT:CG Site No. 847; alternate gen name dnaP, parB] [LE:15902] [RE:17647] [DI:direct] >gp:[GI:g1789447] [LN:AE000388] [AC:AE000388:U00096] [PN:DNA biosynthesis; DNA primase] [GN:dnaG] [FN:enzyme; DNA - replication, repair,] [OR:Escherichia coli] [DB:genpept-bct2] [EC:2.7.7.-] [DE:Escherichia coli K-12 MG1655 section 278 of 400 of the completegenome.] [NT:o581; 100 pct identical to PRIM_ECOLI SW: P02923;] [LE:4778] [RE:6523] [DI:direct]

| ORF Name | NT ID | AA ID | NT LN | AA LN | Score | P-value |
|---|---|---|---|---|---|---|
| 16219775_c2_472 | 2025 | 9196 | 483 | 161 | 77 | 0.0096 |

Description sp:[LN:TAT_CAEVG] [AC:P21125] [GN:TAT] [OR:Caprine arthritis encephalitis virus] [SR:,strain G63:CAEV] [DE:TRANS-ACTIVATING TRANSCRIPTIONAL REGULATORY PROTEIN (PROTEIN S)] [SP:P21125] [DB:swissprot] >gp:[GI:g323287] [LN:CEACAEVB] [AC:M34093:M33675] [OR:Caprine arthritis-encephalitis virus] [SR:Caprine arthritis-encephalitis lentivirus (strain G63) RNA, fro] [DB:genpept-vrl] [DE:Caprine arthritis-encephalitis lentivirus tat protein gene,complete cds.] [NT:tat protein] [LE:1] [RE:264] [DI:direct]

| ORF Name | NT ID | AA ID | NT LN | AA LN | Score | P-value |
|---|---|---|---|---|---|---|
| 16275125_c3_505 | 2026 | 9197 | 738 | 245 | 131 | 2.6e-07 |

Description gp:[GI:g1128979] [LN:ECOTOLQRA] [AC:M16489] [OR:Escherichia coli] [SR:Escherichia coli DNA] [DB:genpept-bct1] [DE:Escherichia coli tolQRA gene cluster DNA.] [NT:ORF 4; putative] [LE:627] [RE:1199] [DI:complement]

| ORF Name | NT ID | AA ID | NT/LN | AA/LN | Score | P-value |
|---|---|---|---|---|---|---|
| 16494757_c1_281 | 2027 | 9198 | 468 | 155 | 119 | 3.3e-07 |

Description sp:[LN:S29309] [AC:S29309] [PN:hypothetical protein 4 (phaC2 3' region)]
[OR:Pseudomonas aeruginosa] [DB:pir2]

| ORF Name | NT ID | AA ID | NT/LN | AA/LN | Score | P-value |
|---|---|---|---|---|---|---|
| 16525702_c2_463 | 2028 | 9199 | 1899 | 632 | 2983 | 0.0 |

Description sp:[LN:RPSD_ECOLI] [AC:P00579] [GN:RPOD:ALT] [OR:Escherichia coli] [DE:RNA
POLYMERASE SIGMA FACTOR RPOD (SIGMA-70)] [SP:P00579] [DB:swissprot]
>sp:[LN:RNECS] [AC:A65095:A00699] [PN:transcription initiation factor sigma
70:DNA-directed RNA polymerase sigma chain:major sigma factor:transcriptase sigma
chain] [GN:rpoD] [CL:transcription initiation factor sigma 70:transcription
initiation factor sigma katF homology:transcription initiation factor sigma
region 1 homology] [OR:Escherichia coli] [DB:pir1] [MP:67 min] >gp:[GI:g882590]
[LN:ECU28379] [AC:U28379] [GN:rpoD] [FN:RNA polymerase, sigma-70 subunit]
[OR:Escherichia coli] [DB:genpept-bct1] [DE:Escherichia coli K-12 genome;
approximately 68 minutes.] [NT:CG Site No. 231; alternate gene name alt]
[LE:17842] [RE:19683] [DI:direct] >gp:[GI:g1789448] [LN:AE000388]
[AC:AE000388:U00096] [PN:RNA polymerase, sigma(70) factor; regulation of]
[GN:rpoD] [FN:factor; Global regulatory functions] [OR:Escherichia coli]
[DB:genpept-bct2] [DE:Escherichia coli K-12 MG1655 section 278 of 400 of the
completegenome.] [NT:o613; 99 pct identical to RP70_ECOLI SW: P00579; CG]
[LE:6718] [RE:8559] [DI:direct]

| ORF Name | NT ID | AA ID | NT/LN | AA/LN | Score | P-value |
|---|---|---|---|---|---|---|
| 16538567_f1_32 | 2029 | 9200 | 1011 | 336 | 1428 | 4.0e-146 |

Description sp:[LN:GLNE_ECOLI] [AC:P30870:P78107] [GN:GLNE] [OR:Escherichia coli]
[EC:2.7.7.42] [DE:SYNTHETASE ADENYLYLTRANSFERASE] (ATASE)] [SP:P30870:P78107]
[DB:swissprot] >sp:[LN:C65093] [AC:C65093:S37755:S31965]
[PN:[glutamate--ammonia-ligase] adenylyltransferase,] [GN:glnE] [OR:Escherichia
coli] [EC:2.7.7.42] [DB:pir2] >gp:[GI:g1789433] [LN:AE000387]
[AC:AE000387:U00096] [PN:adenylylating enzyme for glutamine synthetase] [GN:glnE]
[FN:enzyme; Proteins - translation and] [OR:Escherichia coli] [DB:genpept-bct2]
[EC:2.7.7.42] [DE:Escherichia coli K-12 MG1655 section 277 of 400 of the
completegenome.] [NT:f946; 99 pct identical (1 gap) to GLNE_ECOLI] [LE:1721]
[RE:4561] [DI:complement]

| ORF Name | NT ID | AA ID | NT/LN | AA/LN | Score | P-value |
|---|---|---|---|---|---|---|
| 16829205_f2_174 | 2030 | 9201 | 432 | 143 | 644 | 4.8e-63 |

Description sp:[LN:EXBD_ECOLI] [AC:P18784] [GN:EXBD] [OR:Escherichia coli] [DE:BIOPOLYMER
TRANSPORT EXBD PROTEIN] [SP:P18784] [DB:swissprot] >sp:[LN:BVECED]
[AC:JV0030:C65087] [PN:biopolymer transport exbD protein] [GN:exbD] [CL:tolR
protein] [OR:Escherichia coli] [DB:pir1] [MP:65 min] >gp:[GI:g145869]
[LN:ECOEXBBD] [AC:M28819] [OR:Escherichia coli] [SR:E.coli DNA] [DB:genpept-bct1]
[DE:E.coli exbB and exbD genes encoding biopolymer transport proteins,complete
cds.] [NT:exbD peptide] [LE:1323] [RE:1748] [DI:direct] >gp:[GI:g882534]
[LN:ECU28377] [AC:U28377] [GN:exbD] [OR:Escherichia coli] [DB:genpept-bct1]
[DE:Escherichia coli K-12 genome; approximately 65 to 68 minutes.] [LE:105206]
[RE:105631] [DI:complement] >gp:[GI:g1789380] [LN:AE000383] [AC:AE000383:U00096]
[PN:uptake of enterochelin; tonB-dependent uptake of] [GN:exbD] [FN:transport;
Transport of small molecules:] [OR:Escherichia coli] [DB:genpept-bct2]
[DE:Escherichia coli K-12 MG1655 section 273 of 400 of the completegenome.]
[NT:f141; 100 pct identical to EXBD_ECOLI SW: P18784] [LE:1282] [RE:1707]
[DI:complement]

| ORF Name | NT ID | AA ID | NT/LN | AA/LN | Score | P-value |
|---|---|---|---|---|---|---|
| 16847907_f3_225 | 2031 | 9202 | 1572 | 523 | 1377 | 1.0e-140 |

Description sp:[LN:YGIF_ECOLI] [AC:P30871] [GN:YGIF] [OR:Escherichia coli] [DE:HYPOTHETICAL
48.4 KD PROTEIN IN GLNE-CCA INTERGENIC REGION (ORFXE)] [SP:P30871] [DB:swissprot]
>sp:[LN:S37754] [AC:S37754:D65093:S31964] [PN:ygiF protein] [GN:ygiF]
[OR:Escherichia coli] [DB:pir2] >gp:[GI:g49399] [LN:ECORFXEA] [AC:Z21844]
[GN:orfXE] [OR:Escherichia coli] [DB:genpept-bct1] [DE:E.coli orfXE gene.]
[NT:open reading frame upstream glnE] [SP:P30871] [LE:63] [RE:1364] [DI:direct]
>gp:[GI:g1789434] [LN:AE000387] [AC:AE000387:U00096] [PN:orf, hypothetical
protein] [GN:ygiF] [FN:orf; Unknown] [OR:Escherichia coli] [DB:genpept-bct2]
[DE:Escherichia coli K-12 MG1655 section 277 of 400 of the completegenome.]
[NT:f433] [LE:4584] [RE:5885] [DI:complement]

| ORF Name | NT ID | AA ID | NT/LN | AA/LN | Score | P-value |
|---|---|---|---|---|---|---|
| 16891325_c2_386 | 2032 | 9203 | 366 | 121 | | |

Description

NO-HIT

| ORF Name | NT ID | AA ID | NT/LN | AA/LN | Score | P-value |
|---|---|---|---|---|---|---|
| 16901906_f3_247 | 2033 | 9204 | 2298 | 765 | 2017 | 1.7e-210 |

Description sp:[LN:YGIQ_ECOLI] [AC:Q46861] [GN:YGIQ] [OR:Escherichia coli] [DE:HYPOTHETICAL
46.9 KD PROTEIN IN METC-SUFI INTERGENIC REGION] [SP:Q46861] [DB:swissprot]
>sp:[LN:E65088] [AC:E65088] [PN:hypothetical protein b3015] [OR:Escherichia coli]
[DB:pir2] >gp:[GI:g882545] [LN:ECU28377] [AC:U28377] [OR:Escherichia coli]
[DB:genpept-bct1] [DE:Escherichia coli K-12 genome; approximately 65 to 68
minutes.] [NT:ORF_f413] [LE:113315] [RE:114556] [DI:complement] >gp:[GI:g1789391]
[LN:AE000383] [AC:AE000383:U00096] [PN:orf, hypothetical protein] [GN:b3015]
[FN:orf; Unknown] [OR:Escherichia coli] [DB:genpept-bct2] [DE:Escherichia coli
K-12 MG1655 section 273 of 400 of the completegenome.] [NT:f413] [LE:9393]
[RE:10634] [DI:complement]

| ORF Name | NT ID | AA ID | NT/LN | AA/LN | Score | P-value |
|---|---|---|---|---|---|---|
| 176443_f1_48 | 2034 | 9205 | 837 | 278 | 1254 | 1.1e-127 |

Description sp:[LN:ICC_ECOLI] [AC:P36650] [GN:ICC] [OR:Escherichia coli] [DE:ICC PROTEIN]
[SP:P36650] [DB:swissprot] >sp:[LN:F65090] [AC:F65090:A58723]
[PN:3',5'-cyclic-nucleotide phosphodiesterase, cpdA:icc protein] [GN:cpdA:icc]
[CL:3',5'-cyclic-nucleotide phosphodiesterase cpdA:3',5'-cyclic-nucleotide
phosphodiesterase cpdA homology:phosphoesterase core homology] [OR:Escherichia
coli] [EC:3.1.4.17] [DB:pir1] [MP:68.4 min] >gp:[GI:d1004505:g453396] [LN:ECOICC]
[AC:D16557] [PN:Icc] [GN:icc] [FN:affect the expression of the lacZ gene]
[OR:Escherichia coli] [SR:Escherichia coli (strain K12, isolate W3110) DNA]
[DB:genpept-bct1] [DE:E. coli DNA for Icc protein, complete cds.] [LE:985]
[RE:1812] [DI:direct] >gp:[GI:g1789410] [LN:AE000385] [AC:AE000385:U00096]
[PN:regulator of lacZ] [GN:icc] [FN:regulator; Degradation of small molecules:]
[OR:Escherichia coli] [DB:genpept-bct2] [DE:Escherichia coli K-12 MG1655 section
275 of 400 of the completegenome.] [NT:f275; 100 pct identical to ICC_ECOLI SW:
P36650;] [LE:3666] [RE:4493] [DI:complement]

| ORF Name | NT ID | AA ID | NT/LN | AA/LN | Score | P-value |
|---|---|---|---|---|---|---|
| 19533388_f2_175 | 2035 | 9206 | 1476 | 491 | 1020 | 6.8e-103 |

Description sp:[LN:YICJ_ECOLI] [AC:P31435:P76724] [GN:YICJ] [OR:Escherichia coli]
[DE:HYPOTHETICAL SYMPORTER IN GLTS-SELC INTERGENIC REGION] [SP:P31435:P76724]
[DB:swissprot]

| ORF_Name | NT_ID | AA_ID | NT/LN | AA/LN | Score | P-value |
|---|---|---|---|---|---|---|
| 19620638_c3_504 | 2036 | 9207 | 528 | 175 | 164 | 3.5e-12 |

Description sp:[LN:B65087] [AC:B65087] [PN:hypothetical protein b3004] [OR:Escherichia coli] [DB:pir2] >gp:[GI:g882533] [LN:ECU28377] [AC:U28377] [OR:Escherichia coli] [DB:genpept-bct1] [DE:Escherichia coli K-12 genome; approximately 65 to 68 minutes.] [NT:ORF_o81; alternate name yghA] [LE:105110] [RE:105355] [DI:direct] >gp:[GI:g1789379] [LN:AE000383] [AC:AE000383:U00096] [PN:orf, hypothetical protein] [GN:b3004] [FN:orf; Unknown] [OR:Escherichia coli] [DB:genpept-bct2] [DE:Escherichia coli K-12 MG1655 section 273 of 400 of the completegenome.] [NT:o81; alternate name yghA; This 81 aa ORF is 28 pct] [LE:1186] [RE:1431] [DI:direct]

| ORF_Name | NT_ID | AA_ID | NT/LN | AA/LN | Score | P-value |
|---|---|---|---|---|---|---|
| 20109590_f2_135 | 2037 | 9208 | 1500 | 499 | 2227 | 8.5e-231 |

Description sp:[LN:RFAE_ECOLI] [AC:P76658] [GN:RFAE:WAAE] [OR:Escherichia coli] [EC:2.7.-.-] [DE:ADP-HEPTOSE SYNTHASE,] [SP:P76658] [DB:swissprot] >sp:[LN:B65093] [AC:B65093] [PN:ADP-heptose synthase homolog:hypothetical protein b3052] [CL:hypothetical protein b3052] [OR:Escherichia coli] [DB:pir1] >gp:[GI:g1789432] [LN:AE000387] [AC:AE000387:U00096] [PN:putative kinase] [GN:b3052] [FN:putative enzyme; Not classified] [OR:Escherichia coli] [DB:genpept-bct2] [DE:Escherichia coli K-12 MG1655 section 277 of 400 of the completegenome.] [NT:f477] [LE:240] [RE:1673] [DI:complement]

| ORF_Name | NT_ID | AA_ID | NT/LN | AA/LN | Score | P-value |
|---|---|---|---|---|---|---|
| 20940950_c3_489 | 2038 | 9209 | 249 | 82 | | |

Description

NO-HIT

| ORF_Name | NT_ID | AA_ID | NT/LN | AA/LN | Score | P-value |
|---|---|---|---|---|---|---|
| 21579716_f2_158 | 2039 | 9210 | 2370 | 789 | 3653 | 0.0 |

Description sp:[LN:PARC_ECOLI] [AC:P20082] [GN:PARC] [OR:Escherichia coli] [EC:5.99.1.-]
[DE:TOPOISOMERASE IV SUBUNIT A,] [SP:P20082] [DB:swissprot] >sp:[LN:A65089]
[AC:A65089:A49517:A39936:A36075:S20459] [PN:DNA topoisomerase IV, parC chain]
[GN:parC] [CL:DNA topoisomerase (ATP-hydrolyzing) chain A:phage T4 DNA
topoisomerase (ATP-hydrolyzing) medium chain homology] [OR:Escherichia coli]
[EC:5.99.1.-] [DB:pir2] [MP:65 min] >gp:[GI:g882549] [LN:ECU28377] [AC:U28377]
[PN:topoisomerase IV subunit] [GN:parC] [FN:chromosome partitioning]
[OR:Escherichia coli] [DB:genpept-bct1] [DE:Escherichia coli K-12 genome;
approximately 65 to 68 minutes.] [LE:118102] [RE:120360] [DI:complement]
>gp:[GI:g1789396] [LN:AE000384] [AC:AE000384:U00096] [PN:DNA topoisomerase IV
subunit A] [GN:parC] [FN:enzyme; DNA - replication, repair,] [OR:Escherichia
coli] [DB:genpept-bct2] [EC:5.99.1.-] [DE:Escherichia coli K-12 MG1655 section
274 of 400 of the completegenome.] [NT:f752; 100 pct identical to PARC_ECOLI SW:
P20082] [LE:2544] [RE:4802] [DI:complement]

| ORF_Name | NT_ID | AA_ID | NT/LN | AA/LN | Score | P-value |
|---|---|---|---|---|---|---|
| 22552082_f3_262 | 2040 | 9211 | 249 | 82 | | |

Description

NO-HIT

| ORF_Name | NT_ID | AA_ID | NT/LN | AA/LN | Score | P-value |
|---|---|---|---|---|---|---|
| 22760156_c2_467 | 2041 | 9212 | 675 | 224 | 682 | 4.5e-67 |

Description sp:[LN:EVGA_ECOLI] [AC:P30854] [GN:EVGA] [OR:Escherichia coli] [DE:PUTATIVE
POSITIVE TRANSCRIPTION REGULATOR EVGA] [SP:P30854] [DB:swissprot] >sp:[LN:JU0220]
[AC:JU0220:I41199:I41198:F65010] [PN:probable positive transcription regulator
evgA] [GN:evgA] [CL:regulatory protein comA:response regulator homology]
[OR:Escherichia coli] [DB:pir2] >gp:[GI:d1016968:g1799780] [LN:D90867]
[AC:D90867:AB001340] [PN:evgA protein] [GN:evgA] [OR:Escherichia coli]
[SR:Escherichia coli (strain:K12) DNA, clone_lib:Kohara lambda minise]
[DB:genpept-bct1] [DE:E.coli genomic DNA, Kohara clone #412(53.4-53.8 min.).]
[NT:similar to [PIR Accession Number JU0220]] [LE:7523] [RE:8137] [DI:direct]
>gp:[GI:d1002395:g216551] [LN:ECOEVGA] [AC:D11142] [PN:evgA protein] [GN:evgA]
[OR:Escherichia coli] [SR:Escherichia coli (strain:K-12) DNA] [DB:genpept-bct1]
[DE:E.coli evgA gene.] [LE:445] [RE:1059] [DI:direct] >gp:[GI:d1003613:g216553]
[LN:ECOEVGS] [AC:D14008] [PN:EvgA] [GN:evgA] [FN:regulatory protein of two
component regulatory] [OR:Escherichia coli] [SR:Escherichia coli (strain:K-12)
DNA] [DB:genpept-bct1] [DE:E.coli genes for sensor protein EvgS and regulatory
protein EvgA oftwo component regulatory system, complete cds.] [LE:445] [RE:1059]
[DI:direct] >gp:[GI:g1788712] [LN:AE000325] [AC:AE000325:U00096] [PN:putative
positive transcription regulator] [GN:evgA] [FN:putative regulator; Not
classified] [OR:Escherichia coli] [DB:genpept-bct2] [DE:Escherichia coli K-12
MG1655 section 215 of 400 of the completegenome.] [NT:o204; 100 pct identical to
EVGA_ECOLI SW: P30854] [LE:3201] [RE:3815] [DI:direct]

| ORF Name | NT ID | AA ID | NT/LN | AA/LN | Score | P-value |
|---|---|---|---|---|---|---|
| 23463567_f2_177 | 2042 | 9213 | 915 | 304 | 607 | 4.0e-59 |

Description sp:[LN:E65086] [AC:E65086] [PN:hypothetical protein b2999] [OR:Escherichia coli] [DB:pir2] >gp:[GI:g882528] [LN:ECU28377] [AC:U28377] [OR:Escherichia coli] [DB:genpept-bct1] [DE:Escherichia coli K-12 genome; approximately 65 to 68 minutes.] [NT:ORF_f136] [LE:101244] [RE:101654] [DI:complement] >gp:[GI:g1789373] [LN:AE000382] [AC:AE000382:U00096] [PN:orf, hypothetical protein] [GN:b2999] [FN:orf; Unknown] [OR:Escherichia coli] [DB:genpept-bct2] [DE:Escherichia coli K-12 MG1655 section 272 of 400 of the completegenome.] [NT:f136] [LE:8286] [RE:8696] [DI:complement]

| ORF Name | NT ID | AA ID | NT/LN | AA/LN | Score | P-value |
|---|---|---|---|---|---|---|
| 23634683_c2_407 | 2043 | 9214 | 1167 | 388 | 1776 | 5.3e-183 |

Description sp:[LN:YQHD_ECOLI] [AC:Q46856] [GN:YQHD] [OR:Escherichia coli] [DE:HYPOTHETICAL OXIDOREDUCTASE IN METC-SUFI INTERGENIC REGION] [SP:Q46856] [DB:swissprot] >sp:[LN:A65088] [AC:A65088] [PN:hypothetical protein b3011] [CL:lactaldehyde reductase:lactaldehyde reductase homology] [OR:Escherichia coli] [DB:pir2] >gp:[GI:g882540] [LN:ECU28377] [AC:U28377] [OR:Escherichia coli] [DB:genpept-bct1] [DE:Escherichia coli K-12 genome; approximately 65 to 68 minutes.] [NT:ORF_o387] [LE:109742] [RE:110905] [DI:direct] >gp:[GI:g1789386] [LN:AE000383] [AC:AE000383:U00096] [PN:putative oxidoreductase] [GN:yqhD] [FN:putative enzyme; Not classified] [OR:Escherichia coli] [DB:genpept-bct2] [DE:Escherichia coli K-12 MG1655 section 273 of 400 of the completegenome.] [NT:o387; This 387 aa ORF is 40 pct identical (11 gaps)] [LE:5818] [RE:6981] [DI:direct]

| ORF Name | NT ID | AA ID | NT/LN | AA/LN | Score | P-value |
|---|---|---|---|---|---|---|
| 23688752_f3_271 | 2044 | 9215 | 366 | 121 | 121 | 1.3e-07 |

Description sp:[LN:F70582] [AC:F70582] [PN:hypothetical protein Rv0918] [GN:Rv0918] [CL:Mycobacterium tuberculosis hypothetical protein Rv0918] [OR:Mycobacterium tuberculosis] [DB:pir2] >gp:[GI:e315219:g2078067] [LN:MTY21C12] [AC:Z95210:AL123456] [PN:hypothetical protein Rv0918] [GN:Rv0918] [OR:Mycobacterium tuberculosis] [DB:genpept-bct1] [DE:Mycobacterium tuberculosis H37Rv complete genome; segment 42/162.] [NT:Rv0918, (MTCY21C12.12), len: 158. Some similarity] [LE:14139] [RE:14615] [DI:direct]

| ORF_Name | NT_ID | AA_ID | NT LN | AA LN | Score | P-value |
|---|---|---|---|---|---|---|
| 23712832_c2_452 | 2045 | 9216 | 1878 | 625 | 2931 | 0.0 |

Description sp:[LN:URE1_KLEAE] [AC:P18314] [GN:UREC] [OR:Klebsiella aerogenes] [EC:3.5.1.5]
[DE:UREASE ALPHA SUBUNIT, (UREA AMIDOHYDROLASE)] [SP:P18314] [DB:swissprot]
>sp:[LN:C36138] [AC:C36138] [PN:urease, 62K chain:urea amidohydrolase:urease
alpha chain:urease chain C] [GN:ureC] [CL:urease 62K chain:urease 62K chain
homology] [OR:Klebsiella pneumoniae] [EC:3.5.1.5] [DB:pir1] >gp:[GI:g149338]
[LN:KPNUREX] [AC:M36068] [PN:urease subunit C] [GN:ureC] [OR:Klebsiella
aerogenes] [SR:Klebsiella aerogenes (strain CG253) DNA] [DB:genpept-bct1]
[DE:K.aerogenes urease subunits A (ureA), B (ureB), C (ureC), andurease accessory
protein (ureE, ureF and ureG) genes, complete cds.] [LE:896] [RE:2599]
[DI:direct]

| ORF_Name | NT_ID | AA_ID | NT LN | AA LN | Score | P-value |
|---|---|---|---|---|---|---|
| 23728542_f2_173 | 2046 | 9217 | 735 | 244 | 995 | 3.0e-100 |

Description sp:[LN:EXBB_ECOLI] [AC:P18783] [GN:EXBB] [OR:Escherichia coli] [DE:BIOPOLYMER
TRANSPORT EXBB PROTEIN] [SP:P18783] [DB:swissprot] >sp:[LN:BVECXB]
[AC:D65087:JV0029] [PN:biopolymer transport exbB protein] [GN:exbB]
[CL:biopolymer transport protein] [OR:Escherichia coli] [DB:pir1] [MP:65 min]
>gp:[GI:g882535] [LN:ECU28377] [AC:U28377] [GN:exbB] [OR:Escherichia coli]
[DB:genpept-bct1] [DE:Escherichia coli K-12 genome; approximately 65 to 68
minutes.] [LE:105638] [RE:106372] [DI:complement] >gp:[GI:g1789381] [LN:AE000383]
[AC:AE000383:U00096] [PN:uptake of enterochelin; tonB-dependent uptake of]
[GN:exbB] [FN:transport; Transport of small molecules:] [OR:Escherichia coli]
[DB:genpept-bct2] [DE:Escherichia coli K-12 MG1655 section 273 of 400 of the
completegenome.] [NT:f244; 99 pct identical to EXBB_ECOLI SW: P18783] [LE:1714]
[RE:2448] [DI:complement]

| ORF_Name | NT_ID | AA_ID | NT LN | AA LN | Score | P-value |
|---|---|---|---|---|---|---|
| 24020286_f2_181 | 2047 | 9218 | 717 | 238 | 474 | 4.9e-45 |

Description sp:[LN:E75208] [AC:E75208] [PN:aminotransferase PAB2227] [GN:PAB2227]
[OR:Pyrococcus abyssi] [DB:pir2] >gp:[GI:g5457625] [LN:CNSPAX01]
[AC:AJ248283:AL096836] [PN:AMINOTRANSFERASE] [OR:Pyrococcus abyssi]
[DB:genpept-bct1] [DE:Pyrococcus abyssi complete genome; segment 1/6.]
[NT:PAB2227] [LE:196015] [RE:197247] [DI:complement]

| ORF Name | NT ID | AA ID | NT/LN | AA/LN | Score | P-value |
|---|---|---|---|---|---|---|
| 24103437_c3_527 | 2048 | 9219 | 585 | 194 | 956 | 4.1e-96 |

Description sp:[LN:MDAB_ECOLI] [AC:P40717] [GN:MDAB:MDA66] [OR:Escherichia coli]
[DE:MODULATOR OF DRUG ACTIVITY B] [SP:P40717] [DB:swissprot] >sp:[LN:I80319]
[AC:I80319:B65090] [PN:drug activity modulator B] [GN:mdaB] [OR:Escherichia coli]
[DB:pir2] >gp:[GI:g882558] [LN:ECU28377] [AC:U28377] [OR:Escherichia coli]
[DB:genpept-bct1] [DE:Escherichia coli K-12 genome; approximately 65 to 68
minutes.] [NT:ORF_o193] [LE:126918] [RE:127499] [DI:direct] >gp:[GI:g1789406]
[LN:AE000385] [AC:AE000385:U00096] [PN:modulator of drug activity B] [GN:mdaB]
[FN:phenotype; Not classified] [OR:Escherichia coli] [DB:genpept-bct2]
[DE:Escherichia coli K-12 MG1655 section 275 of 400 of the completegenome.]
[NT:o193; 100 pct identical to MDAB_ECOLI SW: P40717] [LE:190] [RE:771]
[DI:direct] >gp:[GI:g609328] [LN:ECU18656] [AC:U18656] [GN:mda66] [OR:Escherichia
coli] [DB:genpept-bct2] [DE:Escherichia coli modulator of drug activity (mda66)
and orf1 genes,complete cds.] [NT:orf2; encodes a 22 kDa protein] [LE:447]
[RE:1028] [DI:complement]

| ORF Name | NT ID | AA ID | NT/LN | AA/LN | Score | P-value |
|---|---|---|---|---|---|---|
| 24276025_c1_335 | 2049 | 9220 | 852 | 283 | 1109 | 2.5e-112 |

Description gp:[GI:g882570] [LN:ECU28377] [AC:U28377] [OR:Escherichia coli] [DB:genpept-bct1]
[DE:Escherichia coli K-12 genome; approximately 65 to 68 minutes.] [NT:ORF_o265;
alternate name ygiE; orfB of M77129] [LE:136914] [RE:137711] [DI:direct]

| ORF Name | NT ID | AA ID | NT/LN | AA/LN | Score | P-value |
|---|---|---|---|---|---|---|
| 24276667_f3_211 | 2050 | 9221 | 1032 | 343 | 1631 | 1.2e-167 |

Description sp:[LN:QQECR6] [AC:F65094:D29049] [PN:O-sialoglycoprotein endopeptidase,]
[GN:ygjD] [CL:O-sialoglycoprotein endopeptidase] [OR:Escherichia coli]
[EC:3.4.24.57] [DB:pir1] [MP:67 min] >gp:[GI:g882587] [LN:ECU28379] [AC:U28379]
[OR:Escherichia coli] [DB:genpept-bct1] [DE:Escherichia coli K-12 genome;
approximately 68 minutes.] [NT:ORF_f337] [LE:14325] [RE:15338] [DI:complement]
>gp:[GI:g1789445] [LN:AE000388] [AC:AE000388:U00096] [PN:putative
O-sialoglycoprotein endopeptidase] [GN:ygjD] [FN:putative enzyme; Not classified]
[OR:Escherichia coli] [DB:genpept-bct2] [DE:Escherichia coli K-12 MG1655 section
278 of 400 of the completegenome.] [NT:f337; 99 pct identical amino acid sequence
and] [LE:3201] [RE:4214] [DI:complement]

| ORF Name | NT ID | AA ID | NT/LN | AA/LN | Score | P-value |
|---|---|---|---|---|---|---|
| 24410885_c1_289 | 2051 | 9222 | 597 | 198 | | |

Description

NO-HIT

| ORF Name | NT ID | AA ID | NT/LN | AA/LN | Score | P-value |
|---|---|---|---|---|---|---|
| 24629207_f3_237 | 2052 | 9223 | 1926 | 641 | 3114 | 0.0 |

Description sp:[LN:PARE_ECOLI] [AC:P20083] [GN:PARE:NFXD] [OR:Escherichia coli] [EC:5.99.1.-]
[DE:TOPOISOMERASE IV SUBUNIT B,] [SP:P20083] [DB:swissprot] >sp:[LN:D65090]
[AC:D65090:B49517:B36075] [PN:topoisomerase IV subunit,:parE protein] [GN:parE]
[CL:DNA topoisomerase (ATP-hydrolyzing) chain B] [OR:Escherichia coli]
[EC:5.99.1.-] [DB:pir2] >gp:[GI:g882560] [LN:ECU28377] [AC:U28377]
[PN:topoisomerase IV subunit] [GN:parE] [OR:Escherichia coli] [DB:genpept-bct1]
[DE:Escherichia coli K-12 genome; approximately 65 to 68 minutes.] [LE:127892]
[RE:129784] [DI:complement] >gp:[GI:g1789408] [LN:AE000385] [AC:AE000385:U00096]
[PN:DNA topoisomerase IV subunit B] [GN:parE] [FN:enzyme; DNA - replication,
repair,] [OR:Escherichia coli] [DB:genpept-bct2] [EC:5.99.1.-] [DE:Escherichia
coli K-12 MG1655 section 275 of 400 of the completegenome.] [NT:f630; 100 pct
identical to PARE_ECOLI SW: P20083] [LE:1164] [RE:3056] [DI:complement]

| ORF Name | NT ID | AA ID | NT/LN | AA/LN | Score | P-value |
|---|---|---|---|---|---|---|
| 24645257_f1_71 | 2053 | 9224 | 222 | 73 | 149 | 1.4e-10 |

Description sp:[LN:E65087] [AC:E65087] [PN:hypothetical protein b3007] [OR:Escherichia coli]
[DB:pir2] >gp:[GI:g882536] [LN:ECU28377] [AC:U28377] [OR:Escherichia coli]
[DB:genpept-bct1] [DE:Escherichia coli K-12 genome; approximately 65 to 68
minutes.] [NT:ORF_f51] [LE:106365] [RE:106520] [DI:complement] >gp:[GI:g1789382]
[LN:AE000383] [AC:AE000383:U00096] [PN:orf, hypothetical protein] [GN:b3007]
[FN:orf; Unknown] [OR:Escherichia coli] [DB:genpept-bct2] [DE:Escherichia coli
K-12 MG1655 section 273 of 400 of the completegenome.] [NT:f51; This 51 aa ORF is
34 pct identical (6 gaps)] [LE:2441] [RE:2596] [DI:complement]

| ORF Name | NT ID | AA ID | NT/LN | AA/LN | Score | P-value |
|---|---|---|---|---|---|---|
| 24893878_f1_4 | 2054 | 9225 | 414 | 137 | 95 | 7.1e-05 |

Description sp:[LN:HDEB_ECOLI] [AC:P26605] [GN:HDEB] [OR:Escherichia coli] [DE:PROTEIN HDEB
PRECURSOR (10K-L PROTEIN)] [SP:P26605] [DB:swissprot]

| ORF Name | NT ID | AA ID | NT/LN | AA/LN | Score | P-value |
|---|---|---|---|---|---|---|
| 25442961_c2_427 | 2055 | 9226 | 321 | 106 | 125 | 8.1e-07 |

Description sp:[LN:YGY4_HALSQ] [AC:P21562] [OR:Haloferax sp] [SR:,strain Aa 2.2]
[DE:HYPOTHETICAL 80.2 KD PROTEIN IN THE 5'REGION OF GYRA AND GYRB (ORF 4)]
[SP:P21562] [DB:swissprot] >sp:[LN:D39135] [AC:D39135] [PN:hypothetical protein 4
(gyrB region)] [CL:Haloferax hypothetical protein 4 (gyrB region)] [OR:Haloferax
sp.] [DB:pir2] >gp:[GI:g149023] [LN:HLFGYRB] [AC:M38373] [GN:ORF4] [OR:Haloferax
alicantei] [DB:genpept-bct1] [DE:Haloferax alicantei DNA gyrase subunit A and B
(gyrA and gyrB)genes, 5' end and complete cds.] [LE:168] [RE:2404]
[DI:complement]

| ORF_Name | NT_ID | AA_ID | NT LN | AA LN | Score | P-value |
|---|---|---|---|---|---|---|
| 25520466_f3_236 | 2056 | 9227 | 651 | 216 | 880 | 4.7e-88 |

Description sp:[LN:YQIA_ECOLI] [AC:P36653] [GN:YQIA] [OR:Escherichia coli] [DE:HYPOTHETICAL 21.6 KD PROTEIN IN PARE-ICC INTERGENIC REGION (F193)] [SP:P36653] [DB:swissprot] >sp:[LN:E65090] [AC:E65090] [PN:hypothetical 15.2 kD protein in icc 3'region] [GN:yqiA] [OR:Escherichia coli] [DB:pir2] >gp:[GI:g882561] [LN:ECU28377] [AC:U28377] [OR:Escherichia coli] [DB:genpept-bct1] [DE:Escherichia coli K-12 genome; approximately 65 to 68 minutes.] [NT:ORF_f193] [LE:129813] [RE:130394] [DI:complement] >gp:[GI:g1789409] [LN:AE000385] [AC:AE000385:U00096] [PN:orf, hypothetical protein] [GN:yqiA] [FN:orf; Unknown] [OR:Escherichia coli] [DB:genpept-bct2] [DE:Escherichia coli K-12 MG1655 section 275 of 400 of the completegenome.] [NT:f193; 100 pct identical to 134 residues of] [LE:3085] [RE:3666] [DI:complement]

| ORF_Name | NT_ID | AA_ID | NT LN | AA LN | Score | P-value |
|---|---|---|---|---|---|---|
| 25567885_f1_93 | 2057 | 9228 | 525 | 174 | 904 | 1.3e-90 |

Description gp:[GI:d1042584:g5103173] [LN:AP000342] [AC:AP000342] [PN:IS1 transposition protein] [GN:insB] [OR:Plasmid R100] [SR:Plasmid R100 (specific_host:Shigella flexneri 2b strain 222] [DB:genpept-bct1] [DE:Plasmid R100 genomic DNA.] [NT:100% identical to gp:ECAE000134_5[IS1 protein] [LE:21474] [RE:21977] [DI:direct] >gp:[GI:d1042676:g5103265] [LN:AP000342] [AC:AP000342] [PN:IS1 transposition protein] [GN:insB] [OR:Plasmid R100] [SR:Plasmid R100 (specific_host:Shigella flexneri 2b strain 222] [DB:genpept-bct1] [DE:Plasmid R100 genomic DNA.] [NT:100% identical to gp:ECAE000134_5[IS1 protein] [LE:93763] [RE:94266] [DI:direct] >gp:[GI:g673426] [LN:ISIS1X] [AC:V00609] [GN:insB] [OR:Escherichia coli] [DB:genpept-bct1] [DE:E.coli insertion sequence 1.] [SP:P03830] [LE:250] [RE:753] [DI:direct] >gp:[GI:g755079] [LN:SYNISR] [AC:M27083] [GN:insB] [FN:transposition of insertion sequence IS/R] [OR:synthetic construct] [SR:Artificial gene DNA] [DB:genpept-syn] [DE:Synthetic insertion sequence IS/R encoding insA and insB genes bothessential for transposition.] [LE:259] [RE:762] [DI:direct]

| ORF_Name | NT_ID | AA_ID | NT LN | AA LN | Score | P-value |
|---|---|---|---|---|---|---|
| 25598431_c3_553 | 2058 | 9229 | 636 | 211 | 908 | 5.0e-91 |

Description sp:[LN:YGIM_ECOLI] [AC:P39202] [GN:YGIM] [OR:Escherichia coli] [DE:HYPOTHETICAL 23.1 KD PROTEIN IN GLNE-CCA INTERGENIC REGION PRECURSOR] [SP:P39202] [DB:swissprot] >sp:[LN:E65093] [AC:E65093] [PN:hypothetical protein in glne-cca intergenic region] [GN:ygiM] [CL:hypothetical protein HI1605] [OR:Escherichia coli] [DB:pir2] >gp:[GI:g1203798] [LN:ECU28379] [AC:U28379] [OR:Escherichia coli] [DB:genpept-bct1] [DE:Escherichia coli K-12 genome; approximately 68 minutes.] [NT:alternate name ygiM; ORF_o206] [LE:6002] [RE:6622] [DI:direct] >gp:[GI:g1789435] [LN:AE000387] [AC:AE000387:U00096] [PN:orf, hypothetical protein] [GN:ygiM] [FN:orf; Unknown] [OR:Escherichia coli] [DB:genpept-bct2] [DE:Escherichia coli K-12 MG1655 section 277 of 400 of the completegenome.] [NT:o206; 100 pct identical to 127 amino acids of] [LE:6127] [RE:6747] [DI:direct]

| ORF_Name | NT_ID | AA_ID | NT/LN | AA/LN | Score | P-value |
|---|---|---|---|---|---|---|
| 2593762_c1_300 | 2059 | 9230 | 1278 | 425 | 1891 | 3.4e-195 |

Description gp:[GI:g882537] [LN:ECU28377] [AC:U28377] [PN:beta-cystathionase] [GN:metC] [OR:Escherichia coli] [DB:genpept-bct1] [EC:4.4.1.8] [DE:Escherichia coli K-12 genome; approximately 65 to 68 minutes.] [NT:CG Site No. 514] [LE:106546] [RE:107811] [DI:direct]

| ORF_Name | NT_ID | AA_ID | NT/LN | AA/LN | Score | P-value |
|---|---|---|---|---|---|---|
| 26219836_f3_204 | 2060 | 9231 | 1851 | 616 | | |

Description

NO-HIT

| ORF_Name | NT_ID | AA_ID | NT/LN | AA/LN | Score | P-value |
|---|---|---|---|---|---|---|
| 26298162_f2_193 | 2061 | 9232 | 522 | 173 | 400 | 3.4e-37 |

Description sp:[LN:G70582] [AC:G70582] [PN:hypothetical protein Rv0919] [GN:Rv0919] [OR:Mycobacterium tuberculosis] [DB:pir2] >gp:[GI:e315220:g2078068] [LN:MTY21C12] [AC:Z95210:AL123456] [PN:hypothetical protein Rv0919] [GN:Rv0919] [OR:Mycobacterium tuberculosis] [DB:genpept-bct1] [DE:Mycobacterium tuberculosis H37Rv complete genome; segment 42/162.] [NT:Rv0919, (MTCY21C12.13), len: 166. Some similarity] [LE:14612] [RE:15112] [DI:direct]

| ORF_Name | NT_ID | AA_ID | NT/LN | AA/LN | Score | P-value |
|---|---|---|---|---|---|---|
| 26750786_f1_38 | 2062 | 9233 | 810 | 269 | 1240 | 3.3e-126 |

Description sp:[LN:YGID_ECOLI] [AC:P24197] [GN:YGID] [OR:Escherichia coli] [DE:(F271)] [SP:P24197] [DB:swissprot] >sp:[LN:E65091] [AC:E65091:S22362] [PN:ygiD protein] [GN:ygiD] [CL:ygiD protein] [OR:Escherichia coli] [DB:pir2] >gp:[GI:g882569] [LN:ECU28377] [AC:U28377] [OR:Escherichia coli] [DB:genpept-bct1] [DE:Escherichia coli K-12 genome; approximately 65 to 68 minutes.] [NT:ORF_f271; alternate name ygiD; orfC of M77129] [LE:136007] [RE:136822] [DI:complement] >gp:[GI:g1789417] [LN:AE000385] [AC:AE000385:U00096] [PN:orf, hypothetical protein] [GN:ygiD] [FN:orf; Unknown] [OR:Escherichia coli] [DB:genpept-bct2] [DE:Escherichia coli K-12 MG1655 section 275 of 400 of the completegenome.] [NT:f271; 100 pct identical 242 residues from] [LE:9279] [RE:10094] [DI:complement]

| ORF_Name | NT_ID | AA_ID | NT/LN | AA/LN | Score | P-value |
|---|---|---|---|---|---|---|
| 2772662_c3_565 | 2063 | 9234 | 657 | 218 | 1049 | 5.8e-106 |

Description sp:[LN:UREG_KLEAE] [AC:P18319] [GN:UREG] [OR:Klebsiella aerogenes] [DE:UREASE ACCESSORY PROTEIN UREG] [SP:P18319] [DB:swissprot] >sp:[LN:F36138] [AC:F36138] [PN:urease accessory protein ureG] [CL:hydrogenase expression/formation protein hypB] [OR:Klebsiella pneumoniae] [DB:pir2] >gp:[GI:g149341] [LN:KPNUREX] [AC:M36068] [PN:urease accessory protein G] [GN:ureG] [OR:Klebsiella aerogenes] [SR:Klebsiella aerogenes (strain CG253) DNA] [DB:genpept-bct1] [DE:K.aerogenes urease subunits A (ureA), B (ureB), C (ureC), andurease accessory protein (ureE, ureF and ureG) genes, complete cds.] [LE:3770] [RE:4387] [DI:direct]

| ORF_Name | NT_ID | AA_ID | NT/LN | AA/LN | Score | P-value |
|---|---|---|---|---|---|---|
| 2911290_f3_272 | 2064 | 9235 | 234 | 77 | 367 | 1.1e-33 |

Description sp:[LN:IEECC7] [AC:A93826:A93117:S40546:A04452] [PN:hypothetical protein, 8K] [CL:Escherichia coli insertion sequence IS1 hypothetical 7.6K protein] [OR:Escherichia coli] [DB:pir1] >gp:[GI:d1001773:g285762] [LN:ECO110K] [AC:D10483:J01597:J01683:J01706:K01298:K01990:M10420:M10611:M12544] [OR:Escherichia coli] [SR:Escherichia coli (strain:K-12) DNA] [DB:genpept-bct1] [DE:E.coli K12 genome, 0-2.4min. region.] [NT:IS1 hypothetical protein C-70(PIR:A04452)] [LE:19988] [RE:20200] [DI:complement]

| ORF_Name | NT_ID | AA_ID | NT/LN | AA/LN | Score | P-value |
|---|---|---|---|---|---|---|
| 30569082_f2_122 | 2065 | 9236 | 876 | 291 | 1264 | 9.5e-129 |

Description sp:[LN:BACA_ECOLI] [AC:P31054:P39203] [GN:BACA] [OR:Escherichia coli] [EC:2.7.1.66] [DE:(EC 2.7.1.66)] [SP:P31054:P39203] [DB:swissprot] >sp:[LN:G65093] [AC:G65093:A47121] [PN:bacitracin resistance protein bacA:probable undecaprenol kinase] [GN:bacA] [CL:Escherichia coli bacitracin resistance protein bacA] [OR:Escherichia coli] [DB:pir2] >gp:[GI:g882579] [LN:ECU28379] [AC:U28379] [GN:bacA] [OR:Escherichia coli] [DB:genpept-bct1] [DE:Escherichia coli K-12 genome; approximately 68 minutes.] [NT:CG Site No. 29739] [LE:8105] [RE:8926] [DI:complement] >gp:[GI:g1789437] [LN:AE000387] [AC:AE000387:U00096] [PN:bacitracin resistance; possibly phosphorylates] [GN:bacA] [FN:putative transport; Drug/analog sensitivity] [OR:Escherichia coli] [DB:genpept-bct2] [DE:Escherichia coli K-12 MG1655 section 277 of 400 of the completegenome.] [NT:f273; 95 pct identical to BACA_ECOLI SW: P31054; CG] [LE:8230] [RE:9051] [DI:complement]

| ORF Name | NT ID | AA ID | NT LN | AA LN | Score | P-value |
|---|---|---|---|---|---|---|
| 30750930_c1_368 | 2066 | 9237 | 429 | 142 | 132 | 1.8e-07 |

Description gp:[GI:g3980411] [LN:ATAC004561] [AC:AC004561] [PN:putative proline-rich protein] [GN:F16P2.41] [OR:Arabidopsis thaliana] [SR:thale cress] [DB:genpept-pln2] [DE:Arabidopsis thaliana chromosome II BAC F16P2 genomic sequence, complete sequence.] [LE:97570:98219:98433] [RE:98125:98341:99695] [DI:complementJoin]

| ORF Name | NT ID | AA ID | NT LN | AA LN | Score | P-value |
|---|---|---|---|---|---|---|
| 31284383_c1_361 | 2067 | 9238 | 1026 | 341 | 1700 | 6.0e-175 |

Description sp:[LN:T08491] [AC:T08491] [PN:probable transposase] [GN:tnpA] [OR:Enterobacter aerogenes] [DB:pir2] >gp:[GI:g1402861] [LN:PRU60777] [AC:U60777] [PN:transposase] [GN:tnpA] [OR:Plasmid R751] [DB:genpept-bct1] [DE:Plasmid R751 transposon Tn4321 insertion sequence IS4321Ltransposase, Pep1, Pep2, and insertion sequence IS432R transposase, complete cds.] [NT:TnpA of IS4321L; similar to putative transposases] [LE:358] [RE:1362] [DI:complement] >gp:[GI:g1572540] [LN:EAU67194] [AC:U67194:U08908:L13688] [PN:TnpA] [GN:tnpA] [FN:transposase for IS4321L, based on similarity to] [OR:Enterobacter aerogenes] [DB:genpept-bct2] [DE:Enterobacter aerogenes plasmid R751, complete plasmid sequence.] [LE:10303] [RE:11307] [DI:complement]

| ORF Name | NT ID | AA ID | NT LN | AA LN | Score | P-value |
|---|---|---|---|---|---|---|
| 3129086_c2_460 | 2068 | 9239 | 525 | 174 | 357 | 1.2e-32 |

Description sp:[LN:R3EC21] [AC:A02749:A30426:I57721:G65094] [PN:ribosomal protein S21] [GN:rpsU] [CL:Escherichia coli ribosomal protein S21] [OR:Escherichia coli] [DB:pir1] [MP:67 min] >sp:[LN:R3EB21] [AC:A23985] [PN:ribosomal protein S21] [GN:rpsU] [CL:Escherichia coli ribosomal protein S21] [OR:Salmonella typhimurium] [DB:pir1] >gp:[GI:g147754] [LN:ECORPSRPO] [AC:J01687] [PN:ribosomal protein S21] [GN:rpsU] [OR:Escherichia coli] [SR:Escherichia coli K12 and HB101 DNA] [DB:genpept-bct1] [DE:E.coli rpsU-dnaG-rpoD operon with genes coding for ribosomalprotein S21, DNA primase and RNA polymerase sigma-subunit.] [LE:715] [RE:930] [DI:direct] >gp:[GI:g42868] [LN:ECRPSU] [AC:V00346] [OR:Escherichia coli] [DB:genpept-bct1] [DE:E. coli gene rpsU coding for protein S21 of the small subunit ofthe ribosome and fragment (5'-end) of dnaG.] [NT:coding sequence] [SP:P02379] [LE:715] [RE:930] [DI:direct] >gp:[GI:g882588] [LN:ECU28379] [AC:U28379] [PN:30S ribosomal subunit protein S21] [GN:rpsU] [OR:Escherichia coli] [DB:genpept-bct1] [DE:Escherichia coli K-12 genome; approximately 68 minutes.] [NT:CG Site No. 211] [LE:15576] [RE:15791] [DI:direct] >gp:[GI:g154404] [LN:STYUGDOP] [AC:M14427] [OR:Salmonella typhimurium] [SR:Salmonella typhimurium DNA] [DB:genpept-bct1] [DE:S.typhimurium rpsU-dnaG-rpoD operon, complete cds.] [NT:rpsU protein] [LE:359] [RE:574] [DI:direct] >gp:[GI:g1789446] [LN:AE000388] [AC:AE000388:U00096] [PN:30S ribosomal subunit protein S21] [GN:rpsU] [FN:structural component; Ribosomal proteins -] [OR:Escherichia coli] [DB:genpept-bct2] [DE:Escherichia coli K-12 MG1655 section 278 of 400 of the completegenome.] [NT:o71; 100 pct identical to RS21_ECOLI SW: P02379; CG] [LE:4452] [RE:4667] [DI:direct]

| ORF_Name | NT_ID | AA_ID | NT/LN | AA/LN | Score | P-value |
|---|---|---|---|---|---|---|
| 31650832_f3_259 | 2069 | 9240 | 1560 | 519 | 537 | 6.9e-54 |

Description gp:[GI:d1042328:g4996613] [LN:AB022865] [AC:AB022865] [PN:xylosidase]
[OR:Prevotella ruminicola] [SR:Prevotella ruminicola (sub_species:ruminicola,
strain:T31) DNA] [DB:genpept-bct1] [DE:Prevotella ruminicola genes for
polygalacturonase, xylosidase,protein-export membrane protein, complete cds.]
[LE:1672] [RE:3030] [DI:direct]

| ORF_Name | NT_ID | AA_ID | NT/LN | AA/LN | Score | P-value |
|---|---|---|---|---|---|---|
| 31675305_c2_438 | 2070 | 9241 | 303 | 100 | 373 | 2.5e-34 |

Description sp:[LN:YQIC_ECOLI] [AC:Q46868] [GN:YQIC] [OR:Escherichia coli] [DE:HYPOTHETICAL
13.8 KD PROTEIN IN RIBB-GLGS INTERGENIC REGION] [SP:Q46868] [DB:swissprot]
>sp:[LN:H65091] [AC:H65091] [PN:hypothetical protein b3042] [OR:Escherichia coli]
[DB:pir2] >gp:[GI:g882572] [LN:ECU28377] [AC:U28377] [OR:Escherichia coli]
[DB:genpept-bct1] [DE:Escherichia coli K-12 genome; approximately 65 to 68
minutes.] [NT:ORF_o116] [LE:139168] [RE:139518] [DI:direct] >gp:[GI:g1789421]
[LN:AE000386] [AC:AE000386:U00096] [PN:orf, hypothetical protein] [GN:b3042]
[FN:orf; Unknown] [OR:Escherichia coli] [DB:genpept-bct2] [DE:Escherichia coli
K-12 MG1655 section 276 of 400 of the completegenome.] [NT:o116; This 116 aa ORF
is 25 pct identical (2 gaps)] [LE:2318] [RE:2668] [DI:direct]

| ORF_Name | NT_ID | AA_ID | NT/LN | AA/LN | Score | P-value |
|---|---|---|---|---|---|---|
| 32069680_c3_507 | 2071 | 9242 | 690 | 229 | 1038 | 8.4e-105 |

Description sp:[LN:YGHB_ECOLI] [AC:P33196] [GN:YGHB] [OR:Escherichia coli] [DE:HYPOTHETICAL
24.1 KD PROTEIN IN METC-SUFI INTERGENIC REGION] [SP:P33196] [DB:swissprot]
>sp:[LN:G65087] [AC:G65087] [PN:hypothetical 24.1 kD protein in metC-sufI
intergenic region] [GN:yghB] [CL:dedA protein] [OR:Escherichia coli] [DB:pir2]
>gp:[GI:g882538] [LN:ECU28377] [AC:U28377] [OR:Escherichia coli]
[DB:genpept-bct1] [DE:Escherichia coli K-12 genome; approximately 65 to 68
minutes.] [NT:ORF_o219; alternate name yghB] [LE:107951] [RE:108610] [DI:direct]
>gp:[GI:g1789384] [LN:AE000383] [AC:AE000383:U00096] [PN:orf, hypothetical
protein] [GN:yghB] [FN:orf; Unknown] [OR:Escherichia coli] [DB:genpept-bct2]
[DE:Escherichia coli K-12 MG1655 section 273 of 400 of the completegenome.]
[NT:o219; 100 pct identical to YGHB_ECOLI SW: P33196] [LE:4027] [RE:4686]
[DI:direct]

| ORF_Name | NT ID | AA ID | NT LN | AA LN | Score | P-value |
|---|---|---|---|---|---|---|
| 32072958_c1_331 | 2072 | 9243 | 1914 | 637 | 2067 | 7.7e-214 |

Description sp:[LN:MMECTC] [AC:A65091:A03430:S11457:I53455] [PN:outer membrane protein tolC precursor] [GN:tolC] [CL:outer membrane protein tolC] [OR:Escherichia coli] [DB:pir1] [MP:66 min] >gp:[GI:g882565] [LN:ECU28377] [AC:U28377] [GN:tolC] [FN:specific tolerance to colicin E1; expression of] [OR:Escherichia coli] [DB:genpept-bct1] [DE:Escherichia coli K-12 genome; approximately 65 to 68 minutes.] [NT:CG Site No. 97; alternate names colE1-i, mtcB,] [LE:132497] [RE:133984] [DI:direct] >gp:[GI:g1789413] [LN:AE000385] [AC:AE000385:U00096] [PN:outer membrane channel; specific tolerance to] [GN:tolC] [FN:putative membrane; Cell division] [OR:Escherichia coli] [DB:genpept-bct2] [DE:Escherichia coli K-12 MG1655 section 275 of 400 of the completegenome.] [NT:o495; 99 pct identical to TOLC_ECOLI SW: P02930; CG] [LE:5769] [RE:7256] [DI:direct]

| ORF_Name | NT ID | AA ID | NT LN | AA LN | Score | P-value |
|---|---|---|---|---|---|---|
| 32156502_f2_145 | 2073 | 9244 | 582 | 193 | 873 | 2.6e-87 |

Description sp:[LN:YQIE_ECOLI] [AC:P36651] [GN:YQIE] [OR:Escherichia coli] [DE:HYPOTHETICAL 23.7 KD PROTEIN IN ICC-TOLC INTERGENIC REGION (F209)] [SP:P36651] [DB:swissprot] >sp:[LN:H65090] [AC:H65090] [PN:hypothetical protein b3034] [CL:yffH protein:mutT domain homology] [OR:Escherichia coli] [DB:pir2] >gp:[GI:g882564] [LN:ECU28377] [AC:U28377] [OR:Escherichia coli] [DB:genpept-bct1] [DE:Escherichia coli K-12 genome; approximately 65 to 68 minutes.] [NT:ORF_f209] [LE:131669] [RE:132298] [DI:complement] >gp:[GI:g1789412] [LN:AE000385] [AC:AE000385:U00096] [PN:orf, hypothetical protein] [GN:yqiE] [FN:orf; Unknown] [OR:Escherichia coli] [DB:genpept-bct2] [DE:Escherichia coli K-12 MG1655 section 275 of 400 of the completegenome.] [NT:f209; This 209 aa ORF is 54 pct identical (3 gaps)] [LE:4941] [RE:5570] [DI:complement]

| ORF_Name | NT ID | AA ID | NT LN | AA LN | Score | P-value |
|---|---|---|---|---|---|---|
| 32211630_f3_246 | 2074 | 9245 | 1542 | 513 | 2272 | 1.4e-235 |

Description sp:[LN:SUFI_ECOLI] [AC:P26648] [GN:SUFI] [OR:Escherichia coli] [DE:SUFI PROTEIN PRECURSOR] [SP:P26648] [DB:swissprot] >sp:[LN:G65088] [AC:G65088:S20461] [PN:sufI protein precursor] [GN:sufI] [OR:Escherichia coli] [DB:pir2] >gp:[GI:g882547] [LN:ECU28377] [AC:U28377] [PN:periplasmic protein] [FN:suppresses ftsI mutation] [OR:Escherichia coli] [DB:genpept-bct1] [DE:Escherichia coli K-12 genome; approximately 65 to 68 minutes.] [NT:ORF_f470; alternate name sufI; 16aoh-c in M63491] [LE:115644] [RE:117056] [DI:complement] >gp:[GI:g1789394] [LN:AE000384] [AC:AE000384:U00096] [PN:suppressor of ftsI] [GN:sufI] [FN:phenotype; Not classified] [OR:Escherichia coli] [DB:genpept-bct2] [DE:Escherichia coli K-12 MG1655 section 274 of 400 of the completegenome.] [NT:f470; 100 pct identical to SUFI_ECOLI SW: P26648] [LE:86] [RE:1498] [DI:complement]

| ORF Name | NT ID | AA ID | NT/LN | AA/LN | Score | P-value |
|---|---|---|---|---|---|---|
| 32228416_c2_421 | 2075 | 9246 | 1353 | 450 | 1573 | 1.7e-161 |

Description sp:[LN:YGIY_ECOLI] [AC:P40719] [GN:YGIY] [OR:Escherichia coli] [EC:2.7.3.-]
[DE:PROBABLE SENSOR PROTEIN YGIY,] [SP:P40719] [DB:swissprot] >sp:[LN:H65089]
[AC:H65089] [PN:hypothetical protein b3026] [CL:hypothetical protein
HI1707:sensor histidine kinase homology] [OR:Escherichia coli] [DB:pir2]
>gp:[GI:g882556] [LN:ECU28377] [AC:U28377] [OR:Escherichia coli]
[DB:genpept-bct1] [DE:Escherichia coli K-12 genome; approximately 65 to 68
minutes.] [NT:ORF_o449] [LE:124871] [RE:126220] [DI:direct] >gp:[GI:g1789403]
[LN:AE000384] [AC:AE000384:U00096] [PN:putative 2-component sensor protein]
[GN:ygiY] [FN:putative regulator; Not classified] [OR:Escherichia coli]
[DB:genpept-bct2] [DE:Escherichia coli K-12 MG1655 section 274 of 400 of the
completegenome.] [NT:o449; This 449 aa ORF is 44 pct identical (3 gaps)]
[LE:9313] [RE:10662] [DI:direct]

| ORF Name | NT ID | AA ID | NT/LN | AA/LN | Score | P-value |
|---|---|---|---|---|---|---|
| 32455342_f1_34 | 2076 | 9247 | 210 | 69 | 222 | 2.5e-18 |

Description sp:[LN:GLGS_ECOLI] [AC:P26649] [GN:GLGS] [OR:Escherichia coli] [DE:GLYCOGEN
SYNTHESIS PROTEIN GLGS] [SP:P26649] [DB:swissprot] >sp:[LN:S25201]
[AC:S25201:G65092:S20998] [PN:glycogen synthesis protein glgS] [GN:glgS]
[OR:Escherichia coli] [DB:pir2] [MP:66.6 min] >gp:[GI:d1017310:g1805589]
[LN:D90897] [AC:D90897:AB001340] [PN:glgS protein] [GN:glgS] [OR:Escherichia
coli] [SR:Escherichia coli (strain:K12) DNA] [DB:genpept-bct1] [DE:E.coli genomic
DNA, 68.6-68.8 min.] [NT:similar to [PIR Accession Number S25201]] [LE:4385]
[RE:4585] [DI:complement] >gp:[GI:g41561] [LN:ECGLGSG] [AC:Z11885] [GN:GlgS]
[OR:Escherichia coli] [DB:genpept-bct1] [DE:E.coli GlgS gene.] [SP:P26649]
[LE:240] [RE:440] [DI:direct] >gp:[GI:g1789428] [LN:AE000386]
[AC:AE000386:U00096] [PN:glycogen biosynthesis, rpoS dependent] [GN:glgS]
[FN:putative enzyme; Macromolecule synthesis,] [OR:Escherichia coli]
[DB:genpept-bct2] [DE:Escherichia coli K-12 MG1655 section 276 of 400 of the
completegenome.] [NT:f66; 100 pct identical to GLGS_ECOLI SW: P26649] [LE:9277]
[RE:9477] [DI:complement]

| ORF Name | NT ID | AA ID | NT/LN | AA/LN | Score | P-value |
|---|---|---|---|---|---|---|
| 33205055_f3_203 | 2077 | 9248 | 537 | 178 | 678 | 1.2e-66 |

Description sp:[LN:MUG_ECOLI] [AC:P43342] [GN:MUG] [OR:Escherichia coli] [EC:3.2.2.-]
[DE:URACIL DNA-GLYCOSYLASE) (UDG)] [SP:P43342] [DB:swissprot] >sp:[LN:B65095]
[AC:B65095] [PN:hypothetical protein b3068] [OR:Escherichia coli] [DB:pir2]
>gp:[GI:g882591] [LN:ECU28379] [AC:U28379] [OR:Escherichia coli]
[DB:genpept-bct1] [DE:Escherichia coli K-12 genome; approximately 68 minutes.]
[NT:ORF_f168] [LE:19762] [RE:20268] [DI:complement] >gp:[GI:g1789449]
[LN:AE000388] [AC:AE000388:U00096] [PN:orf, hypothetical protein] [GN:ygjF]
[FN:orf; Unknown] [OR:Escherichia coli] [DB:genpept-bct2] [DE:Escherichia coli
K-12 MG1655 section 278 of 400 of the completegenome.] [NT:f168; This 168 aa ORF
is 63 pct identical (0 gaps)] [LE:8638] [RE:9144] [DI:complement]

| ORF Name | NT ID | AA ID | NT/LN | AA/LN | Score | P-value |
|---|---|---|---|---|---|---|
| 33261056_f3_269 | 2078 | 9249 | 927 | 308 | 482 | 7.0e-46 |

Description gp:[GI:g3169721] [LN:AF007569] [AC:AF007569] [PN:GstR] [GN:gstR]
[OR:Bradyrhizobium japonicum] [DB:genpept-bct2] [DE:Bradyrhizobium japonicum GstR
(gstR) gene, partial cds, andsuccinate dehydrogenase membrane anchor subunit
(sdhC), membraneanchor subunit (sdhD), flavoprotein subunit (sdhA) and
iron-sulfurprotein subunit (sdhB) genes, complete cds.] [NT:similar to GstR from
Rhizobium leguminosarum - a] [LE:<1] [RE:1029] [DI:direct]

| ORF Name | NT ID | AA ID | NT/LN | AA/LN | Score | P-value |
|---|---|---|---|---|---|---|
| 33728131_c1_364 | 2079 | 9250 | 777 | 258 | 1173 | 4.2e-119 |

Description sp:[LN:UREF_KLEAE] [AC:P18318] [GN:UREF] [OR:Klebsiella aerogenes] [DE:UREASE
ACCESSORY PROTEIN UREF] [SP:P18318] [DB:swissprot] >sp:[LN:E36138] [AC:E36138]
[PN:ureF protein] [OR:Klebsiella pneumoniae] [DB:pir2] >gp:[GI:g149340]
[LN:KPNUREX] [AC:M36068] [PN:urease accessory protein F] [GN:ureF] [OR:Klebsiella
aerogenes] [SR:Klebsiella aerogenes (strain CG253) DNA] [DB:genpept-bct1]
[DE:K.aerogenes urease subunits A (ureA), B (ureB), C (ureC), andurease accessory
protein (ureE, ureF and ureG) genes, complete cds.] [LE:3087] [RE:3761]
[DI:direct]

| ORF Name | NT ID | AA ID | NT/LN | AA/LN | Score | P-value |
|---|---|---|---|---|---|---|
| 33867176_f2_121 | 2080 | 9251 | 405 | 134 | 539 | 6.4e-52 |

Description sp:[LN:H65093] [AC:H65093] [PN:probable dihydroneopterin aldolase,] [GN:ygiG]
[CL:dihydroneopterin aldolase folA:dihydroneopterin aldolase homology]
[OR:Escherichia coli] [EC:4.1.2.25] [DB:pir1] >gp:[GI:g882580] [LN:ECU28379]
[AC:U28379] [OR:Escherichia coli] [DB:genpept-bct1] [DE:Escherichia coli K-12
genome; approximately 68 minutes.] [NT:alternate name ygiG; ORF_f123] [LE:9016]
[RE:9387] [DI:complement] >gp:[GI:g1789438] [LN:AE000387] [AC:AE000387:U00096]
[PN:putative kinase] [GN:ygiG] [FN:putative enzyme; Not classified]
[OR:Escherichia coli] [DB:genpept-bct2] [DE:Escherichia coli K-12 MG1655 section
277 of 400 of the completegenome.] [NT:f123; This 123 aa ORF is 95 pct identical
(0 gaps)] [LE:9141] [RE:9512] [DI:complement]

| ORF Name | NT ID | AA ID | NT LN | AA LN | Score | P-value |
|---|---|---|---|---|---|---|
| 3395791_c2_433 | 2081 | 9252 | 1209 | 402 | 1908 | 5.4e-197 |

Description sp:[LN:YGIC_ECOLI] [AC:P24196] [GN:YGIC] [OR:Escherichia coli] [DE:(O386)] [SP:P24196] [DB:swissprot] >sp:[LN:S22361] [AC:S22361:D65091] [PN:hypothetical protein A] [GN:ygiC] [CL:conserved hypothetical protein HI0929] [OR:Escherichia coli] [DB:pir2] >gp:[GI:g146678] [LN:ECOLUXH] [AC:M77129] [OR:Escherichia coli] [SR:Escherichia coli (strain K-12) DNA] [DB:genpept-bct1] [DE:E.coli luxH gene, complete cds; ORFA-ORFD, complete cds.] [NT:ORFA] [LE:828] [RE:1988] [DI:direct] >gp:[GI:g882568] [LN:ECU28377] [AC:U28377] [OR:Escherichia coli] [DB:genpept-bct1] [DE:Escherichia coli K-12 genome; approximately 65 to 68 minutes.] [NT:ORF_o386; alternate name ygiC; orfA of M77129] [LE:134809] [RE:135969] [DI:direct] >gp:[GI:g1789416] [LN:AE000385] [AC:AE000385:U00096] [PN:putative synthetase/amidase] [GN:ygiC] [FN:putative enzyme; Not classified] [OR:Escherichia coli] [DB:genpept-bct2] [DE:Escherichia coli K-12 MG1655 section 275 of 400 of the completegenome.] [NT:o386; 100 pct identical to YGIC_ECOLI SW: P24196] [LE:8081] [RE:9241] [DI:direct]

| ORF Name | NT ID | AA ID | NT LN | AA LN | Score | P-value |
|---|---|---|---|---|---|---|
| 34159528_f1_66 | 2082 | 9253 | 1089 | 362 | 1401 | 2.9e-143 |

Description sp:[LN:YQHC_ECOLI] [AC:Q46855] [GN:YQHC] [OR:Escherichia coli] [DE:HYPOTHETICAL TRANSCRIPTIONAL REGULATOR IN METC-SUFI INTERGENIC REGION] [SP:Q46855] [DB:swissprot] >sp:[LN:H65087] [AC:H65087] [PN:hypothetical protein b3010] [OR:Escherichia coli] [DB:pir2] >gp:[GI:g882539] [LN:ECU28377] [AC:U28377] [OR:Escherichia coli] [DB:genpept-bct1] [DE:Escherichia coli K-12 genome; approximately 65 to 68 minutes.] [NT:ORF_f375] [LE:108649] [RE:109776] [DI:complement] >gp:[GI:g1789385] [LN:AE000383] [AC:AE000383:U00096] [PN:putative ARAC-type regulatory protein] [GN:yqhC] [FN:putative regulator; Not classified] [OR:Escherichia coli] [DB:genpept-bct2] [DE:Escherichia coli K-12 MG1655 section 273 of 400 of the completegenome.] [NT:f375; This 375 aa ORF is 24 pct identical (10 gaps)] [LE:4725] [RE:5852] [DI:complement]

| ORF Name | NT ID | AA ID | NT LN | AA LN | Score | P-value |
|---|---|---|---|---|---|---|
| 34179833_c3_524 | 2083 | 9254 | 744 | 247 | 953 | 8.6e-96 |

Description sp:[LN:YGIX_ECOLI] [AC:P52076] [GN:YGIX] [OR:Escherichia coli] [DE:PROBABLE TRANSCRIPTIONAL REGULATORY PROTEIN YGIX] [SP:P52076] [DB:swissprot] >sp:[LN:G65089] [AC:G65089] [PN:hypothetical protein b3025] [CL:ompR protein:response regulator homology] [OR:Escherichia coli] [DB:pir2] >gp:[GI:g882555] [LN:ECU28377] [AC:U28377] [OR:Escherichia coli] [DB:genpept-bct1] [DE:Escherichia coli K-12 genome; approximately 65 to 68 minutes.] [NT:ORF_o219] [LE:124215] [RE:124874] [DI:direct] >gp:[GI:g1789402] [LN:AE000384] [AC:AE000384:U00096] [PN:putative 2-component transcriptional regulator] [GN:ygiX] [FN:putative regulator; Not classified] [OR:Escherichia coli] [DB:genpept-bct2] [DE:Escherichia coli K-12 MG1655 section 274 of 400 of the completegenome.] [NT:o219; This 219 aa ORF is 60 pct identical (0 gaps)] [LE:8657] [RE:9316] [DI:direct]

| ORF_Name | NT_ID | AA_ID | NT LN | AA LN | Score | P-value |
|---|---|---|---|---|---|---|
| 34245757_f3_250 | 2084 | 9255 | 1347 | 448 | | |

Description

NO-HIT

| ORF_Name | NT_ID | AA_ID | NT LN | AA LN | Score | P-value |
|---|---|---|---|---|---|---|
| 36130327_f1_86 | 2085 | 9256 | 1866 | 621 | 2848 | 1.3e-296 |

Description sp:[LN:GSP_ECOLI] [AC:P43675] [GN:GSP] [OR:Escherichia coli]
[EC:6.3.1.8:3.5.1.78] [DE:FORMING]) (GSP AMIDASE)]] [SP:P43675] [DB:swissprot]
>sp:[LN:A57538] [AC:A57538:B65085] [PN:glutathionylspermidine synthetase/amidase]
[GN:gsp] [OR:Escherichia coli] [DB:pir2] >gp:[GI:g882517] [LN:ECU28377]
[AC:U28377] [OR:Escherichia coli] [DB:genpept-bct1] [DE:Escherichia coli K-12
genome; approximately 65 to 68 minutes.] [NT:ORF_f619] [LE:91054] [RE:92913]
[DI:complement] >gp:[GI:g1789361] [LN:AE000381] [AC:AE000381:U00096]
[PN:glutathionylspermidine synthetase/amidase] [GN:gsp] [FN:enzyme; Central
intermediary metabolism:] [OR:Escherichia coli] [DB:genpept-bct2] [DE:Escherichia
coli K-12 MG1655 section 271 of 400 of the completegenome.] [NT:f619; 100 pct
identical to GSP_ECOLI SW: P43675] [LE:8547] [RE:10406] [DI:complement]
>gp:[GI:g861186] [LN:ECU23148] [AC:U23148] [PN:glutathionylspermidine
synthetase/amidase] [GN:gsp] [FN:catalyzes formation of an amide bond between]
[OR:Escherichia coli] [DB:genpept-bct2] [DE:Escherichia coli
glutathionylspermidine synthetase/amidase (gsp)gene, complete cds.]
[NT:C-terminal similar to E. coli YjfC, Swiss-Prot] [LE:408] [RE:2267]
[DI:direct]

| ORF_Name | NT_ID | AA_ID | NT LN | AA LN | Score | P-value |
|---|---|---|---|---|---|---|
| 36151711_c3_513 | 2086 | 9257 | 840 | 279 | 1270 | 2.2e-129 |

Description sp:[LN:YQHE_ECOLI] [AC:Q46857] [GN:YQHE] [OR:Escherichia coli] [DE:HYPOTHETICAL
OXIDOREDUCTASE IN METC-SUFI INTERGENIC REGION] [SP:Q46857] [DB:swissprot]

| ORF_Name | NT_ID | AA_ID | NT LN | AA LN | Score | P-value |
|---|---|---|---|---|---|---|
| 36415628_f2_154 | 2087 | 9258 | 447 | 148 | 537 | 1.0e-51 |

Description sp:[LN:YGIW_ECOLI] [AC:P52083] [GN:YGIW] [OR:Escherichia coli] [DE:PROTEIN YGIW
PRECURSOR] [SP:P52083] [DB:swissprot] >sp:[LN:F65089] [AC:F65089] [PN:ygiW
protein precursor] [GN:ygiW] [CL:hypothetical protein b3024] [OR:Escherichia
coli] [DB:pir2] >gp:[GI:g882554] [LN:ECU28377] [AC:U28377] [OR:Escherichia coli]
[DB:genpept-bct1] [DE:Escherichia coli K-12 genome; approximately 65 to 68
minutes.] [NT:ORF_f130] [LE:123671] [RE:124063] [DI:complement] >gp:[GI:g1789401]
[LN:AE000384] [AC:AE000384:U00096] [PN:orf, hypothetical protein] [GN:ygiW]
[FN:orf; Unknown] [OR:Escherichia coli] [DB:genpept-bct2] [DE:Escherichia coli
K-12 MG1655 section 274 of 400 of the completegenome.] [NT:f130; This 130 aa ORF
is 38 pct identical (10 gaps)] [LE:8113] [RE:8505] [DI:complement]

| ORF Name | NT ID | AA ID | NT/LN | AA/LN | Score | P-value |
|---|---|---|---|---|---|---|
| 36598750_cl_354 | 2088 | 9259 | 843 | 280 | 1410 | 3.2e-144 |

Description sp:[LN:URED_KLEPN] [AC:Q02944] [GN:URED] [OR:Klebsiella pneumoniae] [DE:UREASE ACCESSORY PROTEIN URED] [SP:Q02944] [DB:swissprot] >sp:[LN:S32937] [AC:S32937] [PN:ureD protein] [GN:ureD] [OR:Klebsiella pneumoniae] [DB:pir2] >gp:[GI:g149331] [LN:KPNURE] [AC:L07039] [PN:urease] [GN:ureD] [OR:Klebsiella pneumoniae] [SR:Klebsiella pneumoniae (strain IA551) DNA] [DB:genpept-bct1] [DE:Klebsiella pneumoniae urease (ureD) gene, complete cds, urease(ureA) gene, complete cds.] [LE:175] [RE:987] [DI:direct]

| ORF Name | NT ID | AA ID | NT/LN | AA/LN | Score | P-value |
|---|---|---|---|---|---|---|
| 3923586_f1_82 | 2089 | 9260 | 504 | 167 | 753 | 1.3e-74 |

Description sp:[LN:YQHA_ECOLI] [AC:P52082] [GN:YQHA] [OR:Escherichia coli] [DE:HYPOTHETICAL 18.6 KD PROTEIN IN HYBA-EXBD INTERGENIC REGION (F164)] [SP:P52082] [DB:swissprot] >sp:[LN:H65086] [AC:H65086] [PN:hypothetical protein b3002] [CL:conserved hypothetical protein HI0507] [OR:Escherichia coli] [DB:pir2] >gp:[GI:g882531] [LN:ECU28377] [AC:U28377] [OR:Escherichia coli] [DB:genpept-bct1] [DE:Escherichia coli K-12 genome; approximately 65 to 68 minutes.] [NT:ORF_f164] [LE:103365] [RE:103859] [DI:complement] >gp:[GI:g1789376] [LN:AE000382] [AC:AE000382:U00096] [PN:orf, hypothetical protein] [GN:yqhA] [FN:orf; Unknown] [OR:Escherichia coli] [DB:genpept-bct2] [DE:Escherichia coli K-12 MG1655 section 272 of 400 of the completegenome.] [NT:f164; Residues 32-151 are 67 pct identical to] [LE:10407] [RE:10901] [DI:complement]

| ORF Name | NT ID | AA ID | NT/LN | AA/LN | Score | P-value |
|---|---|---|---|---|---|---|
| 3957838_cl_355 | 2090 | 9261 | 312 | 103 | 494 | 3.7e-47 |

Description sp:[LN:URE3_KLEAE] [AC:P18316] [GN:UREA] [OR:Klebsiella aerogenes] [EC:3.5.1.5] [DE:UREASE GAMMA SUBUNIT, (UREA AMIDOHYDROLASE)] [SP:P18316] [DB:swissprot] >sp:[LN:A36138] [AC:A36138:S32938] [PN:urease, 11K chain:urea amidohydrolase:urease chain A:urease gamma chain] [GN:ureA] [CL:urease 11K chain:urease 11K chain homology] [OR:Klebsiella pneumoniae] [EC:3.5.1.5] [DB:pir1] >gp:[GI:g149336] [LN:KPNUREX] [AC:M36068] [PN:urease subunit A] [GN:ureA] [OR:Klebsiella aerogenes] [SR:Klebsiella aerogenes (strain CG253) DNA] [DB:genpept-bct1] [DE:K.aerogenes urease subunits A (ureA), B (ureB), C (ureC), andurease accessory protein (ureE, ureF and ureG) genes, complete cds.] [LE:271] [RE:573] [DI:direct]

| ORF_Name | NT_ID | AA_ID | NT/LN | AA/LN | Score | P-value |
|---|---|---|---|---|---|---|
| 4025318_c3_566 | 2091 | 9262 | 1617 | 538 | 1206 | 1.3e-122 |

Description sp:[LN:C70565] [AC:C70565] [PN:hypothetical protein Rv3454] [GN:Rv3454]
[OR:Mycobacterium tuberculosis] [DB:pir2] >gp:[GI:e316058:g2104377] [LN:MTY13E12]
[AC:Z95390:AL123456] [PN:hypothetical protein Rv3454] [GN:Rv3454]
[OR:Mycobacterium tuberculosis] [DB:genpept-bct1] [DE:Mycobacterium tuberculosis
H37Rv complete genome; segment 147/162.] [NT:Rv3454, (MTCY13E12.07), len: 422 aa.
Some] [LE:6548] [RE:7816] [DI:direct]

| ORF_Name | NT_ID | AA_ID | NT/LN | AA/LN | Score | P-value |
|---|---|---|---|---|---|---|
| 4112716_c1_287 | 2092 | 9263 | 1284 | 427 | | |

Description

NO-HIT

| ORF_Name | NT_ID | AA_ID | NT/LN | AA/LN | Score | P-value |
|---|---|---|---|---|---|---|
| 4352253_f1_94 | 2093 | 9264 | 210 | 69 | | |

Description

NO-HIT

| ORF_Name | NT_ID | AA_ID | NT/LN | AA/LN | Score | P-value |
|---|---|---|---|---|---|---|
| 4427012_f1_54 | 2094 | 9265 | 960 | 319 | 478 | 1.9e-45 |

Description sp:[LN:E65089] [AC:E65089] [PN:hypothetical protein b3023] [OR:Escherichia coli]
[DB:pir2] >gp:[GI:g882553] [LN:ECU28377] [AC:U28377] [OR:Escherichia coli]
[DB:genpept-bct1] [DE:Escherichia coli K-12 genome; approximately 65 to 68
minutes.] [NT:ORF_f160] [LE:123136] [RE:123618] [DI:complement] >gp:[GI:g1789400]
[LN:AE000384] [AC:AE000384:U00096] [PN:orf, hypothetical protein] [GN:b3023]
[FN:orf; Unknown] [OR:Escherichia coli] [DB:genpept-bct2] [DE:Escherichia coli
K-12 MG1655 section 274 of 400 of the completegenome.] [NT:f160; This 160 aa ORF
is 27 pct identical (7 gaps)] [LE:7578] [RE:8060] [DI:complement]

| ORF Name | NT ID | AA ID | NT/LN | AA/LN | Score | P-value |
|---|---|---|---|---|---|---|
| 4427143_c1_356 | 2095 | 9266 | 330 | 109 | 561 | 3.0e-54 |

Description sp:[LN:URE2_KLEAE] [AC:P18315] [GN:UREB] [OR:Klebsiella aerogenes] [EC:3.5.1.5]
[DE:UREASE BETA SUBUNIT, (UREA AMIDOHYDROLASE)] [SP:P18315] [DB:swissprot]
>sp:[LN:B36138] [AC:B36138] [PN:urease, 12K chain:urea amidohydrolase:urease beta
chain:urease chain B] [GN:ureB] [CL:urease 12K chain:urease 12K chain homology]
[OR:Klebsiella pneumoniae] [EC:3.5.1.5] [DB:pir1] >gp:[GI:g149337] [LN:KPNUREX]
[AC:M36068] [PN:urease subunit B] [GN:ureB] [OR:Klebsiella aerogenes]
[SR:Klebsiella aerogenes (strain CG253) DNA] [DB:genpept-bct1] [DE:K.aerogenes
urease subunits A (ureA), B (ureB), C (ureC), andurease accessory protein (ureE,
ureF and ureG) genes, complete cds.] [LE:583] [RE:903] [DI:direct]

| ORF Name | NT ID | AA ID | NT/LN | AA/LN | Score | P-value |
|---|---|---|---|---|---|---|
| 4579768_c3_577 | 2096 | 9267 | 3288 | 1095 | 1179 | 8.7e-229 |

Description sp:[LN:EVGS_ECOLI] [AC:P30855:P77644] [GN:EVGS] [OR:Escherichia coli]
[EC:2.7.3.-] [DE:PUTATIVE SENSOR PROTEIN EVGS PRECURSOR,] [SP:P30855:P77644]
[DB:swissprot] >sp:[LN:G65010] [AC:G65010:JU0221:I41200] [PN:sensor protein evgS,
precursor] [GN:evgS] [CL:evgS protein:response regulator homology]
[OR:Escherichia coli] [EC:2.7.3.-] [DB:pir1] >gp:[GI:d1016969:g1799781]
[LN:D90867] [AC:D90867:AB001340] [PN:PUTATIVE SENSOR PROTEIN EVGS PRECURSOR (EC)
[GN:evgS] [OR:Escherichia coli] [SR:Escherichia coli (strain:K12) DNA,
clone_lib:Kohara lambda minise] [DB:genpept-bct1] [DE:E.coli genomic DNA, Kohara
clone #412(53.4-53.8 min.).] [NT:similar to [SwissProt Accession Number P30855]]
[LE:8142] [RE:11735] [DI:direct] >gp:[GI:g1788713] [LN:AE000325]
[AC:AE000325:U00096] [PN:putative sensor for regulator EvgA] [GN:evgS]
[FN:putative regulator; Not classified] [OR:Escherichia coli] [DB:genpept-bct2]
[EC:2.7.3.-] [DE:Escherichia coli K-12 MG1655 section 215 of 400 of the
completegenome.] [NT:o1197; 98 pct identical to EVGS_ECOLI SW: P30855] [LE:3820]
[RE:7413] [DI:direct]

| ORF Name | NT ID | AA ID | NT/LN | AA/LN | Score | P-value |
|---|---|---|---|---|---|---|
| 4766452_f3_274 | 2097 | 9268 | 594 | 197 | | |

Description

NO-HIT

| ORF Name | NT ID | AA ID | NT LN | AA LN | Score | P-value |
|---|---|---|---|---|---|---|
| 4879828_f1_47 | 2098 | 9269 | 432 | 143 | 688 | 1.0e-67 |

Description sp:[LN:YQIB_ECOLI] [AC:P36652] [GN:YQIB] [OR:Escherichia coli] [DE:(F140)]
[SP:P36652] [DB:swissprot] >sp:[LN:G65090] [AC:G65090:B58723] [PN:hypothetical
protein yqiB:hypothetical protein 2, cpdA 5' region] [GN:yqiB] [CL:Escherichia
coli hypothetical protein yqiB] [OR:Escherichia coli] [DB:pir2] [MP:68.4 min]
>gp:[GI:d1004504:g453395] [LN:ECOICC] [AC:D16557] [PN:ORF2] [OR:Escherichia coli]
[SR:Escherichia coli (strain K12, isolate W3110) DNA] [DB:genpept-bct1] [DE:E.
coli DNA for Icc protein, complete cds.] [NT:product was detected by maxicell
method] [LE:538] [RE:960] [DI:direct] >gp:[GI:g882563] [LN:ECU28377] [AC:U28377]
[OR:Escherichia coli] [DB:genpept-bct1] [DE:Escherichia coli K-12 genome;
approximately 65 to 68 minutes.] [NT:ORF_f140; orf2 of D16557] [LE:131246]
[RE:131668] [DI:complement] >gp:[GI:g1789411] [LN:AE000385] [AC:AE000385:U00096]
[PN:putative enzyme] [GN:yqiB] [FN:putative enzyme; Not classified]
[OR:Escherichia coli] [DB:genpept-bct2] [DE:Escherichia coli K-12 MG1655 section
275 of 400 of the completegenome.] [NT:f140; 100 pct identical to YZZH_ECOLI SW:
P36652] [LE:4518] [RE:4940] [DI:complement]

| ORF Name | NT ID | AA ID | NT LN | AA LN | Score | P-value |
|---|---|---|---|---|---|---|
| 4897555_c2_461 | 2099 | 9270 | 1275 | 424 | 1850 | 7.6e-191 |

Description sp:[LN:PRIM_ECOLI] [AC:P02923:P02922] [GN:DNAG:DNAP:PARB] [OR:Escherichia coli]
[EC:2.7.7.-] [DE:DNA PRIMASE,] [SP:P02923:P02922] [DB:swissprot] >sp:[LN:RYEC2]
[AC:A03423:H65094:A03422:I77532] [PN:DNA primase,] [GN:dnaG] [CL:DNA primase]
[OR:Escherichia coli] [EC:2.7.7.-] [DB:pir1] [MP:67 min] >gp:[GI:g1617301]
[LN:ECDNAG] [AC:V00274] [PN:DNA primase] [GN:dnaG] [OR:Escherichia coli]
[DB:genpept-bct1] [DE:E. coli dnaG gene.] [SP:P02923] [LE:182] [RE:1927]
[DI:direct] >gp:[GI:g147755] [LN:ECORPSRPO] [AC:J01687] [GN:dnaG] [OR:Escherichia
coli] [SR:Escherichia coli K12 and HB101 DNA] [DB:genpept-bct1] [DE:E.coli
rpsU-dnaG-rpoD operon with genes coding for ribosomalprotein S21, DNA primase and
RNA polymerase sigma-subunit.] [NT:DNA primase] [LE:1041] [RE:2786] [DI:direct]
>gp:[GI:g882589] [LN:ECU28379] [AC:U28379] [GN:dnaG] [FN:DNA biosynthesis;
primase] [OR:Escherichia coli] [DB:genpept-bct1] [DE:Escherichia coli K-12
genome; approximately 68 minutes.] [NT:CG Site No. 847; alternate gen name dnaP,
parB] [LE:15902] [RE:17647] [DI:direct] >gp:[GI:g1789447] [LN:AE000388]
[AC:AE000388:U00096] [PN:DNA biosynthesis; DNA primase] [GN:dnaG] [FN:enzyme; DNA
- replication, repair,] [OR:Escherichia coli] [DB:genpept-bct2] [EC:2.7.7.-]
[DE:Escherichia coli K-12 MG1655 section 278 of 400 of the completegenome.]
[NT:o581; 100 pct identical to PRIM_ECOLI SW: P02923;] [LE:4778] [RE:6523]
[DI:direct]

| ORF Name | NT ID | AA ID | NT/LN | AA/LN | Score | P-value |
|---|---|---|---|---|---|---|
| 5195340_f2_131 | 2100 | 9271 | 1953 | 650 | 2670 | 1.6e-280 |

Description sp:[LN:GLNE_ECOLI] [AC:P30870:P78107] [GN:GLNE] [OR:Escherichia coli]
[EC:2.7.7.42] [DE:SYNTHETASE ADENYLYLTRANSFERASE) (ATASE)] [SP:P30870:P78107]
[DB:swissprot] >sp:[LN:C65093] [AC:C65093:S37755:S31965]
[PN:[glutamate--ammonia-ligase] adenylyltransferase,] [GN:glnE] [OR:Escherichia
coli] [EC:2.7.7.42] [DB:pir2] >gp:[GI:g1789433] [LN:AE000387]
[AC:AE000387:U00096] [PN:adenylylating enzyme for glutamine synthetase] [GN:glnE]
[FN:enzyme; Proteins - translation and] [OR:Escherichia coli] [DB:genpept-bct2]
[EC:2.7.7.42] [DE:Escherichia coli K-12 MG1655 section 277 of 400 of the
completegenome.] [NT:f946; 99 pct identical (1 gap) to GLNE_ECOLI] [LE:1721]
[RE:4561] [DI:complement]

| ORF Name | NT ID | AA ID | NT/LN | AA/LN | Score | P-value |
|---|---|---|---|---|---|---|
| 5203327_f2_150 | 2101 | 9272 | 843 | 280 | 648 | 1.8e-63 |

Description sp:[LN:I80320] [AC:I80320] [PN:hypothetical protein 1] [OR:Escherichia coli]
[DB:pir2] >gp:[GI:g609327] [LN:ECU18656] [AC:U18656] [OR:Escherichia coli]
[DB:genpept-bct2] [DE:Escherichia coli modulator of drug activity (mda66) and
orf1 genes,complete cds.] [NT:orf1] [LE:468] [RE:1046] [DI:direct]

| ORF Name | NT ID | AA ID | NT/LN | AA/LN | Score | P-value |
|---|---|---|---|---|---|---|
| 5339193_c3_564 | 2102 | 9273 | 486 | 161 | 828 | 1.5e-82 |

Description sp:[LN:UREE_KLEAE] [AC:P18317] [GN:UREE] [OR:Klebsiella aerogenes] [DE:UREASE
ACCESSORY PROTEIN UREE] [SP:P18317] [DB:swissprot] >sp:[LN:D36138] [AC:D36138]
[PN:ureE protein] [OR:Klebsiella pneumoniae] [DB:pir2] >gp:[GI:g149339]
[LN:KPNUREX] [AC:M36068] [PN:urease accessory protein E] [GN:ureE] [OR:Klebsiella
aerogenes] [SR:Klebsiella aerogenes (strain CG253) DNA] [DB:genpept-bct1]
[DE:K.aerogenes urease subunits A (ureA), B (ureB), C (ureC), andurease accessory
protein (ureE, ureF and ureG) genes, complete cds.] [LE:2609] [RE:3085]
[DI:direct]

| ORF Name | NT ID | AA ID | NT/LN | AA/LN | Score | P-value |
|---|---|---|---|---|---|---|
| 6120140_c3_496 | 2103 | 9274 | 948 | 315 | 1330 | 9.6e-136 |

Description sp:[LN:YGHU_ECOLI] [AC:Q46845] [GN:YGHU] [OR:Escherichia coli] [DE:HYPOTHETICAL
34.2 KD PROTEIN IN GSP-HYBG INTERGENIC REGION] [SP:Q46845] [DB:swissprot]
>sp:[LN:C65085] [AC:C65085] [PN:hypothetical protein b2989] [OR:Escherichia coli]
[DB:pir2] >gp:[GI:g882518] [LN:ECU28377] [AC:U28377] [OR:Escherichia coli]
[DB:genpept-bct1] [DE:Escherichia coli K-12 genome; approximately 65 to 68
minutes.] [NT:ORF_o304; GTG start] [LE:93070] [RE:93984] [DI:direct]
>gp:[GI:g1789363] [LN:AE000382] [AC:AE000382:U00096] [PN:orf, hypothetical
protein] [GN:b2989] [FN:orf; Unknown] [OR:Escherichia coli] [DB:genpept-bct2]
[DE:Escherichia coli K-12 MG1655 section 272 of 400 of the completegenome.]
[NT:o304; This 304 aa ORF is 37 pct identical (19 gaps)] [LE:109] [RE:1023]
[DI:direct]

| ORF Name | NT ID | AA ID | NT/LN | AA/LN | Score | P-value |
|---|---|---|---|---|---|---|
| 6511583_f3_265 | 2104 | 9275 | 639 | 212 | 331 | 7.0e-30 |

Description sp:[LN:E75208] [AC:E75208] [PN:aminotransferase PAB2227] [GN:PAB2227]
[OR:Pyrococcus abyssi] [DB:pir2] >gp:[GI:g5457625] [LN:CNSPAX01]
[AC:AJ248283:AL096836] [PN:AMINOTRANSFERASE] [OR:Pyrococcus abyssi]
[DB:genpept-bct1] [DE:Pyrococcus abyssi complete genome; segment 1/6.]
[NT:PAB2227] [LE:196015] [RE:197247] [DI:complement]

| ORF Name | NT ID | AA ID | NT/LN | AA/LN | Score | P-value |
|---|---|---|---|---|---|---|
| 6532081_c2_383 | 2105 | 9276 | 1188 | 395 | 1694 | 2.6e-174 |

Description sp:[LN:S52983] [AC:S52983] [PN:probable cystathionine gamma-lyase,] [OR:Erwinia
herbicola] [EC:4.4.1.1] [DB:pir2]

| ORF Name | NT ID | AA ID | NT/LN | AA/LN | Score | P-value |
|---|---|---|---|---|---|---|
| 6735393_f2_194 | 2106 | 9277 | 285 | 94 | 497 | 1.8e-47 |

Description gp:[GI:e1283282:g2980629] [LN:ECPJB6] [AC:AJ223475] [PN:InsA protein] [GN:insA]
[OR:Escherichia coli] [DB:genpept-bct1] [DE:Escherichia coli yiaK, yiaJ, insB,
and insA genes (plasmid pJB6).] [LE:964] [RE:>1249] [DI:complement]

| ORF Name | NT ID | AA ID | NT/LN | AA/LN | Score | P-value |
|---|---|---|---|---|---|---|
| 6738910_c3_545 | 2107 | 9278 | 1323 | 440 | | |

Description

NO-HIT

| ORF Name | NT ID | AA ID | NT LN | AA LN | Score | P-value |
|---|---|---|---|---|---|---|
| 7144515_c2_423 | 2108 | 9279 | 450 | 149 | 478 | 1.9e-45 |

Description sp:[LN:YGIN_ECOLI] [AC:P40718] [GN:YGIN] [OR:Escherichia coli] [DE:11.5 KD
PROTEIN IN PARC-PARE INTERGENIC REGION] [SP:P40718] [DB:swissprot]
>sp:[LN:C65090] [AC:C65090] [PN:hypothetical protein ygiN] [GN:ygiN]
[CL:Escherichia coli hypothetical protein ygiN] [OR:Escherichia coli] [DB:pir2]
>gp:[GI:g882559] [LN:ECU28377] [AC:U28377] [OR:Escherichia coli]
[DB:genpept-bct1] [DE:Escherichia coli K-12 genome; approximately 65 to 68
minutes.] [NT:ORF_o104] [LE:127530] [RE:127844] [DI:direct] >gp:[GI:g1789407]
[LN:AE000385] [AC:AE000385:U00096] [PN:orf, hypothetical protein] [GN:ygiN]
[FN:orf; Unknown] [OR:Escherichia coli] [DB:genpept-bct2] [DE:Escherichia coli
K-12 MG1655 section 275 of 400 of the completegenome.] [NT:o104; 100 pct
identical to YGIN_ECOLI SW: P40718] [LE:802] [RE:1116] [DI:direct]

| ORF Name | NT ID | AA ID | NT LN | AA LN | Score | P-value |
|---|---|---|---|---|---|---|
| 7266083_f1_58 | 2109 | 9280 | 762 | 253 | 1117 | 3.6e-113 |

Description sp:[LN:PLSC_ECOLI] [AC:P26647] [GN:PLSC:PARF] [OR:Escherichia coli] [EC:2.3.1.51]
[DE:(LPAAT)] [SP:P26647] [DB:swissprot] >sp:[LN:S20460] [AC:S20460:S77999:H65088]
[PN:1-acylglycerol-3-phosphate O-acyltransferase,] [GN:plsC] [OR:Escherichia
coli] [EC:2.3.1.51] [DB:pir2] >gp:[GI:g147298] [LN:ECOPLSC] [AC:M63491]
[PN:1-acyl-glycerol-3-phosphate acyltransferase] [GN:plsC] [FN:produces
diacyl-glycerol-3-phosphate] [OR:Escherichia coli] [SR:Escherichia coli (strain
K-12) (library: Clarke-Carbon) DNA] [DB:genpept-bct1] [DE:Escherichia coli
1-acyl-sn-glycerol-3-phosphate acyltransferase (plsC) gene, complete cds;
periplasmic protein (sufI) gene, 3' end;and peripheral membrane protein (parC)
gene, 5' end.] [LE:325] [RE:1062] [DI:direct] >gp:[GI:g882548] [LN:ECU28377]
[AC:U28377] [PN:1-acyl-glycerol-3-phosphate acyltransferase] [GN:plsC]
[FN:produces diacyl-glycerol-3-phosphate] [OR:Escherichia coli] [DB:genpept-bct1]
[DE:Escherichia coli K-12 genome; approximately 65 to 68 minutes.] [LE:117131]
[RE:117868] [DI:complement] >gp:[GI:g1789395] [LN:AE000384] [AC:AE000384:U00096]
[PN:1-acyl-sn-glycerol-3-phosphate acyltransferase] [GN:plsC] [FN:enzyme;
Macromolecule synthesis, modification:] [OR:Escherichia coli] [DB:genpept-bct2]
[EC:2.3.1.51] [DE:Escherichia coli K-12 MG1655 section 274 of 400 of the
completegenome.] [NT:f245; 100 pct identical to PLSC_ECOLI SW: P26647] [LE:1573]
[RE:2310] [DI:complement]

| ORF Name | NT ID | AA ID | NT/LN | AA/LN | Score | P-value |
|---|---|---|---|---|---|---|
| 10395205_f3_319 | 2110 | 9281 | 843 | 280 | 1042 | 3.2e-105 |

Description sp:[LN:GLDA_CITFR] [AC:P45511] [GN:DHAD] [OR:Citrobacter freundii] [EC:1.1.1.6]
[DE:GLYCEROL DEHYDROGENASE, (GLDH)] [SP:P45511] [DB:swissprot] >gp:[GI:g493084]
[LN:CFU09771] [AC:U09771] [PN:glycerol dehydrogenase] [GN:dhaD] [OR:Citrobacter
freundii] [DB:genpept-bct1] [EC:1.1.1.6] [DE:Citrobacter freundii DSM 30040
cyclopropane fatty acid synthase(cfa) gene, partial cds, dihydroxyacetone kinase
(dhaK), glyceroldehydrogenase (dhaD), transcriptional activator
(dhaR),1,3-propanediol dehydrogenase (dhaT), glycerol dehydratase (dhaB),glycerol
dehydratase (dhaC) and glycerol dehydratase (dhaE) genes,complete cds.] [LE:2557]
[RE:3654] [DI:direct]

| ORF Name | NT ID | AA ID | NT/LN | AA/LN | Score | P-value |
|---|---|---|---|---|---|---|
| 104062_c3_682 | 2111 | 9282 | 636 | 211 | 963 | 7.5e-97 |

Description sp:[LN:YRAO_ECOLI] [AC:P45466] [GN:YRAO] [OR:Escherichia coli] [DE:HYPOTHETICAL
21.1 KD PROTEIN IN AGAI-MTR INTERGENIC REGION (O196)] [SP:P45466] [DB:swissprot]
>sp:[LN:A65105] [AC:A65105] [PN:phosphoheptose isomerase homolog:hypothetical
21.1 kD protein in agai-mtr intergenic region] [GN:yraO] [CL:phosphoheptose
isomerase] [OR:Escherichia coli] [DB:pir1] >gp:[GI:g1789539] [LN:AE000396]
[AC:AE000396:U00096] [PN:orf, hypothetical protein] [GN:yraO] [FN:orf; Unknown]
[OR:Escherichia coli] [DB:genpept-bct2] [DE:Escherichia coli K-12 MG1655 section
286 of 400 of the completegenome.] [NT:o196; 100 pct identical amino acid
sequence and] [LE:2472] [RE:3062] [DI:direct] >gp:[GI:g606089] [LN:ECOUW67]
[AC:U18997] [OR:Escherichia coli] [DB:genpept-bct2] [DE:Escherichia coli K-12
chromosomal region from 67.4 to 76.0 minutes.] [NT:ORF_o196] [LE:76561]
[RE:77151] [DI:direct]

| ORF Name | NT ID | AA ID | NT/LN | AA/LN | Score | P-value |
|---|---|---|---|---|---|---|
| 10678932_f3_327 | 2112 | 9283 | 894 | 297 | 713 | 2.3e-70 |

Description gp:[GI:g940436] [LN:KPU30903] [AC:U30903] [PN:glycerol dehydratase small subunit]
[GN:dhaB3] [OR:Klebsiella pneumoniae] [DB:genpept-bct1] [EC:4.2.1.30]
[DE:Klebsiella pneumoniae dha regulon glycerol dehydratase largesubunit (dhaB4),
small subunit (dhaB3), and medium subunit (dhaB1),and 1,3-propanediol
oxidoreductase (dhaT) genes, complete cds.] [NT:molecular weight is 16,105; orf
3a] [LE:2022] [RE:2447] [DI:complement] >gp:[GI:g1778024] [LN:KPU60992]
[AC:U60992] [PN:glycerol dehydrase gamma subunit] [GN:gldC] [OR:Klebsiella
pneumoniae] [SR:Klebsiella pneumoniae strain=ATCC 25955] [DB:genpept-bct2]
[EC:4.2.1.30] [DE:Klebsiella pneumoniae glycerol dehydrase alpha subunit
(gldA),glycerol dehydrase beta subunit (gldB), and glycerol dehydrasegamma
subunit (gldC) genes, complete cds.] [NT:adenosylcobalamin-dependent glycerol
dehydratase] [LE:2388] [RE:2813] [DI:direct]

| ORF_Name | NT_ID | AA_ID | NT/LN | AA/LN | Score | P-value |
|---|---|---|---|---|---|---|
| 10807283_f2_225 | 2113 | 9284 | 807 | 268 | 610 | 1.9e-59 |

Description sp:[LN:D65011] [AC:D65011] [PN:hypothetical protein b2375] [OR:Escherichia coli]
[DB:pir2] >gp:[GI:g1788719] [LN:AE000326] [AC:AE000326:U00096] [PN:orf,
hypothetical protein] [GN:b2375] [FN:orf; Unknown] [OR:Escherichia coli]
[DB:genpept-bct2] [DE:Escherichia coli K-12 MG1655 section 216 of 400 of the
completegenome.] [NT:f211; This 211 aa ORF is 28 pct identical (4 gaps)] [LE:287]
[RE:922] [DI:complement]

| ORF_Name | NT_ID | AA_ID | NT/LN | AA/LN | Score | P-value |
|---|---|---|---|---|---|---|
| 11017841_c1_402 | 2114 | 9285 | 1008 | 335 | 1351 | 5.7e-138 |

Description sp:[LN:YGJR_ECOLI] [AC:P42599:P42600:P76661] [GN:YGJR] [OR:Escherichia coli]
[DE:HYPOTHETICAL 36.2 KD PROTEIN IN EBGC-UXAA INTERGENIC REGION]
[SP:P42599:P42600:P76661] [DB:swissprot]

| ORF_Name | NT_ID | AA_ID | NT/LN | AA/LN | Score | P-value |
|---|---|---|---|---|---|---|
| 11213918_f1_45 | 2115 | 9286 | 1506 | 501 | 2311 | 1.1e-239 |

Description sp:[LN:UXAA_ECOLI] [AC:P42604] [GN:UXAA] [OR:Escherichia coli] [EC:4.2.1.7]
[DE:ALTRONATE HYDROLASE,] [SP:P42604] [DB:swissprot] >sp:[LN:H65097] [AC:H65097]
[PN:altronate dehydratase,] [GN:uxaA] [OR:Escherichia coli] [EC:4.2.1.7]
[DB:pir2] >gp:[GI:d1019636:g1906767] [LN:D13328] [AC:D13328] [PN:Altronate
dehydratase] [GN:uxaA] [OR:Escherichia coli] [SR:Escherichia coli (strain:K12)
cell_line:W3110 DNA] [DB:genpept-bct1] [EC:4.2.1.7] [DE:Escherichia coli uxaA,
uxaC, exuT and exuR genes for altronatedehydratase, uronate isomerase,
aldohexuronate transport system andexu regulon repressor, complete cds.]
[LE:1085] [RE:2572] [DI:complement] >gp:[GI:g1789475] [LN:AE000391]
[AC:AE000391:U00096] [PN:altronate hydrolase] [GN:uxaA] [FN:enzyme; Degradation
of small molecules: Carbon] [OR:Escherichia coli] [DB:genpept-bct2] [EC:4.2.1.7]
[DE:Escherichia coli K-12 MG1655 section 281 of 400 of the completegenome.]
[NT:f495; 100 pct identical to the first 494 aa of the] [LE:3417] [RE:4904]
[DI:complement] >gp:[GI:g606030] [LN:ECOUW67] [AC:U18997] [OR:Escherichia coli]
[DB:genpept-bct2] [DE:Escherichia coli K-12 chromosomal region from 67.4 to 76.0
minutes.] [NT:ORF_f495] [LE:22576] [RE:24063] [DI:complement]

| ORF Name | NT ID | AA ID | NT/LN | AA/LN | Score | P-value |
|---|---|---|---|---|---|---|
| 11752293_f1_108 | 2116 | 9287 | 597 | 198 | 979 | 1.5e-98 |

Description gp:[GI:g1778023] [LN:KPU60992] [AC:U60992] [PN:glycerol dehydrase beta subunit] [GN:gldB] [OR:Klebsiella pneumoniae] [SR:Klebsiella pneumoniae strain=ATCC 25955] [DB:genpept-bct2] [EC:4.2.1.30] [DE:Klebsiella pneumoniae glycerol dehydrase alpha subunit (gldA),glycerol dehydrase beta subunit (gldB), and glycerol dehydrasegamma subunit (gldC) genes, complete cds.] [NT:adenosylcobalamin-dependent glycerol dehydratase] [LE:1801] [RE:2385] [DI:direct]

| ORF Name | NT ID | AA ID | NT/LN | AA/LN | Score | P-value |
|---|---|---|---|---|---|---|
| 1253431_f3_307 | 2117 | 9288 | 483 | 160 | 165 | 2.7e-12 |

Description sp:[LN:A72741] [AC:A72741] [PN:hypothetical protein APE0458] [GN:APE0458] [OR:Aeropyrum pernix] [DB:pir2] >gp:[GI:d1043207:g5104105] [LN:AP000059] [AC:AP000059] [PN:160aa long hypothetical protein] [GN:APE0458] [OR:Aeropyrum pernix] [SR:Aeropyrum pernix (strain:K1) DNA] [DB:genpept-bct1] [DE:Aeropyrum pernix genomic DNA, section 2/7.] [LE:116432] [RE:116914] [DI:complement]

| ORF Name | NT ID | AA ID | NT/LN | AA/LN | Score | P-value |
|---|---|---|---|---|---|---|
| 12626041_c1_431 | 2118 | 9289 | 342 | 113 | 106 | 4.9e-06 |

Description sp:[LN:H72706] [AC:H72706] [PN:hypothetical protein APE1071] [GN:APE1071] [OR:Aeropyrum pernix] [DB:pir2] >gp:[GI:d1043842:g5104741] [LN:AP000060] [AC:AP000060] [PN:117aa long hypothetical protein] [GN:APE1071] [OR:Aeropyrum pernix] [SR:Aeropyrum pernix (strain:K1) DNA] [DB:genpept-bct1] [DE:Aeropyrum pernix genomic DNA, section 3/7.] [LE:315643] [RE:315996] [DI:complement]

| ORF Name | NT ID | AA ID | NT/LN | AA/LN | Score | P-value |
|---|---|---|---|---|---|---|
| 12753401_c3_641 | 2119 | 9290 | 2064 | 687 | 2898 | 6.7e-302 |

Description sp:[LN:FADH_ECOLI] [AC:P42593] [GN:FADH] [OR:Escherichia coli] [EC:1.3.1.34] [DE:A REDUCTASE)] [SP:P42593] [DB:swissprot]

| ORF_Name | NT ID | AA ID | NT/LN | AA/LN | Score | P-value |
|---|---|---|---|---|---|---|
| 13142003_f1_61 | 2120 | 9291 | 1152 | 383 | 1103 | 1.1e-111 |

Description sp:[LN:YDEY_ECOLI] [AC:P77672] [GN:YDEY] [OR:Escherichia coli] [DE:HYPOTHETICAL ABC TRANSPORTER PERMEASE PROTEIN YDEY] [SP:P77672] [DB:swissprot] >sp:[LN:E64905] [AC:E64905] [PN:probable sugar transport permease protein b1514] [CL:1-arabinose transport system permease araH] [OR:Escherichia coli] [DB:pir2] >gp:[GI:d1015920:g1742491] [LN:D90794] [AC:D90794:AB001340] [PN:L-arabinose transport system permease protein] [GN:araH] [OR:Escherichia coli] [SR:Escherichia coli (strain:K12) DNA, clone_lib:Kohara lambda minise] [DB:genpept-bct1] [DE:E.coli genomic DNA, Kohara clone #303(34.3-34.6 min.).] [NT:ORF_ID:o303#2; similar to [SwissProt Accession] [LE:11432] [RE:12460] [DI:direct] >gp:[GI:g1787793] [LN:AE000249] [AC:AE000249:U00096] [PN:putative transport system permease protein] [GN:ydeY] [FN:putative transport; Not classified] [OR:Escherichia coli] [DB:genpept-bct2] [DE:Escherichia coli K-12 MG1655 section 139 of 400 of the completegenome.] [NT:o342; This 342 aa ORF is 30 pct identical (5 gaps)] [LE:2801] [RE:3829] [DI:direct]

| ORF_Name | NT ID | AA ID | NT/LN | AA/LN | Score | P-value |
|---|---|---|---|---|---|---|
| 13864777_f3_247 | 2121 | 9292 | 885 | 294 | 1368 | 9.0e-140 |

Description sp:[LN:YRAL_ECOLI] [AC:P45528] [GN:YRAL] [OR:Escherichia coli] [DE:HYPOTHETICAL 31.3 KD PROTEIN IN AGAI-MTR INTERGENIC REGION (F286)] [SP:P45528] [DB:swissprot] >sp:[LN:F65104] [AC:F65104] [PN:hypothetical 31.3 kD protein in agai-mtr intergenic region] [GN:yraL] [CL:conserved hypothetical protein MG056] [OR:Escherichia coli] [DB:pir2] >gp:[GI:g1789535] [LN:AE000395] [AC:AE000395:U00096] [PN:orf, hypothetical protein] [GN:yraL] [FN:orf; Unknown] [OR:Escherichia coli] [DB:genpept-bct2] [DE:Escherichia coli K-12 MG1655 section 285 of 400 of the completegenome.] [NT:f286; 100 pct identical amino acid sequence and] [LE:10710] [RE:11570] [DI:complement] >gp:[GI:g606086] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_f286] [LE:73227] [RE:74087] [DI:complement]

| ORF_Name | NT ID | AA ID | NT/LN | AA/LN | Score | P-value |
|---|---|---|---|---|---|---|
| 13884838_f2_204 | 2122 | 9293 | 336 | 111 | 502 | 5.3e-48 |

Description sp:[LN:YGJH_ECOLI] [AC:P42589] [GN:YGJH] [OR:Escherichia coli] [DE:HYPOTHETICAL 12.3 KD PROTEIN IN ILEX-EBGR INTERGENIC REGION] [SP:P42589] [DB:swissprot] >sp:[LN:G65095] [AC:G65095] [PN:hypothetical 12.3 kD protein in ileX-ebgR intergenic region] [GN:ygjH] [OR:Escherichia coli] [DB:pir2] >gp:[GI:g1789455] [LN:AE000389] [AC:AE000389:U00096] [PN:putative tRNA synthetase] [GN:ygjH] [FN:putative enzyme; Not classified] [OR:Escherichia coli] [DB:genpept-bct2] [DE:Escherichia coli K-12 MG1655 section 279 of 400 of the completegenome.] [NT:f110; 100 pct identical to YGJH_ECOLI SW: P42589] [LE:4310] [RE:4642] [DI:complement] >gp:[GI:g606012] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_f110] [LE:1668] [RE:2000] [DI:complement]

| ORF Name | NT ID | AA ID | NT LN | AA LN | Score | P-value |
|---|---|---|---|---|---|---|
| 14100312_f2_146 | 2123 | 9294 | 924 | 307 | 1438 | 3.5e-147 |

Description sp:[LN:YHAE_ECOLI] [AC:P23523] [GN:YHAE] [OR:Escherichia coli] [DE:HYPOTHETICAL 31.0 KD PROTEIN IN RNPB-SOHA INTERGENIC REGION (ORF 2)] [SP:P23523] [DB:swissprot] >sp:[LN:JQ0613] [AC:JQ0613:A65102] [PN:3-hydroxyisobutyrate dehydrogenase, homolog:hypothetical 31K protein (rnpB-sohA intergenic region)] [GN:yhaE] [CL:3-hydroxyisobutyrate dehydrogenase:3-hydroxyisobutyrate dehydrogenase homology] [OR:Escherichia coli] [EC:1.1.1.31] [DB:pir1] [MP:68 min] >gp:[GI:d1014943:g216632] [LN:ECORNPBW] [AC:D90212] [OR:Escherichia coli] [SR:E.coli (strain K12; isolate W3110)genomic DNA, clone 6B5(#515) fro] [DB:genpept-bct1] [DE:E.coli rnpB gene and ORFs.] [NT:ORF2] [LE:528] [RE:1427] [DI:direct] >gp:[GI:g1789513] [LN:AE000394] [AC:AE000394:U00096] [PN:putative dehydrogenase] [GN:yhaE] [FN:putative enzyme; Not classified] [OR:Escherichia coli] [DB:genpept-bct2] [DE:Escherichia coli K-12 MG1655 section 284 of 400 of the completegenome.] [NT:f299; 100 pct identical amino acid sequence and] [LE:2265] [RE:3164] [DI:complement] >gp:[GI:g606065] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_f299] [LE:52620] [RE:53519] [DI:complement]

| ORF Name | NT ID | AA ID | NT LN | AA LN | Score | P-value |
|---|---|---|---|---|---|---|
| 14460180_c1_416 | 2124 | 9295 | 351 | 116 | 386 | 1.0e-35 |

Description sp:[LN:YQJD_ECOLI] [AC:P42617] [GN:YQJD] [OR:Escherichia coli] [DE:HYPOTHETICAL 11.1 KD PROTEIN IN EXUR-TDCC INTERGENIC REGION] [SP:P42617] [DB:swissprot] >sp:[LN:G65098] [AC:G65098] [PN:hypothetical 11.1 kD protein in exuR-tdcC intergenic region] [GN:yqjD] [CL:conserved hypothetical protein b2672] [OR:Escherichia coli] [DB:pir2] >gp:[GI:g1789485] [LN:AE000392] [AC:AE000392:U00096] [PN:orf, hypothetical protein] [GN:yqjD] [FN:orf; Unknown] [OR:Escherichia coli] [DB:genpept-bct2] [DE:Escherichia coli K-12 MG1655 section 282 of 400 of the completegenome.] [NT:o101; 100 pct identical to YQJD_ECOLI SW: P42617] [LE:517] [RE:822] [DI:direct] >gp:[GI:g606039] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_o101] [LE:30127] [RE:30432] [DI:direct]

| ORF Name | NT ID | AA ID | NT LN | AA LN | Score | P-value |
|---|---|---|---|---|---|---|
| 14572127_c1_405 | 2125 | 9296 | 1251 | 416 | 1825 | 3.4e-188 |

Description sp:[LN:YGJU_ECOLI] [AC:P42602] [GN:YGJU] [OR:Escherichia coli] [DE:HYPOTHETICAL
43.5 KD PROTEIN IN EBGC-UXAA INTERGENIC REGION (O414)] [SP:P42602] [DB:swissprot]
>sp:[LN:F65097] [AC:F65097] [PN:hypothetical 43.5 kD protein in ebgC-exuT
intergenic region] [GN:ygjU] [OR:Escherichia coli] [DB:pir2] >gp:[GI:g1789473]
[LN:AE000391] [AC:AE000391:U00096] [PN:putative transport protein] [GN:ygjU]
[FN:putative transport; Not classified] [OR:Escherichia coli] [DB:genpept-bct2]
[DE:Escherichia coli K-12 MG1655 section 281 of 400 of the completegenome.]
[NT:o414; o414; Geneplot suggests frameshift near start] [LE:1534] [RE:2778]
[DI:direct] >gp:[GI:g606028] [LN:ECOUW67] [AC:U18997] [OR:Escherichia coli]
[DB:genpept-bct2] [DE:Escherichia coli K-12 chromosomal region from 67.4 to 76.0
minutes.] [NT:ORF_o414; Geneplot suggests frameshift near start] [LE:20693]
[RE:21937] [DI:direct]

| ORF Name | NT ID | AA ID | NT LN | AA LN | Score | P-value |
|---|---|---|---|---|---|---|
| 1458257_f2_173 | 2126 | 9297 | 1167 | 388 | 1430 | 2.4e-146 |

Description sp:[LN:YGJO_ECOLI] [AC:P42596] [GN:YGJO] [OR:Escherichia coli] [DE:HYPOTHETICAL
43.4 KD PROTEIN IN EBGC-UXAA INTERGENIC REGION] [SP:P42596] [DB:swissprot]
>sp:[LN:A65097] [AC:A65097] [PN:hypothetical 43.4 kD protein in ebgC-exuT
intergenic region] [GN:ygjO] [OR:Escherichia coli] [DB:pir2] >gp:[GI:g1789466]
[LN:AE000390] [AC:AE000390:U00096] [PN:putative enzyme] [GN:ygjO] [FN:putative
enzyme; Not classified] [OR:Escherichia coli] [DB:genpept-bct2] [DE:Escherichia
coli K-12 MG1655 section 280 of 400 of the completegenome.] [NT:f388; 100 pct
identical amino acid sequence and] [LE:7035] [RE:8201] [DI:complement]
>gp:[GI:g606022] [LN:ECOUW67] [AC:U18997] [OR:Escherichia coli] [DB:genpept-bct2]
[DE:Escherichia coli K-12 chromosomal region from 67.4 to 76.0 minutes.]
[NT:ORF_f388] [LE:15490] [RE:16656] [DI:complement]

| ORF Name | NT ID | AA ID | NT LN | AA LN | Score | P-value |
|---|---|---|---|---|---|---|
| 14667882_c1_354 | 2127 | 9298 | 657 | 218 | 928 | 3.8e-93 |

Description gp:[GI:d1037042:g4062782] [LN:D90754] [AC:D90754:AB001340] [OR:Escherichia coli]
[SR:Escherichia coli(strain:K12) DNA, clone:Kohara clone #245] [DB:genpept-bct1]
[DE:Escherichia coli genomic DNA. (26.8 - 27.1 min).] [NT:ORF_ID:o246#1]
[LE:11222] [RE:11929] [DI:complement]

| ORF_Name | NT_ID | AA_ID | NT/LN | AA/LN | Score | P-value |
|---|---|---|---|---|---|---|
| 14875033_c2_576 | 2128 | 9299 | 1014 | 337 | 1647 | 2.5e-169 |

Description sp:[LN:YHBW_ECOLI] [AC:P45529] [GN:YHBW] [OR:Escherichia coli] [DE:HYPOTHETICAL 37.1 KD PROTEIN IN SOHA-MTR INTERGENIC REGION (O335)] [SP:P45529] [DB:swissprot] >sp:[LN:D65106] [AC:D65106] [PN:hypothetical 37.1 kD protein in sohA-mtr intergenic region] [GN:yhbW] [CL:ynbW protein] [OR:Escherichia coli] [DB:pir1] >gp:[GI:g1789551] [LN:AE000397] [AC:AE000397:U00096] [PN:putative enzyme] [GN:yhbW] [FN:putative enzyme; Not classified] [OR:Escherichia coli] [DB:genpept-bct2] [DE:Escherichia coli K-12 MG1655 section 287 of 400 of the completegenome.] [NT:o335; 100 pct identical amino acid sequence and] [LE:71] [RE:1078] [DI:direct] >gp:[GI:g606100] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_o335] [LE:84200] [RE:85207] [DI:direct]

| ORF_Name | NT_ID | AA_ID | NT/LN | AA/LN | Score | P-value |
|---|---|---|---|---|---|---|
| 16016038_c3_582 | 2129 | 9300 | 222 | 73 | | |

Description

NO-HIT

| ORF_Name | NT_ID | AA_ID | NT/LN | AA/LN | Score | P-value |
|---|---|---|---|---|---|---|
| 16022962_c1_452 | 2130 | 9301 | 438 | 145 | 336 | 2.1e-30 |

Description sp:[LN:YHBQ_ECOLI] [AC:P45472] [GN:YHBQ] [OR:Escherichia coli] [DE:HYPOTHETICAL 11.3 KD PROTEIN IN SOHA-MTR INTERGENIC REGION (O100)] [SP:P45472] [DB:swissprot] >sp:[LN:G65105] [AC:G65105] [PN:hypothetical 11.3 kD protein in sohA-mtr intergenic region] [GN:yhbQ] [CL:hypothetical protein 312] [OR:Escherichia coli] [DB:pir1] >gp:[GI:g1789545] [LN:AE000396] [AC:AE000396:U00096] [PN:orf, hypothetical protein] [GN:yhbQ] [FN:orf; Unknown] [OR:Escherichia coli] [DB:genpept-bct2] [DE:Escherichia coli K-12 MG1655 section 286 of 400 of the completegenome.] [NT:o100; 100 pct identical amino acid sequence and] [LE:6629] [RE:6931] [DI:direct] >gp:[GI:g606095] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_o100] [LE:80718] [RE:81020] [DI:direct]

| ORF Name | NT ID | AA ID | NT/LN | AA/LN | Score | P-value |
|---|---|---|---|---|---|---|
| 16025832_c2_507 | 2131 | 9302 | 1068 | 355 | 1578 | 5.0e-162 |

Description sp:[LN:YGJI_ECOLI] [AC:P42590] [GN:YGJI] [OR:Escherichia coli] [DE:HYPOTHETICAL 52.1 KD PROTEIN IN EBGC-UXAA INTERGENIC REGION] [SP:P42590] [DB:swissprot] >sp:[LN:C65096] [AC:C65096] [PN:hypothetical 52.1 kD protein in ebgC-exuT intergenic region] [GN:ygjI] [OR:Escherichia coli] [DB:pir2] >gp:[GI:g1789459] [LN:AE000389] [AC:AE000389:U00096] [PN:putative oxidoreductase] [GN:ygjI] [FN:orf; Not classified] [OR:Escherichia coli] [DB:genpept-bct2] [DE:Escherichia coli K-12 MG1655 section 279 of 400 of the completegenome.] [NT:100 pct identical amino acid sequence and equal] [LE:9629] [RE:11062] [DI:direct] >gp:[GI:g606016] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_o477] [LE:6987] [RE:8420] [DI:direct]

| ORF Name | NT ID | AA ID | NT/LN | AA/LN | Score | P-value |
|---|---|---|---|---|---|---|
| 16126005_c2_530 | 2132 | 9303 | 204 | 67 | | |

Description

NO-HIT

| ORF Name | NT ID | AA ID | NT/LN | AA/LN | Score | P-value |
|---|---|---|---|---|---|---|
| 16297907_f3_321 | 2133 | 9304 | 2013 | 670 | 3034 | 0.0 |

Description sp:[LN:DHAR_CITFR] [AC:P45512] [GN:DHAR] [OR:Citrobacter freundii] [DE:GLYCEROL METABOLISM OPERON REGULATORY PROTEIN] [SP:P45512] [DB:swissprot] >gp:[GI:g493085] [LN:CFU09771] [AC:U09771] [PN:transcriptional activator] [GN:dhaR] [OR:Citrobacter freundii] [DB:genpept-bct1] [DE:Citrobacter freundii DSM 30040 cyclopropane fatty acid synthase(cfa) gene, partial cds, dihydroxyacetone kinase (dhaK), glyceroldehydrogenase (dhaD), transcriptional activator (dhaR),1,3-propanediol dehydrogenase (dhaT), glycerol dehydratase (dhaB),glycerol dehydratase (dhaC) and glycerol dehydratase (dhaE) genes,complete cds.] [NT:putative s54 interaction domain and] [LE:3746] [RE:5671] [DI:direct]

| ORF Name | NT ID | AA ID | NT/LN | AA/LN | Score | P-value |
|---|---|---|---|---|---|---|
| 16432125_c2_581 | 2134 | 9305 | 369 | 122 | 141 | 1.8e-08 |

Description gp:[GI:g3005587] [LN:AF048977] [AC:AF048977] [PN:Ser/Arg-related nuclear matrix protein] [GN:SRM160] [FN:splicing factor] [OR:Homo sapiens] [SR:human] [DB:genpept-pri3] [DE:Homo sapiens Ser/Arg-related nuclear matrix protein (SRM160) mRNA,complete cds.] [NT:160 kDa] [LE:6] [RE:2468] [DI:direct]

| ORF Name | NT ID | AA ID | NT/LN | AA/LN | Score | P-value |
|---|---|---|---|---|---|---|
| 16535138_f3_330 | 2135 | 9306 | 987 | 328 | 1180 | 7.6e-120 |

Description gp:[GI:e1510727:g5327228] [LN:SFGLPFG] [AC:Z11768:S47683] [GN:glpF] [OR:Shigella flexneri] [DB:genpept-bct1] [DE:S.flexneri glpF gene.] [NT:amber stop sodon] [LE:1] [RE:846] [DI:direct]

| ORF Name | NT ID | AA ID | NT/LN | AA/LN | Score | P-value |
|---|---|---|---|---|---|---|
| 16663967_c1_347 | 2136 | 9307 | 420 | 139 | 602 | 1.3e-58 |

Description gp:[GI:g940441] [LN:KPU30903] [AC:U30903] [PN:unknown] [OR:Klebsiella pneumoniae] [DB:genpept-bct1] [DE:Klebsiella pneumoniae dha regulon glycerol dehydratase largesubunit (dhaB4), small subunit (dhaB3), and medium subunit (dhaB1),and 1,3-propanediol oxidoreductase (dhaT) genes, complete cds.] [NT:orf 2b] [LE:6762] [RE:7115] [DI:direct]

| ORF Name | NT ID | AA ID | NT/LN | AA/LN | Score | P-value |
|---|---|---|---|---|---|---|
| 16893931_f1_110 | 2137 | 9308 | 618 | 205 | 869 | 6.8e-87 |

Description gp:[GI:g940435] [LN:KPU30903] [AC:U30903] [PN:glycerol dehydratase large subunit] [GN:dhaB4] [OR:Klebsiella pneumoniae] [DB:genpept-bct1] [EC:4.2.1.30] [DE:Klebsiella pneumoniae dha regulon glycerol dehydratase largesubunit (dhaB4), small subunit (dhaB3), and medium subunit (dhaB1),and 1,3-propanediol oxidoreductase (dhaT) genes, complete cds.] [NT:molecular weight is 63,577; orf 3] [LE:186] [RE:2009] [DI:complement]

| ORF Name | NT ID | AA ID | NT/LN | AA/LN | Score | P-value |
|---|---|---|---|---|---|---|
| 16898432_c1_336 | 2138 | 9309 | 252 | 83 | 133 | 2.0e-07 |

Description sp:[LN:EVGS_ECOLI] [AC:P30855:P77644] [GN:EVGS] [OR:Escherichia coli] [EC:2.7.3.-] [DE:PUTATIVE SENSOR PROTEIN EVGS PRECURSOR,] [SP:P30855:P77644] [DB:swissprot] >sp:[LN:G65010] [AC:G65010:JU0221:I41200] [PN:sensor protein evgS, precursor] [GN:evgS] [CL:evgS protein:response regulator homology] [OR:Escherichia coli] [EC:2.7.3.-] [DB:pir1] >gp:[GI:d1016969:g1799781] [LN:D90867] [AC:D90867:AB001340] [PN:PUTATIVE SENSOR PROTEIN EVGS PRECURSOR (EC) [GN:evgS] [OR:Escherichia coli] [SR:Escherichia coli (strain:K12) DNA, clone_lib:Kohara lambda minise] [DB:genpept-bct1] [DE:E.coli genomic DNA, Kohara clone #412(53.4-53.8 min.).] [NT:similar to [SwissProt Accession Number P30855]] [LE:8142] [RE:11735] [DI:direct] >gp:[GI:g1788713] [LN:AE000325] [AC:AE000325:U00096] [PN:putative sensor for regulator EvgA] [GN:evgS] [FN:putative regulator; Not classified] [OR:Escherichia coli] [DB:genpept-bct2] [EC:2.7.3.-] [DE:Escherichia coli K-12 MG1655 section 215 of 400 of the completegenome.] [NT:o1197; 98 pct identical to EVGS_ECOLI SW: P30855] [LE:3820] [RE:7413] [DI:direct]

| ORF Name | NT ID | AA ID | NT/LN | AA/LN | Score | P-value |
|---|---|---|---|---|---|---|
| 19645333_f1_99 | 2139 | 9310 | 393 | 130 | 626 | 3.8e-61 |

Description sp:[LN:GLDA_CITFR] [AC:P45511] [GN:DHAD] [OR:Citrobacter freundii] [EC:1.1.1.6]
[DE:GLYCEROL DEHYDROGENASE, (GLDH)] [SP:P45511] [DB:swissprot] >gp:[GI:g493084]
[LN:CFU09771] [AC:U09771] [PN:glycerol dehydrogenase] [GN:dhaD] [OR:Citrobacter
freundii] [DB:genpept-bct1] [EC:1.1.1.6] [DE:Citrobacter freundii DSM 30040
cyclopropane fatty acid synthase(cfa) gene, partial cds, dihydroxyacetone kinase
(dhaK), glyceroldehydrogenase (dhaD), transcriptional activator
(dhaR),1,3-propanediol dehydrogenase (dhaT), glycerol dehydratase (dhaB),glycerol
dehydratase (dhaC) and glycerol dehydratase (dhaE) genes,complete cds.] [LE:2557]
[RE:3654] [DI:direct]

| ORF Name | NT ID | AA ID | NT/LN | AA/LN | Score | P-value |
|---|---|---|---|---|---|---|
| 19659378_c2_493 | 2140 | 9311 | 1677 | 558 | 2339 | 1.2e-242 |

Description sp:[LN:DHAK_CITFR] [AC:P45510] [GN:DHAK] [OR:Citrobacter freundii] [EC:2.7.1.29]
[DE:DIHYDROXYACETONE KINASE, (GLYCERONE KINASE)] [SP:P45510] [DB:swissprot]
>gp:[GI:g493083] [LN:CFU09771] [AC:U09771] [PN:dihydroxyacetone kinase] [GN:dhaK]
[OR:Citrobacter freundii] [DB:genpept-bct1] [EC:2.7.1.29] [DE:Citrobacter
freundii DSM 30040 cyclopropane fatty acid synthase(cfa) gene, partial cds,
dihydroxyacetone kinase (dhaK), glyceroldehydrogenase (dhaD), transcriptional
activator (dhaR),1,3-propanediol dehydrogenase (dhaT), glycerol dehydratase
(dhaB),glycerol dehydratase (dhaC) and glycerol dehydratase (dhaE) genes,complete
cds.] [NT:the initial methionine in the mature protein is] [LE:337] [RE:1995]
[DI:complement]

| ORF Name | NT ID | AA ID | NT/LN | AA/LN | Score | P-value |
|---|---|---|---|---|---|---|
| 20493905_c3_615 | 2141 | 9312 | 1434 | 477 | 2295 | 5.3e-238 |

Description sp:[LN:F65095] [AC:F65095] [PN:ornithine--oxo-acid transaminase,] [GN:ygjG]
[OR:Escherichia coli] [EC:2.6.1.13] [DB:pir2] >gp:[GI:g1789454] [LN:AE000389]
[AC:AE000389:U00096] [PN:probable ornithine aminotransferase] [GN:ygjG]
[FN:putative enzyme; Amino acid biosynthesis:] [OR:Escherichia coli]
[DB:genpept-bct2] [EC:2.6.1.13] [DE:Escherichia coli K-12 MG1655 section 279 of
400 of the completegenome.] [NT:o496; 100 pct identical to 429 amino acids of]
[LE:2778] [RE:4268] [DI:direct] >gp:[GI:g606011] [LN:ECOUW67] [AC:U18997]
[OR:Escherichia coli] [DB:genpept-bct2] [DE:Escherichia coli K-12 chromosomal
region from 67.4 to 76.0 minutes.] [NT:ORF_o496] [LE:136] [RE:1626] [DI:direct]

| ORF Name | NT ID | AA ID | NT/LN | AA/LN | Score | P-value |
|---|---|---|---|---|---|---|
| 20519061_c2_539 | 2142 | 9313 | 813 | 270 | 1254 | 1.1e-127 |

Description sp:[LN:C65098] [AC:C65098] [PN:exu regulon regulator] [GN:exuR] [CL:regulatory protein uxuR 2] [OR:Escherichia coli] [DB:pir2] >gp:[GI:g1789480] [LN:AE000391] [AC:AE000391:U00096] [PN:negative regulator of exu regulon, exuT, uxaAC,] [GN:exuR] [FN:regulator; Degradation of small molecules:] [OR:Escherichia coli] [DB:genpept-bct2] [DE:Escherichia coli K-12 MG1655 section 281 of 400 of the completegenome.] [NT:o263; 100 pct identical amino acid sequence and] [LE:8227] [RE:9018] [DI:direct] >gp:[GI:g606035] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_o263] [LE:27389] [RE:28180] [DI:direct]

| ORF Name | NT ID | AA ID | NT/LN | AA/LN | Score | P-value |
|---|---|---|---|---|---|---|
| 21692643_f1_1 | 2143 | 9314 | 447 | 148 | 733 | 1.8e-72 |

Description sp:[LN:DEAD_KLEPN] [AC:P33906] [GN:DEAD] [OR:Klebsiella pneumoniae] [DE:ATP-DEPENDENT RNA HELICASE DEAD] [SP:P33906] [DB:swissprot] >sp:[LN:JX0314] [AC:JX0314] [PN:DEAD box protein] [CL:unassigned DEAD/H box helicases:DEAD/H box helicase homology] [OR:Klebsiella pneumoniae] [DB:pir2] >gp:[GI:g149184] [LN:KPNDEAD] [AC:L08387] [PN:RNA helicase] [GN:deaD] [OR:Klebsiella pneumoniae] [SR:Klebsiella pneumoniae (strain CG43) DNA] [DB:genpept-bct1] [DE:Klebsiella pneumoniae possible RNA helicase (deaD) gene, completecds.] [NT:DeaD protein, a possible RNA helicase] [LE:215] [RE:2194] [DI:direct]

| ORF Name | NT ID | AA ID | NT/LN | AA/LN | Score | P-value |
|---|---|---|---|---|---|---|
| 21775383_c2_560 | 2144 | 9315 | 300 | 99 | 508 | 1.2e-48 |

Description sp:[LN:T09187] [AC:T09187] [PN:hypothetical protein o263] [CL:Escherichia coli hypothetical protein o263] [OR:Escherichia coli] [DB:pir2] >gp:[GI:d1015680:g1742223] [LN:D90774] [AC:D90774:AB001340] [GN:IS5] [OR:Escherichia coli] [SR:Escherichia coli (strain:K12) DNA, clone_lib:Kohara lambda minise] [DB:genpept-bct1] [DE:E.coli genomic DNA, Kohara clone #263(30.5-30.9 min.).] [NT:ORF_ID:o263#20; similar to [SwissProt Accession] [LE:13994] [RE:14362] [DI:direct] >gp:[GI:d1015689:g1742241] [LN:D90775] [AC:D90775:AB001340] [GN:IS5] [OR:Escherichia coli] [SR:Escherichia coli (strain:K12) DNA, clone_lib:Kohara lambda minise] [DB:genpept-bct1] [DE:E.coli genomic DNA, Kohara clone #264(30.7-31.1 min.).] [NT:ORF_ID:o263#20; similar to [SwissProt Accession] [LE:2441] [RE:2809] [DI:direct]

| ORF Name | NT ID | AA ID | NT/LN | AA/LN | Score | P-value |
|---|---|---|---|---|---|---|
| 22010438_c1_409 | 2145 | 9316 | 1344 | 447 | | |

Description

NO-HIT

| ORF Name | NT ID | AA ID | NT LN | AA LN | Score | P-value |
|---|---|---|---|---|---|---|
| 22150058_c3_680 | 2146 | 9317 | 2142 | 713 | 1319 | 1.4e-134 |

Description sp:[LN:YRAM_ECOLI] [AC:P45464] [GN:YRAM] [OR:Escherichia coli] [DE:HYPOTHETICAL 72.8 KD PROTEIN IN AGAI-MTR INTERGENIC REGION (O678)] [SP:P45464] [DB:swissprot] >sp:[LN:G65104] [AC:G65104] [PN:hypothetical 72.8 kD protein in agai-mtr intergenic region] [GN:yraM] [OR:Escherichia coli] [DB:pir2] >gp:[GI:g1789537] [LN:AE000396] [AC:AE000396:U00096] [PN:putative glycosylase] [GN:yraM] [FN:putative enzyme; Not classified] [OR:Escherichia coli] [DB:genpept-bct2] [DE:Escherichia coli K-12 MG1655 section 286 of 400 of the completegenome.] [NT:o678; 100 pct identical amino acid sequence and] [LE:63] [RE:2099] [DI:direct] >gp:[GI:g606087] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_o678] [LE:74152] [RE:76188] [DI:direct]

| ORF Name | NT ID | AA ID | NT LN | AA LN | Score | P-value |
|---|---|---|---|---|---|---|
| 22458580_c2_561 | 2147 | 9318 | 348 | 115 | 469 | 1.7e-44 |

Description sp:[LN:T09188] [AC:T09188:F64887] [PN:probable outer membrane protein b1371] [OR:Escherichia coli] [DB:pir2] >gp:[GI:d1015681:g1742232] [LN:D90774] [AC:D90774:AB001340] [PN:Outer membrane protein Lom precursor (ORF)] [OR:Escherichia coli] [SR:Escherichia coli (strain:K12) DNA, clone_lib:Kohara lambda minise] [DB:genpept-bct1] [DE:E.coli genomic DNA, Kohara clone #263(30.5-30.9 min.).] [NT:ORF_ID:o263#21; similar to [SwissProt Accession] [LE:14435] [RE:14896] [DI:direct] >gp:[GI:d1015690:g1742242] [LN:D90775] [AC:D90775:AB001340] [PN:Outer membrane protein Lom precursor (ORF)] [OR:Escherichia coli] [SR:Escherichia coli (strain:K12) DNA, clone_lib:Kohara lambda minise] [DB:genpept-bct1] [DE:E.coli genomic DNA, Kohara clone #264(30.7-31.1 min.).] [NT:ORF_ID:o263#21; similar to [SwissProt Accession] [LE:2882] [RE:3343] [DI:direct] >gp:[GI:g1787635] [LN:AE000234] [AC:AE000234:U00096] [PN:orf, hypothetical protein] [GN:b1371] [FN:orf; Unknown] [OR:Escherichia coli] [DB:genpept-bct2] [DE:Escherichia coli K-12 MG1655 section 124 of 400 of the completegenome.] [NT:o153; This 153 aa ORF is 57 pct identical (0 gaps)] [LE:874] [RE:1335] [DI:direct]

| ORF Name | NT ID | AA ID | NT/LN | AA/LN | Score | P-value |
|---|---|---|---|---|---|---|
| 22542216_c3_640 | 2148 | 9319 | 1680 | 559 | 2137 | 2.9e-221 |

Description sp:[LN:YDEV_ECOLI] [AC:P77432:Q99894] [GN:YDEV] [OR:Escherichia coli]
[DE:HYPOTHETICAL SUGAR KINASE IN HIPB-UXAB INTERGENIC REGION] [SP:P77432:Q99894]
[DB:swissprot] >sp:[LN:B64905] [AC:B64905] [PN:sugar kinase homolog ydeV]
[GN:ydeV] [OR:Escherichia coli] [DB:pir2] >gp:[GI:d1015910:g1742480] [LN:D90793]
[AC:D90793:AB001340] [PN:Xylulose kinase (EC 2.7.1.17) (Xylulokinase).]
[OR:Escherichia coli] [SR:Escherichia coli (strain:K12) DNA, clone_lib:Kohara
lambda minise] [DB:genpept-bct1] [DE:E.coli genomic DNA, Kohara clone
302(34.1-34.5 min.).] [NT:ORF_ID:o302#4; similar to [SwissProt Accession]
[LE:14356] [RE:15948] [DI:complement] >gp:[GI:d1015917:g1742488] [LN:D90794]
[AC:D90794:AB001340] [PN:Xylulose kinase (EC 2.7.1.17) (Xylulokinase).]
[OR:Escherichia coli] [SR:Escherichia coli (strain:K12) DNA, clone_lib:Kohara
lambda minise] [DB:genpept-bct1] [DE:E.coli genomic DNA, Kohara clone
303(34.3-34.6 min.).] [NT:ORF_ID:o302#4; similar to [SwissProt Accession]
[LE:7029] [RE:8621] [DI:complement] >gp:[GI:g1787789] [LN:AE000248]
[AC:AE000248:U00096] [PN:putative kinase] [GN:ydeV] [FN:putative enzyme; Not
classified] [OR:Escherichia coli] [DB:genpept-bct2] [DE:Escherichia coli K-12
MG1655 section 138 of 400 of the completegenome.] [NT:f530; This 530 aa ORF is 25
pct identical (21 gaps)] [LE:8550] [RE:10142] [DI:complement]

| ORF Name | NT ID | AA ID | NT/LN | AA/LN | Score | P-value |
|---|---|---|---|---|---|---|
| 22830001_f1_44 | 2149 | 9320 | 1476 | 491 | 2412 | 2.1e-250 |

Description sp:[LN:UXAC_ECOLI] [AC:P42607:P42606:P42605:P76664:P76663:P76662] [GN:UXAC]
[OR:Escherichia coli] [EC:5.3.1.12] [DE:ISOMERASE)]
[SP:P42607:P42606:P42605:P76664:P76663:P76662] [DB:swissprot] >sp:[LN:A65098]
[AC:A65098] [PN:glucuronate isomerase,] [GN:uxaC] [OR:Escherichia coli]
[EC:5.3.1.12] [DB:pir2] >gp:[GI:d1003091:g1160318] [LN:D13328] [AC:D13328]
[PN:Uronate isomerase] [GN:uxaC] [OR:Escherichia coli] [SR:Escherichia coli
(strain:K12) cell_line:W3110 DNA] [DB:genpept-bct1] [EC:5.3.1.12] [DE:Escherichia
coli uxaA, uxaC, exuT and exuR genes for altronatedehydratase, uronate isomerase,
aldohexuronate transport system andexu regulon repressor, complete cds.]
[LE:2587] [RE:3999] [DI:complement] >gp:[GI:g2367192] [LN:AE000391]
[AC:AE000391:U00096] [PN:uronate isomerase] [GN:uxaC] [FN:enzyme; Degradation of
small molecules: Carbon] [OR:Escherichia coli] [DB:genpept-bct2] [EC:5.3.1.12]
[DE:Escherichia coli K-12 MG1655 section 281 of 400 of the completegenome.]
[NT:f470; sequence changes joined 3 ORFs from earlier] [LE:4919] [RE:6331]
[DI:complement]

| ORF Name | NT ID | AA ID | NT/LN | AA/LN | Score | P-value |
|---|---|---|---|---|---|---|
| 22867692_f3_311 | 2150 | 9321 | 237 | 78 | | |

Description

NO-HIT

| ORF_Name | NT ID | AA ID | NT LN | AA LN | Score | P-value |
|---|---|---|---|---|---|---|
| 23886067_c2_549 | 2151 | 9322 | 717 | 238 | 998 | 1.5e-100 |

Description sp:[LN:YHAK_ECOLI] [AC:P42624] [GN:YHAK] [OR:Escherichia coli] [DE:HYPOTHETICAL 25.9 KD PROTEIN IN EXUR-TDCC INTERGENIC REGION (O233)] [SP:P42624] [DB:swissprot] >sp:[LN:G65099] [AC:G65099] [PN:hypothetical 25.9 kD protein in exuR-tdcC intergenic region] [GN:yhaK] [CL:conserved hypothetical protein sll1773] [OR:Escherichia coli] [DB:pir2] >gp:[GI:g1789493] [LN:AE000392] [AC:AE000392:U00096] [PN:orf, hypothetical protein] [GN:yhaK] [FN:orf; Unknown] [OR:Escherichia coli] [DB:genpept-bct2] [DE:Escherichia coli K-12 MG1655 section 282 of 400 of the completegenome.] [NT:o233; 100 pct identical amino acid sequence and] [LE:5461] [RE:6162] [DI:direct] >gp:[GI:g606047] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_o233] [LE:35072] [RE:35773] [DI:direct]

| ORF_Name | NT ID | AA ID | NT LN | AA LN | Score | P-value |
|---|---|---|---|---|---|---|
| 24276541_f3_253 | 2152 | 9323 | 786 | 261 | 1165 | 2.9e-118 |

Description sp:[LN:YHAF_ECOLI] [AC:P23522] [GN:YHAF] [OR:Escherichia coli] [DE:HYPOTHETICAL 27.4 KD PROTEIN IN RNPB-SOHA INTERGENIC REGION (ORF 1)] [SP:P23522] [DB:swissprot] >sp:[LN:B65102] [AC:B65102:JQ0612] [PN:hypothetical 27.4K protein (rnpB-sohA intergenic region)] [GN:yhaF] [CL:2,4-dihydroxyhept-2-ene-1,7] [OR:Escherichia coli] [DB:pir2] [MP:68 min] >gp:[GI:g1789514] [LN:AE000394] [AC:AE000394:U00096] [PN:orf, hypothetical protein] [GN:yhaF] [FN:orf; Unknown] [OR:Escherichia coli] [DB:genpept-bct2] [DE:Escherichia coli K-12 MG1655 section 284 of 400 of the completegenome.] [NT:f256; 100 pct identical amino acid sequence and] [LE:3185] [RE:3955] [DI:complement] >gp:[GI:g606066] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_f256] [LE:53540] [RE:54310] [DI:complement]

| ORF_Name | NT ID | AA ID | NT LN | AA LN | Score | P-value |
|---|---|---|---|---|---|---|
| 24391926_f1_89 | 2153 | 9324 | 873 | 290 | 935 | 6.9e-94 |

Description sp:[LN:YQJH_ECOLI] [AC:Q46871] [GN:YQJH] [OR:Escherichia coli] [DE:HYPOTHETICAL 28.9 KD PROTEIN IN RPOD-AER INTERGENIC REGION] [SP:Q46871] [DB:swissprot] >sp:[LN:C65095] [AC:C65095] [PN:hypothetical protein b3070] [OR:Escherichia coli] [DB:pir2] >gp:[GI:g882592] [LN:ECU28379] [AC:U28379] [OR:Escherichia coli] [DB:genpept-bct1] [DE:Escherichia coli K-12 genome; approximately 68 minutes.] [NT:ORF_f254] [LE:20522] [RE:21286] [DI:complement] >gp:[GI:g1789450] [LN:AE000388] [AC:AE000388:U00096] [PN:orf, hypothetical protein] [GN:yqjH] [FN:orf; Unknown] [OR:Escherichia coli] [DB:genpept-bct2] [DE:Escherichia coli K-12 MG1655 section 278 of 400 of the completegenome.] [NT:f254; This 254 aa ORF is 24 pct identical (5 gaps)] [LE:9398] [RE:10162] [DI:complement]

| ORF Name | NT ID | AA ID | NT LN | AA LN | Score | P-value |
|---|---|---|---|---|---|---|
| 24391927_c1_359 | 2154 | 9325 | 582 | 193 | 578 | 4.7e-56 |

Description sp:[LN:YQJI_ECOLI] [AC:Q46872] [GN:YQJI] [OR:Escherichia coli] [DE:HYPOTHETICAL 23.4 KD PROTEIN IN RPOD-AER INTERGENIC REGION] [SP:Q46872] [DB:swissprot] >sp:[LN:D65095] [AC:D65095] [PN:hypothetical protein b3071] [OR:Escherichia coli] [DB:pir2] >gp:[GI:g882593] [LN:ECU28379] [AC:U28379] [OR:Escherichia coli] [DB:genpept-bct1] [DE:Escherichia coli K-12 genome; approximately 68 minutes.] [NT:ORF_o207] [LE:21574] [RE:22197] [DI:direct] >gp:[GI:g1789452] [LN:AE000389] [AC:AE000389:U00096] [PN:orf, hypothetical protein] [GN:yqjI] [FN:orf; Unknown] [OR:Escherichia coli] [DB:genpept-bct2] [DE:Escherichia coli K-12 MG1655 section 279 of 400 of the completegenome.] [NT:o207; This 207 aa ORF is 42 pct identical (7 gaps)] [LE:174] [RE:797] [DI:direct]

| ORF Name | NT ID | AA ID | NT LN | AA LN | Score | P-value |
|---|---|---|---|---|---|---|
| 24415927_c3_603 | 2155 | 9326 | 1077 | 358 | 1597 | 4.9e-164 |

Description sp:[LN:E64866] [AC:E64866] [PN:hypothetical protein b1200] [OR:Escherichia coli] [DB:pir2] >gp:[GI:d1037043:g4062783] [LN:D90754] [AC:D90754:AB001340] [PN:Hypothetical protein] [OR:Escherichia coli] [SR:Escherichia coli(strain:K12) DNA, clone:Kohara clone #245] [DB:genpept-bct1] [DE:Escherichia coli genomic DNA. (26.8 - 27.1 min).] [NT:ORF_ID:o246#2; similar to PIR Accession Number] [LE:11865] [RE:12965] [DI:complement] >gp:[GI:g1787450] [LN:AE000218] [AC:AE000218:U00096] [PN:putative dihydroxyacetone kinase (EC 2.7.1.2)] [GN:b1200] [FN:putative enzyme; Not classified] [OR:Escherichia coli] [DB:genpept-bct2] [DE:Escherichia coli K-12 MG1655 section 108 of 400 of the completegenome.] [NT:f366; 35 pct identical (32 gaps) to 355 residues] [LE:5171] [RE:6271] [DI:complement]

| ORF Name | NT ID | AA ID | NT LN | AA LN | Score | P-value |
|---|---|---|---|---|---|---|
| 24415937_c2_546 | 2156 | 9327 | 396 | 131 | 634 | 5.5e-62 |

Description sp:[LN:YQJF_ECOLI] [AC:P42619] [GN:YQJF] [OR:Escherichia coli] [DE:HYPOTHETICAL 17.2 KD PROTEIN IN EXUR-TDCC INTERGENIC REGION] [SP:P42619] [DB:swissprot] >sp:[LN:B65099] [AC:B65099] [PN:hypothetical 17.2 kD protein in exuR-tdcC intergenic region] [GN:yqjF] [OR:Escherichia coli] [DB:pir2] >gp:[GI:g1789488] [LN:AE000392] [AC:AE000392:U00096] [PN:orf, hypothetical protein] [GN:yqjF] [FN:orf; Unknown] [OR:Escherichia coli] [DB:genpept-bct2] [DE:Escherichia coli K-12 MG1655 section 282 of 400 of the completegenome.] [NT:o160; 100 pct identical amino acid sequence and] [LE:1614] [RE:2096] [DI:direct] >gp:[GI:g606042] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_o160] [LE:31224] [RE:31706] [DI:direct]

| ORF_Name | NT_ID | AA_ID | NT/LN | AA/LN | Score | P-value |
|---|---|---|---|---|---|---|
| 24432663_c3_583 | 2157 | 9328 | 1005 | 334 | 482 | 1.1e-44 |

Description sp:[LN:EVGS_ECOLI] [AC:P30855:P77644] [GN:EVGS] [OR:Escherichia coli]
[EC:2.7.3.-] [DE:PUTATIVE SENSOR PROTEIN EVGS PRECURSOR,] [SP:P30855:P77644]
[DB:swissprot] >sp:[LN:G65010] [AC:G65010:JU0221:I41200] [PN:sensor protein evgS,
precursor] [GN:evgS] [CL:evgS protein:response regulator homology]
[OR:Escherichia coli] [EC:2.7.3.-] [DB:pir1] >gp:[GI:d1016969:g1799781]
[LN:D90867] [AC:D90867:AB001340] [PN:PUTATIVE SENSOR PROTEIN EVGS PRECURSOR (EC]
[GN:evgS] [OR:Escherichia coli] [SR:Escherichia coli (strain:K12) DNA,
clone_lib:Kohara lambda minise] [DB:genpept-bct1] [DE:E.coli genomic DNA, Kohara
clone #412(53.4-53.8 min.).] [NT:similar to [SwissProt Accession Number P30855]]
[LE:8142] [RE:11735] [DI:direct] >gp:[GI:g1788713] [LN:AE000325]
[AC:AE000325:U00096] [PN:putative sensor for regulator EvgA] [GN:evgS]
[FN:putative regulator; Not classified] [OR:Escherichia coli] [DB:genpept-bct2]
[EC:2.7.3.-] [DE:Escherichia coli K-12 MG1655 section 215 of 400 of the
completegenome.] [NT:o1197; 98 pct identical to EVGS_ECOLI SW: P30855] [LE:3820]
[RE:7413] [DI:direct]

| ORF_Name | NT_ID | AA_ID | NT/LN | AA/LN | Score | P-value |
|---|---|---|---|---|---|---|
| 24492840_f2_123 | 2158 | 9329 | 456 | 151 | 596 | 5.8e-58 |

Description sp:[LN:YHBP_ECOLI] [AC:P45471] [GN:YHBP] [OR:Escherichia coli] [DE:HYPOTHETICAL
16.8 KD PROTEIN IN SOHA-MTR INTERGENIC REGION (F147)] [SP:P45471] [DB:swissprot]
>sp:[LN:F65105] [AC:F65105] [PN:hypothetical protein yhbP] [GN:yhbP]
[CL:Escherichia coli hypothetical protein yhbP] [OR:Escherichia coli] [DB:pir2]
>gp:[GI:g1789544] [LN:AE000396] [AC:AE000396:U00096] [PN:orf, hypothetical
protein] [GN:yhbP] [FN:orf; Unknown] [OR:Escherichia coli] [DB:genpept-bct2]
[DE:Escherichia coli K-12 MG1655 section 286 of 400 of the completegenome.]
[NT:f147; f147; end overlaps end of o186 by 20] [LE:6135] [RE:6578]
[DI:complement] >gp:[GI:g606094] [LN:ECOUW67] [AC:U18997] [OR:Escherichia coli]
[DB:genpept-bct2] [DE:Escherichia coli K-12 chromosomal region from 67.4 to 76.0
minutes.] [NT:ORF_f147; end overlaps end of o186 by 20 bases] [LE:80224]
[RE:80667] [DI:complement]

| ORF Name | NT ID | AA ID | NT LN | AA LN | Score | P-value |
|---|---|---|---|---|---|---|
| 24635952_f1_62 | 2159 | 9330 | 999 | 332 | 1171 | 6.8e-119 |

Description sp:[LN:YDEZ_ECOLI] [AC:P77651] [GN:YDEZ] [OR:Escherichia coli] [DE:HYPOTHETICAL
ABC TRANSPORTER PERMEASE PROTEIN YDEZ] [SP:P77651] [DB:swissprot] >sp:[LN:F64905]
[AC:F64905] [PN:probable sugar transport permease protein b1515] [CL:1-arabinose
transport system permease araH] [OR:Escherichia coli] [DB:pir2]
>gp:[GI:d1015921:g1742492] [LN:D90794] [AC:D90794:AB001340] [PN:Ribose transport
system permease protein RbsC.] [OR:Escherichia coli] [SR:Escherichia coli
(strain:K12) DNA, clone_lib:Kohara lambda minise] [DB:genpept-bct1] [DE:E.coli
genomic DNA, Kohara clone #303(34.3-34.6 min.).] [NT:ORF_ID:o303-4#1; similar to
[SwissProt Accession] [LE:12460] [RE:13452] [DI:direct] >gp:[GI:g1787794]
[LN:AE000249] [AC:AE000249:U00096] [PN:putative transport system permease
protein] [GN:ydeZ] [FN:putative transport; Not classified] [OR:Escherichia coli]
[DB:genpept-bct2] [DE:Escherichia coli K-12 MG1655 section 139 of 400 of the
completegenome.] [NT:o330; This 330 aa ORF is 37 pct identical (6 gaps)]
[LE:3829] [RE:4821] [DI:direct]

| ORF Name | NT ID | AA ID | NT LN | AA LN | Score | P-value |
|---|---|---|---|---|---|---|
| 24636331_c3_645 | 2160 | 9331 | 543 | 180 | 708 | 7.9e-70 |

Description sp:[LN:YGJP_ECOLI] [AC:P42597] [GN:YGJP] [OR:Escherichia coli] [DE:HYPOTHETICAL
20.9 KD PROTEIN IN EBGC-UXAA INTERGENIC REGION (O179)] [SP:P42597] [DB:swissprot]
>sp:[LN:B65097] [AC:B65097] [PN:hypothetical 20.9 kD protein in ebgC-exuT
intergenic region] [GN:ygjP] [OR:Escherichia coli] [DB:pir2] >gp:[GI:g1789467]
[LN:AE000390] [AC:AE000390:U00096] [PN:orf, hypothetical protein] [GN:ygjP]
[FN:orf; Unknown] [OR:Escherichia coli] [DB:genpept-bct2] [DE:Escherichia coli
K-12 MG1655 section 280 of 400 of the completegenome.] [NT:o179; 100 pct
identical amino acid sequence and] [LE:8220] [RE:8759] [DI:direct]
>gp:[GI:g606023] [LN:ECOUW67] [AC:U18997] [OR:Escherichia coli] [DB:genpept-bct2]
[DE:Escherichia coli K-12 chromosomal region from 67.4 to 76.0 minutes.]
[NT:ORF_o179] [LE:16675] [RE:17214] [DI:direct]

| ORF Name | NT ID | AA ID | NT LN | AA LN | Score | P-value |
|---|---|---|---|---|---|---|
| 24891652_c2_501 | 2161 | 9332 | 465 | 154 | 99 | 2.7e-05 |

Description sp:[LN:G72704] [AC:G72704] [PN:hypothetical protein APE1054] [GN:APE1054]
[OR:Aeropyrum pernix] [DB:pir2] >gp:[GI:d1043825:g5104724] [LN:AP000060]
[AC:AP000060] [PN:109aa long hypothetical protein] [GN:APE1054] [OR:Aeropyrum
pernix] [SR:Aeropyrum pernix (strain:K1) DNA] [DB:genpept-bct1] [DE:Aeropyrum
pernix genomic DNA, section 3/7.] [LE:309099] [RE:309428] [DI:complement]

| ORF_Name | NT_ID | AA_ID | NT/LN | AA/LN | Score | P-value |
|---|---|---|---|---|---|---|
| 2542533_f1_9 | 2162 | 9333 | 1818 | 605 | 1533 | 3.0e-157 |

Description sp:[LN:YRAQ_ECOLI] [AC:P45468] [GN:YRAQ] [OR:Escherichia coli] [DE:HYPOTHETICAL
37.3 KD PROTEIN IN AGAI-MTR INTERGENIC REGION (F346)] [SP:P45468] [DB:swissprot]
>sp:[LN:C65105] [AC:C65105] [PN:hypothetical 37.3 kD protein in agai-mtr
intergenic region] [GN:yraQ] [OR:Escherichia coli] [DB:pir2] >gp:[GI:g1789541]
[LN:AE000396] [AC:AE000396:U00096] [PN:orf, hypothetical protein] [GN:yraQ]
[FN:orf; Unknown] [OR:Escherichia coli] [DB:genpept-bct2] [DE:Escherichia coli
K-12 MG1655 section 286 of 400 of the completegenome.] [NT:f346; 100 pct
identical amino acid sequence and] [LE:3761] [RE:4801] [DI:complement]
>gp:[GI:g606091] [LN:ECOUW67] [AC:U18997] [OR:Escherichia coli] [DB:genpept-bct2]
[DE:Escherichia coli K-12 chromosomal region from 67.4 to 76.0 minutes.]
[NT:ORF_f346] [LE:77850] [RE:78890] [DI:complement]

| ORF_Name | NT_ID | AA_ID | NT/LN | AA/LN | Score | P-value |
|---|---|---|---|---|---|---|
| 25522567_c2_542 | 2163 | 9334 | 495 | 164 | 382 | 2.8e-35 |

Description sp:[LN:YQJB_ECOLI] [AC:P42615] [GN:YQJB] [OR:Escherichia coli] [DE:HYPOTHETICAL
14.2 KD PROTEIN IN EXUR-TDCC INTERGENIC REGION] [SP:P42615] [DB:swissprot]
>sp:[LN:E65098] [AC:E65098] [PN:hypothetical 14.2 kD protein in exuR-tdcC
intergenic region] [GN:yqjB] [OR:Escherichia coli] [DB:pir2] >gp:[GI:g1789482]
[LN:AE000391] [AC:AE000391:U00096] [PN:orf, hypothetical protein] [GN:yqjB]
[FN:orf; Unknown] [OR:Escherichia coli] [DB:genpept-bct2] [DE:Escherichia coli
K-12 MG1655 section 281 of 400 of the completegenome.] [NT:o127; 100 pct
identical amino acid sequence and] [LE:10029] [RE:10412] [DI:direct]
>gp:[GI:g606037] [LN:ECOUW67] [AC:U18997] [OR:Escherichia coli] [DB:genpept-bct2]
[DE:Escherichia coli K-12 chromosomal region from 67.4 to 76.0 minutes.]
[NT:ORF_o127a] [LE:29191] [RE:29574] [DI:direct]

| ORF_Name | NT_ID | AA_ID | NT/LN | AA/LN | Score | P-value |
|---|---|---|---|---|---|---|
| 26562827_f1_20 | 2164 | 9335 | 1332 | 443 | 2036 | 1.5e-210 |

Description sp:[LN:YHAU_ECOLI] [AC:P42613] [GN:YHAU] [OR:Escherichia coli] [DE:HYPOTHETICAL
49.0 KD PROTEIN IN RNPB-SOHA INTERGENIC REGION] [SP:P42613] [DB:swissprot]
>sp:[LN:C65102] [AC:C65102] [PN:hypothetical 49.0 kD protein in rnpB-sohA
intergenic region] [GN:yhaU] [CL:hexuronate transporter] [OR:Escherichia coli]
[DB:pir2] >gp:[GI:g1789515] [LN:AE000394] [AC:AE000394:U00096] [PN:putative
transport protein] [GN:yhaU] [FN:putative transport; Not classified]
[OR:Escherichia coli] [DB:genpept-bct2] [DE:Escherichia coli K-12 MG1655 section
284 of 400 of the completegenome.] [NT:f444; 100 pct identical amino acid
sequence and] [LE:3971] [RE:5305] [DI:complement] >gp:[GI:g606067] [LN:ECOUW67]
[AC:U18997] [OR:Escherichia coli] [DB:genpept-bct2] [DE:Escherichia coli K-12
chromosomal region from 67.4 to 76.0 minutes.] [NT:ORF_f444] [LE:54326]
[RE:55660] [DI:complement]

| ORF Name | NT ID | AA ID | NT LN | AA LN | Score | P-value |
|---|---|---|---|---|---|---|
| 2854202_f1_2 | 2165 | 9336 | 528 | 175 | 850 | 7.0e-85 |

Description sp:[LN:MTR_ECOLI] [AC:P22306] [GN:MTR] [OR:Escherichia coli]
[DE:TRYPTOPHAN-SPECIFIC TRANSPORT PROTEIN (TRYPTOPHAN PERMEASE)] [SP:P22306]
[DB:swissprot] >sp:[LN:A39187] [AC:A39187:A44902:E65106] [PN:tryptophan-specific
permease] [GN:mtr] [CL:tyrosine-specific transport protein] [OR:Escherichia coli]
[DB:pir2] [MP:69 min] >gp:[GI:g146894] [LN:ECOMTR] [AC:M59862:M35417]
[PN:tryptophan-specific permease] [GN:mtr] [OR:Escherichia coli] [SR:Escherichia
coli (strain K-12) DNA] [DB:genpept-bct1] [DE:E.coli tryptophan-specific permease
(mtr) gene, complete cds.] [LE:473] [RE:1717] [DI:direct] >gp:[GI:g146896]
[LN:ECOMTRA] [AC:M58338] [PN:tryptophan-specific permease] [GN:mtr]
[OR:Escherichia coli] [SR:Escherichia coli (strain K-12) DNA] [DB:genpept-bct1]
[DE:Escherichia coli mtr tryptophan-specific permease (mtr) gene,complete cds.]
[LE:694] [RE:1938] [DI:direct] >gp:[GI:g1789552] [LN:AE000397]
[AC:AE000397:U00096] [PN:tryptophan-specific transport protein] [GN:mtr]
[FN:transport; Transport of small molecules: Amino] [OR:Escherichia coli]
[DB:genpept-bct2] [DE:Escherichia coli K-12 MG1655 section 287 of 400 of the
completegenome.] [NT:f414; CG Site No. 478; 100 pct identical amino] [LE:1196]
[RE:2440] [DI:complement] >gp:[GI:g606101] [LN:ECOUW67] [AC:U18997]
[PN:tryptophan-specific permease] [GN:mtr] [FN:5-methyltryptophan resistance]
[OR:Escherichia coli] [DB:genpept-bct2] [DE:Escherichia coli K-12 chromosomal
region from 67.4 to 76.0 minutes.] [NT:CG Site No. 478] [LE:85325] [RE:86569]
[DI:complement]

| ORF Name | NT ID | AA ID | NT LN | AA LN | Score | P-value |
|---|---|---|---|---|---|---|
| 2931712_c3_668 | 2166 | 9337 | 270 | 89 | | |

Description

NO-HIT

| ORF Name | NT ID | AA ID | NT LN | AA LN | Score | P-value |
|---|---|---|---|---|---|---|
| 29330217_f1_46 | 2167 | 9338 | 684 | 227 | 727 | 7.6e-72 |

Description sp:[LN:YGJV_ECOLI] [AC:P42603] [GN:YGJV] [OR:Escherichia coli] [DE:HYPOTHETICAL
20.5 KD PROTEIN IN EBGC-UXAA INTERGENIC REGION] [SP:P42603] [DB:swissprot]
>sp:[LN:G65097] [AC:G65097] [PN:hypothetical 20.5 kD protein in ebgC-exuT
intergenic region] [GN:ygjV] [OR:Escherichia coli] [DB:pir2] >gp:[GI:g1789474]
[LN:AE000391] [AC:AE000391:U00096] [PN:orf, hypothetical protein] [GN:ygjV]
[FN:orf; Unknown] [OR:Escherichia coli] [DB:genpept-bct2] [DE:Escherichia coli
K-12 MG1655 section 281 of 400 of the completegenome.] [NT:f183; 100 pct
identical amino acid sequence and] [LE:2783] [RE:3334] [DI:complement]
>gp:[GI:g606029] [LN:ECOUW67] [AC:U18997] [OR:Escherichia coli] [DB:genpept-bct2]
[DE:Escherichia coli K-12 chromosomal region from 67.4 to 76.0 minutes.]
[NT:ORF_f183] [LE:21942] [RE:22493] [DI:complement]

| ORF Name | NT ID | AA ID | NT/LN | AA/LN | Score | P-value |
|---|---|---|---|---|---|---|
| 29457841_f3_233 | 2168 | 9339 | 555 | 184 | 763 | 1.2e-75 |

Description sp:[LN:YHBT_ECOLI] [AC:P45474] [GN:YHBT] [OR:Escherichia coli] [DE:HYPOTHETICAL 19.7 KD PROTEIN IN SOHA-MTR INTERGENIC REGION (F174)] [SP:P45474] [DB:swissprot] >sp:[LN:A65106] [AC:A65106] [PN:hypothetical 19.7 kD protein in sohA-mtr intergenic region] [GN:yhbT] [OR:Escherichia coli] [DB:pir2] >gp:[GI:g1789547] [LN:AE000396] [AC:AE000396:U00096] [PN:orf, hypothetical protein] [GN:yhbT] [FN:orf; Unknown] [OR:Escherichia coli] [DB:genpept-bct2] [DE:Escherichia coli K-12 MG1655 section 286 of 400 of the completegenome.] [NT:f174; 100 pct identical amino acid sequence and] [LE:7415] [RE:7939] [DI:complement] >gp:[GI:g606097] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_f174] [LE:81504] [RE:82028] [DI:complement]

| ORF Name | NT ID | AA ID | NT/LN | AA/LN | Score | P-value |
|---|---|---|---|---|---|---|
| 29949040_f3_254 | 2169 | 9340 | 1305 | 434 | 1604 | 8.9e-165 |

Description sp:[LN:JQ0614] [AC:JQ0614:H65101] [PN:yhaD protein:hypothetical protein 3] [GN:yhaD] [CL:yhaD protein] [OR:Escherichia coli] [DB:pir2] [MP:68 min] >gp:[GI:d1014944:g216633] [LN:ECORNPBW] [AC:D90212] [OR:Escherichia coli] [SR:E.coli (strain K12; isolate W3110)genomic DNA, clone 6B5(#515) fro] [DB:genpept-bct1] [DE:E.coli rnpB gene and ORFs.] [NT:ORF3] [LE:1443] [RE:2669] [DI:direct] >gp:[GI:g1789512] [LN:AE000394] [AC:AE000394:U00096] [PN:orf, hypothetical protein] [GN:yhaD] [FN:orf; Unknown] [OR:Escherichia coli] [DB:genpept-bct2] [DE:Escherichia coli K-12 MG1655 section 284 of 400 of the completegenome.] [NT:f408; 100 pct identical amino acid sequence and] [LE:1023] [RE:2249] [DI:complement] >gp:[GI:g606064] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_f408] [LE:51378] [RE:52604] [DI:complement]

| ORF Name | NT ID | AA ID | NT/LN | AA/LN | Score | P-value |
|---|---|---|---|---|---|---|
| 29958182_f2_116 | 2170 | 9341 | 282 | 93 | 84 | 0.013 |

Description sp:[LN:ODP2_PSEAE] [AC:Q59638] [GN:ACEF:ACEB] [OR:Pseudomonas aeruginosa] [EC:2.3.1.12] [DE:COMPLEX, (E2)] [SP:Q59638] [DB:swissprot] >gp:[GI:g1200525] [LN:PAU47920] [AC:U47920] [PN:dihydrolipoamide acetyltransferase] [GN:aceB] [FN:transfer of acetyl group to CoA; binds] [OR:Pseudomonas aeruginosa] [DB:genpept-bct2] [EC:2.3.1.12] [DE:Pseudomonas aeruginosa pyruvate dehydrogenase (aceA) anddihydrolipoamide acetyltransferase (aceB) genes, complete cds.] [LE:2983] [RE:4623] [DI:direct]

| ORF Name | NT ID | AA ID | NT/LN | AA/LN | Score | P-value |
|---|---|---|---|---|---|---|
| 31667712_c3_625 | 2171 | 9342 | 1101 | 366 | 1581 | 2.4e-162 |

Description sp:[LN:YGJJ_ECOLI] [AC:P42591] [GN:YGJJ] [OR:Escherichia coli] [DE:HYPOTHETICAL
40.1 KD PROTEIN IN EBGC-UXAA INTERGENIC REGION PRECURSOR] [SP:P42591]
[DB:swissprot] >sp:[LN:D65096] [AC:D65096] [PN:hypothetical 40.1 kD protein in
ebgC-exuT intergenic region] [GN:ygjJ] [OR:Escherichia coli] [DB:pir2]
>gp:[GI:g1789461] [LN:AE000390] [AC:AE000390:U00096] [PN:orf, hypothetical
protein] [GN:ygjJ] [FN:orf; Unknown] [OR:Escherichia coli] [DB:genpept-bct2]
[DE:Escherichia coli K-12 MG1655 section 280 of 400 of the completegenome.]
[NT:o356; 100 pct identical amino acid sequence and] [LE:97] [RE:1167]
[DI:direct] >gp:[GI:g606017] [LN:ECOUW67] [AC:U18997] [OR:Escherichia coli]
[DB:genpept-bct2] [DE:Escherichia coli K-12 chromosomal region from 67.4 to 76.0
minutes.] [NT:ORF_o356] [LE:8554] [RE:9624] [DI:direct]

| ORF Name | NT ID | AA ID | NT/LN | AA/LN | Score | P-value |
|---|---|---|---|---|---|---|
| 31816651_c1_415 | 2172 | 9343 | 573 | 190 | 430 | 2.3e-40 |

Description sp:[LN:YQJC_ECOLI] [AC:P42616] [GN:YQJC] [OR:Escherichia coli] [DE:HYPOTHETICAL
14.5 KD PROTEIN IN EXUR-TDCC INTERGENIC REGION PRECURSOR] [SP:P42616]
[DB:swissprot] >sp:[LN:F65098] [AC:F65098] [PN:hypothetical 14.5 kD protein in
exuR-tdcC intergenic region] [GN:yqjC] [OR:Escherichia coli] [DB:pir2]
>gp:[GI:g2367195] [LN:AE000392] [AC:AE000392:U00096] [PN:orf, hypothetical
protein] [GN:yqjC] [FN:orf; Unknown] [OR:Escherichia coli] [DB:genpept-bct2]
[DE:Escherichia coli K-12 MG1655 section 282 of 400 of the completegenome.]
[NT:o127; 99 pct identical amino acid sequence and] [LE:96] [RE:479] [DI:direct]

| ORF Name | NT ID | AA ID | NT/LN | AA/LN | Score | P-value |
|---|---|---|---|---|---|---|
| 31838212_f3_292 | 2173 | 9344 | 1017 | 338 | 1176 | 2.0e-119 |

Description sp:[LN:YNEB_ECOLI] [AC:P76143] [GN:YNEB] [OR:Escherichia coli] [DE:HYPOTHETICAL
31.9 KD PROTEIN IN HIPB-UXAB INTERGENIC REGION] [SP:P76143] [DB:swissprot]
>sp:[LN:H64905] [AC:H64905] [PN:conserved hypothetical protein b1517]
[OR:Escherichia coli] [DB:pir2] >gp:[GI:g1787796] [LN:AE000249]
[AC:AE000249:U00096] [PN:orf, hypothetical protein] [GN:yneB] [FN:orf; Unknown]
[OR:Escherichia coli] [DB:genpept-bct2] [DE:Escherichia coli K-12 MG1655 section
139 of 400 of the completegenome.] [NT:o291; This 291 aa ORF is 40 pct identical
(6 gaps)] [LE:5882] [RE:6757] [DI:direct]

| ORF_Name | NT ID | AA ID | NT/LN | AA/LN | Score | P-value |
|---|---|---|---|---|---|---|
| 31909408_f1_54 | 2174 | 9345 | 834 | 277 | 128 | 3.5e-06 |

Description gp:[GI:g6015817] [LN:SSU18930] [AC:Y18930] [PN:hypothetical protein]
[GN:ORF-c09_009] [OR:Sulfolobus solfataricus] [DB:genpept-bct1] [DE:Sulfolobus solfataricus 281 kb genomic DNA fragment, strain P2.] [LE:157106] [RE:157780]
[DI:direct]

| ORF_Name | NT ID | AA ID | NT/LN | AA/LN | Score | P-value |
|---|---|---|---|---|---|---|
| 32037791_c1_425 | 2175 | 9346 | 525 | 174 | | |

Description

NO-HIT

| ORF_Name | NT ID | AA ID | NT/LN | AA/LN | Score | P-value |
|---|---|---|---|---|---|---|
| 32164137_c2_470 | 2176 | 9347 | 354 | 117 | 197 | 1.1e-15 |

Description sp:[LN:S30269] [AC:S30269:S30265:S47729:H65148] [PN:protein hdeB precursor:hypothetical protein B] [GN:hdeB] [OR:Escherichia coli] [DB:pir2]
>gp:[GI:d1002361:g216432] [LN:ECO10KLS] [AC:D11109] [PN:10K-S protein]
[OR:Escherichia coli] [SR:Escherichia coli (strain:K-12) DNA] [DB:genpept-bct1]
[DE:E. coli gene for 10K-L and 10K-S protein.] [LE:1009] [RE:1347] [DI:direct]
>gp:[GI:g466646] [LN:ECOUW76] [AC:U00039] [OR:Escherichia coli] [SR:Escherichia coli (sub_strain MG1655, strain K-12) (library: lambda] [DB:genpept-bct1] [DE:E. coli chromosomal region from 76.0 to 81.5 minutes.] [NT:alternate name 10K-S of D11109] [LE:70225] [RE:70563] [DI:complement] >gp:[GI:g1789925] [LN:AE000427]
[AC:AE000427:U00096] [PN:orf, hypothetical protein] [GN:hdeB] [FN:orf; Unknown]
[OR:Escherichia coli] [DB:genpept-bct2] [DE:Escherichia coli K-12 MG1655 section 317 of 400 of the completegenome.] [NT:f112; 100 pct identical amino acid sequence and] [LE:5083] [RE:5421] [DI:complement]

| ORF_Name | NT ID | AA ID | NT/LN | AA/LN | Score | P-value |
|---|---|---|---|---|---|---|
| 32235063_f2_190 | 2177 | 9348 | 357 | 118 | 351 | 5.3e-32 |

Description sp:[LN:YNEC_ECOLI] [AC:P76144] [GN:YNEC] [OR:Escherichia coli] [DE:HYPOTHETICAL 11.3 KD PROTEIN IN HIPB-UXAB INTERGENIC REGION] [SP:P76144] [DB:swissprot]
>sp:[LN:A64906] [AC:A64906] [PN:hypothetical protein b1518] [OR:Escherichia coli]
[DB:pir2] >gp:[GI:g1787797] [LN:AE000249] [AC:AE000249:U00096] [PN:orf,
hypothetical protein] [GN:b1518] [FN:orf; Unknown] [OR:Escherichia coli]
[DB:genpept-bct2] [DE:Escherichia coli K-12 MG1655 section 139 of 400 of the completegenome.] [NT:o96; This 96 aa ORF is 31 pct identical (1 gap)] [LE:6781]
[RE:7071] [DI:direct]

| ORF Name | NT ID | AA ID | NT LN | AA LN | Score | P-value |
|---|---|---|---|---|---|---|
| 32313842_f2_149 | 2178 | 9349 | 966 | 321 | 1425 | 8.2e-146 |

Description sp:[LN:YHAJ_ECOLI] [AC:P42623] [GN:YHAJ] [OR:Escherichia coli] [DE:HYPOTHETICAL
TRANSCRIPTIONAL REGULATOR IN EXUR-TDCC INTERGENIC REGION] [SP:P42623]
[DB:swissprot] >sp:[LN:F65099] [AC:F65099] [PN:hypothetical transcription
regulator exuR-tdcC intergenic region] [GN:yhaJ] [CL:probable transcription
regulator ybbS] [OR:Escherichia coli] [DB:pir1] >gp:[GI:g1789492] [LN:AE000392]
[AC:AE000392:U00096] [PN:putative transcriptional regulator LYSR-type] [GN:yhaJ]
[FN:putative regulator; Not classified] [OR:Escherichia coli] [DB:genpept-bct2]
[DE:Escherichia coli K-12 MG1655 section 282 of 400 of the completegenome.]
[NT:f298; 100 pct identical amino acid sequence and] [LE:4460] [RE:5356]
[DI:complement] >gp:[GI:g606046] [LN:ECOUW67] [AC:U18997] [OR:Escherichia coli]
[DB:genpept-bct2] [DE:Escherichia coli K-12 chromosomal region from 67.4 to 76.0
minutes.] [NT:ORF_f298] [LE:34071] [RE:34967] [DI:complement]

| ORF Name | NT ID | AA ID | NT LN | AA LN | Score | P-value |
|---|---|---|---|---|---|---|
| 3244706_f1_3 | 2179 | 9350 | 717 | 238 | 1098 | 3.7e-111 |

Description sp:[LN:MTR_ECOLI] [AC:P22306] [GN:MTR] [OR:Escherichia coli]
[DE:TRYPTOPHAN-SPECIFIC TRANSPORT PROTEIN (TRYPTOPHAN PERMEASE)] [SP:P22306]
[DB:swissprot] >sp:[LN:A39187] [AC:A39187:A44902:E65106] [PN:tryptophan-specific
permease] [GN:mtr] [CL:tyrosine-specific transport protein] [OR:Escherichia coli]
[DB:pir2] [MP:69 min] >gp:[GI:g146894] [LN:ECOMTR] [AC:M59862:M35417]
[PN:tryptophan-specific permease] [GN:mtr] [OR:Escherichia coli] [SR:Escherichia
coli (strain K-12) DNA] [DB:genpept-bct1] [DE:E.coli tryptophan-specific permease
(mtr) gene, complete cds.] [LE:473] [RE:1717] [DI:direct] >gp:[GI:g146896]
[LN:ECOMTRA] [AC:M58338] [PN:tryptophan-specific permease] [GN:mtr]
[OR:Escherichia coli] [SR:Escherichia coli (strain K-12) DNA] [DB:genpept-bct1]
[DE:Escherichia coli mtr tryptophan-specific permease gene,complete cds.]
[LE:694] [RE:1938] [DI:direct] >gp:[GI:g1789552] [LN:AE000397]
[AC:AE000397:U00096] [PN:tryptophan-specific transport protein] [GN:mtr]
[FN:transport; Transport of small molecules: Amino] [OR:Escherichia coli]
[DB:genpept-bct2] [DE:Escherichia coli K-12 MG1655 section 287 of 400 of the
completegenome.] [NT:f414; CG Site No. 478; 100 pct identical amino] [LE:1196]
[RE:2440] [DI:complement] >gp:[GI:g606101] [LN:ECOUW67] [AC:U18997]
[PN:tryptophan-specific permease] [GN:mtr] [FN:5-methyltryptophan resistance]
[OR:Escherichia coli] [DB:genpept-bct2] [DE:Escherichia coli K-12 chromosomal
region from 67.4 to 76.0 minutes.] [NT:CG Site No. 478] [LE:85325] [RE:86569]
[DI:complement]

| ORF Name | NT ID | AA ID | NT LN | AA LN | Score | P-value |
|---|---|---|---|---|---|---|
| 32463177_c2_504 | 2180 | 9351 | 219 | 72 | 186 | 3.5e-13 |

Description gp:[GI:g41313] [LN:ECEBGRA] [AC:X03228:M13700:M13796] [PN:evolved
beta-galactosidase] [GN:ebgR] [OR:Escherichia coli] [DB:genpept-bct1] [DE:E. coli
ebgR and ebgA genes for ebg repressor andbeta-galactosidase.] [LE:1371] [RE:4265]
[DI:direct]

| ORF Name | NT ID | AA ID | NT LN | AA LN | Score | P-value |
|---|---|---|---|---|---|---|
| 32474055_f3_309 | 2181 | 9352 | 273 | 90 | | |

Description

NO-HIT

| ORF Name | NT ID | AA ID | NT LN | AA LN | Score | P-value |
|---|---|---|---|---|---|---|
| 32501925_c3_659 | 2182 | 9353 | 486 | 161 | 529 | 7.3e-51 |

Description gp:[GI:g606040] [LN:ECOUW67] [AC:U18997] [OR:Escherichia coli] [DB:genpept-bct2]
[DE:Escherichia coli K-12 chromosomal region from 67.4 to 76.0 minutes.]
[NT:ORF_o157; overlaps o101 by 64 bases, no frameshift] [LE:30366] [RE:30839]
[DI:direct]

| ORF Name | NT ID | AA ID | NT LN | AA LN | Score | P-value |
|---|---|---|---|---|---|---|
| 33626380_c1_436 | 2183 | 9354 | 210 | 69 | | |

Description

NO-HIT

| ORF Name | NT ID | AA ID | NT LN | AA LN | Score | P-value |
|---|---|---|---|---|---|---|
| 33651708_f3_328 | 2184 | 9355 | 1359 | 452 | 2136 | 3.7e-221 |

Description gp:[GI:g940435] [LN:KPU30903] [AC:U30903] [PN:glycerol dehydratase large subunit]
[GN:dhaB4] [OR:Klebsiella pneumoniae] [DB:genpept-bct1] [EC:4.2.1.30]
[DE:Klebsiella pneumoniae dha regulon glycerol dehydratase largesubunit (dhaB4),
small subunit (dhaB3), and medium subunit (dhaB1),and 1,3-propanediol
oxidoreductase (dhaT) genes, complete cds.] [NT:molecular weight is 63,577; orf
3] [LE:186] [RE:2009] [DI:complement]

| ORF Name | NT ID | AA ID | NT LN | AA LN | Score | P-value |
|---|---|---|---|---|---|---|
| 33838557_c3_607 | 2185 | 9356 | 189 | 62 | | |

Description

NO-HIT

| ORF_Name | NT ID | AA ID | NT LN | AA LN | Score | P-value |
|---|---|---|---|---|---|---|
| 34015627_c2_516 | 2186 | 9357 | 993 | 330 | 1010 | 7.8e-102 |

Description sp:[LN:YDEW_ECOLI] [AC:P76141:P77190] [GN:YDEW] [OR:Escherichia coli]
[DE:HYPOTHETICAL TRANSCRIPTIONAL REGULATOR IN HIPB-UXAB INTERGENIC REGION]
[SP:P76141:P77190] [DB:swissprot] >sp:[LN:C64905] [AC:C64905] [PN:probable
transcription regulator ydeW] [OR:Escherichia coli] [DB:pir2] >gp:[GI:g1787791]
[LN:AE000249] [AC:AE000249:U00096] [PN:putative transcriptional regulator, sorC
family] [GN:ydeW] [FN:putative regulator; Not classified] [OR:Escherichia coli]
[DB:genpept-bct2] [DE:Escherichia coli K-12 MG1655 section 139 of 400 of the
completegenome.] [NT:f317; This 317 aa ORF is 27 pct identical (16 gaps)] [LE:70]
[RE:1023] [DI:complement]

| ORF_Name | NT ID | AA ID | NT LN | AA LN | Score | P-value |
|---|---|---|---|---|---|---|
| 34181557_f1_107 | 2187 | 9358 | 1671 | 556 | 2793 | 9.0e-291 |

Description gp:[GI:g940438] [LN:KPU30903] [AC:U30903] [PN:glycerol dehydratase medium
subunit] [GN:dhaB1] [OR:Klebsiella pneumoniae] [DB:genpept-bct1] [EC:4.2.1.30]
[DE:Klebsiella pneumoniae dha regulon glycerol dehydratase largesubunit (dhaB4),
small subunit (dhaB3), and medium subunit (dhaB1),and 1,3-propanediol
oxidoreductase (dhaT) genes, complete cds.] [NT:molecular weight is 60,633; orf
4] [LE:3047] [RE:4714] [DI:complement] >gp:[GI:g1778022] [LN:KPU60992]
[AC:U60992] [PN:glycerol dehydrase alpha subunit] [GN:gldA] [OR:Klebsiella
pneumoniae] [SR:Klebsiella pneumoniae strain=ATCC 25955] [DB:genpept-bct2]
[EC:4.2.1.30] [DE:Klebsiella pneumoniae glycerol dehydrase alpha subunit
(gldA),glycerol dehydrase beta subunit (gldB), and glycerol dehydrasegamma
subunit (gldC) genes, complete cds.] [NT:adenosylcobalamin-dependent glycerol
dehydratase] [LE:121] [RE:1788] [DI:direct]

| ORF_Name | NT ID | AA ID | NT LN | AA LN | Score | P-value |
|---|---|---|---|---|---|---|
| 34429202_c3_692 | 2188 | 9359 | 894 | 297 | 1397 | 7.6e-143 |

Description sp:[LN:YHBV_ECOLI] [AC:P45475] [GN:YHBV] [OR:Escherichia coli] [DE:HYPOTHETICAL
33.2 KD PROTEIN IN SOHA-MTR INTERGENIC REGION (O298)] [SP:P45475] [DB:swissprot]
>sp:[LN:C65106] [AC:C65106] [PN:hypothetical 33.2 kD protein in sohA-mtr
intergenic region] [GN:yhbV] [OR:Escherichia coli] [DB:pir2] >gp:[GI:g1789549]
[LN:AE000396] [AC:AE000396:U00096] [PN:orf, hypothetical protein] [GN:yhbV]
[FN:orf; Unknown] [OR:Escherichia coli] [DB:genpept-bct2] [DE:Escherichia coli
K-12 MG1655 section 286 of 400 of the completegenome.] [NT:o298; o298; overlaps
o298, other starts] [LE:9134] [RE:10030] [DI:direct] >gp:[GI:g606099]
[LN:ECOUW67] [AC:U18997] [OR:Escherichia coli] [DB:genpept-bct2] [DE:Escherichia
coli K-12 chromosomal region from 67.4 to 76.0 minutes.] [NT:ORF_o298; overlaps
o298, other starts possible] [LE:83223] [RE:84119] [DI:direct]

| ORF Name | NT ID | AA ID | NT/LN | AA/LN | Score | P-value |
|---|---|---|---|---|---|---|
| 34507881_c2_481 | 2189 | 9360 | 1185 | 394 | 1977 | 2.6e-204 |

Description sp:[LN:DHAT_KLEPN] [AC:Q59477] [GN:DHAT] [OR:Klebsiella pneumoniae]
[EC:1.1.1.202] [DE:REDUCTASE) (1,3-PROPANEDIOL OXIDOREDUCTASE)] [SP:Q59477]
[DB:swissprot] >gp:[GI:g940440] [LN:KPU30903] [AC:U30903] [PN:1,3-propanediol
oxidoreductase] [GN:dhaT] [OR:Klebsiella pneumoniae] [DB:genpept-bct1]
[EC:1.1.1.202] [DE:Klebsiella pneumoniae dha regulon glycerol dehydratase
largesubunit (dhaB4), small subunit (dhaB3), and medium subunit (dhaB1),and
1,3-propanediol oxidoreductase (dhaT) genes, complete cds.] [NT:orf 2; molecular
weight is 41,459] [LE:5578] [RE:6741] [DI:direct]

| ORF Name | NT ID | AA ID | NT/LN | AA/LN | Score | P-value |
|---|---|---|---|---|---|---|
| 35165786_c3_678 | 2190 | 9361 | 1596 | 531 | 2532 | 4.1e-263 |

Description sp:[LN:YHAG_ECOLI] [AC:P39829] [GN:YHAG] [OR:Escherichia coli] [DE:HYPOTHETICAL
56.4 KD PROTEIN IN RNPB-SOHA INTERGENIC REGION] [SP:P39829] [DB:swissprot]
>sp:[LN:D65102] [AC:D65102] [PN:hypothetical 56.4 kD protein in rnpB-sohA
intergenic region] [GN:yhaG] [OR:Escherichia coli] [DB:pir2] >gp:[GI:g1789516]
[LN:AE000394] [AC:AE000394;U00096] [PN:putative hydrolase] [GN:yhaG] [FN:putative
enzyme; Not classified] [OR:Escherichia coli] [DB:genpept-bct2] [DE:Escherichia
coli K-12 MG1655 section 284 of 400 of the completegenome.] [NT:o523; 100 pct
identical amino acid sequence and] [LE:5680] [RE:7251] [DI:direct]
>gp:[GI:g606068] [LN:ECOUW67] [AC:U18997] [OR:Escherichia coli] [DB:genpept-bct2]
[DE:Escherichia coli K-12 chromosomal region from 67.4 to 76.0 minutes.]
[NT:ORF_o523] [LE:56035] [RE:57606] [DI:direct]

| ORF Name | NT ID | AA ID | NT/LN | AA/LN | Score | P-value |
|---|---|---|---|---|---|---|
| 35329676_c2_480 | 2191 | 9362 | 555 | 184 | 705 | 1.6e-69 |

Description gp:[GI:g940439] [LN:KPU30903] [AC:U30903] [PN:unknown] [OR:Klebsiella pneumoniae]
[DB:genpept-bct1] [DE:Klebsiella pneumoniae dha regulon glycerol dehydratase
largesubunit (dhaB4), small subunit (dhaB3), and medium subunit (dhaB1),and
1,3-propanediol oxidoreductase (dhaT) genes, complete cds.] [NT:orf 2a] [LE:5125]
[RE:5556] [DI:direct]

| ORF_Name | NT_ID | AA_ID | NT/LN | AA/LN | Score | P-value |
|---|---|---|---|---|---|---|
| 35353527_c2_545 | 2192 | 9363 | 300 | 99 | 327 | 1.9e-29 |

Description sp:[LN:YQJK_ECOLI] [AC:Q47710] [GN:YQJK] [OR:Escherichia coli] [DE:HYPOTHETICAL
11.8 KD PROTEIN IN EXUR-TDCE INTERGENIC REGION] [SP:Q47710] [DB:swissprot]
>sp:[LN:A65099] [AC:A65099] [PN:hypothetical protein b3100] [OR:Escherichia coli]
[DB:pir2] >gp:[GI:g1789487] [LN:AE000392] [AC:AE000392:U00096] [PN:orf,
hypothetical protein] [GN:b3100] [FN:orf; Unknown] [OR:Escherichia coli]
[DB:genpept-bct2] [DE:Escherichia coli K-12 MG1655 section 282 of 400 of the
completegenome.] [NT:o99; 32 pct identical to 46 residues from] [LE:1219]
[RE:1518] [DI:direct] >gp:[GI:g606041] [LN:ECOUW67] [AC:U18997] [OR:Escherichia
coli] [DB:genpept-bct2] [DE:Escherichia coli K-12 chromosomal region from 67.4 to
76.0 minutes.] [NT:ORF_o99; 8 base overlap with o157] [LE:30829] [RE:31128]
[DI:direct]

| ORF_Name | NT_ID | AA_ID | NT/LN | AA/LN | Score | P-value |
|---|---|---|---|---|---|---|
| 35360406_f3_237 | 2193 | 9364 | 474 | 157 | 116 | 3.4e-06 |

Description gp:[GI:d1012527:g1507659] [LN:D83241] [AC:D83241] [PN:Antheraea pernyi fibroin]
[OR:Antheraea pernyi] [SR:Antheraea pernyi final instar larvae posterior
silkglands cDNA t] [DB:genpept-inv1] [DE:Antheraea pernyi mRNA for Antheraea
pernyi fibroin, partial cds.] [LE:<1] [RE:1268] [DI:direct]

| ORF_Name | NT_ID | AA_ID | NT/LN | AA/LN | Score | P-value |
|---|---|---|---|---|---|---|
| 35567892_c3_585 | 2194 | 9365 | 714 | 237 | 248 | 4.4e-21 |

Description sp:[LN:HDED_ECOLI] [AC:P26603:P28326] [GN:HDED] [OR:Escherichia coli] [DE:HDED
PROTEIN] [SP:P26603:P28326] [DB:swissprot] >sp:[LN:S47731]
[AC:S47731:B65149:S30267] [PN:probable membrane protein hdeD:protein
b3511:protein o190] [GN:hdeD] [OR:Escherichia coli] [DB:pir2]
>gp:[GI:d1002466:g216573] [LN:ECOHSND] [AC:D11389] [OR:Escherichia coli]
[SR:Escherichia coli (strain:K-12) DNA, clone:lambda-4D9] [DB:genpept-bct1]
[DE:Escherichia coli DNA, complete cds (ORF-D).] [NT:ORF-D] [LE:62] [RE:634]
[DI:direct] >gp:[GI:g466648] [LN:ECOUW76] [AC:U00039] [OR:Escherichia coli]
[SR:Escherichia coli (sub_strain MG1655, strain K-12) (library: lambda]
[DB:genpept-bct1] [DE:E. coli chromosomal region from 76.0 to 81.5 minutes.]
[NT:alternate name ORFD of L23635] [LE:71254] [RE:71826] [DI:direct]
>gp:[GI:g1789927] [LN:AE000427] [AC:AE000427:U00096] [PN:orf, hypothetical
protein] [GN:hdeD] [FN:orf; Unknown] [OR:Escherichia coli] [DB:genpept-bct2]
[DE:Escherichia coli K-12 MG1655 section 317 of 400 of the completegenome.]
[NT:o190; 100 pct identical amino acid sequence and] [LE:6112] [RE:6684]
[DI:direct]

| ORF Name | NT ID | AA ID | NT LN | AA LN | Score | P-value |
|---|---|---|---|---|---|---|
| 35647706_c1_446 | 2195 | 9366 | 534 | 177 | 127 | 9.8e-07 |

Description gp:[GI:g1683354] [LN:S75490] [AC:S75490] [GN:orf2] [OR:Neisseria gonorrhoeae]
[SR:Neisseria gonorrhoeae MS11] [DB:genpept-bct1] [DE:competence region: iga=IgA
protease, comA=transformation competence[Neisseria gonorrhoeae, MS11, Genomic, 3
genes, 2664 nt].] [LE:889] [RE:2259] [DI:complement]

| ORF Name | NT ID | AA ID | NT LN | AA LN | Score | P-value |
|---|---|---|---|---|---|---|
| 35728755_f2_186 | 2196 | 9367 | 1575 | 524 | 1482 | 7.5e-152 |

Description sp:[LN:YDEX_ECOLI] [AC:P77257] [GN:YDEX] [OR:Escherichia coli] [DE:HYPOTHETICAL
ABC TRANSPORTER ATP-BINDING PROTEIN YDEX] [SP:P77257] [DB:swissprot]
>sp:[LN:D64905] [AC:D64905] [PN:probable sugar transport ATP-binding protein
b1513] [CL:ATP-binding cassette homology] [OR:Escherichia coli] [DB:pir2]
>gp:[GI:d1015919:g1742490] [LN:D90794] [AC:D90794:AB001340] [PN:Ribose transport
ATP-binding protein RbsA.] [OR:Escherichia coli] [SR:Escherichia coli
(strain:K12) DNA, clone_lib:Kohara lambda minise] [DB:genpept-bct1] [DE:E.coli
genomic DNA, Kohara clone #303(34.3-34.6 min.).] [NT:ORF_ID:o302-303#1; similar
to [SwissProt Accession] [LE:9903] [RE:11438] [DI:direct] >gp:[GI:g1787792]
[LN:AE000249] [AC:AE000249:U00096] [PN:putative ATP-binding component of a
transport] [GN:b1513] [FN:putative transport; Not classified] [OR:Escherichia
coli] [DB:genpept-bct2] [DE:Escherichia coli K-12 MG1655 section 139 of 400 of
the completegenome.] [NT:o511; This 511 aa ORF is 39 pct identical (24 gaps)]
[LE:1272] [RE:2807] [DI:direct] >gp:[GI:g3661533] [AC:AF089855]
[PN:aerobic growth essential protein] [GN:ego10A] [FN:essential for aerobic
growth] [OR:Escherichia coli] [DB:genpept-bct2] [DE:Escherichia coli aerobic
growth essential protein (ego10A) gene,complete cds.] [LE:1] [RE:1536]
[DI:direct]

| ORF Name | NT ID | AA ID | NT LN | AA LN | Score | P-value |
|---|---|---|---|---|---|---|
| 35817712_c2_529 | 2197 | 9368 | 1032 | 343 | 1438 | 3.5e-147 |

Description sp:[LN:YGJT_ECOLI] [AC:P42601] [GN:YGJT] [OR:Escherichia coli] [DE:HYPOTHETICAL
35.8 KD PROTEIN IN EBGC-UXAA INTERGENIC REGION] [SP:P42601] [DB:swissprot]
>sp:[LN:E65097] [AC:E65097] [PN:hypothetical 35.8 kD protein in ebgC-exuT
intergenic region] [GN:ygjT] [OR:Escherichia coli] [DB:pir2] >gp:[GI:g1789472]
[LN:AE000391] [AC:AE000391:U00096] [PN:putative transport protein] [GN:ygjT]
[FN:putative transport; Not classified] [OR:Escherichia coli] [DB:genpept-bct2]
[DE:Escherichia coli K-12 MG1655 section 281 of 400 of the completegenome.]
[NT:o321; 100 pct identical amino acid sequence and] [LE:172] [RE:1137]
[DI:direct] >gp:[GI:g606027] [LN:ECOUW67] [AC:U18997] [OR:Escherichia coli]
[DB:genpept-bct2] [DE:Escherichia coli K-12 chromosomal region from 67.4 to 76.0
minutes.] [NT:ORF_o321] [LE:19331] [RE:20296] [DI:direct]

| ORF Name | NT ID | AA ID | NT/LN | AA/LN | Score | P-value |
|---|---|---|---|---|---|---|
| 36219077_cl_366 | 2198 | 9369 | 1449 | 482 | 1266 | 5.8e-129 |

Description sp:[LN:YGJI_ECOLI] [AC:P42590] [GN:YGJI] [OR:Escherichia coli] [DE:HYPOTHETICAL
52.1 KD PROTEIN IN EBGC-UXAA INTERGENIC REGION] [SP:P42590] [DB:swissprot]
>sp:[LN:C65096] [AC:C65096] [PN:hypothetical 52.1 kD protein in ebgC-exuT
intergenic region] [GN:ygjI] [OR:Escherichia coli] [DB:pir2] >gp:[GI:g1789459]
[LN:AE000389] [AC:AE000389:U00096] [PN:putative oxidoreductase] [GN:ygjI]
[FN:orf; Not classified] [OR:Escherichia coli] [DB:genpept-bct2] [DE:Escherichia
coli K-12 MG1655 section 279 of 400 of the completegenome.] [NT:100 pct identical
amino acid sequence and equal] [LE:9629] [RE:11062] [DI:direct] >gp:[GI:g606016]
[LN:ECOUW67] [AC:U18997] [OR:Escherichia coli] [DB:genpept-bct2] [DE:Escherichia
coli K-12 chromosomal region from 67.4 to 76.0 minutes.] [NT:ORF_o477] [LE:6987]
[RE:8420] [DI:direct]

| ORF Name | NT ID | AA ID | NT/LN | AA/LN | Score | P-value |
|---|---|---|---|---|---|---|
| 36226630_cl_419 | 2199 | 9370 | 1005 | 334 | 1594 | 1.0e-163 |

Description sp:[LN:YQJG_ECOLI] [AC:P42620] [GN:YQJG] [OR:Escherichia coli] [DE:HYPOTHETICAL
37.4 KD PROTEIN IN EXUR-TDCC INTERGENIC REGION (O328)] [SP:P42620] [DB:swissprot]
>sp:[LN:C65099] [AC:C65099] [PN:hypothetical 37.4 kD protein in exuR-tdcC
intergenic region] [GN:yqjG] [OR:Escherichia coli] [DB:pir2] >gp:[GI:g1789489]
[LN:AE000392] [AC:AE000392:U00096] [PN:putative transferase] [GN:yqjG]
[FN:putative enzyme; Not classified] [OR:Escherichia coli] [DB:genpept-bct2]
[DE:Escherichia coli K-12 MG1655 section 282 of 400 of the completegenome.]
[NT:o328; 100 pct identical amino acid sequence and] [LE:2166] [RE:3152]
[DI:direct] >gp:[GI:g606043] [LN:ECOUW67] [AC:U18997] [OR:Escherichia coli]
[DB:genpept-bct2] [DE:Escherichia coli K-12 chromosomal region from 67.4 to 76.0
minutes.] [NT:ORF_o328] [LE:31776] [RE:32762] [DI:direct]

| ORF Name | NT ID | AA ID | NT/LN | AA/LN | Score | P-value |
|---|---|---|---|---|---|---|
| 36500408_cl_364 | 2200 | 9371 | 3111 | 1036 | 4527 | 0.0 |

Description sp:[LN:GBECE] [AC:A65096:A25751:S09206] [PN:beta-galactosidase, alpha
chain:beta-D-galactoside galactohydrolase:lactase:phospho-beta-D-galactosidase
alpha-subunit] [GN:ebgA] [CL:beta-galactosidase] [OR:Escherichia coli]
[EC:3.2.1.23] [DB:pir1] [MP:68 min] >gp:[GI:g1789457] [LN:AE000389]
[AC:AE000389:U00096] [PN:evolved beta-D-galactosidase, alpha subunit;] [GN:ebgA]
[FN:enzyme; Degradation of small molecules: Carbon] [OR:Escherichia coli]
[DB:genpept-bct2] [DE:Escherichia coli K-12 MG1655 section 279 of 400 of the
completegenome.] [NT:o1042; This 1042 aa ORF is 99 pct identical (1] [LE:5992]
[RE:9120] [DI:direct] >gp:[GI:g606014] [LN:ECOUW67] [AC:U18997]
[PN:phospho-beta-D-galactosidase; alpha-subunit] [GN:ebgA] [OR:Escherichia coli]
[DB:genpept-bct2] [DE:Escherichia coli K-12 chromosomal region from 67.4 to 76.0
minutes.] [NT:CG Site No. 830] [LE:3350] [RE:6478] [DI:direct]

| ORF Name | NT ID | AA ID | NT/LN | AA/LN | Score | P-value |
|---|---|---|---|---|---|---|
| 3907625_c3_634 | 2201 | 9372 | 489 | 162 | 137 | 1.6e-08 |

Description sp:[LN:PQ0479] [AC:PQ0479:S24620] [PN:pistil extensin-like protein (clone pMG14)] [OR:Nicotiana tabacum] [SR:, common tobacco] [DB:pir2]

| ORF Name | NT ID | AA ID | NT/LN | AA/LN | Score | P-value |
|---|---|---|---|---|---|---|
| 4157577_c1_348 | 2202 | 9373 | 531 | 176 | 868 | 8.7e-87 |

Description gp:[GI:g940442] [LN:KPU30903] [AC:U30903] [PN:unknown] [OR:Klebsiella pneumoniae] [DB:genpept-bct1] [DE:Klebsiella pneumoniae dha regulon glycerol dehydratase largesubunit (dhaB4), small subunit (dhaB3), and medium subunit (dhaB1),and 1,3-propanediol oxidoreductase (dhaT) genes, complete cds.] [NT:orf 2c] [LE:7116] [RE:7646] [DI:direct]

| ORF Name | NT ID | AA ID | NT/LN | AA/LN | Score | P-value |
|---|---|---|---|---|---|---|
| 4339135_f3_250 | 2203 | 9374 | 1026 | 341 | 1732 | 2.4e-178 |

Description gp:[GI:d1015679:g1742230] [LN:D90774] [AC:D90774:AB001340] [GN:IS5] [OR:Escherichia coli] [SR:Escherichia coli (strain:K12) DNA, clone_lib:Kohara lambda minise] [DB:genpept-bct1] [DE:E.coli genomic DNA, Kohara clone #263(30.5-30.9 min.).] [NT:ORF_ID:o263#19; similar to [SwissProt Accession] [LE:13658] [RE:>14668] [DI:complement] >gp:[GI:d1015688:g1742240] [LN:D90775] [AC:D90775:AB001340] [GN:IS5] [OR:Escherichia coli] [SR:Escherichia coli (strain:K12) DNA, clone_lib:Kohara lambda minise] [DB:genpept-bct1] [DE:E.coli genomic DNA, Kohara clone #264(30.7-31.1 min.).] [NT:ORF_ID:o263#19; similar to [SwissProt Accession] [LE:2105] [RE:>3115] [DI:complement]

| ORF Name | NT ID | AA ID | NT/LN | AA/LN | Score | P-value |
|---|---|---|---|---|---|---|
| 4411027_f2_177 | 2204 | 9375 | 363 | 120 | | |

Description

NO-HIT

| ORF_Name | NT_ID | AA_ID | NT/LN | AA/LN | Score | P-value |
|---|---|---|---|---|---|---|
| 4476693_c3_683 | 2205 | 9376 | 585 | 194 | 818 | 1.7e-81 |

Description sp:[LN:YRAP_ECOLI] [AC:P45467] [GN:YRAP] [OR:Escherichia coli] [DE:(O191)]
[SP:P45467] [DB:swissprot] >sp:[LN:B65105] [AC:B65105] [PN:hypothetical 20.0 kD
protein in agai-mtr intergenic region] [GN:yraP] [OR:Escherichia coli] [DB:pir2]
>gp:[GI:g1789540] [LN:AE000396] [AC:AE000396:U00096] [PN:putative periplasmic
protein] [GN:yraP] [FN:putative transport; Not classified] [OR:Escherichia coli]
[DB:genpept-bct2] [DE:Escherichia coli K-12 MG1655 section 286 of 400 of the
completegenome.] [NT:o191; 100 pct identical amino acid sequence and] [LE:3072]
[RE:3647] [DI:direct] >gp:[GI:g606090] [LN:ECOUW67] [AC:U18997] [OR:Escherichia
coli] [DB:genpept-bct2] [DE:Escherichia coli K-12 chromosomal region from 67.4 to
76.0 minutes.] [NT:ORF_o191] [LE:77161] [RE:77736] [DI:direct]

| ORF_Name | NT_ID | AA_ID | NT/LN | AA/LN | Score | P-value |
|---|---|---|---|---|---|---|
| 4897293_c1_420 | 2206 | 9377 | 378 | 125 | 578 | 4.7e-56 |

Description sp:[LN:YHAH_ECOLI] [AC:P42621] [GN:YHAH] [OR:Escherichia coli] [DE:HYPOTHETICAL
14.3 KD PROTEIN IN EXUR-TDCC INTERGENIC REGION] [SP:P42621] [DB:swissprot]
>sp:[LN:D65099] [AC:D65099] [PN:hypothetical 14.3 kD protein in exuR-tdcC
intergenic region] [GN:yhaH] [OR:Escherichia coli] [DB:pir2] >gp:[GI:g2367196]
[LN:AE000392] [AC:AE000392:U00096] [PN:putative cytochrome] [GN:yhaH]
[FN:putative carrier; Not classified] [OR:Escherichia coli] [DB:genpept-bct2]
[DE:Escherichia coli K-12 MG1655 section 282 of 400 of the completegenome.]
[NT:o121; C-terminal differs from earlier version] [LE:3446] [RE:3811]
[DI:direct]

| ORF_Name | NT_ID | AA_ID | NT/LN | AA/LN | Score | P-value |
|---|---|---|---|---|---|---|
| 4962807_c3_621 | 2207 | 9378 | 453 | 150 | 656 | 2.5e-64 |

Description sp:[LN:EBGC_ECOLI] [AC:P24225] [GN:EBGC] [OR:Escherichia coli] [DE:EVOLVED
BETA-GALACTOSIDASE BETA-SUBUNIT] [SP:P24225] [DB:swissprot] >sp:[LN:B65096]
[AC:B65096:S09207] [PN:beta-galactosidase, beta
chain:phospho-beta-D-galactosidase, beta-subunit] [GN:ebgC] [OR:Escherichia coli]
[EC:3.2.1.23] [DB:pir2] >gp:[GI:g1789458] [LN:AE000389] [AC:AE000389:U00096]
[PN:evolved beta-D-galactosidase, beta subunit;] [GN:ebgC] [FN:enzyme;
Degradation of small molecules: Carbon] [OR:Escherichia coli] [DB:genpept-bct2]
[DE:Escherichia coli K-12 MG1655 section 279 of 400 of the completegenome.]
[NT:o149; CG Site No. 18412; difference near end makes] [LE:9117] [RE:9566]
[DI:direct] >gp:[GI:g606015] [LN:ECOUW67] [AC:U18997]
[PN:phospho-beta-D-galactosidase, beta-subunit] [GN:ebgC] [OR:Escherichia coli]
[DB:genpept-bct2] [DE:Escherichia coli K-12 chromosomal region from 67.4 to 76.0
minutes.] [NT:CG Site No. 18412; difference near end makes this] [LE:6475]
[RE:6924] [DI:direct]

| ORF Name | NT ID | AA ID | NT/LN | AA/LN | Score | P-value |
|---|---|---|---|---|---|---|
| 5103418_f2_121 | 2208 | 9379 | 450 | 149 | 554 | 1.6e-53 |

Description sp:[LN:YHBS_ECOLI] [AC:P45473] [GN:YHBS] [OR:Escherichia coli] [DE:HYPOTHETICAL
18.5 KD PROTEIN IN SOHA-MTR INTERGENIC REGION (F167)] [SP:P45473] [DB:swissprot]
>sp:[LN:H65105] [AC:H65105] [PN:hypothetical protein b3156] [OR:Escherichia coli]
[DB:pir2] >gp:[GI:g1789546] [LN:AE000396] [AC:AE000396:U00096] [PN:orf,
hypothetical protein] [GN:yhbS] [FN:orf; Unknown] [OR:Escherichia coli]
[DB:genpept-bct2] [DE:Escherichia coli K-12 MG1655 section 286 of 400 of the
completegenome.] [NT:f167; f167; end overlaps end of o100 by 14] [LE:6918]
[RE:7421] [DI:complement] >gp:[GI:g606096] [LN:ECOUW67] [AC:U18997]
[OR:Escherichia coli] [DB:genpept-bct2] [DE:Escherichia coli K-12 chromosomal
region from 67.4 to 76.0 minutes.] [NT:ORF_f167; end overlaps end of o100 by 14
bases;] [LE:81007] [RE:81510] [DI:complement]

| ORF Name | NT ID | AA ID | NT/LN | AA/LN | Score | P-value |
|---|---|---|---|---|---|---|
| 5273467_c3_617 | 2209 | 9380 | 993 | 330 | 1405 | 1.1e-143 |

Description sp:[LN:EBGR_ECOLI] [AC:P06846] [GN:EBGR] [OR:Escherichia coli] [DE:EBG OPERON
REPRESSOR] [SP:P06846] [DB:swissprot] >sp:[LN:RPECEG] [AC:A25752:S09205:H65095]
[PN:ebg repressor] [GN:ebgR] [CL:lac repressor] [OR:Escherichia coli] [DB:pir1]
[MP:68 min] >gp:[GI:g41308] [LN:ECEBG] [AC:X52031] [OR:Escherichia coli]
[DB:genpept-bct1] [DE:Escherichia coli wildtype ebg operon DNA for
beta-galactosidasealpha and beta subunits and repressor proteins.] [NT:ebgR
product, repressor (AA 1-126)] [SP:P06846] [LE:126] [RE:1109] [DI:direct]
>gp:[GI:g145820] [LN:ECOEBGRA] [AC:M64441:M13700:M13796:M66835:M66836:X03228]
[PN:EBG repressor] [GN:ebgR] [OR:Escherichia coli] [SR:E.coli DNA]
[DB:genpept-bct1] [DE:E.coli ebgR, ebgA, ebgC genes complete cds.] [NT:putative]
[LE:126] [RE:1109] [DI:direct] >gp:[GI:g1789456] [LN:AE000389]
[AC:AE000389:U00096] [PN:regulator of ebg operon] [GN:ebgR] [FN:regulator;
Degradation of small molecules:] [OR:Escherichia coli] [DB:genpept-bct2]
[DE:Escherichia coli K-12 MG1655 section 279 of 400 of the completegenome.]
[NT:o327; 100 pct to EBGR_ECOLI SW: P06846; CG Site] [LE:4861] [RE:5844]
[DI:direct] >gp:[GI:g606013] [LN:ECOUW67] [AC:U18997] [GN:ebgR] [FN:ebg
repressor] [OR:Escherichia coli] [DB:genpept-bct2] [DE:Escherichia coli K-12
chromosomal region from 67.4 to 76.0 minutes.] [NT:CG Site No. 829] [LE:2219]
[RE:3202] [DI:direct]

| ORF_Name | NT ID | AA ID | NT LN | AA LN | Score | P-value |
|---|---|---|---|---|---|---|
| 5274165_c1_413 | 2210 | 9381 | 1332 | 443 | 2052 | 3.0e-212 |

Description sp:[LN:EXUT_ECOLI] [AC:P42609] [GN:EXUT] [OR:Escherichia coli] [DE:HEXURONATE TRANSPORTER] [SP:P42609] [DB:swissprot] >sp:[LN:B65098] [AC:B65098] [PN:hexuronate transporter] [GN:exuT] [CL:hexuronate transporter] [OR:Escherichia coli] [DB:pir1] >gp:[GI:d1003092:g1160319] [LN:D13328] [AC:D13328] [PN:aldohexuronate transport system] [GN:exuT] [OR:Escherichia coli] [SR:Escherichia coli (strain:K12) cell_line:W3110 DNA] [DB:genpept-bct1] [DE:Escherichia coli uxaA, uxaC, exuT and exuR genes for altronatedehydratase, uronate isomerase, aldohexuronate transport system andexu regulon repressor, complete cds.] [LE:4362] [RE:5780] [DI:direct] >gp:[GI:g2367193] [LN:AE000391] [AC:AE000391:U00096] [PN:transport of hexuronates] [GN:exuT] [FN:transport; Transport of small molecules:] [OR:Escherichia coli] [DB:genpept-bct2] [DE:Escherichia coli K-12 MG1655 section 281 of 400 of the completegenome.] [NT:o472; 99 pct identical to EXUT_ECOLI SW: P42609] [LE:6694] [RE:8112] [DI:direct]

| ORF_Name | NT ID | AA ID | NT LN | AA LN | Score | P-value |
|---|---|---|---|---|---|---|
| 5976711_c2_566 | 2211 | 9382 | 399 | 132 | 487 | 2.1e-46 |

Description sp:[LN:YRAN_ECOLI] [AC:P45465] [GN:YRAN] [OR:Escherichia coli] [DE:HYPOTHETICAL 14.8 KD PROTEIN IN AGAI-MTR INTERGENIC REGION (O131)] [SP:P45465] [DB:swissprot] >sp:[LN:H65104] [AC:H65104] [PN:hypothetical 14.8 kD protein in agai-mtr intergenic region] [GN:yraN] [CL:hypothetical protein HI1656] [OR:Escherichia coli] [DB:pir2] >gp:[GI:g1789538] [LN:AE000396] [AC:AE000396:U00096] [PN:orf, hypothetical protein] [GN:yraN] [FN:orf; Unknown] [OR:Escherichia coli] [DB:genpept-bct2] [DE:Escherichia coli K-12 MG1655 section 286 of 400 of the completegenome.] [NT:o131; o131; overlaps o678, other starts] [LE:2057] [RE:2452] [DI:direct] >gp:[GI:g606088] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_o131; overlaps o678, other starts possible] [LE:76146] [RE:76541] [DI:direct]

| ORF_Name | NT ID | AA ID | NT LN | AA LN | Score | P-value |
|---|---|---|---|---|---|---|
| 6364408_f2_189 | 2212 | 9383 | 1083 | 360 | 1359 | 8.1e-139 |

Description sp:[LN:G64905] [AC:G64905] [PN:sugar-binding protein homolog b1516 precursor] [OR:Escherichia coli] [DB:pir2] >gp:[GI:g1787795] [LN:AE000249] [AC:AE000249:U00096] [PN:putative LACI-type transcriptional regulator] [GN:b1516] [FN:putative regulator; Not classified] [OR:Escherichia coli] [DB:genpept-bct2] [DE:Escherichia coli K-12 MG1655 section 139 of 400 of the completegenome.] [NT:o340; This 340 aa ORF is 25 pct identical (15 gaps)] [LE:4833] [RE:5855] [DI:direct]

| ORF_Name | NT_ID | AA_ID | NT/LN | AA/LN | Score | P-value |
|---|---|---|---|---|---|---|
| 6447181_c2_525 | 2213 | 9384 | 606 | 201 | 168 | 1.3e-12 |

Description gp:[GI:g3318590] [LN:AB015670] [AC:AB015670] [OR:Bacillus sp.] [SR:Bacillus sp. DNA] [DB:genpept-bct1] [DE:Bacillus sp. genes for CDase, CGTase, MBP and 15 ORFs, partial andcomplete cds.] [NT:A2-5a orf21; hypothetical protein] [LE:1014] [RE:1568] [DI:complement]

| ORF_Name | NT_ID | AA_ID | NT/LN | AA/LN | Score | P-value |
|---|---|---|---|---|---|---|
| 6504537_c2_508 | 2214 | 9385 | 2514 | 837 | 3570 | 0.0 |

Description sp:[LN:YGJK_ECOLI] [AC:P42592] [GN:YGJK] [OR:Escherichia coli] [DE:HYPOTHETICAL 88.3 KD PROTEIN IN EBGC-UXAA INTERGENIC REGION PRECURSOR] [SP:P42592] [DB:swissprot] >sp:[LN:E65096] [AC:E65096] [PN:hypothetical 88.3 kD protein in ebgC-exuT intergenic region] [GN:ygjK] [OR:Escherichia coli] [DB:pir2] >gp:[GI:g1789462] [LN:AE000390] [AC:AE000390:U00096] [PN:putative isomerase] [GN:ygjK] [FN:putative enzyme; Not classified] [OR:Escherichia coli] [DB:genpept-bct2] [DE:Escherichia coli K-12 MG1655 section 280 of 400 of the completegenome.] [NT:o783; 100 pct identical amino acid sequence and] [LE:1184] [RE:3535] [DI:direct] >gp:[GI:g606018] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_o783] [LE:9641] [RE:11992] [DI:direct]

| ORF_Name | NT_ID | AA_ID | NT/LN | AA/LN | Score | P-value |
|---|---|---|---|---|---|---|
| 6518806_c1_454 | 2215 | 9386 | 1038 | 345 | 1702 | 3.7e-175 |

Description sp:[LN:YHBU_ECOLI] [AC:P45527] [GN:YHBU] [OR:Escherichia coli] [EC:3.4.-.-] [DE:PUTATIVE PROTEASE YHBU PRECURSOR,] [SP:P45527] [DB:swissprot] >sp:[LN:B65106] [AC:B65106] [PN:probable proteinase, (sohA-mtr intergenic region)] [GN:yhbU] [OR:Escherichia coli] [EC:3.4.-.-] [DB:pir2] >gp:[GI:g1789548] [LN:AE000396] [AC:AE000396:U00096] [PN:putative collagenase] [GN:yhbU] [FN:orf; Not classified] [OR:Escherichia coli] [DB:genpept-bct2] [EC:3.4.-.-] [DE:Escherichia coli K-12 MG1655 section 286 of 400 of the completegenome.] [NT:o331; 100 pct identical amino acid sequence and] [LE:8148] [RE:9143] [DI:direct] >gp:[GI:g606098] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_o331] [LE:82237] [RE:83232] [DI:direct]

| ORF_Name | NT_ID | AA_ID | NT/LN | AA/LN | Score | P-value |
|---|---|---|---|---|---|---|
| 6531283_f3_293 | 2216 | 9387 | 1464 | 487 | | |

Description

NO-HIT

| ORF Name | NT ID | AA ID | NT LN | AA LN | Score | P-value |
|---|---|---|---|---|---|---|
| 7229155_c2_492 | 2217 | 9388 | 1737 | 578 | 1482 | 7.5e-152 |

Description sp:[LN:YCGC_ECOLI] [AC:P37349:P76013] [GN:YCGC] [OR:Escherichia coli]
[DE:HYPOTHETICAL 51.6 KD PROTEIN IN TREA-PTH INTERGENIC REGION]
[SP:P37349:P76013] [DB:swissprot] >sp:[LN:C64866] [AC:C64866] [PN:trehalase
precursor] [GN:ycgC] [CL:phosphotransferase system phosphohistidine-containing
protein homology] [OR:Escherichia coli] [DB:pir2] >gp:[GI:d1037041:g4062781]
[LN:D90754] [AC:D90754:AB001340] [PN:Hypothetical protein in treA 5'region .]
[GN:ycgC] [OR:Escherichia coli] [SR:Escherichia coli(strain:K12) DNA,
clone:Kohara clone #245] [DB:genpept-bct1] [DE:Escherichia coli genomic DNA.
(26.8 - 27.1 min).] [NT:ORF_ID:o245#7; similar to SwissProt Accession] [LE:9793]
[RE:11214] [DI:complement] >gp:[GI:g1787448] [LN:AE000218] [AC:AE000218:U00096]
[PN:putative PTS system enzyme I] [GN:ycgC] [FN:putative transport; Not
classified] [OR:Escherichia coli] [DB:genpept-bct2] [DE:Escherichia coli K-12
MG1655 section 108 of 400 of the completegenome.] [NT:f473; 100 pct identical to
fragment YCGC_ECOLI] [LE:3099] [RE:4520] [DI:complement]

| ORF Name | NT ID | AA ID | NT LN | AA LN | Score | P-value |
|---|---|---|---|---|---|---|
| 804827_c3_656 | 2218 | 9389 | 663 | 220 | 1077 | 6.2e-109 |

Description sp:[LN:YQJA_ECOLI] [AC:P42614] [GN:YQJA] [OR:Escherichia coli] [DE:HYPOTHETICAL
24.6 KD PROTEIN IN EXUR-TDCC INTERGENIC REGION] [SP:P42614] [DB:swissprot]
>sp:[LN:D65098] [AC:D65098] [PN:hypothetical protein b3095] [CL:dedA protein]
[OR:Escherichia coli] [DB:pir2] >gp:[GI:g1789481] [LN:AE000391]
[AC:AE000391:U00096] [PN:orf, hypothetical protein] [GN:yqjA] [FN:orf; Unknown]
[OR:Escherichia coli] [DB:genpept-bct2] [DE:Escherichia coli K-12 MG1655 section
281 of 400 of the completegenome.] [NT:o220] [LE:9363] [RE:10025] [DI:direct]
>gp:[GI:g606036] [LN:ECOUW67] [AC:U18997] [OR:Escherichia coli] [DB:genpept-bct2]
[DE:Escherichia coli K-12 chromosomal region from 67.4 to 76.0 minutes.]
[NT:ORF_o220] [LE:28525] [RE:29187] [DI:direct]

| ORF Name | NT ID | AA ID | NT LN | AA LN | Score | P-value |
|---|---|---|---|---|---|---|
| 9797905_f2_147 | 2219 | 9390 | 447 | 148 | 94 | 0.00044 |

Description gp:[GI:e323042:g2415682] [LN:LP16KDIMM] [AC:Z97066] [PN:16 kD immunogenic
protein] [OR:Legionella pneumophila] [DB:genpept-bct1] [DE:Legionella pneumophila
DNA for 16 kD immunogenic protein.] [LE:2114] [RE:2524] [DI:direct]

| ORF_Name | NT ID | AA ID | NT LN | AA LN | Score | P-value |
|---|---|---|---|---|---|---|
| 9855206_c2_506 | 2220 | 9391 | 690 | 229 | 605 | 6.5e-59 |

Description sp:[LN:YGJI_ECOLI] [AC:P42590] [GN:YGJI] [OR:Escherichia coli] [DE:HYPOTHETICAL 52.1 KD PROTEIN IN EBGC-UXAA INTERGENIC REGION] [SP:P42590] [DB:swissprot] >sp:[LN:C65096] [AC:C65096] [PN:hypothetical 52.1 kD protein in ebgC-exuT intergenic region] [GN:ygjI] [OR:Escherichia coli] [DB:pir2] >gp:[GI:g1789459] [LN:AE000389] [AC:AE000389:U00096] [PN:putative oxidoreductase] [GN:ygjI] [FN:orf; Not classified] [OR:Escherichia coli] [DB:genpept-bct2] [DE:Escherichia coli K-12 MG1655 section 279 of 400 of the completegenome.] [NT:100 pct identical amino acid sequence and equal] [LE:9629] [RE:11062] [DI:direct] >gp:[GI:g606016] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_o477] [LE:6987] [RE:8420] [DI:direct]

| ORF_Name | NT ID | AA ID | NT LN | AA LN | Score | P-value |
|---|---|---|---|---|---|---|
| 9895640_c3_591 | 2221 | 9392 | 327 | 108 | 103 | 1.0e-05 |

Description gp:[GI:e1370576:g4158213] [LN:SC1A11] [AC:AL035205] [PN:hypothetical protein SC1A11.02c] [GN:SC1A11.02c] [OR:Streptomyces coelicolor] [DB:genpept-bct1] [DE:Streptomyces coelicolor cosmid 1A11.] [NT:SC1A11.02c, partial CDS, unknown, len: 134aa;] [LE:302] [RE:>760] [DI:complement]

| ORF_Name | NT ID | AA ID | NT LN | AA LN | Score | P-value |
|---|---|---|---|---|---|---|
| 10058211_f2_863 | 2222 | 9393 | 588 | 195 | 145 | 3.6e-10 |

Description gp:[GI:e1312902:g3355676] [LN:SC1C2] [AC:AL031124] [PN:putative transcriptional regulator] [GN:SC1C2.09] [OR:Streptomyces coelicolor] [DB:genpept-bct1] [DE:Streptomyces coelicolor cosmid 1C2.] [NT:SC1C2.09, possible transcriptional regulator, len:] [LE:9233] [RE:9835] [DI:direct]

| ORF_Name | NT ID | AA ID | NT LN | AA LN | Score | P-value |
|---|---|---|---|---|---|---|
| 10195282_c3_2768 | 2223 | 9394 | 378 | 125 | 202 | 3.3e-16 |

Description sp:[LN:PTCB_BACST] [AC:Q45399] [GN:CELA] [OR:Bacillus stearothermophilus] [EC:2.7.1.69] [DE:(EC 2.7.1.69)] [SP:Q45399] [DB:swissprot] >sp:[LN:B49898] [AC:B49898] [PN:cellobiose phosphotransferase system celA] [CL:phosphotransferase system enzyme II cellobiose-specific factor IIB] [OR:Bacillus stearothermophilus] [DB:pir2] >gp:[GI:g466473] [LN:BSU07818] [AC:U07818:S66216] [PN:cellobiose phosphotransferase enzyme II'] [GN:celA] [OR:Bacillus stearothermophilus] [DB:genpept-bct1] [DE:Bacillus stearothermophilus XL-65-6 PTS regulatory protein (celR')gene, partial cds, and cellobiose phosphotransferase system operon(celA, celB, celC, and celD) genes, complete cds.] [NT:cellobiose PTS enzyme II'] [LE:1541] [RE:1843] [DI:direct]

| ORF Name | NT ID | AA ID | NT/LN | AA/LN | Score | P-value |
|---|---|---|---|---|---|---|
| 10210441_f2_768 | 2224 | 9395 | 843 | 280 | 1351 | 5.7e-138 |

Description sp:[LN:PQQC_KLEPN] [AC:P27505] [GN:PQQC] [OR:Klebsiella pneumoniae] [DE:COENZYME PQQ SYNTHESIS PROTEIN C] [SP:P27505] [DB:swissprot] >sp:[LN:S20455] [AC:S20455:S21840] [PN:pqqC protein] [GN:pqqC] [OR:Klebsiella pneumoniae] [DB:pir2] >gp:[GI:g43907] [LN:KPPQQAF] [AC:X58778:S92172] [GN:pqqC] [OR:Klebsiella pneumoniae] [DB:genpept-bct1] [DE:K.pneumoniae pqqABCDEF genes, involved in pyrroloquinolinebiosynthesis.] [SP:P27505] [LE:2000] [RE:2755] [DI:direct]

| ORF Name | NT ID | AA ID | NT/LN | AA/LN | Score | P-value |
|---|---|---|---|---|---|---|
| 10338187_f1_422 | 2225 | 9396 | 645 | 214 | 630 | 1.4e-61 |

Description sp:[LN:D35119] [AC:D35119] [PN:protocatechuate 3,4-dioxygenase, alpha chain] [CL:protocatechuate 3,4-dioxygenase alpha chain] [OR:Acinetobacter calcoaceticus] [EC:1.13.11.3] [DB:pir1]

| ORF Name | NT ID | AA ID | NT/LN | AA/LN | Score | P-value |
|---|---|---|---|---|---|---|
| 10423588_c1_1894 | 2226 | 9397 | 1347 | 448 | 783 | 8.9e-78 |

Description sp:[LN:FUCP_ECOLI] [AC:P11551] [GN:FUCP] [OR:Escherichia coli] [DE:L-FUCOSE PERMEASE] [SP:P11551] [DB:swissprot] >sp:[LN:WQECFP] [AC:JS0184:C33495:S49565:E65062] [PN:L-fucose permease] [GN:fucP] [CL:fucose permease] [OR:Escherichia coli] [DB:pir1] [MP:60 min] >gp:[GI:g41504] [LN:ECFUCOSE] [AC:X15025] [OR:Escherichia coli] [DB:genpept-bct1] [DE:Escherichia coli fucose operon.] [NT:fucP ORF (AA 1-438)] [SP:P11551] [LE:2608] [RE:3924] [DI:direct] >gp:[GI:g882696] [LN:ECU29581] [AC:U29581] [PN:L-fucose permease] [GN:fucP] [OR:Escherichia coli] [DB:genpept-bct1] [DE:Escherichia coli K-12 genome; approximately 63 to 64 minutes.] [NT:CG Site no. 10875; ORF_o438] [LE:15790] [RE:17106] [DI:direct] >gp:[GI:g1789166] [LN:AE000364] [AC:AE000364:U00096] [PN:fucose permease] [GN:fucP] [FN:transport; Transport of small molecules:] [OR:Escherichia coli] [DB:genpept-bct2] [DE:Escherichia coli K-12 MG1655 section 254 of 400 of the completegenome.] [NT:o438; 100 pct identical to FUCP_ECOLI SW: P11551;] [LE:304] [RE:1620] [DI:direct]

| ORF Name | NT ID | AA ID | NT LN | AA LN | Score | P-value |
|---|---|---|---|---|---|---|
| 1042516_cl_1720 | 2227 | 9398 | 963 | 320 | 1495 | 3.2e-153 |

Description sp:[LN:FDNH_ECOLI] [AC:P24184:P77166] [GN:FDNH] [OR:Escherichia coli]
[DE:DEHYDROGENASE IRON-SULFUR SUBUNIT)] [SP:P24184:P77166] [DB:swissprot]
>sp:[LN:JS0629] [AC:F64900:JS0629] [PN:formate dehydrogenase, N
(nitrate-inducible) beta chain:formate dehydrogenase N iron-sulfur protein]
[GN:fdnH] [CL:ferredoxin 2[4Fe-4S] homology] [OR:Escherichia coli] [EC:1.2.1.2]
[DB:pir2] >gp:[GI:d1015843:g1742408] [LN:D90788] [AC:D90788:AB001340] [PN:Formate
dehydrogenase (EC 1.2.1.2),] [GN:fdnH] [OR:Escherichia coli] [SR:Escherichia coli
(strain:K12) DNA, clone_lib:Kohara lambda minise] [DB:genpept-bct1] [DE:E.coli
genomic DNA, Kohara clone #277(33.2-33.6 min.).] [NT:ORF_ID:o277#5; similar to
[PIR Accession Number] [LE:8265] [RE:9149] [DI:direct] >gp:[GI:d1015852:g1742418]
[LN:D90789] [AC:D90789:AB001340] [PN:Formate dehydrogenase (EC 1.2.1.2),]
[GN:fdnH] [OR:Escherichia coli] [SR:Escherichia coli (strain:K12) DNA,
clone_lib:Kohara lambda minise] [DB:genpept-bct1] [DE:E.coli genomic DNA, Kohara
clone #278(33.3-33.7 min.).] [NT:ORF_ID:o277#5; similar to [PIR Accession Number]
[LE:4641] [RE:5525] [DI:direct] >gp:[GI:g1787749] [LN:AE000244]
[AC:AE000244:U00096] [PN:formate dehydrogenase-N, nitrate-inducible,] [GN:fdnH]
[FN:enzyme; Energy metabolism, carbon: Anaerobic] [OR:Escherichia coli]
[DB:genpept-bct2] [DE:Escherichia coli K-12 MG1655 section 134 of 400 of the
completegenome.] [NT:o294; 99 pct identical to FDNH_ECOLI SW: P24184; CG]
[LE:7860] [RE:8744] [DI:direct]

| ORF Name | NT ID | AA ID | NT LN | AA LN | Score | P-value |
|---|---|---|---|---|---|---|
| 10433437_f2_534 | 2228 | 9399 | 498 | 165 | 335 | 2.6e-30 |

Description sp:[LN:IAAT_AZOBR] [AC:P26945] [OR:Azospirillum brasilense] [EC:2.3.1.-] [DE:IAA
ACETYLTRANSFERASE,] [SP:P26945] [DB:swissprot] >sp:[LN:S17706] [AC:S17706]
[PN:acetyl transferase] [OR:Azospirillum brasilense] [DB:pir2] >gp:[GI:g580700]
[LN:ABTRPGDC] [AC:X57853:S55187] [PN:acetyl transferase] [OR:Azospirillum
brasilense] [DB:genpept-bct1] [DE:A.brasilense trpG, trpD, trpC gene.] [NT:ORF5]
[SP:P26945] [LE:4438] [RE:4899] [DI:direct]

| ORF Name | NT ID | AA ID | NT LN | AA LN | Score | P-value |
|---|---|---|---|---|---|---|
| 10650305_cl_1920 | 2229 | 9400 | 618 | 205 | 471 | 1.0e-44 |

Description sp:[LN:AMPM_SALTY] [AC:P10882] [GN:MAP:PEPM] [OR:Salmonella typhimurium]
[EC:3.4.11.18] [DE:METHIONINE AMINOPEPTIDASE, (MAP) (PEPTIDASE M)] [SP:P10882]
[DB:swissprot]

| ORF Name | NT ID | AA ID | NT/LN | AA/LN | Score | P-value |
|---|---|---|---|---|---|---|
| 10943907_c1_1711 | 2230 | 9401 | 1194 | 397 | 1036 | 1.4e-104 |

Description sp:[LN:CATB_PSEPU] [AC:P08310] [GN:CATB] [OR:Pseudomonas putida] [EC:5.5.1.1] [DE:ENZYME I) (MLE)] [SP:P08310] [DB:swissprot]

| ORF Name | NT ID | AA ID | NT/LN | AA/LN | Score | P-value |
|---|---|---|---|---|---|---|
| 11025816_f1_42 | 2231 | 9402 | 990 | 329 | 1314 | 4.8e-134 |

Description sp:[LN:YNEH_ECOLI] [AC:P77470] [GN:YNEH] [OR:Escherichia coli] [DE:HYPOTHETICAL 33.5 KD PROTEIN IN UXAB-MARR INTERGENIC REGION] [SP:P77470] [DB:swissprot] >sp:[LN:G64906] [AC:G64906] [PN:glutaminase homolog yneH] [GN:yneH] [CL:Escherichia coli glutaminase homolog yneH] [OR:Escherichia coli] [DB:pir1] >gp:[GI:d1015925:g1742497] [LN:D90795] [AC:D90795:AB001340] [PN:Glutaminase, kidney isoform precursor (EC) [OR:Escherichia coli] [SR:Escherichia coli (strain:K12) DNA, clone_lib:Kohara lambda minise] [DB:genpept-bct1] [DE:E.coli genomic DNA, Kohara clone #304(34.6-34.9 min.).] [NT:ORF_ID:o304#10; similar to [SwissProt Accession] [LE:8191] [RE:9117] [DI:complement] >gp:[GI:d1015933:g1742506] [LN:D90796] [AC:D90796:AB001340] [PN:Glutaminase, kidney isoform precursor (EC) [OR:Escherichia coli] [SR:Escherichia coli (strain:K12) DNA, clone_lib:Kohara lambda minise] [DB:genpept-bct1] [DE:E.coli genomic DNA, Kohara clone #305(34.7-35.1 min.).] [NT:ORF_ID:o304#10; similar to [SwissProt Accession] [LE:1474] [RE:2400] [DI:complement] >gp:[GI:g1787804] [LN:AE000250] [AC:AE000250:U00096] [PN:putative glutaminase] [GN:yneH] [FN:putative enzyme; Not classified] [OR:Escherichia coli] [DB:genpept-bct2] [DE:Escherichia coli K-12 MG1655 section 140 of 400 of the completegenome.] [NT:f308; This 308 aa ORF is 38 pct identical (6 gaps)] [LE:1562] [RE:2488] [DI:complement]

| ORF Name | NT ID | AA ID | NT/LN | AA/LN | Score | P-value |
|---|---|---|---|---|---|---|
| 11037500_f2_487 | 2232 | 9403 | 321 | 106 | 141 | 2.0e-08 |

Description gp:[GI:g3153821] [LN:AF062655] [AC:AF062655] [PN:plenty-of-prolines-101] [OR:Mus musculus] [SR:house mouse] [DB:genpept-rod] [DE:Mus musculus plenty-of-prolines-101 mRNA, complete cds.] [NT:binds to several SH3 domain containing proteins] [LE:24] [RE:2717] [DI:direct]

| ORF Name | NT ID | AA ID | NT/LN | AA/LN | Score | P-value |
|---|---|---|---|---|---|---|
| 11113152_c1_1703 | 2233 | 9404 | 261 | 86 | 130 | 1.4e-08 |

Description sp:[LN:D72603] [AC:D72603] [PN:hypothetical protein APE1291] [GN:APE1291] [OR:Aeropyrum pernix] [DB:pir2] >gp:[GI:d1044068:g5104968] [LN:AP000061] [AC:AP000061] [PN:198aa long hypothetical protein] [GN:APE1291] [OR:Aeropyrum pernix] [SR:Aeropyrum pernix (strain:K1) DNA] [DB:genpept-bct1] [DE:Aeropyrum pernix genomic DNA, section 4/7.] [LE:102120] [RE:102716] [DI:complement]

| ORF Name | NT ID | AA ID | NT LN | AA LN | Score | P-value |
|---|---|---|---|---|---|---|
| 11175307_f3_1400 | 2234 | 9405 | 204 | 67 | 121 | 1.3e-07 |

Description sp:[LN:G72510] [AC:G72510] [PN:hypothetical protein APE2061] [GN:APE2061] [OR:Aeropyrum pernix] [DB:pir2] >gp:[GI:d1044857;g5105759] [LN:AP000063] [AC:AP000063] [PN:114aa long hypothetical protein] [GN:APE2061] [OR:Aeropyrum pernix] [SR:Aeropyrum pernix (strain:K1) DNA] [DB:genpept-bct1] [DE:Aeropyrum pernix genomic DNA, section 6/7.] [NT:similar to OWL:AP00000656 percent identity:52.747] [LE:58153] [RE:58497] [DI:direct]

| ORF Name | NT ID | AA ID | NT LN | AA LN | Score | P-value |
|---|---|---|---|---|---|---|
| 11189032_f1_464 | 2235 | 9406 | 627 | 208 | 781 | 1.4e-77 |

Description sp:[LN:YDHM_ECOLI] [AC:P76189] [GN:YDHM] [OR:Escherichia coli] [DE:HYPOTHETICAL TRANSCRIPTIONAL REGULATOR IN SODC-NEMA INTERGENIC REGION] [SP:P76189] [DB:swissprot] >sp:[LN:C64922] [AC:C64922] [PN:conserved hypothetical protein b1649] [OR:Escherichia coli] [DB:pir2] >gp:[GI:g1787938] [LN:AE000260] [AC:AE000260:U00096] [PN:orf, hypothetical protein] [GN:b1649] [FN:orf; Unknown] [OR:Escherichia coli] [DB:genpept-bct2] [DE:Escherichia coli K-12 MG1655 section 150 of 400 of the completegenome.] [NT:o199; Residues 18-121 are 26 pct identical to 104] [LE:1358] [RE:1957] [DI:direct]

| ORF Name | NT ID | AA ID | NT LN | AA LN | Score | P-value |
|---|---|---|---|---|---|---|
| 11726091_c2_2041 | 2236 | 9407 | 258 | 85 | 150 | 1.1e-10 |

Description gp:[GI:g3046980] [LN:AF056931] [AC:AF056931] [PN:copper-zinc superoxide dismutase] [GN:sodC-2] [OR:Salmonella typhimurium] [DB:genpept-bct2] [DE:Salmonella typhimurium copper-zinc superoxide dismutase (sodC-2)gene, complete cds.] [NT:similar to Escherichia coli copper-zinc superoxide] [LE:433] [RE:954] [DI:direct]

| ORF Name | NT ID | AA ID | NT LN | AA LN | Score | P-value |
|---|---|---|---|---|---|---|
| 11800340_f3_1526 | 2237 | 9408 | 969 | 322 | 988 | 1.7e-99 |

Description sp:[LN:YDHJ_ECOLI] [AC:P76185] [GN:YDHJ] [OR:Escherichia coli] [DE:HYPOTHETICAL 33.0 KD PROTEIN IN SLYA-SODC INTERGENIC REGION] [SP:P76185] [DB:swissprot] >sp:[LN:F64921] [AC:F64921] [PN:probable membrane protein b1644] [CL:Escherichia coli hypothetical protein b1644] [OR:Escherichia coli] [DB:pir2] >gp:[GI:g1787932] [LN:AE000259] [AC:AE000259:U00096] [PN:putative membrane protein] [GN:b1644] [FN:putative membrane; Not classified] [OR:Escherichia coli] [DB:genpept-bct2] [DE:Escherichia coli K-12 MG1655 section 149 of 400 of the completegenome.] [NT:o299; This 299 aa ORF is 41 pct identical (1 gap)] [LE:8829] [RE:9728] [DI:direct]

| ORF_Name | NT_ID | AA_ID | NT/LN | AA/LN | Score | P-value |
|---|---|---|---|---|---|---|
| 11828793_c1_1822 | 2238 | 9409 | 831 | 276 | 283 | 8.5e-25 |

Description sp:[LN:YEAM_ECOLI] [AC:P76241] [GN:YEAM] [OR:Escherichia coli] [DE:HYPOTHETICAL
TRANSCRIPTIONAL REGULATOR IN GAPA-RND INTERGENIC REGION] [SP:P76241]
[DB:swissprot] >sp:[LN:F64939] [AC:F64939] [PN:hypothetical protein b1790]
[OR:Escherichia coli] [DB:pir2] >gp:[GI:g1788091] [LN:AE000274]
[AC:AE000274:U00096] [PN:putative ARAC-type regulatory protein] [GN:yeaM]
[FN:putative regulator; Not classified] [OR:Escherichia coli] [DB:genpept-bct2]
[DE:Escherichia coli K-12 MG1655 section 164 of 400 of the completegenome.]
[NT:f273; This 273 aa ORF is 21 pct identical (7 gaps)] [LE:494] [RE:1315]
[DI:complement]

| ORF_Name | NT_ID | AA_ID | NT/LN | AA/LN | Score | P-value |
|---|---|---|---|---|---|---|
| 11972281_f3_1170 | 2239 | 9410 | 1059 | 352 | 1064 | 1.5e-107 |

Description sp:[LN:G3P_BACST] [AC:P00362] [GN:GAP] [OR:Bacillus stearothermophilus]
[EC:1.2.1.12] [DE:GLYCERALDEHYDE 3-PHOSPHATE DEHYDROGENASE, (GAPDH)] [SP:P00362]
[DB:swissprot]

| ORF_Name | NT_ID | AA_ID | NT/LN | AA/LN | Score | P-value |
|---|---|---|---|---|---|---|
| 11988402_c1_1988 | 2240 | 9411 | 1218 | 405 | 1669 | 1.1e-171 |

Description sp:[LN:YDEA_ECOLI] [AC:P31122:P77353:P76883] [GN:YDEA] [OR:Escherichia coli]
[DE:HYPOTHETICAL 42.5 KD PROTEIN IN UXAB-MARR INTERGENIC REGION]
[SP:P31122:P77353:P76883] [DB:swissprot] >sp:[LN:C64907] [AC:C64907]
[PN:chloramphenicol resistance protein homolog ydeA] [GN:ydeA] [CL:Streptomyces
lividans chloramphenicol resistance protein] [OR:Escherichia coli] [DB:pir1]
>gp:[GI:d1015929:g1742501] [LN:D90795] [AC:D90795:AB001340] [PN:Protein AraJ
precursor.] [GN:ydeA] [OR:Escherichia coli] [SR:Escherichia coli (strain:K12)
DNA, clone_lib:Kohara lambda minise] [DB:genpept-bct1] [DE:E.coli genomic DNA,
Kohara clone #304(34.6-34.9 min.).] [NT:ORF_ID:o304#15; similar to [SwissProt
Accession] [LE:12892] [RE:14082] [DI:direct] >gp:[GI:d1015937:g1742510]
[LN:D90796] [AC:D90796:AB001340] [PN:Protein AraJ precursor.] [GN:ydeA]
[OR:Escherichia coli] [SR:Escherichia coli (strain:K12) DNA, clone_lib:Kohara
lambda minise] [DB:genpept-bct1] [DE:E.coli genomic DNA, Kohara clone
305(34.7-35.1 min.).] [NT:ORF_ID:o304#15; similar to [SwissProt Accession]
[LE:6175] [RE:7365] [DI:direct] >gp:[GI:g1787808] [LN:AE000250]
[AC:AE000250:U00096] [PN:putative resistance / regulatory protein] [GN:ydeA]
[FN:putative transport; Drug/analog sensitivity] [OR:Escherichia coli]
[DB:genpept-bct2] [DE:Escherichia coli K-12 MG1655 section 140 of 400 of the
completegenome.] [NT:o396; 100 pct identical to fragment YDEA_ECOLI] [LE:6265]
[RE:7455] [DI:direct]

| ORF Name | NT ID | AA ID | NT/LN | AA/LN | Score | P-value |
|---|---|---|---|---|---|---|
| 1204050_f2_518 | 2241 | 9412 | 675 | 224 | 991 | 8.1e-100 |

Description sp:[LN:MARC_SALTY] [AC:Q56068] [GN:MARC] [OR:Salmonella typhimurium] [DE:MULTIPLE ANTIBIOTIC RESISTANCE PROTEIN MARC] [SP:Q56068] [DB:swissprot] >sp:[LN:T11755] [AC:T11755] [PN:conserved hypothetical protein 221] [CL:conserved hypothetical protein MJ1677] [OR:Salmonella typhimurium] [DB:pir2] >gp:[GI:g1293697] [LN:STU54468] [AC:U54468] [OR:Salmonella typhimurium] [SR:Salmonella typhimurium strain=X3181] [DB:genpept-bct2] [DE:Salmonella typhimurium multiple antibiotic resistance operon MarR,MarA, MarB, and ORF221 genes, complete cds, and ORFA gene, partialcds.] [NT:ORF221] [LE:61] [RE:726] [DI:complement]

| ORF Name | NT ID | AA ID | NT/LN | AA/LN | Score | P-value |
|---|---|---|---|---|---|---|
| 1209658_c1_1908 | 2242 | 9413 | 750 | 249 | 160 | 2.4e-10 |

Description sp:[LN:A69502] [AC:A69502] [PN:conserved hypothetical protein AF2018] [OR:Archaeoglobus fulgidus] [DB:pir2] >gp:[GI:g2648513] [LN:AE000963] [AC:AE000963:AE000782] [PN:conserved hypothetical protein] [GN:AF2018] [OR:Archaeoglobus fulgidus] [DB:genpept-bct2] [DE:Archaeoglobus fulgidus section 144 of 172 of the complete genome.] [NT:similar to GP:454844 percent identity: 26.98;] [LE:4671] [RE:5405] [DI:direct]

| ORF Name | NT ID | AA ID | NT/LN | AA/LN | Score | P-value |
|---|---|---|---|---|---|---|
| 12140756_c2_2471 | 2243 | 9414 | 1200 | 399 | 1062 | 2.4e-107 |

Description sp:[LN:YHHS_ECOLI] [AC:P37621] [GN:YHHS] [OR:Escherichia coli] [DE:HYPOTHETICAL 43.8 KD PROTEIN IN FTSY-NIKA INTERGENIC REGION (F419)] [SP:P37621] [DB:swissprot] >sp:[LN:S47692] [AC:S47692:D65144] [PN:hypothetical 43.8K protein (ftsY-nikA intergenic region):hypothetical protein f419] [GN:yhhS] [CL:hypothetical protein b2322] [OR:Escherichia coli] [DB:pir1] >gp:[GI:g912459] [LN:ECOUW76] [AC:U00039] [OR:Escherichia coli] [SR:Escherichia coli (sub_strain MG1655, strain K-12) (library: lambda) [DB:genpept-bct1] [DE:E. coli chromosomal region from 76.0 to 81.5 minutes.] [LE:24778] [RE:26037] [DI:complement] >gp:[GI:g1789884] [LN:AE000423] [AC:AE000423:U00096] [PN:putative transport] [GN:yhhS] [FN:putative transport; Not classified] [OR:Escherichia coli] [DB:genpept-bct2] [DE:Escherichia coli K-12 MG1655 section 313 of 400 of the completegenome.] [NT:f419; 100 pct identical amino acid sequence and] [LE:1830] [RE:3089] [DI:complement]

| ORF_Name | NT_ID | AA_ID | NT/LN | AA/LN | Score | P-value |
|---|---|---|---|---|---|---|
| 12219001_c2_2461 | 2244 | 9415 | 1056 | 351 | 215 | 2.2e-25 |

Description sp:[LN:T08037] [AC:T08037] [PN:1-aminocyclopropane-1-carboxylic acid oxidase, 1:ACC oxidase 1] [GN:ACO1] [CL:1-aminocyclopropane-1-carboxylate oxidase] [OR:Cucumis sativus] [SR:, cucumber] [EC:1.4.3.-] [DB:pir2] >gp:[GI:g3025693] [LN:AF033581] [AC:AF033581] [PN:ACC oxidase 1] [GN:Cs-ACO1] [OR:Cucumis sativus] [SR:cucumber] [DB:genpept-pln2] [DE:Cucumis sativus ACC oxidase 1 (Cs-ACO1) mRNA, complete cds.] [NT:contains a frameshift relative to other species'] [LE:44] [RE:892] [DI:direct]

| ORF_Name | NT_ID | AA_ID | NT/LN | AA/LN | Score | P-value |
|---|---|---|---|---|---|---|
| 12306567_c3_2766 | 2245 | 9416 | 1206 | 401 | | |

Description

NO-HIT

| ORF_Name | NT_ID | AA_ID | NT/LN | AA/LN | Score | P-value |
|---|---|---|---|---|---|---|
| 12362705_f3_1286 | 2246 | 9417 | 981 | 326 | 1662 | 6.3e-171 |

Description sp:[LN:PQQB_KLEPN] [AC:P27504] [GN:PQQB] [OR:Klebsiella pneumoniae] [DE:COENZYME PQQ SYNTHESIS PROTEIN B] [SP:P27504] [DB:swissprot] >sp:[LN:S20454] [AC:S20454:S21839] [PN:pqqB protein] [GN:pqqB] [OR:Klebsiella pneumoniae] [DB:pir2] >gp:[GI:g43906] [LN:KPPQQAF] [AC:X58778:S92172] [GN:pqqB] [OR:Klebsiella pneumoniae] [DB:genpept-bct1] [DE:K.pneumoniae pqqABCDEF genes, involved in pyrroloquinolinebiosynthesis.] [SP:P27504] [LE:1080] [RE:2006] [DI:direct]

| ORF_Name | NT_ID | AA_ID | NT/LN | AA/LN | Score | P-value |
|---|---|---|---|---|---|---|
| 12535406_f3_1529 | 2247 | 9418 | 429 | 142 | 324 | 2.7e-28 |

Description sp:[LN:G64921] [AC:G64921] [PN:probable membrane protein b1645] [OR:Escherichia coli] [DB:pir2] >gp:[GI:g1787933] [LN:AE000259] [AC:AE000259:U00096] [PN:orf, hypothetical protein] [GN:b1645] [FN:orf; Unknown] [OR:Escherichia coli] [DB:genpept-bct2] [DE:Escherichia coli K-12 MG1655 section 149 of 400 of the completegenome.] [NT:o670; This 670 aa ORF is 25 pct identical (35 gaps)] [LE:9728] [RE:11740] [DI:direct]

| ORF Name | NT ID | AA ID | NT/LN | AA/LN | Score | P-value |
|---|---|---|---|---|---|---|
| 12537587_c1_1876 | 2248 | 9419 | 1017 | 338 | 252 | 1.6e-21 |

Description gp:[GI:g5881859] [LN:SC5G9] [AC:AL117385] [PN:putative lipoprotein] [GN:SC5G9.10]
[OR:Streptomyces coelicolor A3(2)] [DB:genpept-bct1] [DE:Streptomyces coelicolor
cosmid 5G9.] [NT:SC5G9.10, possible lipoprotein, len: 342 aa;] [LE:11321]
[RE:12349] [DI:direct]

| ORF Name | NT ID | AA ID | NT/LN | AA/LN | Score | P-value |
|---|---|---|---|---|---|---|
| 12588330_f1_461 | 2249 | 9420 | 597 | 198 | 778 | 3.0e-77 |

Description sp:[LN:G64921] [AC:G64921] [PN:probable membrane protein b1645] [OR:Escherichia
coli] [DB:pir2] >gp:[GI:g1787933] [LN:AE000259] [AC:AE000259:U00096] [PN:orf,
hypothetical protein] [GN:b1645] [FN:orf; Unknown] [OR:Escherichia coli]
[DB:genpept-bct2] [DE:Escherichia coli K-12 MG1655 section 149 of 400 of the
completegenome.] [NT:o670; This 670 aa ORF is 25 pct identical (35 gaps)]
[LE:9728] [RE:11740] [DI:direct]

| ORF Name | NT ID | AA ID | NT/LN | AA/LN | Score | P-value |
|---|---|---|---|---|---|---|
| 1269075_c2_2163 | 2250 | 9421 | 1713 | 570 | 438 | 3.2e-41 |

Description gp:[GI:e1247696:g2815337] [LN:SC10A5] [AC:AL021529] [PN:putative membrane
protein] [GN:SC10A5.29c] [OR:Streptomyces coelicolor] [DB:genpept-bct1]
[DE:Streptomyces coelicolor cosmid 10A5.] [NT:SC10A5.29c, probable integral
membrane protein,] [LE:31214] [RE:32983] [DI:complement]

| ORF Name | NT ID | AA ID | NT/LN | AA/LN | Score | P-value |
|---|---|---|---|---|---|---|
| 12695791_f3_1059 | 2251 | 9422 | 1158 | 385 | 631 | 1.1e-61 |

Description sp:[LN:S76273] [AC:S76273] [PN:hypothetical protein] [CL:Synechocystis sp. 41K
hypothetical protein:ATP-binding cassette homology] [OR:Synechocystis sp.]
[SR:PCC 6803, , PCC 6803] [SR:PCC 6803, ] [DB:pir1] >gp:[GI:d1010776:g1001500]
[LN:SYCSLRB] [AC:D64000:AB001339] [PN:high-affinity branched-chain amino acid]
[GN:livG] [OR:Synechocystis sp.] [SR:Synechocystis sp. (strain:PCC6803) DNA]
[DB:genpept-bct1] [DE:Synechocystis sp. PCC6803 complete genome, 19/27,
2392729-2538999.] [NT:ORF_ID:sll0764] [LE:14837] [RE:15958] [DI:complement]

| ORF Name | NT ID | AA ID | NT LN | AA LN | Score | P-value |
|---|---|---|---|---|---|---|
| 12703780_c3_2915 | 2252 | 9423 | 1008 | 335 | 542 | 3.1e-52 |

Description sp:[LN:G72307] [AC:G72307] [PN:hypothetical protein TM1005] [GN:TM1005]
[OR:Thermotoga maritima] [DB:pir2] >gp:[GI:g4981549] [LN:AE001762]
[AC:AE001762:AE000512] [PN:transcriptional regulator, putative] [GN:TM1005]
[OR:Thermotoga maritima] [DB:genpept-bct2] [DE:Thermotoga maritima section 74 of
136 of the complete genome.] [NT:similar to GB:L19201 SP:P09377 GB:X06058
PID:305009] [LE:5709] [RE:6608] [DI:complement]

| ORF Name | NT ID | AA ID | NT LN | AA LN | Score | P-value |
|---|---|---|---|---|---|---|
| 128842_f1_99 | 2253 | 9424 | 915 | 304 | 433 | 1.1e-40 |

Description gp:[GI:g5852324] [LN:AF088856] [AC:AF088856] [PN:IgiB] [GN:igiB] [OR:Vogesella
indigofera] [DB:genpept-bct2] [DE:Vogesella indigofera indigoidine biosynthesis
locus, completesequence.] [NT:putative glutamine dehydrogenase; probably
involved] [LE:2214] [RE:3089] [DI:complement]

| ORF Name | NT ID | AA ID | NT LN | AA LN | Score | P-value |
|---|---|---|---|---|---|---|
| 12891040_f2_595 | 2254 | 9425 | 1695 | 564 | 734 | 1.2e-81 |

Description sp:[LN:S76238] [AC:S76238] [PN:hypothetical protein sll0267] [OR:Synechocystis
sp.] [SR:PCC 6803, , PCC 6803] [SR:PCC 6803, ] [DB:pir2]
>gp:[GI:d1019230:g1653584] [LN:D90914] [AC:D90914:AB001339] [PN:hypothetical
protein] [OR:Synechocystis sp.] [SR:Synechocystis sp. (strain:PCC6803) DNA]
[DB:genpept-bct1] [DE:Synechocystis sp. PCC6803 complete genome, 16/27,
1991550-2137258.] [NT:ORF_ID:sll0267] [LE:119592] [RE:124328] [DI:complement]

| ORF Name | NT ID | AA ID | NT LN | AA LN | Score | P-value |
|---|---|---|---|---|---|---|
| 12925937_f3_1401 | 2255 | 9426 | 1059 | 352 | 827 | 1.9e-82 |

Description sp:[LN:YDDH_ECOLI] [AC:P76121] [GN:YDDH] [OR:Escherichia coli] [DE:HYPOTHETICAL
22.8 KD PROTEIN IN TEHB-ANSP INTERGENIC REGION] [SP:P76121] [DB:swissprot]
>sp:[LN:A64899] [AC:A64899] [PN:hypothetical protein b1462] [OR:Escherichia coli]
[DB:pir2] >gp:[GI:g1787735] [LN:AE000243] [AC:AE000243:U00096] [PN:orf,
hypothetical protein] [GN:b1462] [FN:orf; Unknown] [OR:Escherichia coli]
[DB:genpept-bct2] [DE:Escherichia coli K-12 MG1655 section 133 of 400 of the
completegenome.] [NT:f205; UUG start; This 205 aa ORF is 22 pct] [LE:2817]
[RE:3434] [DI:complement]

| ORF_Name | NT ID | AA ID | NT/LN | AA/LN | Score | P-value |
|---|---|---|---|---|---|---|
| 12939838_f2_490 | 2256 | 9427 | 1152 | 383 | 109 | 2.2e-07 |

Description sp:[LN:C75124] [AC:C75124] [PN:hypothetical protein PAB0539] [GN:PAB0539]
[OR:Pyrococcus abyssi] [DB:pir2] >gp:[GI:g5458219] [LN:CNSPAX03]
[AC:AJ248285:AL096836] [PN:hypothetical protein] [OR:Pyrococcus abyssi]
[DB:genpept-bct1] [DE:Pyrococcus abyssi complete genome; segment 3/6.]
[NT:PAB0539] [LE:148679] [RE:149617] [DI:direct]

| ORF_Name | NT ID | AA ID | NT/LN | AA/LN | Score | P-value |
|---|---|---|---|---|---|---|
| 12990677_f3_1074 | 2257 | 9428 | 900 | 299 | 390 | 3.9e-36 |

Description sp:[LN:YGBI_HAEIN] [AC:P44978] [GN:HI1009] [OR:Haemophilus influenzae]
[DE:HYPOTHETICAL TRANSCRIPTIONAL REGULATOR HI1009] [SP:P44978] [DB:swissprot]
>gp:[GI:g1574039] [LN:U32781] [AC:U32781:L42023] [PN:glycerol-3-phosphate regulon
repressor (glpR)] [GN:HI1009] [OR:Haemophilus influenzae Rd] [DB:genpept-bct2]
[DE:Haemophilus influenzae Rd section 96 of 163 of the complete genome.]
[NT:similar to SP:P09392 GB:M96795 PID:146186] [LE:9793] [RE:10563]
[DI:complement]

| ORF_Name | NT ID | AA ID | NT/LN | AA/LN | Score | P-value |
|---|---|---|---|---|---|---|
| 12992942_c3_2976 | 2258 | 9429 | 1134 | 377 | 657 | 2.0e-64 |

Description sp:[LN:VANB_PSES9] [AC:P12580] [GN:VANB] [OR:Pseudomonas sp] [SR:,strain ATCC
19151] [EC:1.14.13.-] [DE:DEGRADATION FERREDOXIN-LIKE PROTEIN)] [SP:P12580]
[DB:swissprot] >sp:[LN:B43652] [AC:B43652] [PN:ferredoxin [2Fe-2S] homolog vanB]
[CL:phthalate dioxygenase reductase:cytochrome-b5 reductase homology:ferredoxin
[2Fe-2S] homology] [OR:Pseudomonas sp.] [DB:pir2] >gp:[GI:g151637] [LN:PSEVANDE]
[AC:M22077] [OR:Pseudomonas sp.] [SR:Pseudomonas sp. (strain ATCC 19151) DNA]
[DB:genpept-bct1] [DE:Pseudomonas sp. vanA gene encoding monooxygenase, complete
cds, andvanB gene encoding ferredoxin, complete cds.] [NT:ferredoxin] [LE:1248]
[RE:2192] [DI:direct]

| ORF_Name | NT ID | AA ID | NT/LN | AA/LN | Score | P-value |
|---|---|---|---|---|---|---|
| 13005042_f1_76 | 2259 | 9430 | 1362 | 453 | | |

Description

NO-HIT

| ORF Name | NT ID | AA ID | NT LN | AA LN | Score | P-value |
|---|---|---|---|---|---|---|
| 13010050_f2_920 | 2260 | 9431 | 879 | 292 | 888 | 6.6e-89 |

Description gp:[GI:e305863;g1946288] [LN:PSVDHORF2] [AC:Y11520] [PN:vanillin dehydrogenase]
[GN:vdh] [OR:Pseudomonas sp.] [SR:Pseudomonas sp] [DB:genpept-bct1]
[DE:Pseudomonas sp. vdh gene and ORF2.] [LE:1797] [RE:3242] [DI:direct]

| ORF Name | NT ID | AA ID | NT LN | AA LN | Score | P-value |
|---|---|---|---|---|---|---|
| 1301316_f1_369 | 2261 | 9432 | 1053 | 350 | 1430 | 2.4e-146 |

Description sp:[LN:YBEK_ECOLI] [AC:P41409;P77738] [GN:YBEK] [OR:Escherichia coli]
[DE:HYPOTHETICAL 33.8 KD PROTEIN IN LEUS-GLTL INTERGENIC REGION]
[SP:P41409;P77738] [DB:swissprot] >sp:[LN:A64800] [AC:A64800] [PN:purine
nucleosidase-related protein ybeK] [GN:ybeK] [CL:yaaF protein] [OR:Escherichia
coli] [DB:pir2] >gp:[GI:d1036289;g4062271] [LN:D90705] [AC:D90705;AB001340]
[PN:Hypothetical protein in gltL 3'region .] [GN:ybeK] [OR:Escherichia coli]
[SR:Escherichia coli(strain:K12) DNA, clone:Kohara clone #170] [DB:genpept-bct1]
[DE:Escherichia coli genomic DNA. (14.6 - 14.9 min).] [NT:ORF_ID:o170#5; similar
to SwissProt Accession] [LE:5961] [RE:6896] [DI:complement] >gp:[GI:g1778569]
[LN:ECU82598] [AC:U82598] [PN:YaaF homolog] [OR:Escherichia coli]
[DB:genpept-bct1] [DE:Escherichia coli genomic sequence of minutes 9 to 12.]
[NT:similar to E. coli YaaF] [LE:124107] [RE:125042] [DI:complement]
>gp:[GI:g1786871] [LN:AE000169] [AC:AE000169;U00096] [PN:putative tRNA
synthetase] [GN:ybeK] [FN:orf; Not classified] [OR:Escherichia coli]
[DB:genpept-bct2] [DE:Escherichia coli K-12 MG1655 section 59 of 400 of the
completegenome.] [NT:f311; 100 pct identical to fragment YBEK_ECOLI] [LE:8607]
[RE:9542] [DI:complement]

| ORF Name | NT ID | AA ID | NT LN | AA LN | Score | P-value |
|---|---|---|---|---|---|---|
| 13016391_f1_180 | 2262 | 9433 | 1617 | 538 | 968 | 2.2e-97 |

Description sp:[LN:B71726] [AC:B71726] [PN:multidrug resistance protein B (emrB) RP157]
[GN:emrB;RP157] [OR:Rickettsia prowazekii] [DB:pir2] >gp:[GI:e1342468;g3860724]
[LN:RPXX01] [AC:AJ235270;AJ235269] [PN:MULTIDRUG RESISTANCE PROTEIN B (emrB)]
[GN:RP157] [OR:Rickettsia prowazekii] [DB:genpept-bct1] [DE:Rickettsia prowazekii
strain Madrid E, complete genome; segment1/4.] [LE:186278] [RE:187837]
[DI:complement]

| ORF Name | NT ID | AA ID | NT LN | AA LN | Score | P-value |
|---|---|---|---|---|---|---|
| 13019033_f1_231 | 2263 | 9434 | 351 | 116 | 110 | 2.2e-05 |

Description gp:[GI:e309048;g1906822] [LN:ASZ93338] [AC:Z93338] [PN:hypothetical protein]
[GN:ORF2] [OR:Nocardioides simplex] [DB:genpept-bct1] [DE:A.simplex ksdI genes
and three open reading frames.] [NT:low similarity to phytoene dehydrogenase
from] [LE:591] [RE:2228] [DI:direct]

| ORF_Name | NT ID | AA ID | NT LN | AA LN | Score | P-value |
|---|---|---|---|---|---|---|
| 13079755_c3_2949 | 2264 | 9435 | 1590 | 529 | 721 | 3.3e-71 |

Description sp:[LN:D70180] [AC:D70180] [PN:phosphotransferase system enzyme II,, glucose-specific, factor II] [CL:phosphotransferase system glucose-specific enzyme II, factor II:phosphotransferase system glucose-specific enzyme II, factor II homology] [OR:Borrelia burgdorferi] [SR:, Lyme disease spirochete] [EC:2.7.1.69] [DB:pir1] >gp:[GI:g2688579] [LN:AE001166] [AC:AE001166:AE000783] [PN:PTS system, glucose-specific IIBC component] [GN:BB0645] [OR:Borrelia burgdorferi] [SR:Lyme disease spirochete] [DB:genpept-bct2] [DE:Borrelia burgdorferi (section 52 of 70) of the complete genome.] [NT:similar to GB:X80415 PID:1072418 PID:515384 percent] [LE:1808] [RE:3352] [DI:direct]

| ORF_Name | NT ID | AA ID | NT LN | AA LN | Score | P-value |
|---|---|---|---|---|---|---|
| 13147708_f1_19 | 2265 | 9436 | 414 | 137 | 114 | 1.4e-05 |

Description gp:[GI:g4455041] [LN:AF116463] [AC:AF116463] [PN:unknown] [OR:Streptomyces lincolnensis] [DB:genpept-bct2] [DE:Streptomyces lincolnensis putative regulatory protein WdlA (wdlA)gene, complete cds; and unknown gene.] [LE:1321] [RE:3789] [DI:direct]

| ORF_Name | NT ID | AA ID | NT LN | AA LN | Score | P-value |
|---|---|---|---|---|---|---|
| 13175913_f1_425 | 2266 | 9437 | 315 | 104 | 463 | 3.5e-43 |

Description gp:[GI:g5052223] [LN:AF109471] [AC:AF109471] [PN:pyrroloquinoline-quinone-dependent quinate] [GN:qumA] [FN:quinate metabolism] [OR:Xanthomonas campestris] [DB:genpept-bct2] [DE:Xanthomonas campestris pyrroloquinoline-quinone-dependent quinatedehydrogenase (qumA) gene, complete cds.] [NT:PQQ-dependent quinate dehydrogenase] [LE:304] [RE:2676] [DI:direct]

| ORF_Name | NT ID | AA ID | NT LN | AA LN | Score | P-value |
|---|---|---|---|---|---|---|
| 133586_f2_542 | 2267 | 9438 | 543 | 180 | 261 | 1.8e-22 |

Description sp:[LN:TTR_PSESY] [AC:P16966] [GN:TTR] [OR:Pseudomonas syringae] [SR:,pvsyringae] [EC:2.3.1.-] [DE:ACETYLTRANSFERASE, (TABTOXIN RESISTANCE PROTEIN)] [SP:P16966] [DB:swissprot] >sp:[LN:S09214] [AC:S09214] [PN:acetyltransferase,:tabtoxin resistance protein] [GN:ttr] [OR:Pseudomonas syringae pv. tabaci] [EC:2.3.1.-] [DB:pir2] >gp:[GI:g45893] [LN:PSTTRG] [AC:X17150] [OR:Pseudomonas syringae] [DB:genpept-bct1] [DE:P.syringae ttr gene for acetyltransferase.] [NT:acetyltransferase (AA 1-177)] [SP:P16966] [LE:16] [RE:549] [DI:direct]

| ORF_Name | NT_ID | AA_ID | NT/LN | AA/LN | Score | P-value |
|---|---|---|---|---|---|---|
| 134375_c3_2771 | 2268 | 9439 | 714 | 237 | 813 | 5.9e-81 |

Description sp:[LN:ATMC_SALTY] [AC:P22037] [GN:MGTC] [OR:Salmonella typhimurium] [DE:MG(2+) TRANSPORT ATPASE PROTEIN C] [SP:P22037] [DB:swissprot] >sp:[LN:A39083] [AC:A39083] [PN:Mg2+-transporting ATPase, mgtC] [CL:Mg2+-transporting ATPase] [OR:Salmonella typhimurium] [EC:3.6.1.-] [DB:pir2] >gp:[GI:g154179] [LN:STYMGTBC] [AC:M57715;J05728] [PN:Mg2+ transport ATPase] [GN:mgtC] [OR:Salmonella typhimurium] [SR:S.typhimurium (strain LT2) DNA] [DB:genpept-bct1] [DE:Salmonella typhimurium Mg2+ transport ATPase (mgtB and mgtC) genes,complete cds.] [LE:603] [RE:1298] [DI:direct] >gp:[GI:g4324616] [LN:AF106566] [AC:AF106566] [PN:MgtC] [GN:mgtC] [FN:required for intramacrophage survival and] [OR:Salmonella typhimurium] [DB:genpept-bct2] [DE:Salmonella typhimurium pathogenicity island SPI-3, completesequence.] [LE:15836] [RE:16531] [DI:complement]

| ORF_Name | NT_ID | AA_ID | NT/LN | AA/LN | Score | P-value |
|---|---|---|---|---|---|---|
| 13676286_c3_3050 | 2269 | 9440 | 1140 | 379 | 606 | 5.1e-59 |

Description gp:[GI:e1452146;g4803681] [LN:SCE7] [AC:AL049819] [PN:putative AraC-family transcriptional regulator] [GN:SCE7.02c] [OR:Streptomyces coelicolor] [DB:genpept-bct1] [DE:Streptomyces coelicolor cosmid E7.] [NT:SCE7.02c, probable AraC-family transcriptional] [LE:583] [RE:1587] [DI:complement]

| ORF_Name | NT_ID | AA_ID | NT/LN | AA/LN | Score | P-value |
|---|---|---|---|---|---|---|
| 13688886_f1_423 | 2270 | 9441 | 936 | 311 | 1320 | 1.1e-134 |

Description sp:[LN:YDCI_ECOLI] [AC:P77171] [GN:YDCI] [OR:Escherichia coli] [DE:HYPOTHETICAL TRANSCRIPTIONAL REGULATOR IN TRG-RIML INTERGENIC REGION] [SP:P77171] [DB:swissprot]

| ORF_Name | NT_ID | AA_ID | NT/LN | AA/LN | Score | P-value |
|---|---|---|---|---|---|---|
| 13781580_f3_1507 | 2271 | 9442 | 672 | 223 | 911 | 2.4e-91 |

Description sp:[LN:YDGP_ECOLI] [AC:P77285] [GN:YDGP] [OR:Escherichia coli] [DE:HYPOTHETICAL
21.9 KD PROTEIN IN ADD-NTH INTERGENIC REGION] [SP:P77285] [DB:swissprot]
>sp:[LN:A64920] [AC:A64920] [PN:conserved hypothetical protein b1631]
[CL:hypothetical protein HI1687] [OR:Escherichia coli] [DB:pir2]
>gp:[GI:d1016106:g1742689] [LN:D90806] [AC:D90806:AB001340] [OR:Escherichia coli]
[SR:Escherichia coli (strain:K12) DNA, clone_lib:Kohara lambda minise]
[DB:genpept-bct1] [DE:E.coli genomic DNA, Kohara clone #315(36.6-36.9 min.).]
[NT:ORF_ID:o316#10; similar to [SwissProt Accession] [LE:13200] [RE:13820]
[DI:direct] >gp:[GI:d1016113:g1742697] [LN:D90807] [AC:D90807:AB001340]
[OR:Escherichia coli] [SR:Escherichia coli (strain:K12) DNA, clone_lib:Kohara
lambda minise] [DB:genpept-bct1] [DE:E.coli genomic DNA, Kohara clone
316(36.7-37.1 min.).] [NT:ORF_ID:o316#10; similar to [SwissProt Accession]
[LE:7810] [RE:8430] [DI:direct] >gp:[GI:d1016136:g1742721] [LN:D90808]
[AC:D90808:AB001340] [OR:Escherichia coli] [SR:Escherichia coli (strain:K12) DNA,
clone_lib:Kohara lambda minise] [DB:genpept-bct1] [DE:E.coli genomic DNA, Kohara
clone #317(36.6-36.9 min.).] [NT:ORF_ID:o316#10; similar to [SwissProt Accession]
[LE:13301] [RE:13921] [DI:direct] >gp:[GI:g1787918] [LN:AE000258]
[AC:AE000258:U00096] [PN:orf, hypothetical protein] [GN:b1631] [FN:orf; Unknown]
[OR:Escherichia coli] [DB:genpept-bct2] [DE:Escherichia coli K-12 MG1655 section
148 of 400 of the completegenome.] [NT:o206; This 206 aa ORF is 48 pct identical
(1 gap)] [LE:10925] [RE:11545] [DI:direct]

| ORF_Name | NT_ID | AA_ID | NT/LN | AA/LN | Score | P-value |
|---|---|---|---|---|---|---|
| 13783135_f3_1437 | 2272 | 9443 | 558 | 185 | 755 | 8.2e-75 |

Description gp:[GI:d1015799:g1742360] [LN:D90784] [AC:D90784:AB001340] [PN:Phosphinothricin
acetyltransferase (EC] [OR:Escherichia coli] [SR:Escherichia coli (strain:K12)
DNA, clone_lib:Kohara lambda minise] [DB:genpept-bct1] [DE:E.coli genomic DNA,
Kohara clone #273(32.5-32.8 min.).] [NT:ORF_ID:o273#3; similar to [SwissProt
Accession] [LE:10366] [RE:11004] [DI:complement] >gp:[GI:d1015802:g1742364]
[LN:D90785] [AC:D90785:AB001340] [PN:Phosphinothricin acetyltransferase (EC]
[OR:Escherichia coli] [SR:Escherichia coli (strain:K12) DNA, clone_lib:Kohara
lambda minise] [DB:genpept-bct1] [DE:E.coli genomic DNA, Kohara clone
274(32.7-33.0 min.).] [NT:ORF_ID:o273#3; similar to [SwissProt Accession]
[LE:564] [RE:1202] [DI:complement]

| ORF_Name | NT ID | AA ID | NT LN | AA LN | Score | P-value |
|---|---|---|---|---|---|---|
| 13785250_c2_2195 | 2273 | 9444 | 717 | 238 | 1071 | 2.7e-108 |

Description sp:[LN:FDNI_ECOLI] [AC:P24185:P77513] [GN:FDNI] [OR:Escherichia coli]
[DE:(ANAEROBIC FORMATE DEHYDROGENASE CYTOCHROME B556 SUBUNIT)] [SP:P24185:P77513]
[DB:swissprot] >sp:[LN:JS0630] [AC:G64900:JS0630] [PN:formate dehydrogenase, N
(nitrate-inducible) gamma chain:cytochrome b556] [GN:fdnI] [CL:formate
dehydrogenase gamma chain] [OR:Escherichia coli] [EC:1.2.1.2] [DB:pir1]
>gp:[GI:d1015844:g1742409] [LN:D90788] [AC:D90788:AB001340] [PN:Formate
dehydrogenase, nitrate-inducible,] [GN:fdnI] [OR:Escherichia coli]
[SR:Escherichia coli (strain:K12) DNA, clone_lib:Kohara lambda minise]
[DB:genpept-bct1] [DE:E.coli genomic DNA, Kohara clone #277(33.2-33.6 min.).]
[NT:ORF_ID:o277#6; similar to [SwissProt Accession] [LE:9142] [RE:9795]
[DI:direct] >gp:[GI:d1015853:g1742419] [LN:D90789] [AC:D90789:AB001340]
[PN:Formate dehydrogenase, nitrate-inducible,] [GN:fdnI] [OR:Escherichia coli]
[SR:Escherichia coli (strain:K12) DNA, clone_lib:Kohara lambda minise]
[DB:genpept-bct1] [DE:E.coli genomic DNA, Kohara clone #278(33.3-33.7 min.).]
[NT:ORF_ID:o277#6; similar to [SwissProt Accession] [LE:5518] [RE:6171]
[DI:direct] >gp:[GI:g1787750] [LN:AE000244] [AC:AE000244:U00096] [PN:formate
dehydrogenase-N, nitrate-inducible,] [GN:fdnI] [FN:enzyme; Energy metabolism,
carbon: Anaerobic] [OR:Escherichia coli] [DB:genpept-bct2] [DE:Escherichia coli
K-12 MG1655 section 134 of 400 of the completegenome.] [NT:o217; CG Site No.
32168; more closely resembles] [LE:8737] [RE:9390] [DI:direct]

| ORF_Name | NT ID | AA ID | NT LN | AA LN | Score | P-value |
|---|---|---|---|---|---|---|
| 1384775_c3_2886 | 2274 | 9445 | 1278 | 425 | 753 | 1.3e-74 |

Description gp:[GI:e1535118:g5708250] [LN:SCJ21] [AC:AL109747] [PN:putative integral membrane
protein] [GN:SCJ21.17c] [OR:Streptomyces coelicolor A3(2)] [DB:genpept-bct1]
[DE:Streptomyces coelicolor cosmid J21.] [NT:SCJ21.17c, probable integral
membrane protein, len:] [LE:29638] [RE:31188] [DI:complement]

| ORF_Name | NT ID | AA ID | NT LN | AA LN | Score | P-value |
|---|---|---|---|---|---|---|
| 1386061_c1_1657 | 2275 | 9446 | 1053 | 350 | 1547 | 9.7e-159 |

Description sp:[LN:YNCB_ECOLI] [AC:P76113:P78255] [GN:YNCB] [OR:Escherichia coli]
[EC:1.-.-.-] [DE:(EC 1.-.-.-)] [SP:P76113:P78255] [DB:swissprot]
>gp:[GI:d1015800:g1742361] [LN:D90784] [AC:D90784:AB001340] [PN:Possible quinone
oxidoreductase (EC 1.6.5.5)] [OR:Escherichia coli] [SR:Escherichia coli
(strain:K12) DNA, clone_lib:Kohara lambda minise] [DB:genpept-bct1] [DE:E.coli
genomic DNA, Kohara clone #273(32.5-32.8 min.).] [NT:ORF_ID:o273#4; similar to
[SwissProt Accession] [LE:11041] [RE:12102] [DI:direct]
>gp:[GI:d1015803:g1742365] [LN:D90785] [AC:D90785:AB001340] [PN:Possible quinone
oxidoreductase (EC 1.6.5.5)] [OR:Escherichia coli] [SR:Escherichia coli
(strain:K12) DNA, clone_lib:Kohara lambda minise] [DB:genpept-bct1] [DE:E.coli
genomic DNA, Kohara clone #274(32.7-33.0 min.).] [NT:ORF_ID:o273#4; similar to
[SwissProt Accession] [LE:1239] [RE:2300] [DI:direct]

| ORF_Name | NT_ID | AA_ID | NT LN | AA LN | Score | P-value |
|---|---|---|---|---|---|---|
| 13864002_f2_961 | 2276 | 9447 | 819 | 272 | 886 | 1.1e-88 |

Description sp:[LN:PCXB_ACICA] [AC:P20372:Q43976] [GN:PCAH] [OR:Acinetobacter calcoaceticus]
[EC:1.13.11.3] [DE:PROTOCATECHUATE 3,4-DIOXYGENASE BETA CHAIN, (3,4-PCD)]
[SP:P20372:Q43976] [DB:swissprot] >gp:[GI:g141782] [LN:ACCPCAOP]
[AC:L05770:U04359:M33798:U20284:U11554:L13114:L03407] [PN:protocatechuate
3,4-dioxygenase beta subunit] [GN:pcaH] [OR:Acinetobacter sp. ADP1]
[DB:genpept-bct2] [EC:1.99.2.3] [DE:Acinetobacter sp. ADP1 pca-qui-pob
supraoperonic cluster, completesequence.] [NT:PO] [LE:9481] [RE:10206]
[DI:direct]

| ORF_Name | NT_ID | AA_ID | NT LN | AA LN | Score | P-value |
|---|---|---|---|---|---|---|
| 14068833_f2_864 | 2277 | 9448 | 1458 | 485 | 1973 | 7.0e-204 |

Description sp:[LN:NARU_ECOLI] [AC:P37758:P77696] [GN:NARU] [OR:Escherichia coli] [DE:NITRITE
EXTRUSION PROTEIN 2 (NITRITE FACILITATOR 2)] [SP:P37758:P77696] [DB:swissprot]
>sp:[LN:S11431] [AC:H64899:S11431] [PN:nitrite extrusion protein narU] [GN:narU]
[CL:nitrate transport protein narK] [OR:Escherichia coli] [DB:pir2]
>gp:[GI:d1015837:g1742401] [LN:D90787] [AC:D90787:AB001340] [PN:Nitrite extrusion
protein 2 (Nitrite facilitator] [GN:narU] [OR:Escherichia coli] [SR:Escherichia
coli (strain:K12) DNA, clone_lib:Kohara lambda minise] [DB:genpept-bct1]
[DE:E.coli genomic DNA, Kohara clone #276(33.0-33.3 min.).] [NT:ORF_ID:o276#8;
similar to [SwissProt Accession] [LE:12902] [RE:14290] [DI:complement]
>gp:[GI:d1015839:g1742404] [LN:D90788] [AC:D90788:AB001340] [PN:Nitrite extrusion
protein 2 (Nitrite facilitator] [GN:narU] [OR:Escherichia coli] [SR:Escherichia
coli (strain:K12) DNA, clone_lib:Kohara lambda minise] [DB:genpept-bct1]
[DE:E.coli genomic DNA, Kohara clone #277(33.2-33.6 min.).] [NT:ORF_ID:o276#8;
similar to [SwissProt Accession] [LE:476] [RE:1864] [DI:complement]
>gp:[GI:g1787743] [LN:AE000244] [AC:AE000244:U00096] [PN:nitrite extrusion
protein 2] [GN:narU] [FN:transport; Transport of small molecules:]
[OR:Escherichia coli] [DB:genpept-bct2] [DE:Escherichia coli K-12 MG1655 section
134 of 400 of the completegenome.] [NT:f462; 99 pct identical to GB: ECNARG_1]
[LE:71] [RE:1459] [DI:complement]

| ORF_Name | NT_ID | AA_ID | NT LN | AA LN | Score | P-value |
|---|---|---|---|---|---|---|
| 14069456_f2_841 | 2278 | 9449 | 1233 | 410 | 744 | 1.2e-73 |

Description gp:[GI:g5748628] [LN:SCJ1] [AC:AL109962] [PN:putative regulator] [GN:SCJ1.15]
[OR:Streptomyces coelicolor A3(2)] [DB:genpept-bct1] [DE:Streptomyces coelicolor
cosmid J1.] [NT:SCJ1.15, possible regulator, Len: 267 aa, highly] [LE:13879]
[RE:14682] [DI:direct]

| ORF_Name | NT_ID | AA_ID | NT/LN | AA/LN | Score | P-value |
|---|---|---|---|---|---|---|
| 14256540_f2_701 | 2279 | 9450 | 234 | 77 | 119 | 2.0e-07 |

Description sp:[LN:G72510] [AC:G72510] [PN:hypothetical protein APE2061] [GN:APE2061] [OR:Aeropyrum pernix] [DB:pir2] >gp:[GI:d1044857:g5105759] [GN:APE2061] [AC:AP000063] [PN:114aa long hypothetical protein] [LN:AP000063] pernix] [SR:Aeropyrum pernix (strain:K1) DNA] [DB:genpept-bct1] [DE:Aeropyrum pernix genomic DNA, section 6/7.] [NT:similar to OWL:AP00000656 percent identity:52.747] [LE:58153] [RE:58497] [DI:direct]

| ORF_Name | NT_ID | AA_ID | NT/LN | AA/LN | Score | P-value |
|---|---|---|---|---|---|---|
| 14322888_c2_2287 | 2280 | 9451 | 1143 | 380 | | |

Description

NO-HIT

| ORF_Name | NT_ID | AA_ID | NT/LN | AA/LN | Score | P-value |
|---|---|---|---|---|---|---|
| 14333168_c3_2882 | 2281 | 9452 | 198 | 65 | | |

Description

NO-HIT

| ORF_Name | NT_ID | AA_ID | NT/LN | AA/LN | Score | P-value |
|---|---|---|---|---|---|---|
| 14348827_c2_2352 | 2282 | 9453 | 243 | 80 | | |

Description

NO-HIT

| ORF_Name | NT_ID | AA_ID | NT/LN | AA/LN | Score | P-value |
|---|---|---|---|---|---|---|
| 14464517_c3_2904 | 2283 | 9454 | 207 | 68 | | |

Description

NO-HIT

| ORF_Name | NT_ID | AA_ID | NT/LN | AA/LN | Score | P-value |
|---|---|---|---|---|---|---|
| 14475091_c2_2241 | 2284 | 9455 | 1089 | 362 | 260 | 3.2e-21 |

Description sp:[LN:B70961] [AC:B70961] [PN:probable esterase] [GN:lipC] [OR:Mycobacterium tuberculosis] [DB:pir2] >gp:[GI:e304955:g1871593] [LN:MTCY8D5] [AC:Z92669:AL123456] [PN:lipC] [GN:lipC] [OR:Mycobacterium tuberculosis] [DB:genpept-bct1] [DE:Mycobacterium tuberculosis H37Rv complete genome; segment 12/162.] [NT:Rv0220, (MTCY08D5.15),len: 403, probable esterase] [LE:15490] [RE:16701] [DI:direct]

| ORF Name | NT ID | AA ID | NT LN | AA LN | Score | P-value |
|---|---|---|---|---|---|---|
| 14553817_f2_986 | 2285 | 9456 | 1200 | 399 | 836 | 2.1e-83 |

Description sp:[LN:G64919] [AC:G64919] [PN:probable iron-sulfur protein b1629:rnfC protein homolog b1629] [CL:ferredoxin 2[4Fe-4S] homology] [OR:Escherichia coli] [DB:pir2] >gp:[GI:d1016105:g1742688] [LN:D90806] [AC:D90806:AB001340] [PN:Glucose repression mediator protein.] [OR:Escherichia coli] [SR:Escherichia coli (strain:K12) DNA, clone_lib:Kohara lambda minise] [DB:genpept-bct1] [DE:E.coli genomic DNA, Kohara clone #315(36.6-36.9 min.).] [NT:ORF_ID:o316#5; similar to [SwissProt Accession] [LE:9915] [RE:12137] [DI:direct] >gp:[GI:d1016112:g1742696] [LN:D90807] [AC:D90807:AB001340] [PN:Glucose repression mediator protein.] [OR:Escherichia coli] [SR:Escherichia coli (strain:K12) DNA, clone_lib:Kohara lambda minise] [DB:genpept-bct1] [DE:E.coli genomic DNA, Kohara clone #316(36.7-37.1 min.).] [NT:ORF_ID:o316#5; similar to [SwissProt Accession] [LE:4525] [RE:6747] [DI:direct] >gp:[GI:d1016135:g1742720] [LN:D90808] [AC:D90808:AB001340] [PN:Glucose repression mediator protein.] [OR:Escherichia coli] [SR:Escherichia coli (strain:K12) DNA, clone_lib:Kohara lambda minise] [DB:genpept-bct1] [DE:E.coli genomic DNA, Kohara clone #317(36.6-36.9 min.).] [NT:ORF_ID:o316#5; similar to [SwissProt Accession] [LE:10016] [RE:12238] [DI:direct] >gp:[GI:g1787916] [LN:AE000258] [AC:AE000258:U00096] [PN:putative membrane protein] [GN:b1629] [FN:putative membrane; Not classified] [OR:Escherichia coli] [DB:genpept-bct2] [DE:Escherichia coli K-12 MG1655 section 148 of 400 of the completegenome.] [NT:o740; This 740 aa ORF is 30 pct identical (9 gaps)] [LE:7640] [RE:9862] [DI:direct]

| ORF Name | NT ID | AA ID | NT LN | AA LN | Score | P-value |
|---|---|---|---|---|---|---|
| 14555411_c2_2192 | 2286 | 9457 | 2460 | 819 | 4066 | 0.0 |

Description sp:[LN:FDNG_ECOLI] [AC:P24183:P78261] [GN:FDNG] [OR:Escherichia coli] [EC:1.2.1.2] [DE:(ANAEROBIC FORMATE DEHYDROGENASE MAJOR SUBUNIT)] [SP:P24183:P78261] [DB:swissprot] >sp:[LN:JS0628] [AC:E64900:JS0628] [PN:formate dehydrogenase, N (nitrate-inducible) alpha chain:formate dehydrogenase N selenocysteine-containing protein] [GN:fdnG] [CL:formate dehydrogenase] [OR:Escherichia coli] [EC:1.2.1.2] [DB:pir1] [MP:32 min]

| ORF Name | NT ID | AA ID | NT LN | AA LN | Score | P-value |
|---|---|---|---|---|---|---|
| 14571057_c2_2186 | 2287 | 9458 | 540 | 179 | 508 | 1.2e-48 |

Description sp:[LN:BENB_ACICA] [AC:P07770] [GN:BENB] [OR:Acinetobacter calcoaceticus] [EC:1.14.12.10] [DE:BENZOATE 1,2-DIOXYGENASE BETA SUBUNIT,] [SP:P07770] [DB:swissprot] >sp:[LN:S23478] [AC:S23478] [PN:probable benzoate 1,2-dioxygenase, benB] [CL:benB protein] [OR:Acinetobacter calcoaceticus] [EC:1.14.12.10] [DB:pir1] >gp:[GI:g2996622] [LN:AF009224] [AC:AF009224:M76991:M76990:M23245:M29848:M29714:M62649] [PN:BenB] [GN:benB] [FN:reductive oxygenase for benzoate] [OR:Acinetobacter sp. ADP1] [DB:genpept-bct2] [DE:Acinetobacter sp. ADP1 ben operon and cat operon, completesequence.] [LE:4044] [RE:4553] [DI:direct]

| ORF Name | NT ID | AA ID | NT LN | AA LN | Score | P-value |
|---|---|---|---|---|---|---|
| 14588586_f1_247 | 2288 | 9459 | 258 | 85 | | |

Description

NO-HIT

| ORF Name | NT ID | AA ID | NT LN | AA LN | Score | P-value |
|---|---|---|---|---|---|---|
| 14645902_c2_2528 | 2289 | 9460 | 579 | 192 | 708 | 7.9e-70 |

Description sp:[LN:BLA2_ECOLI] [AC:P14558] [GN:SHV2] [OR:Escherichia coli:Klebsiella pneumoniae:Klebsiella pneumoniae:and Salmonella typhimurium] [SR:,subspozaenae] [EC:3.5.2.6] [DE:BETA-LACTAMASE SHV-2 PRECURSOR (2A),] [SP:P14558] [DB:swissprot] >sp:[LN:A44998] [AC:A44998:S12703] [PN:beta-lactamase, SHV-2] [CL:beta-lactamase I] [OR:Klebsiella ozaenae] [EC:3.5.2.6] [DB:pir1] >sp:[LN:A35395] [AC:A35395:S18767] [PN:beta-lactamase, 2A precursor:beta-lactamase SHV2A] [GN:blaS2A] [CL:beta-lactamase I] [OR:Klebsiella pneumoniae] [EC:3.5.2.6] [DB:pir2] >gp:[GI:g43790] [LN:KOPLSHV2] [AC:X53433] [OR:Klebsiella pneumoniae subsp. ozaenae] [DB:genpept-bct1] [DE:Klebsiella ozaenae plasmid pBP60-1-2 SHV-2 gene for beta-lactamase.] [NT:beta-lactamase (AA 1-286)] [SP:P14558] [LE:931] [RE:1791] [DI:direct] >gp:[GI:g48990] [LN:KPPBWH77] [AC:X62115:S75769] [PN:SHV2A beta-lactamase] [GN:blaS2A] [OR:Klebsiella pneumoniae] [DB:genpept-bct1] [DE:K.pneumoniae plasmid pBWH77 aphA7 and blaS2A genes for neomycinphosphotransferase and beta-lactamase.] [SP:P14558] [LE:1281] [RE:2141] [DI:direct] >gp:[GI:g150489] [LN:P60BETALAC] [AC:M95179:M35595] [PN:beta-lactamase] [GN:bla] [OR:Plasmid pBP60-1] [SR:Plasmid pBP60-1 DNA] [DB:genpept-bct1] [EC:3.5.2.6.] [DE:Plasmid pBP60-1 beta-lactamase (bla) gene, complete cds.] [LE:187] [RE:1047] [DI:direct] >gp:[GI:g5002314] [LN:AF148851] [AC:AF148851] [PN:beta-lactamase SHV-2] [GN:blaSHV-2] [OR:Escherichia coli] [DB:genpept-bct2] [DE:Escherichia coli strain JC2926 beta-lactamase SHV-2 (blaSHV-2)gene, complete cds.] [LE:6] [RE:866] [DI:direct]

| ORF Name | NT ID | AA ID | NT LN | AA LN | Score | P-value |
|---|---|---|---|---|---|---|
| 14727257_c1_1870 | 2290 | 9461 | 2025 | 674 | 2882 | 3.3e-300 |

Description sp:[LN:T11778] [AC:T11778] [PN:phosphoglycerate transport regulatory protein pgtB] [OR:Salmonella typhimurium] [DB:pir2] >gp:[GI:g858753] [LN:STYPGTBC] [AC:M21279] [PN:regulatory protein pgtB] [OR:Salmonella typhimurium] [SR:Salmonella typhimurium (strain LT-2) DNA] [DB:genpept-bct1] [DE:Salmonella typhimurium phosphoglycerate transport regulatoryprotein (pgtB and pgtC) genes, complete cds, and regulatoryprotein (pgtA) gene, 5' end.] [LE:1305] [RE:3311] [DI:direct]

| ORF_Name | NT_ID | AA_ID | NT LN | AA LN | Score | P-value |
|---|---|---|---|---|---|---|
| 14730025_c1_1785 | 2291 | 9462 | 987 | 328 | 165 | 1.0e-10 |

Description sp:[LN:S75988] [AC:S75988] [PN:hypothetical protein] [OR:Synechocystis sp.]
[SR:PCC 6803, , PCC 6803] [SR:PCC 6803, ] [DB:pir2] >gp:[GI:d1011486:g1001348]
[LN:SYCSLLLH] [AC:D64006:AB001339] [PN:hypothetical protein] [OR:Synechocystis
sp.] [SR:Synechocystis sp. (strain:PCC6803) DNA] [DB:genpept-bct1]
[DE:Synechocystis sp. PCC6803 complete genome, 25/27, 3138604-3270709.]
[NT:ORF_ID:slr0541] [LE:73205] [RE:73915] [DI:direct]

| ORF_Name | NT_ID | AA_ID | NT LN | AA LN | Score | P-value |
|---|---|---|---|---|---|---|
| 14853950_f2_606 | 2292 | 9463 | 738 | 245 | 468 | 2.1e-44 |

Description sp:[LN:YIDP_ECOLI] [AC:P31453] [GN:YIDP] [OR:Escherichia coli] [DE:HYPOTHETICAL
TRANSCRIPTIONAL REGULATOR IN ILVO-IBPB INTERGENIC REGION] [SP:P31453]
[DB:swissprot] >sp:[LN:E65170] [AC:E65170] [PN:hypothetical transcription
regulator, ilvO-ibpB intergenic region] [GN:yidP] [CL:transcription regulator
GntR] [OR:Escherichia coli] [DB:pir1] >gp:[GI:g290533] [LN:ECOUW82] [AC:L10328]
[GN:o238] [FN:unknown] [OR:Escherichia coli] [SR:Escherichia coli K12 strain
MG1655; lambda clones EC14-52] [DB:genpept-bct1] [DE:E. coli; the region from
81.5 to 84.5 minutes.] [NT:similar to E. coli ORF adjacent to suc operon;]
[LE:53293] [RE:54009] [DI:direct] >gp:[GI:g1790118] [LN:AE000445]
[AC:AE000445:U00096] [PN:putative transcriptional regulator] [GN:yidP]
[FN:putative regulator; Not classified] [OR:Escherichia coli] [DB:genpept-bct2]
[DE:Escherichia coli K-12 MG1655 section 335 of 400 of the completegenome.]
[NT:o238; 100 pct identical to YIDP_ECOLI SW:] [LE:11074] [RE:11790] [DI:direct]

| ORF_Name | NT_ID | AA_ID | NT LN | AA LN | Score | P-value |
|---|---|---|---|---|---|---|
| 14892077_f3_1547 | 2293 | 9464 | 1272 | 423 | 1497 | 1.9e-153 |

Description sp:[LN:YDHC_ECOLI] [AC:P37597:P76191] [GN:YDHC] [OR:Escherichia coli]
[DE:HYPOTHETICAL 43.4 KD PROTEIN IN PURR-CFA INTERGENIC REGION]
[SP:P37597:P76191] [DB:swissprot] >sp:[LN:F64923] [AC:F64923] [PN:probable
membrane protein ydhC precursor] [GN:ydhC] [CL:bicyclomycin resistance protein]
[OR:Escherichia coli] [DB:pir2] >gp:[GI:g1787950] [LN:AE000261]
[AC:AE000261:U00096] [PN:putative transport protein] [GN:ydhC] [FN:putative
transport; Not classified] [OR:Escherichia coli] [DB:genpept-bct2]
[DE:Escherichia coli K-12 MG1655 section 151 of 400 of the completegenome.]
[NT:o403; This 403 aa ORF is 90 pct identical (7 gaps)] [LE:4627] [RE:5838]
[DI:direct]

| ORF Name | NT ID | AA ID | NT/LN | AA/LN | Score | P-value |
|---|---|---|---|---|---|---|
| 14943805_c1_1764 | 2294 | 9465 | 1035 | 344 | 443 | 9.5e-42 |

Description gp:[GI:g3738295] [LN:ATAC005309] [AC:AC005309] [GN:F17A22.22] [OR:Arabidopsis thaliana] [SR:thale cress] [DB:genpept-pln2] [DE:Arabidopsis thaliana chromosome II BAC F17A22 genomic sequence, complete sequence.] [NT:unknown protein] [LE:58530:58713:58897] [RE:58629:58804:59052] [DI:complementJoin]

| ORF Name | NT ID | AA ID | NT/LN | AA/LN | Score | P-value |
|---|---|---|---|---|---|---|
| 14944007_c1_1619 | 2295 | 9466 | 1599 | 532 | 685 | 2.1e-67 |

Description gp:[GI:e1429445:g4756971] [LN:BSP238680] [AC:AJ238680] [PN:Carboxylesterase] [GN:estA] [FN:hidrolysis of carboxylic esters] [OR:Bacillus sp. BP-23] [DB:genpept-bct1] [EC:3.1.1.3] [DE:Bacillus sp. estA gene, strain BP-23.] [LE:346] [RE:1803] [DI:direct]

| ORF Name | NT ID | AA ID | NT/LN | AA/LN | Score | P-value |
|---|---|---|---|---|---|---|
| 14958443_c1_1565 | 2296 | 9467 | 360 | 119 | 574 | 1.2e-55 |

Description sp:[LN:YDHD_ECOLI] [AC:P37010:P77424] [GN:YDHD] [OR:Escherichia coli] [DE:12.9 KD PROTEIN IN LHR-SODB INTERGENIC REGION] [SP:P37010:P77424] [DB:swissprot] >sp:[LN:H64922] [AC:H64922] [PN:probable glutaredoxin-like protein ydhD] [GN:ydhD] [CL:conserved hypothetical protein HI1165] [OR:Escherichia coli] [DB:pir2] >gp:[GI:d1016141:g1742727] [LN:D90809] [AC:D90809:AB001340] [GN:ydhD] [OR:Escherichia coli] [SR:Escherichia coli (strain:K12) DNA, clone_lib:Kohara lambda minise] [DB:genpept-bct1] [DE:E.coli genomic DNA, Kohara clone #318(37.2-37.6 min.).] [NT:ORF_ID:o317#10; similar to [SwissProt Accession] [LE:5346] [RE:5693] [DI:complement] >gp:[GI:g1787943] [LN:AE000260] [AC:AE000260:U00096] [PN:orf, hypothetical protein] [GN:ydhD] [FN:orf; Unknown] [OR:Escherichia coli] [DB:genpept-bct2] [DE:Escherichia coli K-12 MG1655 section 150 of 400 of the completegenome.] [NT:f115; 100 pct identical to fragment YDHD_ECOLI] [LE:9089] [RE:9436] [DI:complement]

| ORF Name | NT ID | AA ID | NT LN | AA LN | Score | P-value |
|---|---|---|---|---|---|---|
| 15017187_c1_1628 | 2297 | 9468 | 621 | 206 | 710 | 4.8e-70 |

Description sp:[LN:YDCN_ECOLI] [AC:P77626] [GN:YDCN] [OR:Escherichia coli] [DE:HYPOTHETICAL 19.7 KD PROTEIN IN TEHB-RHSE INTERGENIC REGION] [SP:P77626] [DB:swissprot] >sp:[LN:E64895] [AC:E64895] [PN:ydcN protein] [GN:ydcN] [OR:Escherichia coli] [DB:pir2] >gp:[GI:d1015781:g1742340] [LN:D90782] [AC:D90782:AB001340] [PN:HipB protein.] [OR:Escherichia coli] [SR:Escherichia coli (strain:K12) DNA, clone_lib:Kohara lambda minise] [DB:genpept-bct1] [DE:E.coli genomic DNA, Kohara clone #271(32.1-32.5 min.).] [NT:ORF_ID:o271#7; similar to [SwissProt Accession] [LE:14582] [RE:15118] [DI:direct] >gp:[GI:d1015786:g1742346] [LN:D90783] [AC:D90783:AB001340] [PN:HipB protein.] [OR:Escherichia coli] [SR:Escherichia coli (strain:K12) DNA, clone_lib:Kohara lambda minise] [DB:genpept-bct1] [DE:E.coli genomic DNA, Kohara clone #272(32.4-32.7 min.).] [NT:ORF_ID:o271#7; similar to [SwissProt Accession] [LE:4552] [RE:5088] [DI:direct] >gp:[GI:g1787704] [LN:AE000240] [AC:AE000240:U00096] [PN:orf, hypothetical protein] [GN:ydcN] [FN:orf; Unknown] [OR:Escherichia coli] [DB:genpept-bct2] [DE:Escherichia coli K-12 MG1655 section 130 of 400 of the completegenome.] [NT:o178; residues 15-87 are 31 pct identical to] [LE:7531] [RE:8067] [DI:direct]

| ORF Name | NT ID | AA ID | NT LN | AA LN | Score | P-value |
|---|---|---|---|---|---|---|
| 15632807_c2_2039 | 2298 | 9469 | 306 | 101 | 369 | 6.6e-34 |

Description sp:[LN:YDHL_ECOLI] [AC:P76188] [GN:YDHL] [OR:Escherichia coli] [DE:HYPOTHETICAL 14.4 KD PROTEIN IN SODC-NEMA INTERGENIC REGION PRECURSOR] [SP:P76188] [DB:swissprot] >sp:[LN:B64922] [AC:B64922] [PN:probable membrane protein b1648] [OR:Escherichia coli] [DB:pir2] >gp:[GI:g1787937] [LN:AE000260] [AC:AE000260:U00096] [PN:orf, hypothetical protein] [GN:b1648] [FN:orf; Unknown] [OR:Escherichia coli] [DB:genpept-bct2] [DE:Escherichia coli K-12 MG1655 section 150 of 400 of the completegenome.] [NT:f125] [LE:1016] [RE:1393] [DI:complement]

| ORF Name | NT ID | AA ID | NT/LN | AA/LN | Score | P-value |
|---|---|---|---|---|---|---|
| 15703942_f1_283 | 2299 | 9470 | 1791 | 596 | 2594 | 1.1e-269 |

Description sp:[LN:SFCA_ECOLI] [AC:P26616:P78224] [GN:SFCA:MAEA] [OR:Escherichia coli]
[EC:1.1.1.38] [DE:PROBABLE MALATE OXIDOREDUCTASE [NAD], (MALIC ENZYME)]
[SP:P26616:P78224] [DB:swissprot] >sp:[LN:B64901] [AC:B64901:S38951] [PN:malate
dehydrogenase (oxaloacetate-decarboxylating),, NAD-linked:'malic'
enzyme:pyruvic-malic carboxylase:sfcA protein] [GN:sfcA:maeA] [CL:malate
dehydrogenase (oxaloacetate-decarboxylating)] [OR:Escherichia coli] [EC:1.1.1.38]
[DB:pir2] >gp:[GI:d1015846:g1742411] [LN:D90788] [AC:D90788:AB001340] [PN:SfcA
protein (fragment).] [GN:sfcA, maeA] [OR:Escherichia coli] [SR:Escherichia coli
(strain:K12) DNA, clone_lib:Kohara lambda minise] [DB:genpept-bct1] [DE:E.coli
genomic DNA, Kohara clone #277(33.2-33.6 min.).] [NT:ORF_ID:o277#10; similar to
[SwissProt Accession] [LE:11776] [RE:13500] [DI:complement]
>gp:[GI:d1015855:g1742421] [LN:D90789] [AC:D90789:AB001340] [PN:SfcA protein
(fragment).] [GN:sfcA, maeA] [OR:Escherichia coli] [SR:Escherichia coli
(strain:K12) DNA, clone_lib:Kohara lambda minise] [DB:genpept-bct1] [DE:E.coli
genomic DNA, Kohara clone #278(33.3-33.7 min.).] [NT:ORF_ID:o277#10; similar to
[SwissProt Accession] [LE:8152] [RE:9876] [DI:complement]
>gp:[GI:d1015865:g1742432] [LN:D90790] [AC:D90790:AB001340] [PN:SfcA protein
(fragment).] [GN:sfcA, maeA] [OR:Escherichia coli] [SR:Escherichia coli
(strain:K12) DNA, clone_lib:Kohara lambda minise] [DB:genpept-bct1] [DE:E.coli
genomic DNA, Kohara clone #279(33.5-33.9 min.).] [NT:ORF_ID:o277#10; similar to
[SwissProt Accession] [LE:255] [RE:1979] [DI:complement] >gp:[GI:g1787754]
[LN:AE000245] [AC:AE000245:U00096] [PN:NAD-linked malate dehydrogenase (malic
enzyme)] [GN:sfcA] [FN:enzyme; Central intermediary metabolism:] [OR:Escherichia
coli] [DB:genpept-bct2] [EC:1.1.1.38] [DE:Escherichia coli K-12 MG1655 section
135 of 400 of the completegenome.] [NT:f574; 100 pct identical to fragment
SFCA_ECOLI] [LE:1208] [RE:2932] [DI:complement]

| ORF Name | NT ID | AA ID | NT/LN | AA/LN | Score | P-value |
|---|---|---|---|---|---|---|
| 15709467_f3_1459 | 2300 | 9471 | 1038 | 345 | 1239 | 4.2e-126 |

Description gp:[GI:e293136:g2208965] [LN:PACIOAB] [AC:Y10528] [PN:cyanide insensitive
terminal oxidase] [GN:cioB] [OR:Pseudomonas aeruginosa] [DB:genpept-bct1]
[DE:P.aeruginosa cioA and cioB genes.] [LE:1746] [RE:2753] [DI:direct]

| ORF_Name | NT_ID | AA_ID | NT/LN | AA/LN | Score | P-value |
|---|---|---|---|---|---|---|
| 15723891_c2_2231 | 2301 | 9472 | 555 | 184 | 578 | 4.7e-56 |

Description sp:[LN:E64901] [AC:E64901:S17652] [PN:protein C, osmotically inducible] [GN:osmC]
[CL:hypothetical protein yklA] [OR:Escherichia coli] [DB:pir1]
>gp:[GI:d1015847:g1742412] [LN:D90788] [AC:D90788:AB001340] [PN:OsmC protein]
[GN:osmC] [OR:Escherichia coli] [SR:Escherichia coli (strain:K12) DNA,
clone_lib:Kohara lambda minise] [DB:genpept-bct1] [DE:E.coli genomic DNA, Kohara
clone #277(33.2-33.6 min.).] [NT:ORF_ID:o277#12; similar to [PIR Accession
Number] [LE:14429] [RE:14860] [DI:direct] >gp:[GI:d1015856:g1742422] [LN:D90789]
[AC:D90789:AB001340] [PN:OsmC protein] [GN:osmC] [OR:Escherichia coli]
[SR:Escherichia coli (strain:K12) DNA, clone_lib:Kohara lambda minise]
[DB:genpept-bct1] [DE:E.coli genomic DNA, Kohara clone #278(33.3-33.7 min.).]
[NT:ORF_ID:o277#12; similar to [PIR Accession Number] [LE:10805] [RE:11236]
[DI:direct] >gp:[GI:d1015866:g1742433] [LN:D90790] [AC:D90790:AB001340] [PN:OsmC
protein] [GN:osmC] [OR:Escherichia coli] [SR:Escherichia coli (strain:K12) DNA,
clone_lib:Kohara lambda minise] [DB:genpept-bct1] [DE:E.coli genomic DNA, Kohara
clone #279(33.5-33.9 min.).] [NT:ORF_ID:o277#12; similar to [PIR Accession
Number] [LE:2908] [RE:3339] [DI:direct] >gp:[GI:g1787757] [LN:AE000245]
[AC:AE000245:U00096] [PN:osmotically inducible protein] [GN:osmC] [FN:phenotype;
Osmotic adaptation] [OR:Escherichia coli] [DB:genpept-bct2] [DE:Escherichia coli
K-12 MG1655 section 135 of 400 of the completegenome.] [NT:o143; 100 pct
identical to OSMC_ECOLI SW:] [LE:3861] [RE:4292] [DI:direct]

| ORF_Name | NT_ID | AA_ID | NT/LN | AA/LN | Score | P-value |
|---|---|---|---|---|---|---|
| 15754006_f3_1288 | 2302 | 9473 | 1089 | 362 | 1819 | 1.5e-187 |

Description sp:[LN:PQQE_KLEPN] [AC:P27507] [GN:PQQE] [OR:Klebsiella pneumoniae] [DE:COENZYME
PQQ SYNTHESIS PROTEIN E] [SP:P27507] [DB:swissprot] >sp:[LN:S20457] [AC:S20457]
[PN:pqqE protein] [GN:pqqE] [OR:Klebsiella pneumoniae] [DB:pir2] >gp:[GI:g809708]
[LN:KPPQQAF] [AC:X58778:S92172] [GN:pqqE] [OR:Klebsiella pneumoniae]
[DB:genpept-bct1] [DE:K.pneumoniae pqqABCDEF genes, involved in
pyrroloquinolinebiosynthesis.] [SP:P27507] [LE:3023] [RE:4165] [DI:direct]

| ORF_Name | NT_ID | AA_ID | NT/LN | AA/LN | Score | P-value |
|---|---|---|---|---|---|---|
| 15754551_f2_690 | 2303 | 9474 | 1392 | 463 | 657 | 2.0e-64 |

Description gp:[GI:e1362560:g4106687] [LN:SPBC23G7] [AC:AL035065] [PN:putative nadh-dependent
flavin oxidoreductase] [GN:SPBC23G7.10c] [OR:Schizosaccharomyces pombe]
[SR:fission yeast] [DB:genpept-pln1] [DE:S.pombe chromosome II cosmid c23G7.]
[NT:SPBC23G7.10c, len:395, SIMILARITY:Bacillus] [LE:24051] [RE:25238]
[DI:complement]

| ORF_Name | NT_ID | AA_ID | NT LN | AA LN | Score | P-value |
|---|---|---|---|---|---|---|
| 15761441_f3_1129 | 2304 | 9475 | 198 | 65 | | |

Description

NO-HIT

| ORF_Name | NT_ID | AA_ID | NT LN | AA LN | Score | P-value |
|---|---|---|---|---|---|---|
| 15839043_c1_1609 | 2305 | 9476 | 201 | 66 | 72 | 0.031 |

Description sp:[LN:C75061] [AC:C75061] [PN:hypothetical protein PAB0980] [GN:PAB0980]
[OR:Pyrococcus abyssi] [DB:pir2] >gp:[GI:g5458897] [LN:CNSPAX05]
[AC:AJ248287:AL096836] [PN:hypothetical protein] [OR:Pyrococcus abyssi]
[DB:genpept-bct1] [DE:Pyrococcus abyssi complete genome; segment 5/6.]
[NT:PAB0980] [LE:247589] [RE:248047] [DI:direct]

| ORF_Name | NT_ID | AA_ID | NT LN | AA LN | Score | P-value |
|---|---|---|---|---|---|---|
| 15863458_f1_441 | 2306 | 9477 | 1551 | 516 | 2265 | 8.0e-235 |

Description sp:[LN:G64919] [AC:G64919] [PN:probable iron-sulfur protein b1629:rnfC protein
homolog b1629] [CL:ferredoxin 2[4Fe-4S] homolog] [OR:Escherichia coli] [DB:pir2]
>gp:[GI:d1016105:g1742688] [LN:D90806] [AC:D90806:AB001340] [PN:Glucose
repression mediator protein.] [OR:Escherichia coli] [SR:Escherichia coli
(strain:K12) DNA, clone_lib:Kohara lambda minise] [DB:genpept-bct1] [DE:E.coli
genomic DNA, Kohara clone #315(36.6-36.9 min.).] [NT:ORF_ID:o316#5; similar to
[SwissProt Accession] [LE:9915] [RE:12137] [DI:direct] >gp:[GI:d1016112:g1742696]
[LN:D90807] [AC:D90807:AB001340] [PN:Glucose repression mediator protein.]
[OR:Escherichia coli] [SR:Escherichia coli (strain:K12) DNA, clone_lib:Kohara
lambda minise] [DB:genpept-bct1] [DE:E.coli genomic DNA, Kohara clone
316(36.7-37.1 min.).] [NT:ORF_ID:o316#5; similar to [SwissProt Accession]
[LE:4525] [RE:6747] [DI:direct] >gp:[GI:d1016135:g1742720] [LN:D90808]
[AC:D90808:AB001340] [PN:Glucose repression mediator protein.] [OR:Escherichia
coli] [SR:Escherichia coli (strain:K12) DNA, clone_lib:Kohara lambda minise]
[DB:genpept-bct1] [DE:E.coli genomic DNA, Kohara clone #317(36.6-36.9 min.).]
[NT:ORF_ID:o316#5; similar to [SwissProt Accession] [LE:10016] [RE:12238]
[DI:direct] >gp:[GI:g1787916] [LN:AE000258] [AC:AE000258:U00096] [PN:putative
membrane protein] [GN:b1629] [FN:putative membrane; Not classified]
[OR:Escherichia coli] [DB:genpept-bct2] [DE:Escherichia coli K-12 MG1655 section
148 of 400 of the completegenome.] [NT:o740; This 740 aa ORF is 30 pct identical
(9 gaps)] [LE:7640] [RE:9862] [DI:direct]

| ORF Name | NT ID | AA ID | NT LN | AA LN | Score | P-value |
|---|---|---|---|---|---|---|
| 15898958_f1_14 | 2307 | 9478 | 561 | 186 | 129 | 4.6e-06 |

Description gp:[GI:d1047550:g5821145] [LN:AB016088] [AC:AB016088] [PN:RNA binding protein]
[OR:Homo sapiens] [SR:Homo sapiens cell_line:HeLa cDNA to mRNA, clone_lib:Lambda
gt1] [DB:genpept-pri1] [DE:Homo sapiens mRNA for RNA binding protein, partial
cds, clone: R11.] [LE:<1] [RE:>2870] [DI:direct]

| ORF Name | NT ID | AA ID | NT LN | AA LN | Score | P-value |
|---|---|---|---|---|---|---|
| 15901562_f3_1495 | 2308 | 9479 | 1017 | 338 | 1409 | 4.1e-144 |

Description sp:[LN:ADD_ECOLI] [AC:P22333:P78240:P78163] [GN:ADD] [OR:Escherichia coli]
[EC:3.5.4.4] [DE:ADENOSINE DEAMINASE, (ADENOSINE AMINOHYDROLASE)]
[SP:P22333:P78240:P78163] [DB:swissprot] >sp:[LN:A64919] [AC:A64919:A37943]
[PN:adenosine deaminase,] [GN:add] [CL:adenosine deaminase] [OR:Escherichia coli]
[EC:3.5.4.4] [DB:pir1] >gp:[GI:d1016095:g1742677] [LN:D90805]
[AC:D90805:AB001340] [PN:Adenosine deaminase (EC 3.5.4.4) (Adenosine] [GN:add]
[OR:Escherichia coli] [SR:Escherichia coli (strain:K12) DNA, clone_lib:Kohara
lambda minise] [DB:genpept-bct1] [DE:E.coli genomic DNA, Kohara clone
314(36.3-36.7 min.).] [NT:ORF_ID:o314#9; similar to [SwissProt Accession]
[LE:16917] [RE:17918] [DI:direct] >gp:[GI:d1016102:g1742685] [LN:D90806]
[AC:D90806:AB001340] [PN:Adenosine deaminase (EC 3.5.4.4) (Adenosine] [GN:add]
[OR:Escherichia coli] [SR:Escherichia coli (strain:K12) DNA, clone_lib:Kohara
lambda minise] [DB:genpept-bct1] [DE:E.coli genomic DNA, Kohara clone
315(36.6-36.9 min.).] [NT:ORF_ID:o314#9; similar to [SwissProt Accession]
[LE:5229] [RE:6230] [DI:direct] >gp:[GI:d1016102:g1742717] [LN:D90808]
[AC:D90808:AB001340] [PN:Adenosine deaminase (EC 3.5.4.4) (Adenosine] [GN:add]
[OR:Escherichia coli] [SR:Escherichia coli (strain:K12) DNA, clone_lib:Kohara
lambda minise] [DB:genpept-bct1] [DE:E.coli genomic DNA, Kohara clone
317(36.6-36.9 min.).] [NT:ORF_ID:o314#9; similar to [SwissProt Accession]
[LE:5330] [RE:6331] [DI:direct] >gp:[GI:g1787910] [LN:AE000258]
[AC:AE000258:U00096] [PN:adenosine deaminase] [GN:add] [FN:enzyme; Salvage of
nucleosides and nucleotides] [OR:Escherichia coli] [DB:genpept-bct2] [EC:3.5.4.4]
[DE:Escherichia coli K-12 MG1655 section 148 of 400 of the completegenome.]
[NT:o333; This 333 aa ORF is 99 pct identical (1 gap)] [LE:2954] [RE:3955]
[DI:direct]

| ORF Name | NT ID | AA ID | NT LN | AA LN | Score | P-value |
|---|---|---|---|---|---|---|
| 15907283_f3_1420 | 2309 | 9480 | 1191 | 396 | 827 | 1.9e-82 |

Description sp:[LN:YCJZ_ECOLI] [AC:P77333:P76841] [GN:YCJZ] [OR:Escherichia coli]
[DE:HYPOTHETICAL TRANSCRIPTIONAL REGULATOR IN TPX-FNR INTERGENIC REGION]
[SP:P77333:P76841] [DB:swissprot] >sp:[LN:C64882] [AC:C64882] [PN:probable
transcription regulator ycjZ] [GN:ycjZ] [CL:hypothetical protein b1328]
[OR:Escherichia coli] [DB:pir2] >gp:[GI:d1015637:g1742185] [LN:D90771]
[AC:D90771:AB001340] [PN:Xanthosine operon regulatory protein.] [OR:Escherichia
coli] [SR:Escherichia coli (strain:K12) DNA, clone_lib:Kohara lambda minise]
[DB:genpept-bct1] [DE:E.coli genomic DNA, Kohara clone #260(29.8-30.2 min.).]
[NT:ORF_ID:o260#12; similar to [SwissProt Accession] [LE:10464] [RE:11363]
[DI:direct] >gp:[GI:d1015647:g1742196] [LN:D90772] [AC:D90772:AB001340]
[PN:Xanthosine operon regulatory protein.] [OR:Escherichia coli] [SR:Escherichia
coli (strain:K12) DNA, clone_lib:Kohara lambda minise] [DB:genpept-bct1]
[DE:E.coli genomic DNA, Kohara clone #261(30.0-30.3 min.).] [NT:ORF_ID:o260#12;
similar to [SwissProt Accession] [LE:529] [RE:1428] [DI:direct] >gp:[GI:g1787589]
[LN:AE000231] [AC:AE000231:U00096] [PN:putative transcriptional regulator
LYSR-type] [GN:ycjZ] [FN:putative regulator; Not classified] [OR:Escherichia
coli] [DB:genpept-bct2] [DE:Escherichia coli K-12 MG1655 section 121 of 400 of
the completegenome.] [NT:o299; This 299 aa ORF is 47 pct identical (0 gaps)]
[LE:93] [RE:992] [DI:direct]

| ORF Name | NT ID | AA ID | NT LN | AA LN | Score | P-value |
|---|---|---|---|---|---|---|
| 16023933_f3_1476 | 2310 | 9481 | 1233 | 410 | 892 | 2.5e-89 |

Description gp:[GI:g4929532] [LN:AF150928] [AC:AF150928] [PN:AreB] [GN:areB] [FN:benzyl
alcohol dehydrogenase] [OR:Acinetobacter sp. ADP1] [DB:genpept-bct2]
[DE:Acinetobacter sp. ADP1 BenP (benP), AreR (areR), AreC (areC), AreB(areB), and
AreA (areA) genes, complete cds.] [LE:5002] [RE:6117] [DI:direct]

| ORF Name | NT ID | AA ID | NT LN | AA LN | Score | P-value |
|---|---|---|---|---|---|---|
| 16062881_f1_440 | 2311 | 9482 | 645 | 214 | 935 | 6.9e-94 |

Description sp:[LN:E64919] [AC:E64919] [PN:probable membrane protein b1627] [CL:conserved
hypothetical protein HI1688] [OR:Escherichia coli] [DB:pir2] >gp:[GI:g1787914]
[LN:AE000258] [AC:AE000258:U00096] [PN:orf, hypothetical protein] [GN:b1627]
[FN:orf; Unknown] [OR:Escherichia coli] [DB:genpept-bct2] [DE:Escherichia coli
K-12 MG1655 section 148 of 400 of the completegenome.] [NT:o193; This 193 aa ORF
is 33 pct identical (2 gaps)] [LE:6488] [RE:7069] [DI:direct]

| ORF_Name | NT ID | AA ID | NT/LN | AA/LN | Score | P-value |
|---|---|---|---|---|---|---|
| 16145291_f3_1535 | 2312 | 9483 | 1215 | 404 | 1687 | 1.4e-173 |

Description gp:[GI:g1655954] [LN:ECU68759] [AC:U68759] [PN:pentaerythritol tetranitrate reductase] [GN:onr] [FN:NADPH-dependent reductase] [OR:Enterobacter cloacae] [DB:genpept-bct1] [DE:Enterobacter cloacae pentaerythritol tetranitrate reductase (onr)gene, complete cds.] [NT:liberates nitrite from nitrate esters with] [LE:281] [RE:1378] [DI:direct] >gp:[GI:e1260131:g3714616] [LN:A59288] [AC:A59288] [OR:unidentified] [DB:genpept-pat] [DE:Sequence 1 from Patent WO9703201.] [NT:unnamed protein product] [LE:281] [RE:1378] [DI:direct]

| ORF_Name | NT ID | AA ID | NT/LN | AA/LN | Score | P-value |
|---|---|---|---|---|---|---|
| 16145908_f1_123 | 2313 | 9484 | 822 | 273 | 358 | 9.6e-33 |

Description sp:[LN:C69632] [AC:C69632] [PN:transcription repressor glcR] [GN:glcR] [CL:regulatory protein gutR] [OR:Bacillus subtilis] [DB:pir2] >gp:[GI:e1184536:g2636155] [LN:BSUB0019] [AC:Z99122:AL009126] [PN:transcriptional regulator (DeoR family)] [GN:glcR] [FN:negative regulation of the phosphotransferase] [OR:Bacillus subtilis] [DB:genpept-bct1] [DE:Bacillus subtilis complete genome (section 19 of 21): from 3597091to 3809700.] [NT:alternate gene name: ywpI] [LE:141173] [RE:141949] [DI:complement] >gp:[GI:e289148:g1763710] [LN:BSZ83337] [AC:Z83337] [GN:ywpI] [OR:Bacillus subtilis] [DB:genpept-bct1] [DE:B.subtilis mbl, flh[O,P], rapD, ywp[B,C,D,E,F,G,H,I,J] and ywqAgenes.] [NT:highly similar to phosphotransferase system] [LE:7372] [RE:8148] [DI:direct]

| ORF_Name | NT ID | AA ID | NT/LN | AA/LN | Score | P-value |
|---|---|---|---|---|---|---|
| 16151090_c3_2623 | 2314 | 9485 | 1044 | 347 | 1377 | 1.0e-140 |

Description sp:[LN:YDCT_ECOLI] [AC:P77795] [GN:YDCT] [OR:Escherichia coli] [DE:HYPOTHETICAL ABC TRANSPORTER ATP-BINDING PROTEIN YDCT] [SP:P77795] [DB:swissprot] >sp:[LN:D64896] [AC:D64896] [PN:probable ABC-type transport protein b1441] [CL:ATP-binding cassette homology] [OR:Escherichia coli] [DB:pir2] >gp:[GI:d1015789:g1742349] [LN:D90783] [AC:D90783:AB001340] [PN:Spermidine/putrescine transport ATP-binding] [OR:Escherichia coli] [SR:Escherichia coli (strain:K12) DNA, clone_lib:Kohara lambda minise] [DB:genpept-bct1] [DE:E.coli genomic DNA, Kohara clone #272(32.4-32.7 min.).] [NT:ORF_ID:o272#6; similar to [SwissProt Accession] [LE:11197] [RE:12210] [DI:direct] >gp:[GI:d1015795:g1742356] [LN:D90784] [AC:D90784] [PN:Spermidine/putrescine transport ATP-binding] [OR:Escherichia coli] [SR:Escherichia coli (strain:K12) DNA, clone_lib:Kohara lambda minise] [DB:genpept-bct1] [DE:E.coli genomic DNA, Kohara clone #273(32.5-32.8 min.).] [NT:ORF_ID:o272#6; similar to [SwissProt Accession] [LE:4855] [RE:5868] [DI:direct] >gp:[GI:g1787712] [LN:AE000241] [AC:AE000241:U00096] [PN:putative ATP-binding component of a transport] [GN:b1441] [FN:putative transport; Not classified] [OR:Escherichia coli] [DB:genpept-bct2] [DE:Escherichia coli K-12 MG1655 section 131 of 400 of the completegenome.] [NT:o337; residues 30-234 are 59 pct identical to] [LE:4059] [RE:5072] [DI:direct]

| ORF_Name | NT_ID | AA_ID | NT/LN | AA/LN | Score | P-value |
|---|---|---|---|---|---|---|
| 16151467_c1_1728 | 2315 | 9486 | 237 | 78 | | |

Description

NO-HIT

| ORF_Name | NT_ID | AA_ID | NT/LN | AA/LN | Score | P-value |
|---|---|---|---|---|---|---|
| 16177076_c3_2683 | 2316 | 9487 | 723 | 240 | 130 | 2.6e-08 |

Description sp:[LN:B72603] [AC:B72603] [PN:hypothetical protein APE1289] [GN:APE1289]
[OR:Aeropyrum pernix] [DB:pir2] >gp:[GI:d1044066;g5104966] [LN:AP000061]
[AC:AP000061] [PN:103aa long hypothetical protein] [GN:APE1289] [OR:Aeropyrum
pernix] [SR:Aeropyrum pernix (strain:K1) DNA] [DB:genpept-bct1] [DE:Aeropyrum
pernix genomic DNA, section 4/7.] [LE:100768] [RE:101079] [DI:complement]

| ORF_Name | NT_ID | AA_ID | NT/LN | AA/LN | Score | P-value |
|---|---|---|---|---|---|---|
| 16191010_f3_1461 | 2317 | 9488 | 264 | 87 | 208 | 7.6e-17 |

Description sp:[LN:YNCJ_ECOLI] [AC:P76105] [GN:YNCJ] [OR:Escherichia coli] [DE:HYPOTHETICAL
8.7 KD PROTEIN IN TEHB-ANSP INTERGENIC REGION PRECURSOR] [SP:P76105]
[DB:swissprot] >sp:[LN:G64895] [AC:G64895] [PN:hypothetical protein b1436
precursor] [OR:Escherichia coli] [DB:pir2] >gp:[GI:g1787707] [LN:AE000241]
[AC:AE000241;U00096] [PN:orf, hypothetical protein] [GN:b1436] [FN:orf; Unknown]
[OR:Escherichia coli] [DB:genpept-bct2] [DE:Escherichia coli K-12 MG1655 section
131 of 400 of the completegenome.] [NT:f76; This 76 aa ORF is 34 pct identical (1
gap)] [LE:76] [RE:306] [DI:complement]

| ORF_Name | NT_ID | AA_ID | NT/LN | AA/LN | Score | P-value |
|---|---|---|---|---|---|---|
| 16256937_c1_1874 | 2318 | 9489 | 1044 | 347 | 960 | 1.6e-96 |

Description sp:[LN:F69978] [AC:F69978] [PN:sugar-phosphate dehydrogenase homolog yrpG]
[GN:yrpG] [CL:conserved hypothetical protein YPL088w] [OR:Bacillus subtilis]
[DB:pir2] >gp:[GI:e1183914;g2635130] [LN:BSUB0014] [AC:Z99117;AL009126] [GN:yrpG]
[FN:unknown] [OR:Bacillus subtilis] [DB:genpept-bct1] [DE:Bacillus subtilis
complete genome (section 14 of 21): from 2599451to 2812870.] [NT:similar to
sugar-phosphate dehydrogenase] [LE:142758] [RE:143708] [DI:direct]
>gp:[GI:g1934634] [LN:BSU93875] [AC:U93875] [PN:YrpG] [GN:yrpG] [OR:Bacillus
subtilis] [DB:genpept-bct2] [DE:Bacillus subtilis alcohol dehydrogenase (adhB)
gene, partial cds,hypothetical spore coat protein (yraF), hypothetical spore
coatprotein (yraG), YraH (yraH), YraI (yraI), YraJ (yraJ), YraK (yraK),YraL
(yraL), chitosanase precursor (csn), YraM (yraM), LysR-familytranscription
regulator (yraN), YraO (yraO), YrpG (yrpG), RNApolymerase sigma factor SigZ
(sigZ), YrpE (yrpE), YrpD (yrpD), YrpC(yrpC) and 2-nitropropane dioxygenase
(yrpB) genes, complete cds,and aminoglycoside 6-adenylyltransferase (aadK) gene,
partial cds.] [NT:similar to auxin-induced protein from Nicotiana] [LE:10542]
[RE:11492] [DI:complement]

| ORF_Name | NT_ID | AA_ID | NT/LN | AA/LN | Score | P-value |
|---|---|---|---|---|---|---|
| 16266708_f1_73 | 2319 | 9490 | 537 | 178 | 168 | 1.3e-12 |

Description sp:[LN:YEDX_ECOLI] [AC:P76341] [GN:YEDX] [OR:Escherichia coli] [DE:HYPOTHETICAL TRANSTHYRETIN-LIKE PROTEIN PRECURSOR] [SP:P76341] [DB:swissprot] >sp:[LN:F64961] [AC:F64961] [PN:hypothetical protein b1970] [CL:transthyretin] [OR:Escherichia coli] [DB:pir1] >gp:[GI:g1788281] [LN:AE000288] [AC:AE000288:U00096] [PN:orf, hypothetical protein] [GN:b1970] [FN:orf; Unknown] [OR:Escherichia coli] [DB:genpept-bct2] [DE:Escherichia coli K-12 MG1655 section 178 of 400 of the completegenome.] [NT:o137; This 137 aa ORF is 39 pct identical (2 gaps)] [LE:6636] [RE:7049] [DI:direct]

| ORF_Name | NT_ID | AA_ID | NT/LN | AA/LN | Score | P-value |
|---|---|---|---|---|---|---|
| 16284538_c3_2649 | 2320 | 9491 | 390 | 129 | 190 | 6.1e-15 |

Description sp:[LN:YGDR_ECOLI] [AC:Q46932] [GN:YGDR] [OR:Escherichia coli] [DE:HYPOTHETICAL LIPOPROTEIN YGDR PRECURSOR] [SP:Q46932] [DB:swissprot] >sp:[LN:B65066] [AC:B65066] [PN:hypothetical protein b2833] [OR:Escherichia coli] [DB:pir2] >gp:[GI:g882726] [LN:ECU29581] [AC:U29581] [OR:Escherichia coli] [DB:genpept-bct1] [DE:Escherichia coli K-12 genome; approximately 63 to 64 minutes.] [NT:ORF_o72] [LE:52826] [RE:53044] [DI:direct] >gp:[GI:g1789198] [LN:AE000367] [AC:AE000367:U00096] [PN:orf, hypothetical protein] [GN:b2833] [FN:orf; Unknown] [OR:Escherichia coli] [DB:genpept-bct2] [DE:Escherichia coli K-12 MG1655 section 257 of 400 of the completegenome.] [NT:o72; This 72 aa ORF is 30 pct identical (8 gaps)] [LE:1982] [RE:2200] [DI:direct]

| ORF_Name | NT_ID | AA_ID | NT/LN | AA/LN | Score | P-value |
|---|---|---|---|---|---|---|
| 16302316_f1_213 | 2321 | 9492 | 1077 | 358 | 373 | 2.5e-34 |

Description sp:[LN:LRHA_ECOLI] [AC:P36771:P76490:P76934] [GN:LRHA:GENR] [OR:Escherichia coli] [DE:PROBABLE TRANSCRIPTIONAL REGULATOR LRHA] [SP:P36771:P76490:P76934] [DB:swissprot] >sp:[LN:G65000] [AC:G65000:S40278:S77579] [PN:transcription regulator of NADH dehydrogenase operon] [GN:lrhA] [CL:hypothetical protein b1875] [OR:Escherichia coli] [DB:pir2] >gp:[GI:g1788626] [LN:AE000318] [AC:AE000318:U00096] [PN:NADH dehydrogenase transcriptional regulator,] [GN:lrhA] [FN:regulator; Energy metabolism, carbon: Aerobic] [OR:Escherichia coli] [DB:genpept-bct2] [DE:Escherichia coli K-12 MG1655 section 208 of 400 of the completegenome.] [NT:f312; This 312 aa ORF is 100 pct identical to] [LE:1829] [RE:2767] [DI:complement]

| ORF_Name | NT_ID | AA_ID | NT LN | AA LN | Score | P-value |
|---|---|---|---|---|---|---|
| 16308518_c2_2159 | 2322 | 9493 | 927 | 308 | 432 | 1.4e-40 |

Description sp:[LN:RHAS_ECOLI] [AC:P09377] [GN:RHAS:RHAC2] [OR:Escherichia coli]
[DE:L-RHAMNOSE OPERON REGULATORY PROTEIN RHAS] [SP:P09377] [DB:swissprot]
>sp:[LN:S40849] {AC:S40849:S01273:D65196] [PN:l-rhamnose operon regulatory
protein rhaS] [GN:rhaS] [OR:Escherichia coli] [DB:pir2] >gp:[GI:g305009]
[LN:ECOUW87] [AC:L19201] [GN:rhaS] [FN:transcription regulator for the rha
operon] [OR:Escherichia coli] [SR:Escherichia coli (sub_strain MG1655, strain
K-12) (library: lambda] [DB:genpept-bct1] [DE:E. coli chromosomal region from
87.2 to 89.2 minutes.] [NT:CG Site No. 17950] [LE:59369] [RE:60205] [DI:direct]
>gp:[GI:g42724] [LN:ECRHAC] [AC:X06058] [OR:Escherichia coli] [DB:genpept-bct1]
[DE:E. coli rhaC gene (rhaS and rhaR) (positive activator of genesrequired for
L-rhamnose utilization).] [NT:rhaS (AA 1-278)] [SP:P09377] [LE:121] [RE:957]
[DI:direct] >gp:[GI:g1790339] [LN:AE000465] [AC:AE000465:U00096] [PN:positive
regulator for rhaBAD operon] [GN:rhaS] [FN:regulator; Degradation of small
molecules:] [OR:Escherichia coli] [DB:genpept-bct2] [DE:Escherichia coli K-12
MG1655 section 355 of 400 of the completegenome.] [NT:o278; 100 pct identical to
RHAS_ECOLI SW: P09377;] [LE:11914] [RE:12750] [DI:direct]

| ORF_Name | NT_ID | AA_ID | NT LN | AA LN | Score | P-value |
|---|---|---|---|---|---|---|
| 16515658_f2_746 | 2323 | 9494 | 444 | 147 | 114 | 1.9e-05 |

Description sp:[LN:T2D3_HUMAN] [AC:O00268:Q99721] [GN:TAF2C1:TAF2C:TAFII135:TAFII130]
[OR:Homo sapiens] [SR:,Human] [DE:(TAFII135) (TAFII-130) (TAFII130)]
[SP:O00268:Q99721] [DB:swissprot] >gp:[GI:e305208:g2058326] [LN:HSTAFII13]
[AC:Y11354] [PN:subunit of RNA polymerase II transcription] [GN:TAFII135]
[FN:potentiates ligand dependent transcriptional] [OR:Homo sapiens] [SR:human]
[DB:genpept-pri1] [DE:H.sapiens mRNA for TAFII135.] [SP:O00268] [LE:1] [RE:3252]
[DI:direct]

| ORF_Name | NT_ID | AA_ID | NT LN | AA LN | Score | P-value |
|---|---|---|---|---|---|---|
| 16522256_f2_544 | 2324 | 9495 | 627 | 208 | 226 | 9.4e-19 |

Description gp:[GI:g2271496] [LN:AF009672] [AC:AF009672] [PN:unknown] [OR:Acinetobacter sp.
ADP1] [DB:genpept-bct2] [DE:Acinetobacter sp. ADP1 VanR (vanR), vanillate
demethylase (vanB),vanillate demethylase (vanA), and VanK (vanK) genes, complete
cds;and unknown genes.] [NT:ORF2; putative acetyl transferase] [LE:535]
[RE:>1002] [DI:complement]

| ORF Name | NT ID | AA ID | NT/LN | AA/LN | Score | P-value |
|---|---|---|---|---|---|---|
| 16536405_f1_298 | 2325 | 9496 | 888 | 295 | 120 | 1.8e-05 |

Description gp:[GI:e1370577;g4158178] [LN:SC1A6] [AC:AL023496] [PN:hypothetical protein]
[OR:Streptomyces coelicolor] [DB:genpept-bct1] [DE:Streptomyces coelicolor cosmid
1A6.] [NT:Protein sequence is in conflict with the conceptual] [LE:<1] [RE:574]
[DI:direct]

| ORF Name | NT ID | AA ID | NT/LN | AA/LN | Score | P-value |
|---|---|---|---|---|---|---|
| 16596067_f3_1045 | 2326 | 9497 | 636 | 211 | 123 | 1.0e-07 |

Description gp:[GI:g5616248] [LN:AF158628] [AC:AF158628] [PN:hypothetical protein]
[OR:Prochlorococcus PCC9511] [DB:genpept-bct2] [DE:Prochlorococcus PCC9511 DnaA
(dnaA) gene, complete cds; andhypothetical protein genes.] [LE:<1] [RE:441]
[DI:direct]

| ORF Name | NT ID | AA ID | NT/LN | AA/LN | Score | P-value |
|---|---|---|---|---|---|---|
| 16605327_c3_3026 | 2327 | 9498 | 885 | 294 | 387 | 8.1e-36 |

Description sp:[LN:DAPA_ARCFU] [AC:O29352] [GN:DAPA:AF0910] [OR:Archaeoglobus fulgidus]
[EC:4.2.1.52] [DE:DIHYDRODIPICOLINATE SYNTHASE, (DHDPS)] [SP:O29352]
[DB:swissprot] >sp:[LN:F69363] [AC:F69363] [PN:dihydrodipicolinate synthase
(dapA) homolog] [OR:Archaeoglobus fulgidus] [DB:pir2] >gp:[GI:g2649690]
[LN:AE001041] [AC:AE001041:AE000782] [PN:dihydrodipicolinate synthase (dapA)]
[GN:AF0910] [OR:Archaeoglobus fulgidus] [DB:genpept-bct2] [DE:Archaeoglobus
fulgidus section 66 of 172 of the complete genome.] [NT:similar to GB:L77117
SP:Q57695 PID:1590977 percent] [LE:9768] [RE:10637] [DI:complement]

| ORF Name | NT ID | AA ID | NT/LN | AA/LN | Score | P-value |
|---|---|---|---|---|---|---|
| 16620216_f1_85 | 2328 | 9499 | 366 | 121 | 74 | 0.014 |

Description sp:[LN:YMDA_ECOLI] [AC:P75917] [GN:YMDA] [OR:Escherichia coli] [DE:HYPOTHETICAL
11.2 KD PROTEIN IN CSGC-MDOG INTERGENIC REGION PRECURSOR] [SP:P75917]
[DB:swissprot] >sp:[LN:A64847] [AC:A64847] [PN:hypothetical protein b1044
precursor] [OR:Escherichia coli] [DB:pir2] >gp:[GI:d1036820;g4062615] [LN:D90741]
[AC:D90741;AB001340] [OR:Escherichia coli] [SR:Escherichia coli(strain:K12) DNA,
clone:Kohara clone #231] [DB:genpept-bct1] [DE:Escherichia coli genomic DNA.
(23.7 - 24.0 min).] [NT:ORF_ID:o232#2] [LE:10016] [RE:10327] [DI:direct]
>gp:[GI:d1036828;g4062621] [LN:D90742] [AC:D90742;AB001340] [OR:Escherichia coli]
[SR:Escherichia coli(strain:K12) DNA, clone:Kohara clone #232] [DB:genpept-bct1]
[DE:Escherichia coli genomic DNA. (23.8 - 24.2 min).] [NT:ORF_ID:o232#2]
[LE:2034] [RE:2345] [DI:direct] >gp:[GI:g1787281] [LN:AE000205]
[AC:AE000205;U00096] [PN:orf, hypothetical protein] [GN:b1044] [FN:orf; Unknown]
[OR:Escherichia coli] [DB:genpept-bct2] [DE:Escherichia coli K-12 MG1655 section
95 of 400 of the completegenome.] [NT:o103; This 103 aa ORF is 44 pct identical
(0 gaps)] [LE:9960] [RE:10271] [DI:direct]

| ORF Name | NT ID | AA ID | NT/LN | AA/LN | Score | P-value |
|---|---|---|---|---|---|---|
| 16812711_f2_923 | 2329 | 9500 | 954 | 317 | 149 | 4.7e-10 |

Description gp:[GI:g642964] [LN:ABCARRA] [AC:X70360] [GN:carR] [OR:Azospirillum brasilense]
[DB:genpept-bct1] [DE:A.brasilense carR gene.] [LE:<1] [RE:588] [DI:direct]

| ORF Name | NT ID | AA ID | NT/LN | AA/LN | Score | P-value |
|---|---|---|---|---|---|---|
| 16823291_c3_3038 | 2330 | 9501 | 612 | 203 | 106 | 8.6e-06 |

Description gp:[GI:g5070349] [LN:AF123569] [AC:AF123569] [PN:NmeSIC] [GN:nmeSIC]
[FN:transcriptional regulator] [OR:Neisseria meningitidis] [DB:genpept-bct2]
[DE:Neisseria meningitidis helicase (hrpA) gene, partial cds; andNmeSIM (nmeSIM),
NmeSIR (nmeSIR), and NmeSIC (nmeSIC) genes,complete cds.] [NT:helix-turn-helix
DNA binding protein; putative] [LE:1978] [RE:2190] [DI:complement]

| ORF Name | NT ID | AA ID | NT/LN | AA/LN | Score | P-value |
|---|---|---|---|---|---|---|
| 16831536_c2_2082 | 2331 | 9502 | 1350 | 449 | 2017 | 1.5e-208 |

Description sp:[LN:B64894] [AC:B64894] [PN:hypothetical protein b1423] [OR:Escherichia coli]
[DB:pir2] >gp:[GI:g1787692] [LN:AE000239] [AC:AE000239;U00096] [PN:orf,
hypothetical protein] [GN:b1423] [FN:orf; Unknown] [OR:Escherichia coli]
[DB:genpept-bct2] [DE:Escherichia coli K-12 MG1655 section 129 of 400 of the
completegenome.] [NT:o447; This 447 aa ORF is 29 pct identical (4 gaps)]
[LE:8219] [RE:9562] [DI:direct]

| ORF Name | NT ID | AA ID | NT LN | AA LN | Score | P-value |
|---|---|---|---|---|---|---|
| 16834763_f1_476 | 2332 | 9503 | 1032 | 343 | 1664 | 3.9e-171 |

Description sp:[LN:RPECDU] [AC:A32027:S08477:D64923:JS0138] [PN:pur operon repressor purR]
[GN:purR] [CL:lac repressor] [OR:Escherichia coli] [DB:pir1] [MP:36 min]
>gp:[GI:d1016145:g1742731] [LN:D90809] [AC:D90809:AB001340] [PN:Pur repressor]
[GN:purR] [OR:Escherichia coli] [SR:Escherichia coli (strain:K12) DNA,
clone_lib:Kohara lambda minise] [DB:genpept-bct1] [DE:E.coli genomic DNA, Kohara
clone #318(37.2-37.6 min.).] [NT:ORF_ID:o319#1; similar to [PIR Accession Number]
[LE:9437] [RE:10462] [DI:direct] >gp:[GI:d1016154:g1742741] [LN:D90810]
[AC:D90810:AB001340] [PN:Pur repressor] [GN:purR] [OR:Escherichia coli]
[SR:Escherichia coli (strain:K12) DNA, clone_lib:Kohara lambda minise]
[DB:genpept-bct1] [DE:E.coli genomic DNA, Kohara clone #319(37.4-37.8 min.).]
[NT:ORF_ID:o319#1; similar to [PIR Accession Number] [LE:1831] [RE:2856]
[DI:direct] >gp:[GI:g147428] [LN:ECOPURR] [AC:J04212] [OR:Escherichia coli]
[SR:E.coli (K12) cell line MC1040-2 DNA, clone pRRM127] [DB:genpept-bct1]
[DE:E.coli purine nucleotide synthesis repressor protein (purR) gene, complete
cds.] [NT:purine repressor (purR)] [LE:361] [RE:1386] [DI:direct] >gp:[GI:g42598]
[LN:ECPURRRP] [AC:X51368] [OR:Escherichia coli] [DB:genpept-bct1] [DE:Escherichia
coli purR gene for PurR purine gene repressor.] [NT:purR gene product (AA 1-341)]
[SP:P15039] [LE:401] [RE:1426] [DI:direct] >gp:[GI:g1787948] [LN:AE000261]
[AC:AE000261:U00096] [PN:transcriptional repressor for pur regulon, glyA,]
[GN:purR] [FN:regulator; Purine ribonucleotide biosynthesis] [OR:Escherichia
coli] [DB:genpept-bct2] [DE:Escherichia coli K-12 MG1655 section 151 of 400 of
the completegenome.] [NT:o341; 100 pct identical to PURR_ECOLI SW: P15039;]
[LE:2560] [RE:3585] [DI:direct]

| ORF Name | NT ID | AA ID | NT LN | AA LN | Score | P-value |
|---|---|---|---|---|---|---|
| 16834826_f3_1114 | 2333 | 9504 | 1329 | 442 | 1614 | 7.7e-166 |

Description sp:[LN:F64904] [AC:F64904:B38112] [PN:hipA protein] [GN:hipA] [OR:Escherichia
coli] [DB:pir2] >gp:[GI:g1787785] [LN:AE000248] [AC:AE000248:U00096]
[PN:persistence to inhibition of murein or DNA] [GN:hipA] [FN:regulator; Murein
sacculus, peptidoglycan] [OR:Escherichia coli] [DB:genpept-bct2] [DE:Escherichia
coli K-12 MG1655 section 138 of 400 of the completegenome.] [NT:f440; 99 pct
identical to HIPA_ECOLI SW: P23874; CG] [LE:787] [RE:2109] [DI:complement]

| ORF Name | NT ID | AA ID | NT LN | AA LN | Score | P-value |
|---|---|---|---|---|---|---|
| 16894377_f1_130 | 2334 | 9505 | 249 | 82 | | |

Description

NO-HIT

| ORF Name | NT ID | AA ID | NT LN | AA LN | Score | P-value |
|---|---|---|---|---|---|---|
| 16901530_f3_1504 | 2335 | 9506 | 882 | 293 | 245 | 1.5e-19 |

Description gp:[GI:g3153821] [LN:AF062655] [AC:AF062655] [PN:plenty-of-prolines-101] [OR:Mus musculus] [SR:house mouse] [DB:genpept-rod] [DE:Mus musculus plenty-of-prolines-101 mRNA, complete cds.] [NT:binds to several SH3 domain containing proteins] [LE:24] [RE:2717] [DI:direct]

| ORF Name | NT ID | AA ID | NT LN | AA LN | Score | P-value |
|---|---|---|---|---|---|---|
| 16902040_c1_1725 | 2336 | 9507 | 1188 | 395 | 1472 | 8.6e-151 |

Description sp:[LN:ARAJ_ECOLI] [AC:P23910] [GN:ARAJ] [OR:Escherichia coli] [DE:PROTEIN ARAJ PRECURSOR] [SP:P23910] [DB:swissprot] >sp:[LN:B43750] [AC:B43750:D64768:S27549] [PN:chloramphenicol resistance protein homolog araJ precursor] [GN:araJ] [CL:Streptomyces lividans chloramphenicol resistance protein] [OR:Escherichia coli] [DB:pir1] [MP:9 min] >gp:[GI:g145328] [LN:ECOARAJ] [AC:M64787] [GN:araJ] [OR:Escherichia coli] [SR:E.coli DNA] [DB:genpept-bct1] [DE:E.coli sbcC gene, 3' end, araJ gene, complete cds, and araJ ORF.] [LE:2143] [RE:3327] [DI:direct] >gp:[GI:g1786595] [LN:AE000145] [AC:AE000145:U00096] [PN:involved in either transport or processing of] [GN:araJ] [FN:transport; Degradation of small molecules:] [OR:Escherichia coli] [DB:genpept-bct2] [DE:Escherichia coli K-12 MG1655 section 35 of 400 of the completegenome.] [NT:f394; 100 pct identical to ARAJ_ECOLI SW: P23910] [LE:10173] [RE:11357] [DI:complement]

| ORF Name | NT ID | AA ID | NT LN | AA LN | Score | P-value |
|---|---|---|---|---|---|---|
| 16932661_c3_2938 | 2337 | 9508 | 1389 | 462 | 272 | 1.8e-21 |

Description sp:[LN:A69853] [AC:A69853] [PN:hexuronate transporter homolog yjmG] [GN:yjmG] [CL:hexuronate transporter] [OR:Bacillus subtilis] [DB:pir1]
>gp:[GI:e1183256:g2633590] [LN:BSUB0007] [AC:Z99110:AL009126] [GN:yjmG] [FN:unknown] [OR:Bacillus subtilis] [DB:genpept-bct1] [DE:Bacillus subtilis complete genome (section 7 of 21): from 1194391to 1411140.] [NT:similar to hexuronate transporter] [LE:112525] [RE:113793] [DI:direct] >gp:[GI:g2612908] [LN:AF015825] [AC:AF015825] [PN:hexuronate transporter-like protein] [GN:yjmG] [OR:Bacillus subtilis] [DB:genpept-bct2] [DE:Bacillus subtilis 168 cotT-rapA region sequence.] [NT:similar to hexuronate transporter of Escherichia] [LE:26685] [RE:27953] [DI:direct]

| ORF Name | NT ID | AA ID | NT LN | AA LN | Score | P-value |
|---|---|---|---|---|---|---|
| 16968802_f3_1360 | 2338 | 9509 | 309 | 102 | | |

Description

NO-HIT

| ORF_Name | NT ID | AA ID | NT LN | AA LN | Score | P-value |
|---|---|---|---|---|---|---|
| 17055461_c1_1759 | 2339 | 9510 | 1656 | 551 | 945 | 6.0e-95 |

Description gp:[GI:e1245482:g2808800] [LN:SCO001205] [AC:AJ001205] [PN:putative trehalose synthase] [OR:Streptomyces coelicolor] [DB:genpept-bct1] [DE:Streptomyces coelicolor A3(2) glycogen metabolism clusterI.] [LE:5783] [RE:7483] [DI:direct]

| ORF_Name | NT ID | AA ID | NT LN | AA LN | Score | P-value |
|---|---|---|---|---|---|---|
| 17066431_c3_2553 | 2340 | 9511 | 435 | 144 | 536 | 1.3e-51 |

Description sp:[LN:SODC_ECOLI] [AC:P53635:P96756] [GN:SODC] [OR:Escherichia coli] [EC:1.15.1.1] [DE:(BACTERIOCUPREIN)] [SP:P53635:P96756] [DB:swissprot] >sp:[LN:JC6004] [AC:JC6004:H64921] [PN:superoxide dismutase, (Cu-Zn) sodC precursor] [GN:sodC] [CL:superoxide dismutase (Cu-Zn)] [OR:Escherichia coli] [EC:1.15.1.1] [DB:pir2] [MP:37 min] >gp:[GI:g1256446] [LN:ECU51242] [AC:U51242] [PN:copper-zinc superoxide dismutase] [GN:sodC] [OR:Escherichia coli] [SR:Escherichia coli strain=W3110] [DB:genpept-bct1] [EC:1.15.1.1] [DE:Escherichia coli copper-zinc superoxide dismutase (sodC) gene,complete cds.] [LE:224] [RE:745] [DI:direct] >gp:[GI:g1787934] [LN:AE000259] [AC:AE000259:U00096] [PN:superoxide dismutase precursor (Cu-Zn)] [GN:sodC] [FN:enzyme; Detoxification] [OR:Escherichia coli] [DB:genpept-bct2] [EC:1.15.1.1] [DE:Escherichia coli K-12 MG1655 section 149 of 400 of the completegenome.] [NT:f173; 100 pct identical to GB: ECU51242_1] [LE:11741] [RE:12262] [DI:complement]

| ORF_Name | NT ID | AA ID | NT LN | AA LN | Score | P-value |
|---|---|---|---|---|---|---|
| 17072917_c1_1946 | 2341 | 9512 | 981 | 326 | 429 | 2.9e-40 |

Description sp:[LN:PLPB_PASHA] [AC:Q08869:Q07364] [GN:PLPB] [OR:Pasteurella haemolytica] [DE:OUTER MEMBRANE LIPOPROTEIN 2 PRECURSOR (PLP2)] [SP:Q08869:Q07364] [DB:swissprot] >sp:[LN:JN0752] [AC:JN0752] [PN:outer membrane 30.2K protein:ORF2] [CL:lipoprotein-28] [OR:Pasteurella haemolytica] [DB:pir2] >gp:[GI:g349531] [LN:PASLIPOPR] [AC:L11037] [PN:lipoprotein] [OR:Pasteurella haemolytica] [SR:Pasteurella haemolytica (strain A1) DNA] [DB:genpept-bct1] [DE:Pasteurella haemolytica lipoprotein gene, complete cds.] [NT:precursor] [LE:1088] [RE:1918] [DI:direct]

| ORF_Name | NT ID | AA ID | NT LN | AA LN | Score | P-value |
|---|---|---|---|---|---|---|
| 181250_c1_1747 | 2342 | 9513 | 186 | 61 | | |

Description

NO-HIT

| ORF_Name | NT_ID | AA_ID | NT/LN | AA/LN | Score | P-value |
|---|---|---|---|---|---|---|
| 192925_f2_664 | 2343 | 9514 | 189 | 62 | | |

Description

NO-HIT

| ORF_Name | NT_ID | AA_ID | NT/LN | AA/LN | Score | P-value |
|---|---|---|---|---|---|---|
| 19563426_c2_2357 | 2344 | 9515 | 705 | 234 | 622 | 1.0e-60 |

Description sp:[LN:ALSE_ECOLI] [AC:P32719] [GN:ALSE] [OR:Escherichia coli] [EC:5.1.3.-]
[DE:D-ALLULOSE-6-PHOSPHATE 3-EPIMERASE,] [SP:P32719] [DB:swissprot]
>sp:[LN:D65217] [AC:D65217] [PN:hypothetical 26.1 kD protein in fdhf-phnp
intergenic region] [GN:yjcU] [CL:yeast ribulose-5-phosphate-epimerase]
[OR:Escherichia coli] [DB:pir2] >gp:[GI:g1790523] [LN:AE000482]
[AC:AE000482:U00096] [PN:putative epimerase] [GN:yjcU] [FN:putative enzyme; Not
classified] [OR:Escherichia coli] [DB:genpept-bct2] [DE:Escherichia coli K-12
MG1655 section 372 of 400 of the completegenome.] [NT:f231; 100 pct identical to
YJCU_ECOLI SW:] [LE:3431] [RE:4126] [DI:complement] >gp:[GI:g396420] [LN:ECOUW89]
[AC:U00006] [OR:Escherichia coli] [SR:Escherichia coli (sub_strain MG1655, strain
K-12) (library: lambda] [DB:genpept-bct2] [DE:E. coli chromosomal region from
89.2 to 92.8 minutes.] [NT:similar to Alcaligenes eutrophus pHG1] [LE:173022]
[RE:173717] [DI:complement]

| ORF_Name | NT_ID | AA_ID | NT/LN | AA/LN | Score | P-value |
|---|---|---|---|---|---|---|
| 19564025_f2_842 | 2345 | 9516 | 312 | 103 | | |

Description

NO-HIT

812

| ORF Name | NT ID | AA ID | NT LN | AA LN | Score | P-value |
|---|---|---|---|---|---|---|
| 19710763_c2_2467 | 2346 | 9517 | 453 | 150 | 215 | 1.4e-17 |

Description sp:[LN:YNEJ_ECOLI] [AC:P77309] [GN:YNEJ] [OR:Escherichia coli] [DE:HYPOTHETICAL TRANSCRIPTIONAL REGULATOR IN UXAB-MARR INTERGENIC REGION] [SP:P77309] [DB:swissprot] >sp:[LN:A64907] [AC:A64907:S41477:S35950] [PN:probable transcription regulator yneJ] [GN:yneJ] [CL:Pseudomonas putida regulatory protein catR] [OR:Escherichia coli] [DB:pir2] >gp:[GI:d1015928:g1742500] [LN:D90795] [AC:D90795:AB001340] [PN:Pectinase gene transcriptional regulator.] [OR:Escherichia coli] [SR:Escherichia coli (strain:K12) DNA, clone_lib:Kohara lambda minise] [DB:genpept-bct1] [DE:E.coli genomic DNA, Kohara clone #304(34.6-34.9 min.).] [NT:ORF_ID:o304#13; similar to [SwissProt Accession] [LE:10668] [RE:11549] [DI:direct] >gp:[GI:d1015936:g1742509] [LN:D90796] [AC:D90796:AB001340] [PN:Pectinase gene transcriptional regulator.] [OR:Escherichia coli] [SR:Escherichia coli (strain:K12) DNA, clone_lib:Kohara lambda minise] [DB:genpept-bct1] [DE:E.coli genomic DNA, Kohara clone #305(34.7-35.1 min.).] [NT:ORF_ID:o304#13; similar to [SwissProt Accession] [LE:3951] [RE:4832] [DI:direct] >gp:[GI:g1787806] [LN:AE000250] [AC:AE000250:U00096] [PN:putative transcriptional regulator LYSR-type] [GN:yneJ] [FN:putative regulator; Not classified] [OR:Escherichia coli] [DB:genpept-bct2] [DE:Escherichia coli K-12 MG1655 section 140 of 400 of the completegenome.] [NT:o293; This 293 aa ORF is 27 pct identical (10 gaps)] [LE:4041] [RE:4922] [DI:direct]

| ORF Name | NT ID | AA ID | NT LN | AA LN | Score | P-value |
|---|---|---|---|---|---|---|
| 19719811_c1_1578 | 2347 | 9518 | 459 | 152 | 644 | 4.8e-63 |

Description sp:[LN:S70929] [AC:S70929:D64921] [PN:probable transcription regulator slyA:hypothetical protein b1642] [OR:Escherichia coli] [DB:pir2] >gp:[GI:e303889:g1850818] [LN:ECDNASLYA] [AC:Y11194] [GN:slyA] [FN:haemolytic activity] [OR:Escherichia coli] [DB:genpept-bct1] [DE:E.coli slyA gene.] [SP:P55740] [LE:1] [RE:441] [DI:direct]

| ORF Name | NT ID | AA ID | NT LN | AA LN | Score | P-value |
|---|---|---|---|---|---|---|
| 19726431_f2_604 | 2348 | 9519 | 1257 | 418 | | |

Description

NO-HIT

| ORF Name | NT ID | AA ID | NT LN | AA LN | Score | P-value |
|---|---|---|---|---|---|---|
| 19726533_c2_2040 | 2349 | 9520 | 945 | 314 | 1359 | 8.1e-139 |

Description sp:[LN:YDHF_ECOLI] [AC:P76187] [GN:YDHF] [OR:Escherichia coli] [DE:HYPOTHETICAL OXIDOREDUCTASE IN SODC-NEMA INTERGENIC REGION] [SP:P76187] [DB:swissprot] >sp:[LN:A64922] [AC:A64922] [PN:probable oxidoreductase, b1647] [OR:Escherichia coli] [EC:1.-.-.-] [DB:pir2] >gp:[GI:g1787936] [LN:AE000260] [AC:AE000260:U00096] [PN:orf, hypothetical protein] [GN:b1647] [FN:orf; Unknown] [OR:Escherichia coli] [DB:genpept-bct2] [DE:Escherichia coli K-12 MG1655 section 150 of 400 of the completegenome.] [NT:f298; This 298 aa ORF is 51 pct identical (5 gaps)] [LE:71] [RE:967] [DI:complement]

| ORF Name | NT ID | AA ID | NT LN | AA LN | Score | P-value |
|---|---|---|---|---|---|---|
| 19804787_c3_2856 | 2350 | 9521 | 861 | 286 | 167 | 1.6e-10 |

Description sp:[LN:YARA_PROST] [AC:P46117] [OR:Providencia stuartii] [DE:HYPOTHETICAL 31.5 KD PROTEIN IN AARA 3'REGION] [SP:P46117] [DB:swissprot]

| ORF Name | NT ID | AA ID | NT LN | AA LN | Score | P-value |
|---|---|---|---|---|---|---|
| 19969025_c1_1564 | 2351 | 9522 | 555 | 184 | 228 | 5.7e-19 |

Description sp:[LN:SOXS_SALTY] [AC:Q56143] [GN:SOXS] [OR:Salmonella typhimurium] [DE:REGULATORY PROTEIN SOXS] [SP:Q56143] [DB:swissprot]

| ORF Name | NT ID | AA ID | NT LN | AA LN | Score | P-value |
|---|---|---|---|---|---|---|
| 20058562_c3_2647 | 2352 | 9523 | 255 | 84 | 241 | 2.4e-20 |

Description sp:[LN:G64897] [AC:G64897] [PN:hypothetical protein b1452] [OR:Escherichia coli] [DB:pir2] >gp:[GI:g1787724] [LN:AE000242] [AC:AE000242:U00096] [PN:putative receptor] [GN:b1452] [FN:putative factor; Not classified] [OR:Escherichia coli] [DB:genpept-bct2] [DE:Escherichia coli K-12 MG1655 section 132 of 400 of the completegenome.] [NT:o353; This 353 aa ORF is 22 pct identical (17 gaps)] [LE:4447] [RE:5508] [DI:direct]

| ORF Name | NT ID | AA ID | NT LN | AA LN | Score | P-value |
|---|---|---|---|---|---|---|
| 2007293_f1_209 | 2353 | 9524 | 777 | 258 | 417 | 5.4e-39 |

Description sp:[LN:Y354_HAEIN] [AC:P44656] [GN:HI0354] [OR:Haemophilus influenzae]
[DE:HYPOTHETICAL ABC TRANSPORTER ATP-BINDING PROTEIN HI0354] [SP:P44656]
[DB:swissprot] >sp:[LN:B64063] [AC:B64063] [PN:nasD protein homolog]
[CL:unassigned ATP-binding cassette proteins:ATP-binding cassette homology]
[OR:Haemophilus influenzae] [DB:pir2] >gp:[GI:g1573323] [LN:U32720]
[AC:U32720:L42023] [PN:ABC transporter, ATP-binding protein] [GN:HI0354]
[OR:Haemophilus influenzae Rd] [DB:genpept-bct2] [DE:Haemophilus influenzae Rd
section 35 of 163 of the complete genome.] [NT:similar to PID:1184189 GB:U00096
SP:Q47538] [LE:1528] [RE:2250] [DI:direct]

| ORF Name | NT ID | AA ID | NT LN | AA LN | Score | P-value |
|---|---|---|---|---|---|---|
| 20320136_c3_2757 | 2354 | 9525 | 189 | 62 | | |

Description

NO-HIT

| ORF Name | NT ID | AA ID | NT LN | AA LN | Score | P-value |
|---|---|---|---|---|---|---|
| 2040875_c3_2889 | 2355 | 9526 | 1110 | 369 | 546 | 1.2e-52 |

Description sp:[LN:PTFB_ECOLI] [AC:P20966] [GN:FRUA:PTSF] [OR:Escherichia coli] [EC:2.7.1.69]
[DE:(EC 2.7.1.69) (EII-FRU)] [SP:P20966] [DB:swissprot] >sp:[LN:A34962]
[AC:A34962:C37245:F64985] [PN:phosphotransferase system enzyme II,,
fructose-specific] [GN:fruA:ptsF] [CL:phosphotransferase system enzyme II,
fructose-specific:phosphotransferase system mannitol-specific enzyme II factor
III homology] [OR:Escherichia coli] [EC:2.7.1.69] [DB:pir2] [MP:47 min]
>gp:[GI:g450372] [LN:ECOFRUA] [AC:M23196] [PN:enzyme II-fru] [GN:fruA]
[OR:Escherichia coli] [DB:genpept-bct1] [DE:E. coli phosphotransferase system
enzyme II (fruA) gene, completecds.] [LE:120] [RE:1811] [DI:direct]
>gp:[GI:g405893] [LN:ECOHU47] [AC:U00007] [PN:fructose-specific IIBC component]
[OR:Escherichia coli] [SR:Escherichia coli K12 BHB2600] [DB:genpept-bct1] [DE:47
to 48 centisome region of E.coli K12 BHB2600.] [LE:67463] [RE:69154]
[DI:complement] >gp:[GI:g1788492] [LN:AE000306] [AC:AE000306:U00096] [PN:PTS
system, fructose-specific transport protein] [GN:fruA] [FN:regulator; Degradation
of small molecules:] [OR:Escherichia coli] [DB:genpept-bct2] [EC:2.7.1.69]
[DE:Escherichia coli K-12 MG1655 section 196 of 400 of the completegenome.]
[NT:f563; 100 pct identical to PTFB_ECOLI SW: P20966] [LE:2367] [RE:4058]
[DI:complement]

| ORF_Name | NT_ID | AA_ID | NT/LN | AA/LN | Score | P-value |
|---|---|---|---|---|---|---|
| 20485153_f1_124 | 2356 | 9527 | 1113 | 370 | 1338 | 1.4e-136 |

Description sp:[LN:YODE_PSEAE] [AC:Q01609] [OR:Pseudomonas aeruginosa] [DE:HYPOTHETICAL 40.7 KD PROTEIN IN OPDE 3'REGION (ORF2)] [SP:Q01609] [DB:swissprot] >sp:[LN:S23861] [AC:S23861] [PN:hypothetical protein 2] [OR:Pseudomonas aeruginosa] [DB:pir2] >gp:[GI:g45369] [LN:PAOPDEG] [AC:Z14064] [GN:ORF2] [OR:Pseudomonas aeruginosa] [DB:genpept-bct1] [DE:P.aeruginosa opdE gene.] [SP:Q01609] [LE:2253] [RE:3368] [DI:direct]

| ORF_Name | NT_ID | AA_ID | NT/LN | AA/LN | Score | P-value |
|---|---|---|---|---|---|---|
| 20515801_f3_1201 | 2357 | 9528 | 1449 | 482 | 579 | 3.7e-56 |

Description gp:[GI:g1235993] [LN:OFU40075] [AC:U40075] [PN:oxalate:formate antiport protein] [GN:oxlT] [OR:Oxalobacter formigenes] [DB:genpept-bct2] [DE:Oxalobacter formigenes oxalate:formate antiport protein (oxlT)gene, complete cds.] [NT:OxlT; OxlT is a hydrophobic membrane antiport] [LE:1] [RE:1257] [DI:direct]

| ORF_Name | NT_ID | AA_ID | NT/LN | AA/LN | Score | P-value |
|---|---|---|---|---|---|---|
| 20516441_f2_680 | 2358 | 9529 | 213 | 70 | | |

Description

NO-HIT

| ORF_Name | NT_ID | AA_ID | NT/LN | AA/LN | Score | P-value |
|---|---|---|---|---|---|---|
| 2072167_f1_175 | 2359 | 9530 | 1401 | 466 | 469 | 1.3e-60 |

Description gp:[GI:d1039051:g4512348] [LN:AB011836] [AC:AB011836] [GN:yerM] [OR:Bacillus halodurans] [SR:Bacillus halodurans (strain:C-125, isolate:xylanase producer) DNA] [DB:genpept-bct1] [DE:Bacillus halodurans C-125 genomic DNA, clone ALBAC003.] [NT:similar to B.subtilis yerM gene(84%-identity)] [LE:3123] [RE:4580] [DI:complement]

| ORF Name | NT ID | AA ID | NT LN | AA LN | Score | P-value |
|---|---|---|---|---|---|---|
| 20761055_c3_2741 | 2360 | 9531 | 519 | 172 | 495 | 2.9e-47 |

Description gp:[GI:g775201] [LN:ECU23500] [AC:U23500] [PN:unknown] [GN:yciE] [OR:Escherichia coli] [DB:genpept-bct1] [DE:Escherichia coli ECOR 71 anthranilate isomerase (trpC), tryptophansynthase beta subunit (trpB), tryptophan synthase alpha subunit(trpA), (yciG), (yciF), and (yciE) genes, complete cds.] [LE:4576] [RE:5082] [DI:direct] >gp:[GI:g924837] [LN:ECU25428] [AC:U25428] [GN:yciE] [OR:Escherichia coli] [DB:genpept-bct1] [DE:Escherichia coli ECOR 70 anthranilate isomerase (trpC), tryptophansynthase beta subunit (trpB), tryptophan synthase alpha subunit(trpA), (yciG), (yciF), and (yciE) genes, complete cds.] [LE:4576] [RE:5082] [DI:direct]

| ORF Name | NT ID | AA ID | NT LN | AA LN | Score | P-value |
|---|---|---|---|---|---|---|
| 21522702_f3_1271 | 2361 | 9532 | 1455 | 484 | 1544 | 2.0e-158 |

Description gp:[GI:d1022701:g2340815] [LN:AB001599] [AC:AB001599] [PN:L-2,4-diaminobutyrate:2-ketoglutarate] [OR:Acinetobacter baumannii] [SR:Acinetobacter baumannii (strain:ATCC 19606) DNA, clone:pBDD71] [DB:genpept-bct1] [DE:Acinetobacter baumannii DNA forL-2,4-diaminobutyrate:2-ketoglutarate 4-aminotransferase, completecds.] [NT:amino acid sequence translated is homologous to] [LE:652] [RE:1989] [DI:direct]

| ORF Name | NT ID | AA ID | NT LN | AA LN | Score | P-value |
|---|---|---|---|---|---|---|
| 21531916_f3_1408 | 2362 | 9533 | 387 | 128 | 121 | 1.3e-07 |

Description sp:[LN:G72536] [AC:G72536] [PN:hypothetical protein APE1580] [GN:APE1580] [OR:Aeropyrum pernix] [DB:pir2] >gp:[GI:d1044366:g5105267] [LN:AP000062] [AC:AP000062] [PN:114aa long hypothetical protein] [GN:APE1580] [OR:Aeropyrum pernix] [SR:Aeropyrum pernix (strain:K1) DNA] [DB:genpept-bct1] [DE:Aeropyrum pernix genomic DNA, section 5/7.] [NT:similar to OWL:AB00946832 percent identity:37.500] [LE:13911] [RE:14255] [DI:direct]

| ORF_Name | NT_ID | AA_ID | NT/LN | AA/LN | Score | P-value |
|---|---|---|---|---|---|---|
| 21571878_c2_2365 | 2363 | 9534 | 1311 | 436 | 1592 | 1.7e-163 |

Description sp:[LN:PGTC_SALTY] [AC:P37591] [GN:PGTC] [OR:Salmonella typhimurium]
[DE:PHOSPHOGLYCERATE TRANSPORT REGULATORY PROTEIN PGTC PRECURSOR] [SP:P37591]
[DB:swissprot] >sp:[LN:T11777] [AC:T11777] [PN:phosphoglycerate transport
regulatory protein pgtC] [OR:Salmonella typhimurium] [DB:pir2] >gp:[GI:g154258]
[LN:STYPGTBC] [AC:M21279] [PN:regulatory protein pgtC] [OR:Salmonella
typhimurium] [SR:Salmonella typhimurium (strain LT-2) DNA] [DB:genpept-bct1]
[DE:Salmonella typhimurium phosphoglycerate transport regulatoryprotein (pgtB and
pgtC) genes, complete cds, and regulatoryprotein (pgtA) gene, 5' end.] [LE:115]
[RE:1308] [DI:direct]

| ORF_Name | NT_ID | AA_ID | NT/LN | AA/LN | Score | P-value |
|---|---|---|---|---|---|---|
| 21610308_c2_2499 | 2364 | 9535 | 423 | 140 | 615 | 5.6e-60 |

Description sp:[LN:MARA_ECOLI] [AC:P27246] [GN:MARA] [OR:Escherichia coli] [DE:MULTIPLE
ANTIBIOTIC RESISTANCE PROTEIN MARA] [SP:P27246] [DB:swissprot] >sp:[LN:B47072]
[AC:B47072:A36906:F64907] [PN:probable transcription activator marA:multiple
antibiotic resistance protein marA] [GN:marA] [OR:Escherichia coli] [DB:pir2]
[MP:34 min] >gp:[GI:d1015940:g1742513] [LN:D90796] [AC:D90796:AB001340]
[PN:Multiple antibiotic resistance protein MarA.] [GN:marA] [OR:Escherichia coli]
[SR:Escherichia coli (strain:K12) DNA, clone_lib:Kohara lambda minise]
[DB:genpept-bct1] [DE:E.coli genomic DNA, Kohara clone #305(34.7-35.1 min.).]
[NT:ORF_ID:o306#2; similar to [SwissProt Accession] [LE:8715] [RE:9104]
[DI:direct] >gp:[GI:d1015953:g1742527] [LN:D90797] [AC:D90797:AB001340]
[PN:Multiple antibiotic resistance protein MarA.] [GN:marA] [OR:Escherichia coli]
[SR:Escherichia coli (strain:K12) DNA, clone_lib:Kohara lambda minise]
[DB:genpept-bct1] [DE:E.coli genomic DNA, Kohara clone #306(34.8-35.1 min.).]
[NT:ORF_ID:o306#2; similar to [SwissProt Accession] [LE:2164] [RE:2553]
[DI:direct] >gp:[GI:g1787811] [LN:AE000250] [AC:AE000250:U00096] [PN:multiple
antibiotic resistance; transcriptional] [GN:marA] [FN:regulator; Drug/analog
sensitivity] [OR:Escherichia coli] [DB:genpept-bct2] [DE:Escherichia coli K-12
MG1655 section 140 of 400 of the completegenome.] [NT:o129; 100 pct identical to
MARA_ECOLI SW: P27246;] [LE:8805] [RE:9194] [DI:direct] >gp:[GI:g146732]
[LN:ECOMARAR] [AC:M96235] [PN:multiple antibiotic resistance protein] [GN:marA]
[OR:Escherichia coli] [DB:genpept-bct2] [DE:Escherichia coli multiple antibiotic
resistance protein (marC),multiple antibiotic resistance protein (marR), and
multipleantibiotic resistance protein (marA) genes, complete cds.] [LE:1894]
[RE:2283] [DI:direct]

| ORF_Name | NT_ID | AA_ID | NT LN | AA LN | Score | P-value |
|---|---|---|---|---|---|---|
| 21648332_f1_203 | 2365 | 9536 | 294 | 97 | 73 | 0.015 |

Description sp:[LN:I61260] [AC:I61260] [PN:synapsin II] [GN:SYN2] [OR:Mus musculus] [SR:, house mouse] [DB:pir2] >gp:[GI:g1041087] [LN:MUSSYNII] [AC:L32026] [PN:synapsin II] [GN:SYN2] [OR:Mus musculus] [SR:Mus musculus (tissue library: 129/Sv genomic) DNA] [DB:genpept-rod] [DE:Mouse synapsin II gene, exon 1.] [LE:2170] [RE:>2549] [DI:direct]

| ORF_Name | NT_ID | AA_ID | NT LN | AA LN | Score | P-value |
|---|---|---|---|---|---|---|
| 2167217_f1_47 | 2366 | 9537 | 732 | 243 | | |

Description

NO-HIT

| ORF_Name | NT_ID | AA_ID | NT LN | AA LN | Score | P-value |
|---|---|---|---|---|---|---|
| 21697691_c3_2597 | 2367 | 9538 | 651 | 216 | 635 | 4.3e-62 |

Description sp:[LN:RIML_ECOLI] [AC:P13857] [GN:RIML] [OR:Escherichia coli] [EC:2.3.1.-]
[DE:ENZYME FOR N-TERMINAL OF RIBOSOMAL PROTEIN L7/L12)] [SP:P13857]
[DB:swissprot] >sp:[LN:XXECPL] [AC:S04776:F64894] [PN:ribosomal-protein-serine
N-acetyltransferase, rimL:peptide N-acetyltransferase rimL] [GN:rimL]
[CL:Escherichia coli ribosomal-protein-serine N-acetyltransferase rimL]
[OR:Escherichia coli] [EC:2.3.1.-] [DB:pirl] [MP:33 min]
>gp:[GI:d1015766:g1742324] [LN:D90781] [AC:D90781:D90762:AB001340]
[PN:Ribosomal-protein-serine acetyltransferase (EC] [GN:rimL] [OR:Escherichia
coli] [SR:Escherichia coli (strain:K12) DNA, clone_lib:Kohara lambda minise]
[DB:genpept-bct1] [DE:E.coli genomic DNA, Kohara clone #270(32.0-32.3 min.).]
[NT:ORF_ID:o270#17; similar to [SwissProt Accession] [LE:14609] [RE:15148]
[DI:direct] >gp:[GI:d1015776:g1742335] [LN:D90782] [AC:D90782:AB001340]
[PN:Ribosomal-protein-serine acetyltransferase (EC] [GN:rimL] [OR:Escherichia
coli] [SR:Escherichia coli (strain:K12) DNA, clone_lib:Kohara lambda minise]
[DB:genpept-bct1] [DE:E.coli genomic DNA, Kohara clone #271(32.1-32.5 min.).]
[NT:ORF_ID:o270#17; similar to [SwissProt Accession] [LE:7348] [RE:7887]
[DI:direct] >gp:[GI:g42749] [LN:ECRIML] [AC:X15860] [OR:Escherichia coli]
[DB:genpept-bct1] [DE:E.coli rimL gene for ribosomal protein L12.] [NT:ribosomal
protein L12 (AA 1-179)] [SP:P13857] [LE:603] [RE:1142] [DI:direct]
>gp:[GI:g1787697] [LN:AE000240] [AC:AE000240:U00096] [PN:acetylation of
N-terminal serine of 30S] [GN:rimL] [FN:enzyme; Ribosomes - maturation and]
[OR:Escherichia coli] [DB:genpept-bct2] [EC:2.3.1.-] [DE:Escherichia coli K-12
MG1655 section 130 of 400 of the completegenome.] [NT:o179; 100 pct identical to
RIML_ECOLI SW: P13857;] [LE:297] [RE:836] [DI:direct]

| ORF_Name | NT ID | AA ID | NT/LN | AA/LN | Score | P-value |
|---|---|---|---|---|---|---|
| 21735957_c3_2770 | 2368 | 9539 | 294 | 97 | | |

Description

NO-HIT

| ORF_Name | NT ID | AA ID | NT/LN | AA/LN | Score | P-value |
|---|---|---|---|---|---|---|
| 21772288_c1_1612 | 2369 | 9540 | 1434 | 477 | | |

Description

NO-HIT

| ORF_Name | NT ID | AA ID | NT/LN | AA/LN | Score | P-value |
|---|---|---|---|---|---|---|
| 21886092_c2_2371 | 2370 | 9541 | 1197 | 398 | 939 | 2.6e-94 |

Description sp:[LN:H72307] [AC:H72307] [PN:oxidoreductase, aldo/keto reductase family] [GN:TM1006] [CL:conserved hypothetical protein YPL088w] [OR:Thermotoga maritima] [DB:pir2] >gp:[GI:g4981550] [LN:AE001762] [AC:AE001762:AE000512] [PN:oxidoreductase, aldo/keto reductase family] [GN:TM1006] [OR:Thermotoga maritima] [DB:genpept-bct2] [DE:Thermotoga maritima section 74 of 136 of the complete genome.] [NT:similar to GB:AE000511 PID:2314358 percent] [LE:6737] [RE:7738] [DI:direct]

| ORF_Name | NT ID | AA ID | NT/LN | AA/LN | Score | P-value |
|---|---|---|---|---|---|---|
| 21911555_f3_1546 | 2371 | 9542 | 333 | 110 | | |

Description

NO-HIT

| ORF_Name | NT ID | AA ID | NT/LN | AA/LN | Score | P-value |
|---|---|---|---|---|---|---|
| 21991507_c2_2369 | 2372 | 9543 | 252 | 83 | | |

Description

NO-HIT

| ORF_Name | NT_ID | AA_ID | NT/LN | AA/LN | Score | P-value |
|---|---|---|---|---|---|---|
| 22117691_f2_516 | 2373 | 9544 | 1143 | 380 | 1069 | 4.4e-108 |

Description sp:[LN:YDED_ECOLI] [AC:P31125] [GN:YDED] [OR:Escherichia coli] [DE:HYPOTHETICAL 28.7 KD PROTEIN IN MARB-DCP INTERGENIC REGION] [SP:P31125] [DB:swissprot] >sp:[LN:H64907] [AC:H64907] [PN:probable membrane protein ydeD] [GN:ydeD] [OR:Escherichia coli] [DB:pir2] >gp:[GI:d1015942:g1742515] [LN:D90796] [AC:D90796:AB001340] [GN:ydeD] [OR:Escherichia coli] [SR:Escherichia coli (strain:K12) DNA, clone_lib:Kohara lambda minise] [DB:genpept-bct1] [DE:E.coli genomic DNA, Kohara clone #305(34.7-35.1 min.).] [NT:ORF_ID:o306#4; similar to [SwissProt Accession] [LE:9385] [RE:10185] [DI:complement] >gp:[GI:d1015955:g1742529] [LN:D90797] [AC:D90797:AB001340] [GN:ydeD] [OR:Escherichia coli] [SR:Escherichia coli (strain:K12) DNA, clone_lib:Kohara lambda minise] [DB:genpept-bct1] [DE:E.coli genomic DNA, Kohara clone #306(34.8-35.1 min.).] [NT:ORF_ID:o306#4; similar to [SwissProt Accession] [LE:2834] [RE:3634] [DI:complement] >gp:[GI:g1787813] [LN:AE000250] [AC:AE000250:U00096] [PN:orf, hypothetical protein] [GN:ydeD] [FN:orf; Unknown] [OR:Escherichia coli] [DB:genpept-bct2] [DE:Escherichia coli K-12 MG1655 section 140 of 400 of the completegenome.] [NT:f266; 100 pct identical to YDED_ECOLI SW:] [LE:9475] [RE:10275] [DI:complement]

| ORF_Name | NT_ID | AA_ID | NT/LN | AA/LN | Score | P-value |
|---|---|---|---|---|---|---|
| 22128916_c1_1999 | 2374 | 9545 | 792 | 263 | 138 | 2.9e-06 |

Description sp:[LN:GLT5_WHEAT] [AC:P10388] [GN:GLU-1D-1D:GLU-D1-1B] [OR:Triticum aestivum] [SR:,Wheat] [DE:GLUTENIN, HIGH MOLECULAR WEIGHT SUBUNIT DX5 PRECURSOR] [SP:P10388] [DB:swissprot] >gp:[GI:e300500:g1835264] [LN:TAGL1D1B] [AC:X12928] [OR:Triticum aestivum] [DB:genpept-pln1] [DE:Wheat Glu-1D-1d gene for high molecular weight glutenin subunit 5.] [NT:HMW glutenin subunit 5 (AA 1-848)] [SP:P10388] [LE:637] [RE:3156] [DI:direct]

| ORF_Name | NT_ID | AA_ID | NT/LN | AA/LN | Score | P-value |
|---|---|---|---|---|---|---|
| 22301540_c1_1933 | 2375 | 9546 | 1326 | 441 | 399 | 2.2e-39 |

Description gp:[GI:e1393931:g4490992] [LN:SCE29] [AC:AL035707] [PN:putative salicylate hydroxylase] [GN:SCE29.14c] [OR:Streptomyces coelicolor] [DB:genpept-bct1] [DE:Streptomyces coelicolor cosmid E29.] [NT:SCE29.14c, possible salicylate hydroxylase, len:] [LE:19076] [RE:20338] [DI:complement]

| ORF Name | NT ID | AA ID | NT LN | AA LN | Score | P-value |
|---|---|---|---|---|---|---|
| 22345216_f3_1296 | 2376 | 9547 | 2208 | 735 | 3197 | 0.0 |

Description sp:[LN:CATA_SALTY] [AC:P17750] [GN:KATG] [OR:Salmonella typhimurium]
[EC:1.11.1.6] [DE:CATALASE HPI, (HYDROPEROXIDASE I)] [SP:P17750] [DB:swissprot]
>sp:[LN:CSEBHT] [AC:S12039:S11647] [PN:catalase, HPI:hydroperoxidase I] [GN:katG]
[CL:catalase HPI] [OR:Salmonella typhimurium] [EC:1.11.1.6] [DB:pir1] [MP:88 min]
>gp:[GI:g47755] [LN:STKATG] [AC:X53001] [PN:hydroperoxidase I] [GN:Kat G]
[OR:Salmonella typhimurium] [DB:genpept-bct1] [DE:Salmonella typhimurium Kat G
gene for hydroperoxidase I.] [SP:P17750] [LE:151] [RE:2334] [DI:direct]

| ORF Name | NT ID | AA ID | NT LN | AA LN | Score | P-value |
|---|---|---|---|---|---|---|
| 22365656_f3_1100 | 2377 | 9548 | 333 | 110 | 87 | 0.0025 |

Description sp:[LN:3HAO_RAT] [AC:P46953:Q64556:P70474] [OR:Rattus norvegicus] [SR:,Rat]
[EC:1.13.11.6] [DE:OXYGENASE)] [SP:P46953:Q64556:P70474] [DB:swissprot]
>gp:[GI:d1008525:g1040694] [LN:RAT3H34DB] [AC:D44494] [PN:3-hydroxyanthranilate
3,4-dioxygenase] [OR:Rattus rattus] [SR:Rattus rattus (strain:Sprague-Dawley)
liver cDNA to mRNA] [DB:genpept-rod] [EC:1.13.11.6] [DE:Rat mRNA for
3-hydroxyanthranilate 3,4-dioxygenase, complete cds.] [LE:90] [RE:950]
[DI:direct]

| ORF Name | NT ID | AA ID | NT LN | AA LN | Score | P-value |
|---|---|---|---|---|---|---|
| 22375308_c3_2951 | 2378 | 9549 | 1566 | 521 | 1002 | 5.5e-101 |

Description sp:[LN:G69789] [AC:G69789] [PN:sugar transporter homolog ydjK] [GN:ydjK]
[CL:glucose transport protein] [OR:Bacillus subtilis] [DB:pir2]
>gp:[GI:d1023635:g2522015] [LN:AB007638] [AC:AB007638] [PN:metabolite transport
protein] [GN:ydjK] [OR:Bacillus subtilis] [SR:Bacillus subtilis (strain:Marburg
168) DNA] [DB:genpept-bct1] [DE:Bacillus subtilis genomic DNA containing gutA to
cotA region, 48degree.] [NT:putative] [LE:7934] [RE:9355] [DI:direct]
>gp:[GI:e1182602:g2632936] [LN:BSUB0004] [AC:Z99107:AL009126] [GN:ydjK]
[FN:unknown] [OR:Bacillus subtilis] [DB:genpept-bct1] [DE:Bacillus subtilis
complete genome (section 4 of 21): from 600701 to813890.] [NT:similar to sugar
transporter] [LE:75459] [RE:76880] [DI:direct]

| ORF Name | NT ID | AA ID | NT LN | AA LN | Score | P-value |
|---|---|---|---|---|---|---|
| 22385311_f3_1207 | 2379 | 9550 | 936 | 311 | 339 | 9.9e-31 |

Description sp:[LN:T03562] [AC:T03562] [PN:conserved hypothetical protein] [OR:Rhodobacter
capsulatus] [DB:pir2] [MP:1] >gp:[GI:g3128363] [LN:AF010496] [AC:AF010496]
[PN:hypothetical protein] [OR:Rhodobacter capsulatus] [DB:genpept-bct2]
[DE:Rhodobacter capsulatus strain SB1003, partial genome.] [LE:143821]
[RE:144711] [DI:direct]

| ORF_Name | NT_ID | AA_ID | $\frac{NT}{LN}$ | $\frac{AA}{LN}$ | Score | P-value |
|---|---|---|---|---|---|---|
| 22460212_f2_814 | 2380 | 9551 | 1020 | 339 | 313 | 5.7e-28 |

Description sp:[LN:E70082] [AC:E70082] [PN:glucose 1-dehydrogenase homolog yxnA] [GN:yxnA]
[CL:short-chain alcohol dehydrogenase homology] [OR:Bacillus subtilis] [DB:pir2]
>gp:[GI:e1184726;g2636547] [LN:BSUB0021] [AC:Z99124;AL009126] [GN:yxnA]
[FN:unknown] [OR:Bacillus subtilis] [DB:genpept-bct1] [DE:Bacillus subtilis
complete genome (section 21 of 21): from 3999281to 4214814.] [NT:similar to
glucose 1-dehydrogenase] [LE:107984] [RE:108907] [DI:direct]

| ORF_Name | NT_ID | AA_ID | $\frac{NT}{LN}$ | $\frac{AA}{LN}$ | Score | P-value |
|---|---|---|---|---|---|---|
| 22479712_f1_128 | 2381 | 9552 | 1053 | 350 | 952 | 1.1e-95 |

Description sp:[LN:YAJO_ECOLI] [AC:P77735] [GN:YAJO] [OR:Escherichia coli] [DE:HYPOTHETICAL
OXIDOREDUCTASE IN PGPA-ISPA INTERGENIC REGION] [SP:P77735] [DB:swissprot]

| ORF_Name | NT_ID | AA_ID | $\frac{NT}{LN}$ | $\frac{AA}{LN}$ | Score | P-value |
|---|---|---|---|---|---|---|
| 22667010_c3_2576 | 2382 | 9553 | 1068 | 355 | 1522 | 4.3e-156 |

Description sp:[LN:B64919] [AC:B64919] [PN:conserved hypothetical protein b1624]
[CL:conserved hypothetical protein b1624] [OR:Escherichia coli] [DB:pir2]
>gp:[GI:d1016096;g1742678] [LN:D90805] [AC:D90805;AB001340] [PN:Virulence factor
MviM.] [OR:Escherichia coli] [SR:Escherichia coli (strain:K12) DNA,
clone_lib:Kohara lambda minise] [DB:genpept-bct1] [DE:E.coli genomic DNA, Kohara
clone #314(36.3-36.7 min.).] [NT:ORF_ID:o314#10; similar to [SwissProt Accession]
[LE:17952] [RE:19031] [DI:complement] >gp:[GI:d1016103;g1742686] [LN:D90806]
[AC:D90806;AB001340] [PN:Virulence factor MviM.] [OR:Escherichia coli]
[SR:Escherichia coli (strain:K12) DNA, clone_lib:Kohara lambda minise]
[DB:genpept-bct1] [DE:E.coli genomic DNA, Kohara clone #315(36.6-36.9 min.).]
[NT:ORF_ID:o314#10; similar to [SwissProt Accession] [LE:6264] [RE:7343]
[DI:complement] >gp:[GI:d1016110;g1742694] [LN:D90807] [AC:D90807;AB001340]
[PN:Virulence factor MviM.] [OR:Escherichia coli] [SR:Escherichia coli
(strain:K12) DNA, clone_lib:Kohara lambda minise] [DB:genpept-bct1] [DE:E.coli
genomic DNA, Kohara clone #316(36.7-37.1 min.).] [NT:ORF_ID:o314#10; similar to
[SwissProt Accession] [LE:874] [RE:1953] [DI:complement]
>gp:[GI:d1016133;g1742718] [LN:D90808] [AC:D90808;AB001340] [PN:Virulence factor
MviM.] [OR:Escherichia coli] [SR:Escherichia coli (strain:K12) DNA,
clone_lib:Kohara lambda minise] [DB:genpept-bct1] [DE:E.coli genomic DNA, Kohara
clone #317(36.6-36.9 min.).] [NT:ORF_ID:o314#10; similar to [SwissProt Accession]
[LE:6365] [RE:7444] [DI:complement] >gp:[GI:g1787911] [LN:AE000258]
[AC:AE000258;U00096] [PN:orf, hypothetical protein] [GN:b1624] [FN:orf; Unknown]
[OR:Escherichia coli] [DB:genpept-bct2] [DE:Escherichia coli K-12 MG1655 section
148 of 400 of the completegenome.] [NT:f359; residues 74-259 are 45 pct identical
to] [LE:3989] [RE:5068] [DI:complement]

| ORF Name | NT ID | AA ID | NT LN | AA LN | Score | P-value |
|---|---|---|---|---|---|---|
| 22667662_c2_2067 | 2383 | 9554 | 258 | 85 | | |

Description

NO-HIT

| ORF Name | NT ID | AA ID | NT LN | AA LN | Score | P-value |
|---|---|---|---|---|---|---|
| 22700_c3_2964 | 2384 | 9555 | 762 | 253 | 382 | 2.8e-35 |

Description sp:[LN:LPFB_SALTY] [AC:P43661] [GN:LPFB] [OR:Salmonella typhimurium]
[DE:CHAPERONE PROTEIN LPFB PRECURSOR] [SP:P43661] [DB:swissprot] >sp:[LN:B56271]
[AC:B56271] [PN:long polar fimbrial chaperone] [GN:lpfB] [CL:chaperone protein
papD] [OR:Salmonella typhimurium] [DB:pir1] >gp:[GI:g829372] [LN:STU18559]
[AC:U18559] [GN:lpfB] [OR:Salmonella typhimurium] [DB:genpept-bct1]
[DE:Salmonella typhimurium long polar fimbriae proteins (lpfA, lpfB,lpfC, lpfD,
lpfE) genes, complete cds and (orf1, orf2) genes,partial cds.] [LE:1098]
[RE:1796] [DI:direct]

| ORF Name | NT ID | AA ID | NT LN | AA LN | Score | P-value |
|---|---|---|---|---|---|---|
| 22736040_f2_675 | 2385 | 9556 | 1107 | 368 | 355 | 2.0e-32 |

Description sp:[LN:GNTR_ECOLI] [AC:P46860:Q47241] [GN:GNTR] [OR:Escherichia coli]
[DE:GLUCONATE UTILIZATION SYSTEM GNT-I TRANSCRIPTIONAL REPRESSOR]
[SP:P46860:Q47241] [DB:swissprot] >gp:[GI:d1013000:g1304069] [LN:ECOGNTR]
[AC:D84362] [PN:repressor] [GN:gntR] [OR:Escherichia coli] [SR:Escherichia coli
(strain:W3110) DNA, clone:pGNT15] [DB:genpept-bct1] [DE:Escherichia coli DNA for
repressor, low affinity gluconatepermease, thermoresistant gluconokinase.]
[LE:494] [RE:1489] [DI:direct]

| ORF Name | NT ID | AA ID | NT LN | AA LN | Score | P-value |
|---|---|---|---|---|---|---|
| 22738531_f1_437 | 2386 | 9557 | 1467 | 488 | 1302 | 8.9e-133 |

Description gp:[GI:g1769558] [LN:FMU81184] [AC:U81184] [PN:phospho-beta-glucosidase]
[GN:pbgA] [OR:Fusobacterium mortiferum] [DB:genpept-bct1] [EC:3.2.1.86]
[DE:Fusobacterium mortiferum phospho-beta-glucosidase (pbgA) gene andputative
endoglucanase (pbgB) gene, partial cds.] [NT:6-phosphoryl-beta-D-glucopyranosyl:]
[LE:<1] [RE:1401] [DI:direct]

| ORF Name | NT ID | AA ID | NT LN | AA LN | Score | P-value |
|---|---|---|---|---|---|---|
| 22754652_c3_2662 | 2387 | 9558 | 819 | 272 | 651 | 8.6e-64 |

Description sp:[LN:GLUA_CORGL] [AC:P48243] [GN:GLUA] [OR:Corynebacterium glutamicum]
[SR:,Brevibacterium flavum] [DE:GLUTAMATE TRANSPORT ATP-BINDING PROTEIN GLUA]
[SP:P48243] [DB:swissprot] >gp:[GI:g732701] [LN:GCGLUABCD] [AC:X81191] [GN:gluA]
[OR:Corynebacterium glutamicum] [DB:genpept-bct1] [DE:C.glutamicum gluA, gluB,
gluC and gluD genes.] [SP:P48243] [LE:220] [RE:948] [DI:direct]

| ORF Name | NT ID | AA ID | NT LN | AA LN | Score | P-value |
|---|---|---|---|---|---|---|
| 22755283_c3_2907 | 2388 | 9559 | 348 | 115 | | |

Description

NO-HIT

| ORF Name | NT ID | AA ID | NT LN | AA LN | Score | P-value |
|---|---|---|---|---|---|---|
| 22852336_f3_1509 | 2389 | 9560 | 651 | 216 | 1052 | 2.8e-106 |

Description sp:[LN:END3_ECOLI] [AC:P20625] [GN:NTH] [OR:Escherichia coli] [EC:4.2.99.18]
[DE:LYASE)] [SP:P20625] [DB:swissprot] >sp:[LN:A32412] [AC:A32412:C64920]
[PN:DNA-(apurinic or apyrimidinic site) lyase, endonuclease III:endonuclease III
nth] [GN:nth] [CL:apurinic/apyrimidinic endonuclease III] [OR:Escherichia coli]
[EC:4.2.99.18] [DB:pir1] >gp:[GI:d1016108:g1742691] [LN:D90806]
[AC:D90806:AB001340] [PN:Deoxyribonuclease (pyrimidine dimer) (EC) [GN:nth]
[OR:Escherichia coli] [SR:Escherichia coli (strain:K12) DNA, clone_lib:Kohara
lambda minise] [DB:genpept-bct1] [DE:E.coli genomic DNA, Kohara clone
315(36.6-36.9 min.).] [NT:ORF_ID:o316#12; similar to [PIR Accession Number]
[LE:14519] [RE:15154] [DI:direct] >gp:[GI:d1016115:g1742699] [LN:D90807]
[AC:D90807:AB001340] [PN:Deoxyribonuclease (pyrimidine dimer) (EC) [GN:nth]
[OR:Escherichia coli] [SR:Escherichia coli (strain:K12) DNA, clone_lib:Kohara
lambda minise] [DB:genpept-bct1] [DE:E.coli genomic DNA, Kohara clone
316(36.7-37.1 min.).] [NT:ORF_ID:o316#12; similar to [PIR Accession Number]
[LE:9129] [RE:9764] [DI:direct] >gp:[GI:d1016138:g1742723] [LN:D90808]
[AC:D90808:AB001340] [PN:Deoxyribonuclease (pyrimidine dimer) (EC) [GN:nth]
[OR:Escherichia coli] [SR:Escherichia coli (strain:K12) DNA, clone_lib:Kohara
lambda minise] [DB:genpept-bct1] [DE:E.coli genomic DNA, Kohara clone
317(36.6-36.9 min.).] [NT:ORF_ID:o316#12; similar to [PIR Accession Number]
[LE:14620] [RE:15255] [DI:direct] >gp:[GI:g146972] [LN:ECONTH] [AC:J02857]
[OR:Escherichia coli] [SR:E.coli (strain K12) DNA] [DB:genpept-bct1] [DE:E.coli
nth gene encoding endonuclease III, complete cds.] [NT:endonuclease III] [LE:85]
[RE:720] [DI:direct] >gp:[GI:g1787920] [LN:AE000258] [AC:AE000258:U00096]
[PN:endonuclease III; specific for apurinic and/or] [GN:nth] [FN:enzyme;
Degradation of DNA] [OR:Escherichia coli] [DB:genpept-bct2] [EC:4.2.99.18]
[DE:Escherichia coli K-12 MG1655 section 148 of 400 of the completegenome.]
[NT:o211; 100 pct identical to END3_ECOLI SW: P20625;] [LE:12244] [RE:12879]
[DI:direct]

| ORF Name | NT ID | AA ID | NT/LN | AA/LN | Score | P-value |
|---|---|---|---|---|---|---|
| 22854526_c2_2427 | 2390 | 9561 | 726 | 241 | 622 | 1.0e-60 |

Description gp:[GI:g2738251] [LN:SEU97227] [AC:U97227] [PN:IroE] [GN:iroE] [OR:Salmonella enterica] [DB:genpept-bct2] [DE:Salmonella enterica ferric enterochelin esterase homolog (iroD),IroE (iroE) and TonB dependent outer membrane siderophore receptorprotein (iroN) genes, complete cds.] [LE:1312] [RE:2229] [DI:direct]

| ORF Name | NT ID | AA ID | NT/LN | AA/LN | Score | P-value |
|---|---|---|---|---|---|---|
| 22866665_c3_2991 | 2391 | 9562 | 381 | 126 | 117 | 6.8e-06 |

Description sp:[LN:GLT5_WHEAT] [AC:P10388] [GN:GLU-1D-1D:GLU-D1-1B] [OR:Triticum aestivum] [SR:,Wheat] [DE:GLUTENIN, HIGH MOLECULAR WEIGHT SUBUNIT DX5 PRECURSOR] [SP:P10388] [DB:swissprot] >gp:[GI:e300500:g1835264] [LN:TAGL1D1B] [AC:X12928] [OR:Triticum aestivum] [DB:genpept-pln1] [DE:Wheat Glu-1D-1d gene for high molecular weight glutenin subunit 5.] [NT:HMW glutenin subunit 5 (AA 1-848)] [SP:P10388] [LE:637] [RE:3156] [DI:direct]

| ORF Name | NT ID | AA ID | NT/LN | AA/LN | Score | P-value |
|---|---|---|---|---|---|---|
| 22898592_c2_2459 | 2392 | 9563 | 222 | 73 | | |

Description

NO-HIT

| ORF Name | NT ID | AA ID | NT/LN | AA/LN | Score | P-value |
|---|---|---|---|---|---|---|
| 22906533_c1_1896 | 2393 | 9564 | 1629 | 542 | 593 | 1.2e-57 |

Description sp:[LN:A70904] [AC:A70904] [PN:probable acid--CoA ligase,] [GN:fadD5] [CL:4-coumarate--CoA ligase:acetate--CoA ligase homology] [OR:Mycobacterium tuberculosis] [EC:6.2.1.-] [DB:pir2] >gp:[GI:e322880:g2213503] [LN:MTCI28] [AC:Z97050:AL123456] [PN:fadD5] [GN:fadD5] [OR:Mycobacterium tuberculosis] [DB:genpept-bct1] [DE:Mycobacterium tuberculosis H37Rv complete genome; segment 10/162.] [NT:Rv0166, (MTCI28.06), fadD5, probable fatty-acid] [LE:4491] [RE:6155] [DI:direct]

| ORF Name | NT ID | AA ID | NT/LN | AA/LN | Score | P-value |
|---|---|---|---|---|---|---|
| 22917777_c1_1761 | 2394 | 9565 | 195 | 64 | | |

Description

NO-HIT

| ORF_Name | NT_ID | AA_ID | NT/LN | AA/LN | Score | P-value |
|---|---|---|---|---|---|---|
| 23470001_c1_1857 | 2395 | 9566 | 636 | 211 | 202 | 3.3e-16 |

Description sp:[LN:D69887] [AC:D69887] [PN:conserved hypothetical protein ynaD] [GN:ynaD]
[CL:Escherichia coli ribosomal-protein-alanine N-acetyltransferase rimJ]
[OR:Bacillus subtilis] [DB:pir2] >gp:[GI:g1750115] [LN:BSU66480] [AC:U66480]
[PN:YnaD] [GN:ynaD] [OR:Bacillus subtilis] [DB:genpept-bct1] [DE:Bacillus
subtilis SpoVK (spoVK), YnbA (ynbA), YnbB (ynbB), GlnR(glnR), glutamine
synthetase (glnA), YnaA (ynaA), YnaB (ynaB), YnaC(ynaC), YnaD (ynaD), YnaE
(ynaE), YnaF (ynaF), YnaG (ynaG), YnaH(ynaH), YnaI (ynaI), YnaJ (ynaJ), xylan
beta-1,4-xylosidase (xynB),xylose repressor (xylR), xylose isomerase (xylA),
xylulose kinase(xylB), YncB (yncB), YncC (yncC), YncD (yncD) and YncE
(yncE)genes, complete cds.] [LE:9169] [RE:9681] [DI:direct]
>gp:[GI:e1183411:g2634136] [LN:BSUB0010] [AC:Z99113:AL009126] [GN:ynaD]
[FN:unknown] [OR:Bacillus subtilis] [DB:genpept-bct1] [DE:Bacillus subtilis
complete genome (section 10 of 21): from 1781201to 2014980.] [NT:similar to
hypothetical proteins] [LE:101220] [RE:101732] [DI:direct]

| ORF_Name | NT_ID | AA_ID | NT/LN | AA/LN | Score | P-value |
|---|---|---|---|---|---|---|
| 23475686_f1_249 | 2396 | 9567 | 672 | 223 | 223 | 8.6e-18 |

Description sp:[LN:YYAJ_BACSU] [AC:P37514] [GN:YYAJ] [OR:Bacillus subtilis] [DE:REGION]
[SP:P37514] [DB:swissprot] >sp:[LN:S66008] [AC:S66008:A70085:I39919]
[PN:transporter homolog yyaJ] [GN:yyaJ] [OR:Bacillus subtilis] [DB:pir2]
>gp:[GI:d1005756:g467368] [LN:BAC180K] [AC:D26185] [PN:unknown] [OR:Bacillus
subtilis] [SR:Bacillus subtilis (sub_species:Marburg, strain:168) DNA]
[DB:genpept-bct1] [DE:B. subtilis DNA, 180 kilobase region of replication
origin.] [LE:42385] [RE:43740] [DI:direct] >gp:[GI:e1184810:g2636631]
[LN:BSUB0021] [AC:Z99124:AL009126] [GN:yyaJ] [FN:unknown] [OR:Bacillus subtilis]
[DB:genpept-bct1] [DE:Bacillus subtilis complete genome (section 21 of 21): from
3999281to 4214814.] [NT:similar to transporter] [SP:P37514] [LE:194317]
[RE:195672] [DI:direct]

| ORF_Name | NT ID | AA ID | NT LN | AA LN | Score | P-value |
|---|---|---|---|---|---|---|
| 23549063_f3_1036 | 2397 | 9568 | 366 | 121 | 86 | 0.043 |

Description sp:[LN:GR78_YEAST] [AC:P16474] [GN:KAR2:SSD1:GRP78:YJL034W:J1248]
[OR:Saccharomyces cerevisiae] [SR:,Baker's yeast] [DE:(IMMUNOGLOBULIN HEAVY CHAIN
BINDING PROTEIN HOMOLOG) (BIP)] [SP:P16474] [DB:swissprot] >sp:[LN:HHBYK2]
[AC:A32366:A34875:A32367:B32367:S56806:A30943:S05776;] [PN:dnaK-type molecular
chaperone KAR2 precursor:heat shock protein BiP/GRP78 homolog:nuclear fusion
protein KAR2:protein J1248:protein YJL034w] [GN:KAR2] [CL:heat shock protein 70]
[OR:Saccharomyces cerevisiae] [DB:pir1] [MP:10L] >gp:[GI:g1008157] [LN:SCYJL034W]
[AC:Z49309:Y13136] [GN:KAR2] [OR:Saccharomyces cerevisiae] [SR:baker's yeast]
[DB:genpept-pln1] [DE:S.cerevisiae chromosome X reading frame ORF YJL034w.]
[NT:ORF YJL034w] [SP:P16474] [LE:326] [RE:2374] [DI:direct] >gp:[GI:g171130]
[LN:YSCBIP] [AC:M31006] [GN:KAR2] [OR:Saccharomyces cerevisiae] [SR:S.cerevisiae
(strain LL20) DNA, clone pYG2C2] [DB:genpept-pln1] [DE:S.cerevisiae
glucose-regulated protein (GRP78, BiP, KAR2) gene,complete cds.] [NT:glucose
regulated protein 78 precursor] [LE:631] [RE:2679] [DI:direct] >gp:[GI:g171771]
[LN:YSCKAR2] [AC:M25394] [GN:KAR2] [OR:Saccharomyces cerevisiae] [SR:Yeast
(S.cerevisiae, strain GRF-18) DNA, and cDNA to mRNA, clone] [DB:genpept-pln1]
[DE:Yeast (S.cerevisiae) protein encoding protein folding in theendoplasmic
reticulum (KAR2) gene, complete cds.] [NT:protein-folding protein (KAR2)
precursor] [LE:285] [RE:2333] [DI:direct] >gp:[GI:g171773] [LN:YSCKAR2A]
[AC:M25064] [GN:KAR2] [OR:Saccharomyces cerevisiae] [SR:S.cerevisiae (strain
S288C) GRF88 cell line DNA, clone pMR397] [DB:genpept-pln1] [DE:S.cerevisiae
karyogamy (KAR2) gene, complete cds.] [NT:KAR2 protein precursor] [LE:285]
[RE:2333] [DI:direct]

| ORF_Name | NT ID | AA ID | NT LN | AA LN | Score | P-value |
|---|---|---|---|---|---|---|
| 23619790_c1_1921 | 2398 | 9569 | 204 | 67 | | |

Description

NO-HIT

| ORF_Name | NT ID | AA ID | NT LN | AA LN | Score | P-value |
|---|---|---|---|---|---|---|
| 23636318_f3_1331 | 2399 | 9570 | 189 | 62 | | |

Description

NO-HIT

| ORF Name | NT ID | AA ID | NT LN | AA LN | Score | P-value |
|---|---|---|---|---|---|---|
| 23645666_c3_2782 | 2400 | 9571 | 1983 | 660 | 1987 | 2.3e-205 |

Description sp:[LN:PBP2_ECOLI] [AC:P08150] [GN:MRDA:PBPA] [OR:Escherichia coli]
[DE:PENICILLIN-BINDING PROTEIN 2 (PBP-2)] [SP:P08150] [DB:swissprot]
>sp:[LN:ZPECP2] [AC:C24995:A32257:A64798] [PN:penicillin-binding protein 2]
[GN:mrdA:pbpA] [CL:penicillin-binding protein 3] [OR:Escherichia coli] [DB:pir1]
[MP:15 min] >gp:[GI:d1036268:g1651266] [LN:D90704] [AC:D90704:AB001340]
[PN:Penicillin-binding protein 2 (pbp-2).] [GN:mrdA] [OR:Escherichia coli]
[SR:Escherichia coli(strain:K12) DNA, clone:Kohara clone #169] [DB:genpept-bct1]
[DE:Escherichia coli genomic DNA. (14.3 - 14.7 min).] [NT:ORF_ID:o169#3; similar
to SwissProt Accession] [LE:2564] [RE:4465] [DI:complement] >gp:[GI:g42316]
[LN:ECPBPA] [AC:X04516:D00001:N00001] [PN:penicillin-binding protein 2 (PBP2)]
[GN:pbpA] [OR:Escherichia coli] [DB:genpept-bct1] [DE:E. coli pbpA gene for
penicillin-binding protein (PBP)2.] [SP:P08150] [LE:1035] [RE:2936] [DI:direct]
>gp:[GI:g1778552] [LN:ECU82598] [AC:U82598] [PN:penicillin-binding protein 2]
[GN:pbp2] [OR:Escherichia coli] [DB:genpept-bct1] [DE:Escherichia coli genomic
sequence of minutes 9 to 12.] [LE:106946] [RE:108847] [DI:complement]
>gp:[GI:g1786854] [LN:AE000168] [AC:AE000168:U00096] [PN:cell elongation, e
phase; peptidoglycan] [GN:mrdA] [FN:enzyme; Cell division] [OR:Escherichia coli]
[DB:genpept-bct2] [DE:Escherichia coli K-12 MG1655 section 58 of 400 of the
completegenome.] [NT:f633; 99 pct identical to PBP2_ECOLI SW: P08150;] [LE:4051]
[RE:5952] [DI:complement]

| ORF Name | NT ID | AA ID | NT LN | AA LN | Score | P-value |
|---|---|---|---|---|---|---|
| 23648452_c2_2420 | 2401 | 9572 | 1329 | 442 | 1663 | 5.0e-171 |

Description sp:[LN:MALH_FUSMR] [AC:O06901] [GN:MALH] [OR:Fusobacterium mortiferum]
[EC:3.2.1.122] [DE:GLUCOSIDASE)] [SP:O06901] [DB:swissprot] >gp:[GI:g2145152]
[LN:FMU81185] [AC:U81185] [PN:MalH] [GN:malH] [OR:Fusobacterium mortiferum]
[DB:genpept-bct2] [DE:Fusobacterium mortiferum maltose permease IIB subunit
(malB) gene, partial cds, and maltose 6-P hydrolase (malH) gene, complete cds.]
[NT:6-Phospho-alpha-glucosidase; maltose 6-P hydrolase;] [LE:313] [RE:1638]
[DI:direct]

| ORF_Name | NT ID | AA ID | NT/LN | AA/LN | Score | P-value |
|---|---|---|---|---|---|---|
| 23650131_f3_1404 | 2402 | 9573 | 1641 | 546 | 1239 | 4.2e-126 |

Description sp:[LN:SCRY_SALTY] [AC:P22340] [GN:SCRY] [OR:Salmonella typhimurium] [DE:SUCROSE PORIN PRECURSOR] [SP:P22340] [DB:swissprot] >sp:[LN:A39127] [AC:A39127:S70069] [PN:sucrose porin scrY precursor] [GN:scrY] [OR:Escherichia coli] [DB:pir2] >sp:[LN:S15193] [AC:S15193] [PN:sucrose porin scrY] [GN:scrY] [OR:Salmonella typhimurium] [DB:pir2] >gp:[GI:g48830] [LN:STSCRY] [AC:X57400:S44132] [PN:sucrose porin] [GN:scrY] [OR:Salmonella typhimurium] [DB:genpept-bct1] [DE:S.typhimurium plasmid pUR400 scrY gene for sucrose porin.] [SP:P22340] [LE:133] [RE:1650] [DI:direct] >gp:[GI:g155143] [LN:UR4SCRYA] [AC:M38416] [PN:sucrose porin] [GN:scrY] [OR:Plasmid pUR400] [SR:Plasmid pUR400 (clone: pCH186.) DNA] [DB:genpept-bct1] [DE:Plasmid pUR400 (from S.typhimurium) sucrose porin (scrY) gene,complete cds, and scrA gene, 5' end.] [LE:151] [RE:1668] [DI:direct]

| ORF_Name | NT ID | AA ID | NT/LN | AA/LN | Score | P-value |
|---|---|---|---|---|---|---|
| 23697152_c2_2344 | 2403 | 9574 | 1104 | 367 | | |

Description

NO-HIT

| ORF_Name | NT ID | AA ID | NT/LN | AA/LN | Score | P-value |
|---|---|---|---|---|---|---|
| 23712526_f2_828 | 2404 | 9575 | 1734 | 577 | 512 | 1.4e-55 |

Description gp:[GI:e1345819:g3876095] [LN:CEF18E2] [AC:Z75537] [GN:F18E2.2] [OR:Caenorhabditis elegans] [DB:genpept-inv1] [DE:Caenorhabditis elegans cosmid F18E2, complete sequence.] [NT:Similarity to Yeast ATP-dependent transporter] [LE:7557:8105:8825] [RE:8057:8669:9283] [DI:complementJoin]

| ORF_Name | NT ID | AA ID | NT/LN | AA/LN | Score | P-value |
|---|---|---|---|---|---|---|
| 23719386_c3_2761 | 2405 | 9576 | 942 | 313 | 345 | 2.3e-31 |

Description gp:[GI:e1372804:g4200252] [LN:MLCB1886] [AC:AL035300] [PN:putative LysR-type transcriptional regulator] [GN:MLCB1886.03c] [OR:Mycobacterium leprae] [DB:genpept-bct1] [DE:Mycobacterium leprae cosmid B1886.] [NT:MLCB1886.03c, probable LysR-type transcriptional] [LE:3429] [RE:4361] [DI:complement]

| ORF_Name | NT_ID | AA_ID | NT/LN | AA/LN | Score | P-value |
|---|---|---|---|---|---|---|
| 23720312_f2_488 | 2406 | 9577 | 783 | 260 | 813 | 5.9e-81 |

Description gp:[GI:e1331977:g4106608] [LN:YP102KB] [AC:AL031866] [OR:Yersinia pestis]
[DB:genpept-bct1] [DE:Yersinia pestis 102 kbases unstable region: from 1 to
119443.] [NT:ORF40, len= 256 aa, hypothetical transcriptional] [LE:52041] [RE:52811] [DI:direct]

| ORF Name | NT ID | AA ID | NT LN | AA LN | Score | P-value |
|---|---|---|---|---|---|---|
| 23720643_c1_1585 | 2407 | 9578 | 876 | 291 | 1341 | 6.6e-137 |

Description sp:[LN:PDXY_ECOLI] [AC:P77150] [GN:PDXY] [OR:Escherichia coli] [EC:2.7.1.35] [DE:PYRIDOXAMINE KINASE, (PM KINASE)] [SP:P77150] [DB:swissprot] >sp:[LN:F64920] [AC:F64920] [PN:probable pyridoxal kinase, ydgS] [GN:ydgS] [OR:Escherichia coli] [EC:2.7.1.35] [DB:pir2] >gp:[GI:d1016118:g1742702] [LN:D90807] [AC:D90807:AB001340] [OR:Escherichia coli] [SR:Escherichia coli (strain:K12) DNA, clone_lib:Kohara lambda minise] [DB:genpept-bct1] [DE:E.coli genomic DNA, Kohara clone #316(36.7-37.1 min.).] [NT:ORF_ID:o316#15; similar to [SwissProt Accession] [LE:12632] [RE:13495] [DI:complement] >gp:[GI:g1787924] [LN:AE000259] [AC:AE000259:U00096] [PN:pyridoxal kinase 2 / pyridoxine kinase] [GN:pdxY] [FN:enzyme; Biosynthesis of cofactors, carriers:] [OR:Escherichia coli] [DB:genpept-bct2] [DE:Escherichia coli K-12 MG1655 section 149 of 400 of the completegenome.] [NT:f287; This 287 aa ORF is 51 pct identical (3 gaps)] [LE:2633] [RE:3496] [DI:complement]

| ORF Name | NT ID | AA ID | NT LN | AA LN | Score | P-value |
|---|---|---|---|---|---|---|
| 2386041_c3_2570 | 2408 | 9579 | 966 | 321 | 176 | 2.3e-10 |

Description gp:[GI:g5918498] [LN:SCD25] [AC:AL118514] [PN:ATP-dependent RNA helicase] [GN:SCD25.32] [OR:Streptomyces coelicolor A3(2)] [DB:genpept-bct1] [DE:Streptomyces coelicolor cosmid D25.] [NT:SCD25.32, ATP-dependent RNA helicase, 839 aa.] [LE:38794] [RE:41016] [DI:direct]

| ORF Name | NT ID | AA ID | NT/LN | AA/LN | Score | P-value |
|---|---|---|---|---|---|---|
| 23867202_c1_1562 | 2409 | 9580 | 1167 | 388 | 1696 | 1.6e-174 |

Description sp:[LN:C64923] [AC:C64923] [PN:chloramphenicol resistance protein homolog b1657] [CL:Streptomyces lividans chloramphenicol resistance protein] [OR:Escherichia coli] [DB:pir1] >gp:[GI:d1016144;g1742730] [LN:D90809] [AC:D90809:AB001340] [PN:Protein AraJ precursor.] [OR:Escherichia coli] [SR:Escherichia coli (strain:K12) DNA, clone_lib:Kohara lambda minise] [DB:genpept-bct1] [DE:E.coli genomic DNA, Kohara clone #318(37.2-37.6 min.).] [NT:ORF_ID:o317#13; similar to [SwissProt Accession] [LE:7713] [RE:8882] [DI:complement] >gp:[GI:d1016153;g1742740] [LN:D90810] [AC:D90810:AB001340] [PN:Protein AraJ precursor.] [OR:Escherichia coli] [SR:Escherichia coli (strain:K12) DNA, clone_lib:Kohara lambda minise] [DB:genpept-bct1] [DE:E.coli genomic DNA, Kohara clone #319(37.4-37.8 min.).] [NT:ORF_ID:o317#13; similar to [SwissProt Accession] [LE:107] [RE:1276] [DI:complement] >gp:[GI:g1787947] [LN:AE000261] [AC:AE000261:U00096] [PN:putative transport protein] [GN:b1657] [FN:putative transport; Not classified] [OR:Escherichia coli] [DB:genpept-bct2] [DE:Escherichia coli K-12 MG1655 section 151 of 400 of the completegenome.] [NT:f389; residues 10-254 are 34 pct identical to] [LE:837] [RE:2006] [DI:complement]

| ORF Name | NT ID | AA ID | NT/LN | AA/LN | Score | P-value |
|---|---|---|---|---|---|---|
| 2392793_f2_645 | 2410 | 9581 | 264 | 87 | 83 | 0.011 |

Description sp:[LN:G72329] [AC:G72329] [PN:hypothetical protein TM0820] [GN:TM0820] [CL:lactaldehyde reductase:lactaldehyde reductase homology] [OR:Thermotoga maritima] [DB:pir2] >gp:[GI:g4981351] [LN:AE001749] [AC:AE001749:AE000512] [PN:NADH-dependent butanol dehydrogenase, putative] [GN:TM0820] [OR:Thermotoga maritima] [DB:genpept-bct2] [DE:Thermotoga maritima section 61 of 136 of the complete genome.] [NT:similar to GB:AL009126 percent identity: 68.22;] [LE:4738] [RE:5925] [DI:direct]

| ORF Name | NT ID | AA ID | NT/LN | AA/LN | Score | P-value |
|---|---|---|---|---|---|---|
| 23928415_c3_2765 | 2411 | 9582 | 981 | 326 | 151 | 6.7e-08 |

Description gp:[GI:e1542520:g5830536] [LN:SPAJ6396] [AC:AJ006396] [PN:response regulator] [GN:rr07] [OR:Streptococcus pneumoniae] [DB:genpept-bct1] [DE:Streptococcus pneumoniae rr07 and hk07 genes; two component system07.] [LE:729] [RE:2015] [DI:direct]

| ORF Name | NT ID | AA ID | NT/LN | AA/LN | Score | P-value |
|---|---|---|---|---|---|---|
| 24016887_c3_3037 | 2412 | 9583 | 1227 | 408 | 1495 | 3.2e-153 |

Description sp:[LN:YDEE_ECOLI] [AC:P31126:P31127:P76151] [GN:YDEE] [OR:Escherichia coli]
[DE:HYPOTHETICAL 42.7 KD PROTEIN IN MARB-DCP INTERGENIC REGION]
[SP:P31126:P31127:P76151] [DB:swissprot] >sp:[LN:A64908] [AC:A64908] [PN:membrane
protein ydeE] [GN:ydeE] [OR:Escherichia coli] [DB:pir2] >gp:[GI:g1787815]
[LN:AE000251] [AC:AE000251:U00096] [PN:putative transport protein] [GN:ydeF]
[FN:putative transport; Not classified] [OR:Escherichia coli] [DB:genpept-bct2]
[DE:Escherichia coli K-12 MG1655 section 141 of 400 of the completegenome.]
[NT:o395; residues 157-395 are 100 pct identical] [LE:147] [RE:1334] [DI:direct]

| ORF Name | NT ID | AA ID | NT/LN | AA/LN | Score | P-value |
|---|---|---|---|---|---|---|
| 24025056_f2_745 | 2413 | 9584 | 1278 | 425 | 1287 | 3.5e-131 |

Description sp:[LN:D69803] [AC:D69803] [PN:hypothetical protein yfiI] [GN:yfiI] [OR:Bacillus
subtilis] [DB:pir2] >gp:[GI:e1182818:g2633152] [LN:BSUB0005] [AC:Z99108:AL009126]
[GN:yfiI] [FN:unknown] [OR:Bacillus subtilis] [DB:genpept-bct1] [DE:Bacillus
subtilis complete genome (section 5 of 21): from 802821 to1011250.] [LE:99192]
[RE:100373] [DI:direct] >gp:[GI:d1012064:g1817533] [LN:D78508] [AC:D78508]
[PN:YfiI] [OR:Bacillus subtilis] [SR:Bacillus subtilis (strain:AC327) DNA]
[DB:genpept-bct1] [DE:Bacillus subtilis DNA for YfiO, YfiP, YfiN, YfiM, YfiL,
YfiK, YfiJ,YfiI, YfiH, complete cds.] [LE:1068] [RE:2249] [DI:direct]

| ORF Name | NT ID | AA ID | NT/LN | AA/LN | Score | P-value |
|---|---|---|---|---|---|---|
| 24084583_f3_1248 | 2414 | 9585 | 864 | 287 | 192 | 3.8e-15 |

Description sp:[LN:H69217] [AC:H69217] [PN:hypothetical protein MTH882] [GN:MTH882]
[CL:hypothetical protein HI0902] [OR:Methanobacterium thermoautotrophicum]
[DB:pir2] >gp:[GI:g2621976] [LN:AE000864] [AC:AE000864:AE000666] [PN:conserved
protein] [GN:MTH882] [OR:Methanobacterium thermoautotrophicum] [DB:genpept-bct2]
[DE:Methanobacterium thermoautotrophicum from bases 797757 to 808996(section 70
of 148) of the complete genome.] [NT:Function Code:14.01 - Unknown, Conserved
protein;] [LE:4031] [RE:4816] [DI:complement]

| ORF_Name | NT_ID | AA_ID | NT/LN | AA/LN | Score | P-value |
|---|---|---|---|---|---|---|
| 24088507_c2_2292 | 2415 | 9586 | 1434 | 477 | 1043 | 2.5e-105 |

Description sp:[LN:H64883] [AC:H64883] [PN:conserved hypothetical protein b1341]
[OR:Escherichia coli] [DB:pir2] >gp:[GI:d1015661:g1742211] [LN:D90773]
[AC:D90773:AB001340] [GN:yhcK] [OR:Escherichia coli] [SR:Escherichia coli
(strain:K12) DNA, clone_lib:Kohara lambda minise] [DB:genpept-bct1] [DE:E.coli
genomic DNA, Kohara clone #262(30.3-30.5 min.).] [NT:ORF_ID:o262#1; similar to
[SwissProt Accession] [LE:2362] [RE:3654] [DI:complement] >gp:[GI:g1787603]
[LN:AE000232] [AC:AE000232:U00096] [PN:orf, hypothetical protein] [GN:b1341]
[FN:orf; Unknown] [OR:Escherichia coli] [DB:genpept-bct2] [DE:Escherichia coli
K-12 MG1655 section 122 of 400 of the completegenome.] [NT:f430; This 430 aa ORF
is 31 pct identical (7 gaps)] [LE:1933] [RE:3225] [DI:complement]

| ORF_Name | NT_ID | AA_ID | NT/LN | AA/LN | Score | P-value |
|---|---|---|---|---|---|---|
| 24104686_c1_1853 | 2416 | 9587 | 1341 | 446 | 867 | 1.1e-86 |

Description sp:[LN:C70518] [AC:C70518] [PN:probable nanT protein] [GN:nanT] [OR:Mycobacterium
tuberculosis] [DB:pir2] >gp:[GI:e324867:g2225958] [LN:MTCY180]
[AC:Z97193:AL123456] [PN:nanT] [GN:nanT] [OR:Mycobacterium tuberculosis]
[DB:genpept-bct1] [DE:Mycobacterium tuberculosis H37Rv complete genome; segment
85/162.] [NT:Rv1902c, (MTCY180.16), len: 422. Unknown] [LE:25855] [RE:27123]
[DI:complement]

| ORF_Name | NT_ID | AA_ID | NT/LN | AA/LN | Score | P-value |
|---|---|---|---|---|---|---|
| 24260181_c1_1904 | 2417 | 9588 | 1221 | 406 | 753 | 1.3e-74 |

Description sp:[LN:JQ0614] [AC:JQ0614:H65101] [PN:yhaD protein:hypothetical protein 3]
[GN:yhaD] [CL:yhaD protein] [OR:Escherichia coli] [DB:pir2] [MP:68 min]
>gp:[GI:d1014944:g216633] [LN:ECORNPBW] [AC:D90212] [OR:Escherichia coli]
[SR:E.coli (strain K12; isolate W3110)genomic DNA, clone 6B5(#515) fro]
[DB:genpept-bct1] [DE:E.coli rnpB gene and ORFs.] [NT:ORF3] [LE:1443] [RE:2669]
[DI:direct] >gp:[GI:g1789512] [LN:AE000394] [AC:AE000394:U00096] [PN:orf,
hypothetical protein] [GN:yhaD] [FN:orf; Unknown] [OR:Escherichia coli]
[DB:genpept-bct2] [DE:Escherichia coli K-12 MG1655 section 284 of 400 of the
completegenome.] [NT:f408; 100 pct identical amino acid sequence and] [LE:1023]
[RE:2249] [DI:complement] >gp:[GI:g606064] [LN:ECOUW67] [AC:U18997]
[OR:Escherichia coli] [DB:genpept-bct2] [DE:Escherichia coli K-12 chromosomal
region from 67.4 to 76.0 minutes.] [NT:ORF_f408] [LE:51378] [RE:52604]
[DI:complement]

| ORF Name | NT ID | AA ID | NT LN | AA LN | Score | P-value |
|---|---|---|---|---|---|---|
| 24308517_f1_120 | 2418 | 9589 | 249 | 82 | 85 | 0.0025 |

Description sp:[LN:DEOC_AQUAE] [AC:O66540] [GN:DEOC] [OR:Aquifex aeolicus] [EC:4.1.2.4] [DE:(DEOXYRIBOALDOLASE)] [SP:O66540] [DB:swissprot] >sp:[LN:A70314] [AC:A70314] [PN:deoxyribose-phosphate aldolase] [GN:deoC] [CL:deoxyribose-phosphate aldolase] [OR:Aquifex aeolicus] [DB:pir2] >gp:[GI:g2982875] [LN:AE000675] [AC:AE000675:AE000657] [PN:deoxyribose-phosphate aldolase] [GN:deoC] [OR:Aquifex aeolicus] [DB:genpept-bct2] [DE:Aquifex aeolicus section 7 of 109 of the complete genome.] [LE:12162] [RE:12821] [DI:direct]

| ORF Name | NT ID | AA ID | NT LN | AA LN | Score | P-value |
|---|---|---|---|---|---|---|
| 24312805_c3_2659 | 2419 | 9590 | 966 | 321 | 232 | 2.2e-19 |

Description gp:[GI:g2108229] [LN:LFU97348] [AC:U97348] [PN:basic surface protein] [FN:L-cystine transporter] [OR:Lactobacillus fermentum] [DB:genpept-bct2] [DE:Lactobacillus fermentum cystathionine gamma-lyase homolog gene,partial cds; and integral membrane protein homolog, ATP-bindingprotein homolog, basic surface protein, and unknown hydrophobicprotein genes, complete cds.] [NT:BspA; similar to family III solute binding] [LE:1624] [RE:2418] [DI:direct]

| ORF Name | NT ID | AA ID | NT LN | AA LN | Score | P-value |
|---|---|---|---|---|---|---|
| 24408333_f3_1395 | 2420 | 9591 | 672 | 223 | 124 | 2.0e-07 |

Description gp:[GI:g1245105] [LN:MMU46463] [AC:U46463] [PN:glutamine repeat protein-1] [OR:Mus musculus] [SR:house mouse] [DB:genpept-rod] [DE:Mus musculus glutamine repeat protein-1 mRNA, complete cds.] [NT:GRP-1] [LE:181] [RE:696] [DI:direct]

| ORF Name | NT ID | AA ID | NT LN | AA LN | Score | P-value |
|---|---|---|---|---|---|---|
| 24416078_c3_2798 | 2421 | 9592 | 1215 | 404 | 195 | 4.4e-13 |

Description gp:[GI:e1392649:g4539584] [LN:SCH5] [AC:AL035636] [PN:putative hydrolase] [GN:SCH5.29] [OR:Streptomyces coelicolor] [DB:genpept-bct1] [DE:Streptomyces coelicolor cosmid H5.] [NT:SCH5.29, possible hydrolase, len: 324aa; similar to] [LE:38017] [RE:38991] [DI:direct]

| ORF Name | NT ID | AA ID | NT LN | AA LN | Score | P-value |
|---|---|---|---|---|---|---|
| 24429011_f1_447 | 2422 | 9593 | 639 | 212 | 793 | 7.7e-79 |

Description sp:[LN:GT_ECOLI] [AC:P39100] [GN:GST] [OR:Escherichia coli] [EC:2.5.1.18]
[DE:GLUTATHIONE S-TRANSFERASE,] [SP:P39100] [DB:swissprot] >sp:[LN:A55495]
[AC:A55495:E64920] [PN:glutathione transferase,] [GN:gst] [CL:glutathione
transferase] [OR:Escherichia coli] [EC:2.5.1.18] [DB:pir2]
>gp:[GI:d1016117:g1742701] [LN:D90807] [AC:D90807:AB001340] [PN:Glutathione
s-transferase (EC 2.5.1.18).] [GN:gst] [OR:Escherichia coli] [SR:Escherichia coli
(strain:K12) DNA, clone_lib:Kohara lambda minise] [DB:genpept-bct1] [DE:E.coli
genomic DNA, Kohara clone #316(36.7-37.1 min.).] [NT:ORF_ID:o316#14; similar to
[SwissProt Accession] [LE:11983] [RE:12588] [DI:direct]
>gp:[GI:d1008090:g1213565] [LN:ECOGST] [AC:D38497] [PN:glutathione transferase]
[OR:Escherichia coli] [SR:Escherichia coli (strain K12, sub_strain W3110)
(library: Kohara'] [DB:genpept-bct1] [EC:2.5.1.18] [DE:Escherichia coli gene for
glutathione transferase, complete cds.] [LE:140] [RE:745] [DI:direct]
>gp:[GI:g1787923] [LN:AE000259] [AC:AE000259:U00096] [PN:glutathione
S-transferase] [GN:gst] [FN:enzyme; Biosynthesis of cofactors, carriers:]
[OR:Escherichia coli] [DB:genpept-bct2] [EC:2.5.1.18] [DE:Escherichia coli K-12
MG1655 section 149 of 400 of the completegenome.] [NT:o201; 100 pct identical to
GT_ECOLI SW: P39100] [LE:1984] [RE:2589] [DI:direct]

| ORF Name | NT ID | AA ID | NT LN | AA LN | Score | P-value |
|---|---|---|---|---|---|---|
| 24432132_f1_98 | 2423 | 9594 | 918 | 305 | 565 | 1.1e-54 |

Description gp:[GI:g3419687] [LN:ASU77659] [AC:U77659] [PN:unknown] [OR:Acinetobacter lwoffii
K24] [DB:genpept-bct2] [DE:Acinetobacter lwoffii K24 cic,cis-muconate lactonizing
enzyme I(catB), catechol 1,2-dioxygenase (catA), and muconolactoneisomerase
(catC) genes, complete cds; and unknown genes.] [LE:4104] [RE:4994]
[DI:complement]

| ORF Name | NT ID | AA ID | NT LN | AA LN | Score | P-value |
|---|---|---|---|---|---|---|
| 24432826_c3_2885 | 2424 | 9595 | 282 | 93 | 116 | 4.2e-07 |

Description sp:[LN:PTXB_ECOLI] [AC:P39302] [GN:SGAB] [OR:Escherichia coli] [EC:2.7.1.69]
[DE:(EC 2.7.1.69)] [SP:P39302] [DB:swissprot] >sp:[LN:S56419] [AC:S56419:E65230]
[PN:hypothetical 10.9K protein (aidB-rpsF intergenic region):hypothetical protein
o101] [GN:yjfT] [OR:Escherichia coli] [DB:pir2] >gp:[GI:g537035] [LN:ECOUW93]
[AC:U14003] [OR:Escherichia coli] [DB:genpept-bct1] [DE:Escherichia coli K-12
chromosomal region from 92.8 to 00.1 minutes.] [NT:ORF_o101] [LE:112224]
[RE:112529] [DI:direct] >gp:[GI:g1790638] [LN:AE000491] [AC:AE000491:U00096]
[PN:orf, hypothetical protein] [GN:sgaB] [FN:orf; Unknown] [OR:Escherichia coli]
[DB:genpept-bct2] [DE:Escherichia coli K-12 MG1655 section 381 of 400 of the
completegenome.] [NT:o101; formerly designated yjfT] [LE:5059] [RE:5364]
[DI:direct]

| ORF Name | NT ID | AA ID | NT LN | AA LN | Score | P-value |
|---|---|---|---|---|---|---|
| 24479627_c1_1651 | 2425 | 9596 | 255 | 84 | 311 | 9.2e-28 |

Description sp:[LN:YDCY_ECOLI] [AC:P76110] [GN:YDCY] [OR:Escherichia coli] [DE:HYPOTHETICAL 8.8 KD PROTEIN IN TEHB-ANSP INTERGENIC REGION] [SP:P76110] [DB:swissprot] >sp:[LN:A64897] [AC:A64897] [PN:hypothetical protein b1446] [OR:Escherichia coli] [DB:pir2] >gp:[GI:g1787717] [LN:AE000241] [AC:AE000241:U00096] [PN:orf, hypothetical protein] [GN:b1446] [FN:orf; Unknown] [OR:Escherichia coli] [DB:genpept-bct2] [DE:Escherichia coli K-12 MG1655 section 131 of 400 of the completegenome.] [NT:o77; This 77 aa ORF is 30 pct identical (0 gaps)] [LE:8890] [RE:9123] [DI:direct]

| ORF Name | NT ID | AA ID | NT LN | AA LN | Score | P-value |
|---|---|---|---|---|---|---|
| 2449028_c3_2955 | 2426 | 9597 | 288 | 95 | 112 | 5.2e-06 |

Description gp:[GI:g2738251] [LN:SEU97227] [AC:U97227] [PN:IroE] [GN:iroE] [OR:Salmonella enterica] [DB:genpept-bct2] [DE:Salmonella enterica ferric enterochelin esterase homolog (iroD),IroE (iroE) and TonB dependent outer membrane siderophore receptorprotein (iroN) genes, complete cds.] [LE:1312] [RE:2229] [DI:direct]

| ORF Name | NT ID | AA ID | NT LN | AA LN | Score | P-value |
|---|---|---|---|---|---|---|
| 24650311_c1_2020 | 2427 | 9598 | 192 | 63 | | |

Description

NO-HIT

| ORF Name | NT ID | AA ID | NT LN | AA LN | Score | P-value |
|---|---|---|---|---|---|---|
| 24712641_c1_1624 | 2428 | 9599 | 708 | 235 | 853 | 3.4e-85 |

Description sp:[LN:B64895] [AC:B64895] [PN:hypothetical protein b1431] [CL:Escherichia coli hypothetical protein b1431] [OR:Escherichia coli] [DB:pir2] >gp:[GI:g1787701] [LN:AE000240] [AC:AE000240:U00096] [PN:orf, hypothetical protein] [GN:b1431] [FN:orf; Unknown] [OR:Escherichia coli] [DB:genpept-bct2] [DE:Escherichia coli K-12 MG1655 section 130 of 400 of the completegenome.] [NT:o222; This 222 aa ORF is 21 pct identical (5 gaps)] [LE:3816] [RE:4484] [DI:direct]

| ORF Name | NT ID | AA ID | NT LN | AA LN | Score | P-value |
|---|---|---|---|---|---|---|
| 24728958_c3_2694 | 2429 | 9600 | 1539 | 512 | 1496 | 2.5e-153 |

Description sp:[LN:XYLX_PSEPU] [AC:P23099] [GN:XYLX] [OR:Pseudomonas putida] [EC:1.14.12.-]
[DE:TOLUATE 1,2-DIOXYGENASE ALPHA SUBUNIT,] [SP:P23099] [DB:swissprot]
>sp:[LN:A41659] [AC:S23482:A41659:A24954] [PN:benzoate 1,2-dioxygenase, Rieske
iron-sulfur component:hypothetical protein xylDEGF operon promoter region]
[GN:xylX] [CL:Rieske [2Fe-2S] homology] [OR:Pseudomonas putida] [EC:1.14.12.10]
[DB:pir2] >gp:[GI:g151719] [LN:PWWXYL] [AC:M64747] [PN:toluate 1,2-dioxygenase
subunit] [GN:xylX] [OR:Plasmid pWW0] [SR:Plasmid pWW0, DNA] [DB:genpept-bct1]
[DE:Pseudomonas putida plasmid pWW0 meta operon, 5' genes.] [LE:469] [RE:1833]
[DI:direct]

| ORF Name | NT ID | AA ID | NT LN | AA LN | Score | P-value |
|---|---|---|---|---|---|---|
| 24823556_f2_507 | 2430 | 9601 | 1590 | 529 | 376 | 5.6e-77 |

Description sp:[LN:S77534] [AC:S77534] [PN:high-affinity branched-chain amino acid transport
protein livH:protein slr1200] [GN:livH] [OR:Synechocystis sp.]
[SR:PCC 6803, , PCC 6803] [SR:PCC 6803, ] [DB:pir2] >gp:[GI:d1018114:g1652459]
[LN:D90905] [AC:D90905:AB001339] [PN:high-affinity branched-chain amino acid]
[GN:livH] [OR:Synechocystis sp.] [SR:Synechocystis sp. (strain:PCC6803) DNA]
[DB:genpept-bct1] [DE:Synechocystis sp. PCC6803 complete genome, 7/27,
781449-920915.] [NT:ORF_ID:slr1200] [LE:100575] [RE:101741] [DI:direct]

| ORF Name | NT ID | AA ID | NT LN | AA LN | Score | P-value |
|---|---|---|---|---|---|---|
| 24848906_c1_1638 | 2431 | 9602 | 954 | 317 | 1385 | 1.4e-141 |

Description sp:[LN:E64896] [AC:E64896] [PN:probable membrane protein b1442] [OR:Escherichia
coli] [DB:pir2] >gp:[GI:d1015790:g1742350] [LN:D90783] [AC:D90783:AB001340]
[PN:Putrescine transport system permease protein] [OR:Escherichia coli]
[SR:Escherichia coli (strain:K12) DNA, clone_lib:Kohara lambda minise]
[DB:genpept-bct1] [DE:E.coli genomic DNA, Kohara clone #272(32.4-32.7 min.).]
[NT:ORF_ID:o272#7; similar to [SwissProt Accession] [LE:12211] [RE:13152]
[DI:direct] >gp:[GI:d1015796:g1742357] [LN:D90784] [AC:D90784:AB001340]
[PN:Putrescine transport system permease protein] [OR:Escherichia coli]
[SR:Escherichia coli (strain:K12) DNA, clone_lib:Kohara lambda minise]
[DB:genpept-bct1] [DE:E.coli genomic DNA, Kohara clone #273(32.5-32.8 min.).]
[NT:ORF_ID:o272#7; similar to [SwissProt Accession] [LE:5869] [RE:6810]
[DI:direct] >gp:[GI:g1787713] [LN:AE000241] [AC:AE000241:U00096] [PN:putative
transport system permease protein] [GN:b1442] [FN:putative transport; Not
classified] [OR:Escherichia coli] [DB:genpept-bct2] [DE:Escherichia coli K-12
MG1655 section 131 of 400 of the completegenome.] [NT:o313; This 313 aa ORF is 28
pct identical (18 gaps)] [LE:5073] [RE:6014] [DI:direct]

| ORF_Name | NT_ID | AA_ID | NT LN | AA LN | Score | P-value |
|---|---|---|---|---|---|---|
| 24870658_c3_2988 | 2432 | 9603 | 288 | 95 | 126 | 1.4e-07 |

Description sp:[LN:GLTR_BACSU] [AC:P94501:O07083] [GN:GLTR] [OR:Bacillus subtilis] [DE:TRANSCRIPTIONAL REGULATORY PROTEIN GLTR] [SP:P94501:O07083] [DB:swissprot] >gp:[GI:g1710375] [LN:BSU79494] [AC:U79494] [PN:GltR] [GN:gltR] [FN:LysR-type transcription regulator] [OR:Bacillus subtilis] [DB:genpept-bct1] [DE:Bacillus subtilis BrnQ (brnQ), Orf105 (orf105), LysR-typetranscription regulator GltR (gltR) and Orf129 (orf129) genes,complete cds.] [LE:1852] [RE:2742] [DI:complement]

| ORF_Name | NT_ID | AA_ID | NT LN | AA LN | Score | P-value |
|---|---|---|---|---|---|---|
| 24881526_c2_2402 | 2433 | 9604 | 753 | 250 | 542 | 3.1e-52 |

Description gp:[GI:g1502421] [LN:BSU59433] [AC:U59433] [PN:3-ketoacyl-acyl carrier protein reductase] [GN:fabG] [OR:Bacillus subtilis] [DB:genpept-bct2] [DE:Bacillus subtilis PlsX (plsX), malonyl-CoA:Acyl carrier proteintransacylase (fabD) and 3-ketoacyl-acyl carrier protein reductase(fabG) genes, complete cds, and acyl carrier protein (acpP) gene,partial cds.] [NT:also called 3-oxoacyl-acyl carrier protein] [LE:1813] [RE:2553] [DI:direct]

| ORF_Name | NT_ID | AA_ID | NT LN | AA LN | Score | P-value |
|---|---|---|---|---|---|---|
| 24882136_f3_1216 | 2434 | 9605 | 996 | 331 | 225 | 3.6e-24 |

Description sp:[LN:C70700] [AC:C70700] [PN:hypothetical protein Rv0021c] [GN:Rv0021c] [OR:Mycobacterium tuberculosis] [DB:pir2] >gp:[GI:e267388:g1552576] [LN:MTCY10H4] [AC:Z80233:AL123456] [PN:hypothetical protein Rv0021c] [GN:Rv0021c] [OR:Mycobacterium tuberculosis] [DB:genpept-bct1] [DE:Mycobacterium tuberculosis H37Rv complete genome; segment 2/162.] [NT:Rv0021c, (MTCY10H4.21c), len: 322, similar to] [LE:22653] [RE:23621] [DI:complement]

| ORF_Name | NT_ID | AA_ID | NT/LN | AA/LN | Score | P-value |
|---|---|---|---|---|---|---|
| 25394452_c1_1674 | 2435 | 9606 | 1122 | 373 | 911 | 2.4e-91 |

Description sp:[LN:YXEP_BACSU] [AC:P54955] [GN:YXEP:LP9H] [OR:Bacillus subtilis]
[DE:HYPOTHETICAL 41.6 KD PROTEIN IN IDH-DEOR INTERGENIC REGION] [SP:P54955]
[DB:swissprot] >sp:[LN:B70076] [AC:B70076] [PN:aminoacylase homolog yxeP]
[GN:yxeP] [CL:hippurate hydrolase] [OR:Bacillus subtilis] [DB:pir2]
>gp:[GI:e1184672:g2636493] [LN:BSUB0021] [AC:Z99124:AL009126] [GN:yxeP]
[FN:unknown] [OR:Bacillus subtilis] [DB:genpept-bct1] [DE:Bacillus subtilis
complete genome (section 21 of 21): from 3999281to 4214814.] [NT:similar to
aminoacylase] [SP:P54955] [LE:56380] [RE:57522] [DI:complement]
>gp:[GI:d1008928:g1408501] [LN:D45912] [AC:D45912] [GN:yxeP] [OR:Bacillus
subtilis] [SR:Bacillus subtilis (strain:BGSC 1A1 (Marburg 168; trpC2)) DNA]
[DB:genpept-bct1] [DE:Bacillus subtilis genome sequence between the iol and hut
operon,partial and complete cds.] [NT:homologous to N-acyl-L-amino acid
amidohydrolase of] [LE:13954] [RE:15096] [DI:direct]

| ORF_Name | NT_ID | AA_ID | NT/LN | AA/LN | Score | P-value |
|---|---|---|---|---|---|---|
| 25475053_c2_2119 | 2436 | 9607 | 285 | 94 | | |

Description

NO-HIT

| ORF_Name | NT_ID | AA_ID | NT/LN | AA/LN | Score | P-value |
|---|---|---|---|---|---|---|
| 25494003_c1_1782 | 2437 | 9608 | 636 | 211 | 192 | 3.8e-15 |

Description sp:[LN:YEAS_ECOLI] [AC:P76249:O07971:O07969] [GN:YEAS] [OR:Escherichia coli]
[DE:HYPOTHETICAL 23.2 KD PROTEIN IN GAPA-RND INTERGENIC REGION]
[SP:P76249:O07971:O07969] [DB:swissprot] >sp:[LN:F64940] [AC:F64940]
[PN:hypothetical protein b1798] [CL:hypothetical protein b1798] [OR:Escherichia
coli] [DB:pir2] >gp:[GI:d1016317:g1736421] [LN:D90823] [AC:D90823:AB001340]
[OR:Escherichia coli] [SR:Escherichia coli (strain:K12) DNA, clone_lib:Kohara
lambda minise] [DB:genpept-bct1] [DE:E.coli genomic DNA, Kohara clone
332(40.4-40.7 min.).] [NT:ORF_ID:o332#6; similar to [SwissProt Accession]
[LE:6317] [RE:6955] [DI:complement] >gp:[GI:d1016326:g1736431] [LN:D90824]
[AC:D90824:AB001340] [OR:Escherichia coli] [SR:Escherichia coli (strain:K12) DNA,
clone_lib:Kohara lambda minise] [DB:genpept-bct1] [DE:E.coli genomic DNA, Kohara
clone #333(40.5-40.8 min.).] [NT:ORF_ID:o332#6; similar to [SwissProt Accession]
[LE:1787] [RE:2425] [DI:complement] >gp:[GI:g1788099] [LN:AE000274]
[AC:AE000274:U00096] [PN:orf, hypothetical protein] [GN:yeaS] [FN:orf; Unknown]
[OR:Escherichia coli] [DB:genpept-bct2] [DE:Escherichia coli K-12 MG1655 section
164 of 400 of the completegenome.] [NT:f212; This 212 aa ORF is 50 pct identical
(4 gaps)] [LE:5860] [RE:6498] [DI:complement]

| ORF Name | NT ID | AA ID | NT/LN | AA/LN | Score | P-value |
|---|---|---|---|---|---|---|
| 25503216_f3_1464 | 2438 | 9609 | 1218 | 405 | | |

Description

NO-HIT

| ORF Name | NT ID | AA ID | NT/LN | AA/LN | Score | P-value |
|---|---|---|---|---|---|---|
| 25507961_f3_1421 | 2439 | 9610 | 1473 | 490 | 2300 | 1.6e-238 |

Description sp:[LN:ANSP_SALTY] [AC:P40812] [GN:ANSP] [OR:Salmonella typhimurium]
[DE:L-ASPARAGINE PERMEASE (L-ASPARAGINE TRANSPORT PROTEIN)] [SP:P40812]
[DB:swissprot] >gp:[GI:g458243] [LN:SEANSP] [AC:U04851] [PN:L-asparagine
permease] [GN:ansP] [OR:Salmonella enterica] [DB:genpept-bct1] [DE:Salmonella
enterica SA2656 L-asparagine permease (ansP) gene,complete cds.] [LE:311]
[RE:1804] [DI:direct]

| ORF Name | NT ID | AA ID | NT/LN | AA/LN | Score | P-value |
|---|---|---|---|---|---|---|
| 25526032_f1_153 | 2440 | 9611 | 696 | 231 | 149 | 1.4e-10 |

Description gp:[GI:g3293540] [LN:AF072709] [AC:AF072709] [PN:putative transcriptional
regulator] [OR:Streptomyces lividans] [DB:genpept-bct2] [DE:Streptomyces lividans
amplifiable element AUD4: putativetranscriptional regulator, putative ferredoxin,
putative cytochromeP450 oxidoreductase, and putative oxidoreductase genes,
completecds; and unknown genes.] [NT:ORF2; similar to transcriptional repressor]
[LE:827] [RE:1405] [DI:direct]

| ORF_Name | NT_ID | AA_ID | NT/LN | AA/LN | Score | P-value |
|---|---|---|---|---|---|---|
| 25564535_c1_1553 | 2441 | 9612 | 666 | 221 | 943 | 9.8e-95 |

Description sp:[LN:RISA_ECOLI] [AC:P29015] [GN:RIBE:RIBC] [OR:Escherichia coli] [EC:2.5.1.9]
[DE:RIBOFLAVIN SYNTHASE ALPHA CHAIN,] [SP:P29015] [DB:swissprot] >sp:[LN:S28526]
[AC:S28526:H64923] [PN:riboflavin synthase, alpha chain] [GN:ribE:ribC]
[CL:riboflavin synthase alpha chain] [OR:Escherichia coli] [EC:2.5.1.9] [DB:pir2]
>gp:[GI:d1016150:g1742736] [LN:D90809] [AC:D90809:AB001340] [PN:Riboflavin
synthase a chain (EC 2.5.1.9).] [GN:ribE, ribC] [OR:Escherichia coli]
[SR:Escherichia coli (strain:K12) DNA, clone_lib:Kohara lambda minise]
[DB:genpept-bct1] [DE:E.coli genomic DNA, Kohara clone #318(37.2-37.6 min.).]
[NT:ORF_ID:o319#6; similar to [SwissProt Accession] [LE:14194] [RE:14835]
[DI:complement] >gp:[GI:d1016159:g1742746] [LN:D90810] [AC:D90810:AB001340]
[PN:Riboflavin synthase a chain (EC 2.5.1.9).] [GN:ribE, ribC] [OR:Escherichia
coli] [SR:Escherichia coli (strain:K12) DNA, clone_lib:Kohara lambda minise]
[DB:genpept-bct1] [DE:E.coli genomic DNA, Kohara clone #319(37.4-37.8 min.).]
[NT:ORF_ID:o319#6; similar to [SwissProt Accession] [LE:6588] [RE:7229]
[DI:complement] >gp:[GI:g42740] [LN:ECRIBC] [AC:X69109:X79488] [PN:riboflavin
synthase] [GN:ribC] [OR:Escherichia coli] [DB:genpept-bct1] [EC:2.5.1.9]
[DE:E.coli ribC gene for riboflavin synthase.] [SP:P29015] [LE:905] [RE:1546]
[DI:direct] >gp:[GI:g1549275] [LN:ECU68703] [AC:U68703] [PN:riboflavin synthase,
alpha chain] [GN:ribC] [OR:Escherichia coli] [DB:genpept-bct1] [EC:2.5.1.9]
[DE:Escherichia coli K-12 MG1655 genome, ribC-pykF region.] [NT:CG Site Number
11923] [LE:5] [RE:646] [DI:complement] >gp:[GI:g1787952] [LN:AE000261]
[AC:AE000261:U00096] [PN:riboflavin synthase, alpha chain] [FN:enzyme;
Biosynthesis of cofactors, carriers:] [OR:Escherichia coli] [DB:genpept-bct2]
[EC:2.5.1.9] [DE:Escherichia coli K-12 MG1655 section 151 of 400 of the
completegenome.] [NT:f213; 100 pct identical to RISA_ECOLI SW: P29015;] [LE:7317]
[RE:7958] [DI:complement]

| ORF_Name | NT_ID | AA_ID | NT/LN | AA/LN | Score | P-value |
|---|---|---|---|---|---|---|
| 25650192_c3_2862 | 2442 | 9613 | 1380 | 459 | 714 | 1.8e-70 |

Description sp:[LN:AMB1_BACST] [AC:P37113:P94345] [GN:AMAB] [OR:Bacillus stearothermophilus]
[EC:3.5.1.-] [DE:N-CARBAMYL-L-AMINO ACID AMIDOHYDROLASE,] [SP:P37113:P94345]
[DB:swissprot] >gp:[GI:e276376:g1842192] [LN:BSAMAB] [AC:Y08752]
[PN:N-carbamyl-L-amino acid amidohydrolase] [GN:amaB] [OR:Bacillus
stearothermophilus] [DB:genpept-bct1] [EC:3.5.1.6] [DE:B.stearothermophilus amaB
gene.] [SP:P37113] [LE:348] [RE:>1577] [DI:direct]

| ORF Name | NT ID | AA ID | NT/LN | AA/LN | Score | P-value |
|---|---|---|---|---|---|---|
| 25667061_c1_1738 | 2443 | 9614 | 618 | 205 | 380 | 4.5e-35 |

Description sp:[LN:IPYR_AQUAE] [AC:O67501] [GN:PPA] [OR:Aquifex aeolicus] [EC:3.6.1.1]
[DE:HYDROLASE] (PPASE)] [SP:O67501] [DB:swissprot] >sp:[LN:C70434] [AC:C70434]
[PN:inorganic pyrophosphatase] [GN:ppa] [CL:inorganic pyrophosphatase]
[OR:Aquifex aeolicus] [DB:pir2] >gp:[GI:g2983913] [LN:AE000745]
[AC:AE000745:AE000657] [PN:inorganic pyrophosphatase] [GN:ppa] [OR:Aquifex
aeolicus] [DB:genpept-bct2] [DE:Aquifex aeolicus section 77 of 109 of the
complete genome.] [LE:5378] [RE:5914] [DI:complement]

| ORF Name | NT ID | AA ID | NT/LN | AA/LN | Score | P-value |
|---|---|---|---|---|---|---|
| 25671965_f3_1500 | 2444 | 9615 | 597 | 198 | 895 | 1.2e-89 |

Description sp:[LN:YDGM_ECOLI] [AC:P77223] [GN:YDGM] [OR:Escherichia coli] [DE:PUTATIVE
FERREDOXIN-LIKE PROTEIN IN ADD-NTH INTERGENIC REGION] [SP:P77223] [DB:swissprot]
>sp:[LN:F64919] [AC:F64919] [PN:probable iron-sulfur protein b1628 precursor:rnfB
protein homolog] [CL:conserved hypothetical protein HI1684:ferredoxin 2[4Fe-4S]
homology] [OR:Escherichia coli] [DB:pir2] >gp:[GI:d1016104:g1742687] [LN:D90806]
[AC:D90806:AB001340] [PN:Ferredoxin II.] [OR:Escherichia coli] [SR:Escherichia
coli (strain:K12) DNA, clone_lib:Kohara lambda minise] [DB:genpept-bct1]
[DE:E.coli genomic DNA, Kohara clone #315(36.6-36.9 min.).] [NT:ORF_ID:o316#4;
similar to [SwissProt Accession] [LE:9344] [RE:9922] [DI:direct]
>gp:[GI:d1016111:g1742695] [LN:D90807] [AC:D90807:AB001340] [PN:Ferredoxin II.]
[OR:Escherichia coli] [SR:Escherichia coli (strain:K12) DNA, clone_lib:Kohara
lambda minise] [DB:genpept-bct1] [DE:E.coli genomic DNA, Kohara clone
316(36.7-37.1 min.).] [NT:ORF_ID:o316#4; similar to [SwissProt Accession]
[LE:3954] [RE:4532] [DI:direct] >gp:[GI:d1016134:g1742719] [LN:D90808]
[AC:D90808:AB001340] [PN:Ferredoxin II.] [OR:Escherichia coli] [SR:Escherichia
coli (strain:K12) DNA, clone_lib:Kohara lambda minise] [DB:genpept-bct1]
[DE:E.coli genomic DNA, Kohara clone #317(36.6-36.9 min.).] [NT:ORF_ID:o316#4;
similar to [SwissProt Accession] [LE:9445] [RE:10023] [DI:direct]
>gp:[GI:g1787915] [LN:AE000258] [AC:AE000258:U00096] [PN:orf, hypothetical
protein] [GN:b1628] [FN:orf; Unknown] [OR:Escherichia coli] [DB:genpept-bct2]
[DE:Escherichia coli K-12 MG1655 section 148 of 400 of the completegenome.]
[NT:o192; This 192 aa ORF is 40 pct identical (2 gaps)] [LE:7069] [RE:7647]
[DI:direct]

| ORF Name | NT ID | AA ID | NT LN | AA LN | Score | P-value |
|---|---|---|---|---|---|---|
| 2598252_f2_988 | 2445 | 9616 | 723 | 240 | 1035 | 1.8e-104 |

Description sp:[LN:YDGQ_ECOLI] [AC:P77179] [GN:YDGQ] [OR:Escherichia coli] [DE:HYPOTHETICAL
24.5 KD PROTEIN IN ADD-NTH INTERGENIC REGION] [SP:P77179] [DB:swissprot]
>sp:[LN:B64920] [AC:B64920] [PN:probable membrane protein ydgQ] [GN:ydgQ]
[CL:conserved hypothetical protein HI1688] [OR:Escherichia coli] [DB:pir2]
>gp:[GI:d1016107:g1742690] [LN:D90806] [AC:D90806:AB001340] [OR:Escherichia coli]
[SR:Escherichia coli (strain:K12) DNA, clone_lib:Kohara lambda minise]
[DB:genpept-bct1] [DE:E.coli genomic DNA, Kohara clone #315(36.6-36.9 min.).]
[NT:ORF_ID:o316#11; similar to [SwissProt Accession] [LE:13824] [RE:14519]
[DI:direct] >gp:[GI:d1016114:g1742698] [LN:D90807] [AC:D90807:AB001340]
[OR:Escherichia coli] [SR:Escherichia coli (strain:K12) DNA, clone_lib:Kohara
lambda minise] [DB:genpept-bct1] [DE:E.coli genomic DNA, Kohara clone
316(36.7-37.1 min.).] [NT:ORF_ID:o316#11; similar to [SwissProt Accession]
[LE:8434] [RE:9129] [DI:direct] >gp:[GI:d1016137:g1742722] [LN:D90808]
[AC:D90808:AB001340] [OR:Escherichia coli] [SR:Escherichia coli (strain:K12) DNA,
clone_lib:Kohara lambda minise] [DB:genpept-bct1] [DE:E.coli genomic DNA, Kohara
clone #317(36.6-36.9 min.).] [NT:ORF_ID:o316#11; similar to [SwissProt Accession]
[LE:13925] [RE:14620] [DI:direct] >gp:[GI:g1787919] [LN:AE000258]
[AC:AE000258:U00096] [PN:orf, hypothetical protein] [GN:ydgQ] [FN:orf; Unknown]
[OR:Escherichia coli] [DB:genpept-bct2] [DE:Escherichia coli K-12 MG1655 section
148 of 400 of the completegenome.] [NT:o231; This 231 aa ORF is 37 pct identical
(8 gaps)] [LE:11549] [RE:12244] [DI:direct]

| ORF Name | NT ID | AA ID | NT LN | AA LN | Score | P-value |
|---|---|---|---|---|---|---|
| 25988886_c1_1611 | 2446 | 9617 | 1143 | 380 | 1660 | 1.0e-170 |

Description gp:[GI:g5669093] [LN:AF130307] [AC:AF130307] [PN:glutathione-dependent
formaldehyde] [GN:gd-faldh] [OR:Acinetobacter baumannii] [DB:genpept-bct2]
[DE:Acinetobacter baumannii glutathione-dependent formaldehydedehydrogenase
(gd-faldh) gene, complete cds.] [NT:GD-FALDH] [LE:328] [RE:1437] [DI:direct]

| ORF Name | NT ID | AA ID | NT LN | AA LN | Score | P-value |
|---|---|---|---|---|---|---|
| 25995217_c1_1588 | 2447 | 9618 | 1209 | 402 | | |

Description

NO-HIT

| ORF Name | NT ID | AA ID | NT/LN | AA/LN | Score | P-value |
|---|---|---|---|---|---|---|
| 26064756_c2_2331 | 2448 | 9619 | 300 | 99 | 97 | 1.9e-05 |

Description sp:[LN:VNUA_PRVKA] [AC:P33485] [OR:Pseudorabies virus] [SR:,strain Kaplan:PRV]
[DE:PROBABLE NUCLEAR ANTIGEN] [SP:P33485] [DB:swissprot] >sp:[LN:B45344]
[AC:B45344] [PN:probable nuclear antigen] [CL:pseudorabies virus 1 nuclear
antigen] [OR:suid herpesvirus 1] [DB:pir1] >gp:[GI:g334072] [LN:SH1PROIE]
[AC:M34651:X12904] [OR:Pseudorabies virus] [SR:Pseudorabies virus
(individual_isolate Kaplan) DNA] [DB:genpept-vrl] [DE:Pseudorabies virus with
upstream and downsteam sequences.] [NT:ORF-3 protein] [LE:5818] [RE:11019]
[DI:complement]

| ORF Name | NT ID | AA ID | NT/LN | AA/LN | Score | P-value |
|---|---|---|---|---|---|---|
| 2616566_f3_1231 | 2449 | 9620 | 465 | 154 | | |

Description

NO-HIT

| ORF Name | NT ID | AA ID | NT/LN | AA/LN | Score | P-value |
|---|---|---|---|---|---|---|
| 26179561_f2_1028 | 2450 | 9621 | 1395 | 464 | 2037 | 1.2e-210 |

Description sp:[LN:YDHE_ECOLI] [AC:P37340:P77765:P77276] [GN:YDHE] [OR:Escherichia coli]
[DE:HYPOTHETICAL 49.4 KD PROTEIN IN RIBC-PYKF INTERGENIC REGION]
[SP:P37340:P77765:P77276] [DB:swissprot] >gp:[GI:d1016151:g1742737] [LN:D90809]
[AC:D90809:AB001340] [GN:ydhE] [OR:Escherichia coli] [SR:Escherichia coli
(strain:K12) DNA, clone_lib:Kohara lambda minise] [DB:genpept-bct1] [DE:E.coli
genomic DNA, Kohara clone #318(37.2-37.6 min.).] [NT:ORF_ID:o319#7; similar to
[SwissProt Accession] [LE:15050] [RE:16423] [DI:direct]
>gp:[GI:d1016160:g1742747] [LN:D90810] [AC:D90810:AB001340] [GN:ydhE]
[OR:Escherichia coli] [SR:Escherichia coli (strain:K12) DNA, clone_lib:Kohara
lambda minise] [DB:genpept-bct1] [DE:E.coli genomic DNA, Kohara clone
319(37.4-37.8 min.).] [NT:ORF_ID:o319#7; similar to [SwissProt Accession]
[LE:7444] [RE:8817] [DI:direct]

| ORF Name | NT ID | AA ID | NT/LN | AA/LN | Score | P-value |
|---|---|---|---|---|---|---|
| 26276441_c1_1766 | 2451 | 9622 | 2334 | 777 | 3069 | 0.0 |

Description gp:[GI:g1620508] [LN:REU60056] [AC:U60056] [PN:CbbBc] [GN:cbbBc] [OR:Ralstonia
eutropha] [DB:genpept-bct2] [DE:Ralstonia eutropha formate dehydrogenase-like
protein (cbbBc) gene,complete cds.] [NT:function unknown; formate
dehydrogenase-like] [LE:139] [RE:2412] [DI:direct]

| ORF Name | NT ID | AA ID | NT LN | AA LN | Score | P-value |
|---|---|---|---|---|---|---|
| 26306500_f2_886 | 2452 | 9623 | 1386 | 461 | 780 | 1.8e-77 |

Description sp:[LN:XYLP_LACPE] [AC:P96792] [GN:XYLP] [OR:Lactobacillus pentosus] [DE:PUTATIVE XYLOSE-PROTON SYMPORTER (XYLOSE TRANSPORTER)] [SP:P96792] [DB:swissprot] >gp:[GI:g3688059] [LN:LPU89276] [AC:U89276] [PN:isoprimeverose cation-symporter XylP] [GN:xylP] [OR:Lactobacillus pentosus] [DB:genpept-bct2] [DE:Lactobacillus pentosus isoprimeverose cation-symporter XylP (xylP)and alpha-xylosidase XylQ (xylQ) genes, complete cds.] [NT:belongs to the GusB subgroup of the GPH family of] [LE:377] [RE:1816] [DI:direct]

| ORF Name | NT ID | AA ID | NT LN | AA LN | Score | P-value |
|---|---|---|---|---|---|---|
| 26307082_c3_3042 | 2453 | 9624 | 306 | 101 | 96 | 1.5e-08 |

Description sp:[LN:ODP2_AZOVI] [AC:P10802] [OR:Azotobacter vinelandii] [EC:2.3.1.12] [DE:COMPLEX, (E2)] [SP:P10802] [DB:swissprot]

| ORF Name | NT ID | AA ID | NT LN | AA LN | Score | P-value |
|---|---|---|---|---|---|---|
| 26444090_f2_939 | 2454 | 9625 | 564 | 187 | 196 | 9.0e-15 |

Description sp:[LN:D64895] [AC:D64895] [PN:probable membrane protein b1433] [OR:Escherichia coli] [DB:pir2] >gp:[GI:g1787703] [LN:AE000240] [AC:AE000240:U00096] [PN:putative membrane transport protein] [GN:b1433] [FN:putative transport; Not classified] [OR:Escherichia coli] [DB:genpept-bct2] [DE:Escherichia coli K-12 MG1655 section 130 of 400 of the completegenome.] [NT:f478; This 478 aa ORF is 38 pct identical (2 gaps)] [LE:6264] [RE:7700] [DI:complement]

| ORF Name | NT ID | AA ID | NT LN | AA LN | Score | P-value |
|---|---|---|---|---|---|---|
| 26446058_c1_1935 | 2455 | 9626 | 1053 | 350 | 241 | 4.8e-19 |

Description gp:[GI:d1046298:g5478797] [LN:AB021310] [AC:AB021310] [PN:chlorophyll b synthase] [GN:CAO] [OR:Oryza sativa] [SR:Oryza sativa cDNA to mRNA] [DB:genpept-pln1] [DE:Oryza sativa CAO mRNA for chlorophyll b synthase, partial cds.] [NT:chlorophyll a oxygenase] [LE:<1] [RE:1072] [DI:direct]

| ORF Name | NT ID | AA ID | NT/LN | AA/LN | Score | P-value |
|---|---|---|---|---|---|---|
| 26616456_f2_833 | 2456 | 9627 | 1641 | 546 | 1185 | 2.2e-120 |

Description sp:[LN:H70788] [AC:H70788] [PN:probable peptidetransport system ABC-transporter ATP-binding protein] [GN:dppD] [CL:ATP-binding cassette homology] [OR:Mycobacterium tuberculosis] [DB:pir2] >gp:[GI:e1264523:g2960087] [LN:MTV025] [AC:AL022121:AL123456] [PN:dppD] [GN:dppD] [OR:Mycobacterium tuberculosis] [DB:genpept-bct1] [DE:Mycobacterium tuberculosis H37Rv complete genome; segment 155/162.] [NT:Rv3663c, (MTV025.011c), len: 548. dppD, Probable] [LE:9129] [RE:10775] [DI:complement]

| ORF Name | NT ID | AA ID | NT/LN | AA/LN | Score | P-value |
|---|---|---|---|---|---|---|
| 26739138_f2_567 | 2457 | 9628 | 1275 | 424 | 944 | 7.7e-95 |

Description sp:[LN:YICM_ECOLI] [AC:P31438:P76725] [GN:YICM] [OR:Escherichia coli] [DE:HYPOTHETICAL 43.6 KD PROTEIN IN NLPA-UHPT INTERGENIC REGION] [SP:P31438:P76725] [DB:swissprot]

| ORF Name | NT ID | AA ID | NT/LN | AA/LN | Score | P-value |
|---|---|---|---|---|---|---|
| 26741431_f3_1319 | 2458 | 9629 | 705 | 234 | 340 | 7.8e-31 |

Description sp:[LN:S76077] [AC:S76077] [PN:hypothetical protein] [OR:Synechocystis sp.] [SR:PCC 6803, , PCC 6803] [SR:PCC 6803, ] [DB:pir2] >gp:[GI:d1010706:g1001431] [LN:SYCSLRA] [AC:D63999:AB001339] [PN:hypothetical protein] [OR:Synechocystis sp.] [SR:Synechocystis sp. (strain:PCC6803) DNA] [DB:genpept-bct1] [DE:Synechocystis sp. PCC6803 complete genome, 18/27, 2267260-2392728.] [NT:ORF_ID:sll0174] [LE:41258] [RE:42112] [DI:complement]

| ORF Name | NT ID | AA ID | NT/LN | AA/LN | Score | P-value |
|---|---|---|---|---|---|---|
| 26746087_c1_1819 | 2459 | 9630 | 945 | 314 | 717 | 8.7e-71 |

Description gp:[GI:e325402:g2239196] [LN:SPAC19G12] [AC:Z97209] [PN:possible polysaccharide deacetylase] [GN:SPAC19G12.03] [OR:Schizosaccharomyces pombe] [SR:fission yeast] [DB:genpept-pln2] [DE:S.pombe chromosome I cosmid c19G12.] [NT:SPAC19G12.03, len:320, LOW SIMILARITY:Synechocystis] [LE:5410] [RE:6372] [DI:direct]

| ORF Name | NT ID | AA ID | NT LN | AA LN | Score | P-value |
|---|---|---|---|---|---|---|
| 26757177_f3_1347 | 2460 | 9631 | 1641 | 546 | 619 | 2.1e-60 |

Description gp:[GI:g3170566] [LN:AF058302] [AC:AF058302] [PN:FrnA] [GN:frnA] [OR:Streptomyces roseofulvus] [DB:genpept-bct2] [DE:Streptomyces roseofulvus frenolicin biosynthetic gene cluster,complete sequence.] [NT:similar to Escherichia coli nikA] [LE:1563] [RE:3875] [DI:direct]

| ORF Name | NT ID | AA ID | NT LN | AA LN | Score | P-value |
|---|---|---|---|---|---|---|
| 26800412_c2_2117 | 2461 | 9632 | 825 | 274 | 1217 | 9.1e-124 |

Description sp:[LN:F64896] [AC:F64896] [PN:probable membrane protein b1443] [OR:Escherichia coli] [DB:pir2] >gp:[GI:d1015791:g1742351] [LN:D90783] [AC:D90783:AB001340] [PN:Spermidine/putrescine transport system permease] [OR:Escherichia coli] [SR:Escherichia coli (strain:K12) DNA, clone_lib:Kohara lambda minise] [DB:genpept-bct1] [DE:E.coli genomic DNA, Kohara clone #272(32.4-32.7 min.).] [NT:ORF_ID:o272#8; similar to [SwissProt Accession] [LE:13142] [RE:13936] [DI:direct] >gp:[GI:d1015797:g1742358] [LN:D90784] [AC:D90784:AB001340] [PN:Spermidine/putrescine transport system permease] [OR:Escherichia coli] [SR:Escherichia coli (strain:K12) DNA, clone_lib:Kohara lambda minise] [DB:genpept-bct1] [DE:E.coli genomic DNA, Kohara clone #273(32.5-32.8 min.).] [NT:ORF_ID:o272#8; similar to [SwissProt Accession] [LE:6800] [RE:7594] [DI:direct] >gp:[GI:g1787714] [LN:AE000241] [AC:AE000241:U00096] [PN:putative transport system permease protein] [GN:b1443] [FN:putative transport; Not classified] [OR:Escherichia coli] [DB:genpept-bct2] [DE:Escherichia coli K-12 MG1655 section 131 of 400 of the completegenome.] [NT:o264; This 264 aa ORF is 33 pct identical (11 gaps)] [LE:6004] [RE:6798] [DI:direct]

| ORF Name | NT ID | AA ID | NT LN | AA LN | Score | P-value |
|---|---|---|---|---|---|---|
| 26816661_f2_1017 | 2462 | 9633 | 684 | 227 | 960 | 1.6e-96 |

Description sp:[LN:DSECF] [AC:A29940:S00091:B64923] [PN:superoxide dismutase, (Fe)] [GN:sodB:Fe-SOD] [CL:superoxide dismutase (Mn)] [OR:Escherichia coli] [EC:1.15.1.1] [DB:pir1] [MP:36 min] >gp:[GI:d1016143:g1742729] [LN:D90809] [AC:D90809:AB001340] [PN:Superoxide dismutase (EC 1.15.1.1) (Fe)] [GN:sodB, Fe, SOD] [OR:Escherichia coli] [SR:Escherichia coli (strain:K12) DNA, clone_lib:Kohara lambda minise] [DB:genpept-bct1] [DE:E.coli genomic DNA, Kohara clone #318(37.2-37.6 min.).] [NT:ORF_ID:o317#12; similar to [PIR Accession Number] [LE:6970] [RE:7551] [DI:direct] >gp:[GI:g147842] [LN:ECOSODB] [AC:J03511] [OR:Escherichia coli] [SR:E.coli K12 (strain N99) DNA, clones pHS1-[6,8]] [DB:genpept-bct1] [DE:E.coli sodB gene encoding superoxide dismutase, complete cds.] [NT:superoxide dismutase (sodB)] [LE:177] [RE:758] [DI:direct] >gp:[GI:g1787946] [LN:AE000261] [AC:AE000261:U00096] [PN:superoxide dismutase, iron] [GN:sodB] [FN:enzyme; Detoxification] [OR:Escherichia coli] [DB:genpept-bct2] [EC:1.15.1.1] [DE:Escherichia coli K-12 MG1655 section 151 of 400 of the completegenome.] [NT:o193; 100 pct identical to SODF_ECOLI SW: P09157] [LE:94] [RE:675] [DI:direct]

| ORF Name | NT ID | AA ID | NT LN | AA LN | Score | P-value |
|---|---|---|---|---|---|---|
| 26817691_f3_1083 | 2463 | 9634 | 444 | 147 | 477 | 2.4e-45 |

Description sp:[LN:YNEG_ECOLI] [AC:P76148] [GN:YNEG] [OR:Escherichia coli] [DE:HYPOTHETICAL 13.5 KD PROTEIN IN UXAB-MARC INTERGENIC REGION] [SP:P76148] [DB:swissprot] >sp:[LN:F64906] [AC:F64906] [PN:hypothetical protein b1523] [CL:Escherichia coli hypothetical protein b1523] [OR:Escherichia coli] [DB:pir2] >gp:[GI:g1787803] [LN:AE000250] [AC:AE000250:U00096] [PN:orf, hypothetical protein] [GN:b1523] [FN:orf; Unknown] [OR:Escherichia coli] [DB:genpept-bct2] [DE:Escherichia coli K-12 MG1655 section 140 of 400 of the completegenome.] [NT:f119; This 119 aa ORF is 25 pct identical (6 gaps)] [LE:1203] [RE:1562] [DI:complement]

| ORF Name | NT ID | AA ID | NT LN | AA LN | Score | P-value |
|---|---|---|---|---|---|---|
| 26832207_c3_2642 | 2464 | 9635 | 1233 | 410 | | |

Description

NO-HIT

| ORF Name | NT ID | AA ID | NT LN | AA LN | Score | P-value |
|---|---|---|---|---|---|---|
| 2813202_f3_1084 | 2465 | 9636 | 1425 | 474 | 831 | 7.3e-83 |

Description sp:[LN:E64906] [AC:E64906] [PN:probable membrane protein b1522] [OR:Escherichia coli] [DB:pir2] >gp:[GI:g1787802] [LN:AE000250] [AC:AE000250:U00096] [PN:orf, hypothetical protein] [GN:b1522] [FN:orf; Unknown] [OR:Escherichia coli] [DB:genpept-bct2] [DE:Escherichia coli K-12 MG1655 section 140 of 400 of the completegenome.] [NT:f315; UUG start; This 315 aa ORF is 28 pct] [LE:144] [RE:1091] [DI:complement]

| ORF Name | NT ID | AA ID | NT LN | AA LN | Score | P-value |
|---|---|---|---|---|---|---|
| 2822806_c1_1839 | 2466 | 9637 | 846 | 281 | 700 | 5.5e-69 |

Description sp:[LN:H69334] [AC:H69334] [PN:glutamine transport protein glnQ] [GN:glnQ] [CL:inner membrane protein malK:ATP-binding cassette homology] [OR:Archaeoglobus fulgidus] [DB:pir2] >gp:[GI:g2649950] [LN:AE001058] [AC:AE001058:AE000782] [PN:glutamine ABC transporter, ATP-binding protein] [GN:AF0680] [OR:Archaeoglobus fulgidus] [DB:genpept-bct2] [DE:Archaeoglobus fulgidus section 49 of 172 of the complete genome.] [NT:similar to GB:M61017 SP:P27675 PID:142988 percent] [LE:10147] [RE:10875] [DI:complement]

| ORF Name | NT ID | AA ID | NT LN | AA LN | Score | P-value |
|---|---|---|---|---|---|---|
| 29323763_c2_2148 | 2467 | 9638 | 1035 | 344 | 185 | 8.7e-13 |

Description gp:[GI:d1037385:g4115511] [LN:AB010947] [AC:AB010947] [PN:FliY] [GN:fliY]
[OR:Salmonella typhimurium] [SR:Salmonella typhimurium (strain:KK1004) DNA]
[DB:genpept-bct1] [DE:Salmonella typhimurium genes for FliA, FliZ, FliY, complete
cds.] [LE:1962] [RE:2762] [DI:direct]

| ORF Name | NT ID | AA ID | NT LN | AA LN | Score | P-value |
|---|---|---|---|---|---|---|
| 29462590_c3_2725 | 2468 | 9639 | 996 | 331 | 288 | 2.5e-25 |

Description sp:[LN:F69748] [AC:F69748] [PN:hypothetical protein ybfA] [GN:ybfA] [OR:Bacillus
subtilis] [DB:pir2] >gp:[GI:d1034079:g3599638] [LN:AB006424] [AC:AB006424]
[GN:ybfA] [OR:Bacillus subtilis] [SR:Bacillus subtilis (strain:168) DNA]
[DB:genpept-bct1] [DE:Bacillus subtilis genomic DNA, 70 kb region between 17 and
23degree.] [LE:38955] [RE:39872] [DI:direct] >gp:[GI:e1182168:g2632502]
[LN:BSUB0002] [AC:Z99105:AL009126] [GN:ybfA] [FN:unknown] [OR:Bacillus subtilis]
[DB:genpept-bct1] [DE:Bacillus subtilis complete genome (section 2 of 21): from
194651 to415810.] [LE:41304] [RE:42221] [DI:direct]

| ORF Name | NT ID | AA ID | NT LN | AA LN | Score | P-value |
|---|---|---|---|---|---|---|
| 29469756_c1_1997 | 2469 | 9640 | 564 | 187 | 160 | 1.1e-10 |

Description gp:[GI:e1423725:g4584086] [LN:SSI132828] [AC:AJ132828] [PN:p210 protein]
[FN:putative microtubule-membrane-linker] [OR:Spermatozopsis similis]
[DB:genpept-pln1] [DE:Spermatozopsis similis mRNA for p210 protein, partial.]
[LE:<1] [RE:1830] [DI:direct]

| ORF Name | NT ID | AA ID | NT LN | AA LN | Score | P-value |
|---|---|---|---|---|---|---|
| 29511680_f2_1015 | 2470 | 9641 | 888 | 295 | 765 | 7.2e-76 |

Description sp:[LN:YDHO_ECOLI] [AC:P76190] [GN:YDHO] [OR:Escherichia coli] [DE:HYPOTHETICAL
29.9 KD PROTEIN IN LHR-SODB INTERGENIC REGION PRECURSOR] [SP:P76190]
[DB:swissprot] >sp:[LN:A64923] [AC:A64923] [PN:hypothetical protein b1655
precursor] [OR:Escherichia coli] [DB:pir2] >gp:[GI:g1787944] [LN:AE000260]
[AC:AE000260:U00096] [PN:putative lipoprotein] [GN:ydhO] [FN:putative membrane;
Not classified] [OR:Escherichia coli] [DB:genpept-bct2] [DE:Escherichia coli K-12
MG1655 section 150 of 400 of the completegenome.] [NT:o271; This 271 aa ORF is 27
pct identical (10 gaps)] [LE:9770] [RE:10585] [DI:direct]

| ORF Name | NT ID | AA ID | NT LN | AA LN | Score | P-value |
|---|---|---|---|---|---|---|
| 29532513_f3_1107 | 2471 | 9642 | 1005 | 334 | 338 | 1.3e-30 |

Description gp:[GI:g1439550] [LN:RLU39409] [AC:U39409] [OR:Rhizobium leguminosarum bv. trifolii] [DB:genpept-bct1] [DE:Rhizobium leguminosarum bv. trifolii TfuA (tfuA), gene, completecds.] [NT:ORF1; high similarity to members of the LysR] [LE:61] [RE:963] [DI:direct]

| ORF Name | NT ID | AA ID | NT LN | AA LN | Score | P-value |
|---|---|---|---|---|---|---|
| 29579662_f1_184 | 2472 | 9643 | 189 | 62 | | |

Description

NO-HIT

| ORF Name | NT ID | AA ID | NT LN | AA LN | Score | P-value |
|---|---|---|---|---|---|---|
| 29718816_f2_865 | 2473 | 9644 | 3849 | 1282 | 6018 | 0.0 |

Description sp:[LN:G64899] [AC:G64899:S11427] [PN:nitrate reductase, 2 alpha chain] [GN:narZ] [CL:nitrate reductase alpha chain] [OR:Escherichia coli] [EC:1.7.99.4] [DB:pir2] >gp:[GI:g1787741] [LN:AE000243] [AC:AE000243:U00096] [PN:cryptic nitrate reductase 2, alpha subunit] [GN:narZ] [FN:enzyme; Energy metabolism, carbon: Anaerobic] [OR:Escherichia coli] [DB:genpept-bct2] [EC:1.7.99.4] [DE:Escherichia coli K-12 MG1655 section 133 of 400 of the completegenome.] [NT:f1246; 99 pct identical to NARZ_ECOLI SW: P19319;] [LE:8385] [RE:12125] [DI:complement]

| ORF Name | NT ID | AA ID | NT LN | AA LN | Score | P-value |
|---|---|---|---|---|---|---|
| 29781902_c1_1731 | 2474 | 9645 | 240 | 79 | 146 | 2.8e-10 |

Description sp:[LN:G72536] [AC:G72536] [PN:hypothetical protein APE1580] [GN:APE1580] [OR:Aeropyrum pernix] [DB:pir2] >gp:[GI:d1044366:g5105267] [LN:AP000062] [AC:AP000062] [PN:114aa long hypothetical protein] [GN:APE1580] [OR:Aeropyrum pernix] [SR:Aeropyrum pernix (strain:K1) DNA] [DB:genpept-bct1] [DE:Aeropyrum pernix genomic DNA, section 5/7.] [NT:similar to OWL:AB00946832 percent identity:37.500] [LE:13911] [RE:14255] [DI:direct]

| ORF_Name | NT ID | AA ID | NT/LN | AA/LN | Score | P-value |
|---|---|---|---|---|---|---|
| 29785643_f2_1002 | 2475 | 9646 | 270 | 89 | 327 | 1.9e-29 |

Description sp:[LN:YDHI_ECOLI] [AC:P76184] [GN:YDHI] [OR:Escherichia coli] [DE:HYPOTHETICAL 8.9 KD PROTEIN IN SLYA-SODC INTERGENIC REGION] [SP:P76184] [DB:swissprot] >sp:[LN:E64921] [AC:E64921] [PN:probable membrane protein b1643] [OR:Escherichia coli] [DB:pir2] >gp:[GI:g1787931] [LN:AE000259] [AC:AE000259:U00096] [PN:orf, hypothetical protein] [GN:b1643] [FN:orf; Unknown] [OR:Escherichia coli] [DB:genpept-bct2] [DE:Escherichia coli K-12 MG1655 section 149 of 400 of the completegenome.] [NT:o78; This 78 aa ORF is 37 pct identical (8 gaps)] [LE:8632] [RE:8868] [DI:direct]

| ORF_Name | NT ID | AA ID | NT/LN | AA/LN | Score | P-value |
|---|---|---|---|---|---|---|
| 29787508_c1_1681 | 2476 | 9647 | 639 | 212 | 723 | 2.0e-71 |

Description sp:[LN:A64898] [AC:A64898] [PN:hypothetical protein b1454] [OR:Escherichia coli] [DB:pir2] >gp:[GI:g1787726] [LN:AE000242] [AC:AE000242:U00096] [PN:putative transferase] [GN:b1454] [FN:putative enzyme; Not classified] [OR:Escherichia coli] [DB:genpept-bct2] [DE:Escherichia coli K-12 MG1655 section 132 of 400 of the completegenome.] [NT:o205; This 205 aa ORF is 25 pct identical (9 gaps)] [LE:7387] [RE:8004] [DI:direct]

| ORF_Name | NT ID | AA ID | NT/LN | AA/LN | Score | P-value |
|---|---|---|---|---|---|---|
| 29812675_c3_3032 | 2477 | 9648 | 456 | 151 | 637 | 2.6e-62 |

Description sp:[LN:MARR_SALTY] [AC:Q56069] [GN:MARR] [OR:Salmonella typhimurium] [DE:MULTIPLE ANTIBIOTIC RESISTANCE PROTEIN MARR] [SP:Q56069] [DB:swissprot] >sp:[LN:T11756] [AC:T11756] [PN:transcription regulator marR] [GN:marR] [OR:Salmonella typhimurium] [DB:pir2] >gp:[GI:e1433195:g4775568] [LN:SDU011765] [AC:AJ011765] [PN:multiple antibiotic resistance R protein (MarR)] [GN:marR] [OR:Salmonella dublin] [DB:genpept-bct1] [DE:Salmonella dublin multiple antibiotic resistance (mar) operon andflanking genes, partial.] [NT:ttg start codon] [LE:536] [RE:970] [DI:direct] >gp:[GI:e1433198:g4775571] [LN:SEN011766] [AC:AJ011766] [PN:multiple antibiotic resistance R protein (MarR)] [GN:marR] [OR:Salmonella enteritidis] [DB:genpept-bct1] [DE:Salmonella enteritidis multiple antibiotic resistance (mar) operonand flanking genes, partial.] [NT:TTG start codon] [LE:536] [RE:970] [DI:direct] >gp:[GI:g1293698] [LN:STU54468] [AC:U54468] [PN:MarR] [GN:marR] [FN:repressor of mar operon] [OR:Salmonella typhimurium] [SR:Salmonella typhimurium strain=X3181] [DB:genpept-bct2] [DE:Salmonella typhimurium multiple antibiotic resistance operon MarR,MarA, MarB, and ORF221 genes, complete cds, and ORFA gene, partialcds.] [LE:985] [RE:1419] [DI:direct]

| ORF Name | NT ID | AA ID | NT/LN | AA/LN | Score | P-value |
|---|---|---|---|---|---|---|
| 29817942_c3_2648 | 2478 | 9649 | 693 | 230 | 860 | 6.1e-86 |

Description sp:[LN:G64897] [AC:G64897] [PN:hypothetical protein b1452] [OR:Escherichia coli]
[DB:pir2] >gp:[GI:g1787724] [LN:AE000242] [AC:AE000242:U00096] [PN:putative
receptor] [GN:b1452] [FN:putative factor; Not classified] [OR:Escherichia coli]
[DB:genpept-bct2] [DE:Escherichia coli K-12 MG1655 section 132 of 400 of the
completegenome.] [NT:o353; This 353 aa ORF is 22 pct identical (17 gaps)]
[LE:4447] [RE:5508] [DI:direct]

| ORF Name | NT ID | AA ID | NT/LN | AA/LN | Score | P-value |
|---|---|---|---|---|---|---|
| 29876708_c3_2940 | 2479 | 9650 | 1170 | 389 | 409 | 3.8e-38 |

Description sp:[LN:YAEG_ECOLI] [AC:P37047] [GN:YAEG] [OR:Escherichia coli] [DE:HYPOTHETICAL
43.7 KD PROTEIN PROTEIN IN HTRA-DAPD INTERGENIC REGION] [SP:P37047]
[DB:swissprot] >gp:[GI:g1552740] [LN:ECU70214] [AC:U70214] [GN:yaeG]
[OR:Escherichia coli] [DB:genpept-bct1] [DE:Escherichia coli chromosome minutes
4-6.] [NT:hypothetical] [LE:13538] [RE:14695] [DI:direct]

| ORF Name | NT ID | AA ID | NT/LN | AA/LN | Score | P-value |
|---|---|---|---|---|---|---|
| 29948265_f2_767 | 2480 | 9651 | 1164 | 387 | 1398 | 6.0e-143 |

Description sp:[LN:YPQQ_KLEPN] [AC:P27509] [OR:Klebsiella pneumoniae] [DE:HYPOTHETICAL
PROTEIN IN PQQA 5'REGION (ORF X) (FRAGMENT)] [SP:P27509] [DB:swissprot]
>gp:[GI:g43904] [LN:KPPQQAF] [AC:X58778:S92172] [GN:orfX] [OR:Klebsiella
pneumoniae] [DB:genpept-bct1] [DE:K.pneumoniae pqqABCDEF genes, involved in
pyrroloquinolinebiosynthesis.] [SP:P27509] [LE:<1] [RE:818] [DI:direct]

| ORF Name | NT ID | AA ID | NT/LN | AA/LN | Score | P-value |
|---|---|---|---|---|---|---|
| 29963962_c1_1913 | 2481 | 9652 | 507 | 168 | 283 | 8.5e-25 |

Description gp:[GI:g6013124] [LN:YEN238284] [AC:AJ238284] [PN:hypothetical protein]
[OR:Yersinia enterocolitica] [DB:genpept-bct1] [DE:Yersinia enterocolitica DNA
for left boundary of the highpathogenicity island (HPI) AND ORF's 1 and 2, strain
Ye8081.] [NT:ORF1] [LE:<1] [RE:200] [DI:direct]

| ORF Name | NT ID | AA ID | NT LN | AA LN | Score | P-value |
|---|---|---|---|---|---|---|
| 29970765_c1_1798 | 2482 | 9653 | 1239 | 412 | 370 | 8.4e-47 |

Description sp:[LN:YX05_MYCTU] [AC:Q10801] [GN:MTCY274.05] [OR:Mycobacterium tuberculosis]
[DE:HYPOTHETICAL 74.2 KD PROTEIN CY274.05] [SP:Q10801] [DB:swissprot]
>sp:[LN:E70923] [AC:E70923] [PN:hypothetical protein Rv2874] [GN:Rv2874]
[OR:Mycobacterium tuberculosis] [DB:pir2] >gp:[GI:e248758:g1403394] [LN:MTCY274]
[AC:Z74024:AL123456] [PN:hypothetical protein Rv2874] [GN:Rv2874]
[OR:Mycobacterium tuberculosis] [DB:genpept-bct1] [DE:Mycobacterium tuberculosis
H37Rv complete genome; segment 126/162.] [NT:Rv2874, (MTCY274.05), len: 695.
Unknown integral] [SP:Q10801] [LE:3085] [RE:5172] [DI:direct]

| ORF Name | NT ID | AA ID | NT LN | AA LN | Score | P-value |
|---|---|---|---|---|---|---|
| 29973876_c2_2031 | 2483 | 9654 | 534 | 177 | 105 | 6.3e-06 |

Description gp:[GI:g1542978] [LN:SCU51332] [AC:U51332] [PN:D9] [GN:d9] [OR:Streptomyces
coelicolor] [SR:Streptomyces coelicolor strain=J1501] [DB:genpept-bct1]
[DE:Streptomyces coelicolor histidine kinase homolog (absA1) andresponse
regulator homolog (absA2) genes, complete cds.] [LE:2846] [RE:>3216]
[DI:complement]

| ORF Name | NT ID | AA ID | NT LN | AA LN | Score | P-value |
|---|---|---|---|---|---|---|
| 3001275_f2_977 | 2484 | 9655 | 1266 | 421 | 607 | 4.0e-59 |

Description sp:[LN:D69779] [AC:D69779] [PN:antibiotic resistance protein homolog ydeR]
[GN:ydeR] [OR:Bacillus subtilis] [DB:pir2] >gp:[GI:d1020118:g1881338]
[LN:AB001488] [AC:AB001488] [GN:ydeR] [OR:Bacillus subtilis] [SR:Bacillus
subtilis (strain:168) DNA] [DB:genpept-bct1] [DE:Bacillus subtilis genome
sequence, 148 kb sequence of the regionbetween 35 and 47 degree.] [NT:PROBABLE
INTEGRAL MEMBRANE PROTEIN, SIMILAR TO] [LE:110164] [RE:111351] [DI:complement]
>gp:[GI:e1182497:g2632831] [LN:BSUB0003] [AC:Z99106:AL009126] [GN:ydeR]
[FN:unknown] [OR:Bacillus subtilis] [DB:genpept-bct1] [DE:Bacillus subtilis
complete genome (section 3 of 21): from 402751 to611850.] [NT:similar to
antibiotic resistance protein] [LE:173910] [RE:175097] [DI:complement]

| ORF Name | NT ID | AA ID | NT LN | AA LN | Score | P-value |
|---|---|---|---|---|---|---|
| 30093785_c2_2429 | 2485 | 9656 | 270 | 89 | | |

Description

NO-HIT

| ORF Name | NT ID | AA ID | NT LN | AA LN | Score | P-value |
|---|---|---|---|---|---|---|
| 30120306_f3_1453 | 2486 | 9657 | 843 | 280 | 112 | 4.3e-06 |

Description sp:[LN:E72756] [AC:E72756] [PN:hypothetical protein APE0042] [GN:APE0042] [OR:Aeropyrum pernix] [DB:pir2] >gp:[GI:d1042727:g5103430] [LN:AP000058] [AC:AP000058] [PN:110aa long hypothetical protein] [GN:APE0042] [OR:Aeropyrum pernix] [SR:Aeropyrum pernix (strain:K1) DNA] [DB:genpept-bct1] [DE:Aeropyrum pernix genomic DNA, section 1/7.] [NT:similar to OWL:AP000006197 percent identity:37.705] [LE:25576] [RE:25908] [DI:complement]

| ORF Name | NT ID | AA ID | NT LN | AA LN | Score | P-value |
|---|---|---|---|---|---|---|
| 30197081_c3_2997 | 2487 | 9658 | 831 | 276 | 856 | 1.6e-85 |

Description sp:[LN:B64906] [AC:B64906] [PN:biotin biosynthesis protein homolog b1519] [CL:bioC homology] [OR:Escherichia coli] [DB:pir2] >gp:[GI:g1787798] [LN:AE000249] [AC:AE000249:U00096] [PN:putative enzyme] [GN:b1519] [FN:putative enzyme; Not classified] [OR:Escherichia coli] [DB:genpept-bct1] [DE:Escherichia coli K-12 MG1655 section 139 of 400 of the completegenome.] [NT:o252; This 252 aa ORF is 28 pct identical (18 gaps)] [LE:7128] [RE:7886] [DI:direct]

| ORF Name | NT ID | AA ID | NT LN | AA LN | Score | P-value |
|---|---|---|---|---|---|---|
| 30292141_c1_1840 | 2488 | 9659 | 1257 | 418 | 1048 | 7.3e-106 |

Description sp:[LN:F70017] [AC:F70017] [PN:aspartate aminotransferase homolog yurG] [GN:yurG] [CL:aspartate aminotransferase] [OR:Bacillus subtilis] [DB:pir2] >gp:[GI:e1184331:g2635749] [LN:BSUB0017] [AC:Z99120:AL009126] [GN:yurG] [FN:unknown] [OR:Bacillus subtilis] [DB:genpept-bct1] [DE:Bacillus subtilis complete genome (section 17 of 21): from 3197001to 3414420.] [NT:similar to aspartate aminotransferase] [LE:143225] [RE:144475] [DI:complement]

| ORF Name | NT ID | AA ID | NT LN | AA LN | Score | P-value |
|---|---|---|---|---|---|---|
| 30333152_c3_2695 | 2489 | 9660 | 915 | 304 | 745 | 9.4e-74 |

Description gp:[GI:g4877827] [LN:AF134348] [AC:AF134348] [PN:toluate 1,2 dioxygenase subunit] [GN:xylZ] [OR:Pseudomonas putida] [DB:genpept-bct2] [DE:Pseudomonas putida plasmid pDK1 toluate 1,2 dioxygenase subunit(xylX), toluate 1,2 dioxygenase subunit (xylY), and toluate 1,2dioxygenase subunit (xylZ) genes, complete cds; and1,2-dihydroxycyclohexa-3,5-diene carboxylate dehydrogenase (xylL)gene, partial cds.] [LE:3535] [RE:4545] [DI:direct]

| ORF Name | NT ID | AA ID | NT/LN | AA/LN | Score | P-value |
|---|---|---|---|---|---|---|
| 30364415_f3_1550 | 2490 | 9661 | 411 | 137 | 137 | 2.5e-09 |

Description sp:[LN:ASR_ECOLI] [AC:P36560:P77267] [GN:ASR] [OR:Escherichia coli] [DE:ACID
SHOCK PROTEIN] [SP:P36560:P77267] [DB:swissprot] >sp:[LN:G64915] [AC:G64915]
[PN:acid shock protein] [GN:asr] [OR:Escherichia coli] [DB:pir2]
>gp:[GI:d1016052:g1742631] [LN:D90802] [AC:D90802:AB001340] [PN:Acid shock
protein.] [GN:asr] [OR:Escherichia coli] [SR:Escherichia coli (strain:K12) DNA,
clone_lib:Kohara lambda minise] [DB:genpept-bct1] [DE:E.coli genomic DNA, Kohara
clone #311(35.7-36.1 min.).] [NT:ORF_ID:o311#11; similar to [SwissProt Accession]
[LE:14003] [RE:14338] [DI:direct] >gp:[GI:g1787881] [LN:AE000255]
[AC:AE000255:U00096] [PN:acid shock protein] [GN:asr] [FN:phenotype; Not
classified] [OR:Escherichia coli] [DB:genpept-bct2] [DE:Escherichia coli K-12
MG1655 section 145 of 400 of the completegenome.] [NT:o111; residues 1-68 are 100
pct identical] [LE:6192] [RE:6527] [DI:direct]

| ORF Name | NT ID | AA ID | NT/LN | AA/LN | Score | P-value |
|---|---|---|---|---|---|---|
| 30652006_c3_2710 | 2491 | 9662 | 480 | 159 | 115 | 9.0e-06 |

Description gp:[GI:g4884836] [LN:AF131877] [AC:AF131877] [PN:NapG oxidoreductase] [GN:napG]
[OR:Streptomyces collinus] [DB:genpept-bct2] [DE:Streptomyces collinus putative
naphthomycin AHBA biosynthetic genecluster, complete sequence.] [LE:4666]
[RE:5691] [DI:direct]

| ORF Name | NT ID | AA ID | NT/LN | AA/LN | Score | P-value |
|---|---|---|---|---|---|---|
| 30744677_c1_1986 | 2492 | 9663 | 1383 | 460 | 718 | 6.8e-71 |

Description sp:[LN:GUDT_BACSU] [AC:P42237] [GN:YCBE] [OR:Bacillus subtilis] [DE:PROBABLE
GLUCARATE TRANSPORTER] [SP:P42237] [DB:swissprot] >sp:[LN:H69752] [AC:H69752]
[PN:probalble glucarate transporter] [GN:ycbE] [CL:hexuronate transporter]
[OR:Bacillus subtilis] [DB:pir1] >gp:[GI:d1007040:g709999] [LN:BACYCB20]
[AC:D30808] [PN:glucarate dehydratase] [GN:ycbE] [OR:Bacillus subtilis]
[SR:Bacillus subtilis (strain:168TrpC2) DNA] [DB:genpept-bct1] [DE:Bacillus
subtilis DNA around 20 degrees region of chromosomecontaining yckA-T genes.]
[LE:3924] [RE:5291] [DI:direct] >gp:[GI:e1182200:g2632534] [LN:BSUB0002]
[AC:Z99105:AL009126] [GN:ycbE] [FN:unknown] [OR:Bacillus subtilis]
[DB:genpept-bct1] [DE:Bacillus subtilis complete genome (section 2 of 21): from
194651 to415810.] [NT:similar to glucarate transporter] [SP:P42237] [LE:75738]
[RE:77105] [DI:direct]

| ORF Name | NT ID | AA ID | NT/LN | AA/LN | Score | P-value |
|---|---|---|---|---|---|---|
| 31286032_c2_2140 | 2493 | 9664 | 651 | 216 | 119 | 5.0e-06 |

Description sp:[LN:S70846] [AC:S70846] [PN:flaR protein] [GN:flaR] [OR:Listeria monocytogenes] [DB:pir2] >gp:[GI:g1036788] [LN:LMU29951] [AC:U29951] [GN:flaR] [FN:modulation of DNA topology] [OR:Listeria monocytogenes] [DB:genpept-bct1] [DE:Listeria monocytogenes (flaR) gene, complete cds.] [LE:211] [RE:744] [DI:direct]

| ORF Name | NT ID | AA ID | NT/LN | AA/LN | Score | P-value |
|---|---|---|---|---|---|---|
| 31297717_c3_3022 | 2494 | 9665 | 336 | 111 | 111 | 3.8e-06 |

Description sp:[LN:B24264] [AC:B24264] [PN:proline-rich protein MP3] [CL:proline-rich protein] [OR:Mus musculus] [SR:, house mouse] [DB:pir2]

| ORF Name | NT ID | AA ID | NT/LN | AA/LN | Score | P-value |
|---|---|---|---|---|---|---|
| 31307662_f3_1210 | 2495 | 9666 | 1671 | 556 | 1734 | 1.5e-178 |

Description sp:[LN:D64924] [AC:D64924] [PN:hypothetical protein b1668] [OR:Escherichia coli] [DB:pir2] >gp:[GI:g1549279] [LN:ECU68703] [AC:U68703] [OR:Escherichia coli] [DB:genpept-bct1] [DE:Escherichia coli K-12 MG1655 genome, ribC-pykF region.] [NT:hypothetical protein] [LE:4535] [RE:6139] [DI:direct] >gp:[GI:g1787957] [LN:AE000262] [AC:AE000262:U00096] [PN:orf, hypothetical protein] [GN:b1668] [FN:orf; Unknown] [OR:Escherichia coli] [DB:genpept-bct2] [DE:Escherichia coli K-12 MG1655 section 152 of 400 of the completegenome.] [NT:o534; This 534 aa ORF is 38 pct identical (6 gaps)] [LE:872] [RE:2476] [DI:direct]

| ORF Name | NT ID | AA ID | NT/LN | AA/LN | Score | P-value |
|---|---|---|---|---|---|---|
| 31350681_f3_1269 | 2496 | 9667 | 837 | 278 | 637 | 2.6e-62 |

Description sp:[LN:F64149] [AC:F64149] [PN:nitrate transport protein nrtB homolog HI0355] [CL:Synechococcus nitrate transport protein nrtB] [OR:Haemophilus influenzae] [DB:pir1]

| ORF Name | NT ID | AA ID | NT/LN | AA/LN | Score | P-value |
|---|---|---|---|---|---|---|
| 31379135_c1_1893 | 2497 | 9668 | 1029 | 342 | 645 | 3.7e-63 |

Description gp:[GI:e1389916:g4456874] [LN:STY224978] [AC:AJ224978] [GN:ORF 408] [OR:Salmonella typhimurium] [DB:genpept-bct1] [DE:Salmonella typhimurium, Salmonella Pathogenicity Island 2 (SPI2)genes, ttr gene cluster.] [LE:10000] [RE:11226] [DI:direct]

| ORF_Name | NT ID | AA ID | NT/LN | AA/LN | Score | P-value |
|---|---|---|---|---|---|---|
| 31414806_f3_1350 | 2498 | 9669 | 978 | 325 | 629 | 1.8e-61 |

Description gp:[GI:g3170568] [LN:AF058302] [AC:AF058302] [PN:membrane component of putative ABC transporter] [GN:frnC] [OR:Streptomyces roseofulvus] [DB:genpept-bct2] [DE:Streptomyces roseofulvus frenolicin biosynthetic gene cluster, complete sequence.] [NT:FrnC; similar to Escherichia coli DPPC] [LE:4947] [RE:5771] [DI:direct]

| ORF_Name | NT ID | AA ID | NT/LN | AA/LN | Score | P-value |
|---|---|---|---|---|---|---|
| 31485680_c1_1818 | 2499 | 9670 | 831 | 276 | 535 | 1.7e-51 |

Description sp:[LN:HYUE_PSESN] [AC:Q00924] [GN:HYUE] [OR:Pseudomonas sp] [SR:,strain NS671] [EC:5.1.99.-] [DE:HYDANTOIN RACEMASE,] [SP:Q00924] [DB:swissprot] >sp:[LN:B41895] [AC:B41895] [PN:hydantoin racemase HyuE] [OR:Pseudomonas sp.] [DB:pir2] >gp:[GI:g151279] [LN:PSEHYUEA] [AC:M84731] [PN:5-substituted hydantoin racemase] [GN:hyuE] [OR:Pseudomonas sp.] [SR:Pseudomonas sp. (strain NS671) DNA] [DB:genpept-bct1] [DE:Pseudomonas sp. 5-substituted hydantoin racemase (hyuE) gene, complete cds.] [LE:1106] [RE:1855] [DI:direct]

| ORF_Name | NT ID | AA ID | NT/LN | AA/LN | Score | P-value |
|---|---|---|---|---|---|---|
| 31500066_c1_1932 | 2500 | 9671 | 1359 | 452 | 95 | 0.0017 |

Description sp:[LN:T14155] [AC:T14155] [PN:zinc finger protein Peg3] [GN:Peg3] [OR:Mus musculus] [SR:, house mouse] [DB:pir2] [MP:7] >gp:[GI:g2791678] [LN:AF038939] [AC:AF038939] [PN:zinc finger protein] [GN:Peg3] [OR:Mus musculus] [SR:house mouse] [DB:genpept-rod] [DE:Mus musculus zinc finger protein (Peg3) mRNA, complete cds.] [LE:14] [RE:4729] [DI:direct]

| ORF_Name | NT ID | AA ID | NT/LN | AA/LN | Score | P-value |
|---|---|---|---|---|---|---|
| 3151391_c2_2250 | 2501 | 9672 | 1674 | 557 | | |

Description

NO-HIT

| ORF_Name | NT_ID | AA_ID | NT/LN | AA/LN | Score | P-value |
|---|---|---|---|---|---|---|
| 31540927_c3_2673 | 2502 | 9673 | 903 | 300 | 552 | 2.7e-53 |

Description sp:[LN:H71006] [AC:H71006] [PN:probable ATP-binding transport protein]
[GN:PH1350] [CL:inner membrane protein malK:ATP-binding cassette homology]
[OR:Pyrococcus horikoshii] [DB:pir2] >gp:[GI:d1031399:g3257773] [LN:AP000006]
[AC:AP000006:AB005215:AB009510:AB009511:AB009512:AB009513:AB009514] [PN:330aa
long hypothetical ATP-binding transport] [GN:PH1350] [OR:Pyrococcus horikoshii]
[SR:Pyrococcus horikoshii (strain:OT3) DNA, clone:Pyrococcus horikoshi]
[DB:genpept-bct1] [DE:Pyrococcus horikoshii OT3 genomic DNA, 1166001-1485000 nt.
position(6/7).] [NT:similar to Swiss_Prot:P37009 percent identity:] [LE:50541]
[RE:51533] [DI:complement]

| ORF_Name | NT_ID | AA_ID | NT/LN | AA/LN | Score | P-value |
|---|---|---|---|---|---|---|
| 31672530_f2_769 | 2503 | 9674 | 309 | 102 | 186 | 6.2e-14 |

Description sp:[LN:PQQE_KLEPN] [AC:P27507] [GN:PQQE] [OR:Klebsiella pneumoniae] [DE:COENZYME
PQQ SYNTHESIS PROTEIN E] [SP:P27507] [DB:swissprot] >sp:[LN:S20457] [AC:S20457]
[PN:pqqE protein] [GN:pqqE] [OR:Klebsiella pneumoniae] [DB:pir2] >gp:[GI:g809708]
[LN:KPPQQAF] [AC:X58778:S92172] [GN:pqqE] [OR:Klebsiella pneumoniae]
[DB:genpept-bct1] [DE:K.pneumoniae pqqABCDEF genes, involved in
pyrroloquinolinebiosynthesis.] [SP:P27507] [LE:3023] [RE:4165] [DI:direct]

| ORF_Name | NT_ID | AA_ID | NT/LN | AA/LN | Score | P-value |
|---|---|---|---|---|---|---|
| 31694433_c3_2583 | 2504 | 9675 | 186 | 61 | | |

Description

NO-HIT

| ORF Name | NT ID | AA ID | NT/LN | AA/LN | Score | P-value |
|---|---|---|---|---|---|---|
| 31734385_c2_2230 | 2505 | 9676 | 546 | 181 | 409 | 3.8e-38 |

Description sp:[LN:YDEI_ECOLI] [AC:P31130] [GN:YDEI] [OR:Escherichia coli] [DE:HYPOTHETICAL
14.1 KD PROTEIN IN MARB-DCP INTERGENIC REGION PRECURSOR] [SP:P31130]
[DB:swissprot] >sp:[LN:C64908] [AC:C64908] [PN:ydeI protein precursor] [GN:ydeI]
[CL:hypothetical protein b3024] [OR:Escherichia coli] [DB:pir2]
>gp:[GI:d1015946:g1742519] [LN:D90796] [AC:D90796:AB001340] [GN:ydeI]
[OR:Escherichia coli] [SR:Escherichia coli (strain:K12) DNA, clone_lib:Kohara
lambda minise] [DB:genpept-bct1] [DE:E.coli genomic DNA, Kohara clone
305(34.7-35.1 min.).] [NT:ORF_ID:o306#8; similar to [SwissProt Accession]
[LE:13252] [RE:13644] [DI:complement] >gp:[GI:d1015959:g1742533] [LN:D90797]
[AC:D90797:AB001340] [GN:ydeI] [OR:Escherichia coli] [SR:Escherichia coli
(strain:K12) DNA, clone_lib:Kohara lambda minise] [DB:genpept-bct1] [DE:E.coli
genomic DNA, Kohara clone #306(34.8-35.1 min.).] [NT:ORF_ID:o306#8; similar to
[SwissProt Accession] [LE:6701] [RE:7093] [DI:complement] >gp:[GI:g1787817]
[LN:AE000251] [AC:AE000251:U00096] [PN:orf, hypothetical protein] [GN:ydeI]
[FN:orf; Unknown] [OR:Escherichia coli] [DB:genpept-bct2] [DE:Escherichia coli
K-12 MG1655 section 141 of 400 of the completegenome.] [NT:f130; 100 pct
identical to YDEI_ECOLI SW: P31130] [LE:2920] [RE:3312] [DI:complement]

| ORF Name | NT ID | AA ID | NT/LN | AA/LN | Score | P-value |
|---|---|---|---|---|---|---|
| 31756636_c1_1682 | 2506 | 9677 | 483 | 160 | 151 | 8.3e-11 |

Description sp:[LN:YIAG_ECOLI] [AC:P37668] [GN:YIAG] [OR:Escherichia coli] [DE:HYPOTHETICAL
11.0 KD PROTEIN IN BISC-CSPA INTERGENIC REGION (O96)] [SP:P37668] [DB:swissprot]
>sp:[LN:S47776] [AC:S47776:E65154] [PN:hypothetical 11K protein (bisC-cspA
intergenic region):hypothetical protein o96] [GN:yiaG] [OR:Escherichia coli]
[DB:pir2] >gp:[GI:g466693] [LN:ECOUW76] [AC:U00039] [OR:Escherichia coli]
[SR:Escherichia coli (sub_strain MG1655, strain K-12) (library: lambda]
[DB:genpept-bct1] [DE:E. coli chromosomal region from 76.0 to 81.5 minutes.]
[LE:133729] [RE:134019] [DI:direct] >gp:[GI:g1789978] [LN:AE000433]
[AC:AE000433:U00096] [PN:orf, hypothetical protein] [GN:yiaG] [FN:orf; Unknown]
[OR:Escherichia coli] [DB:genpept-bct2] [DE:Escherichia coli K-12 MG1655 section
323 of 400 of the completegenome.] [NT:o96; 100 pct identical amino acid sequence
and] [LE:177] [RE:467] [DI:direct]

| ORF Name | NT ID | AA ID | NT/LN | AA/LN | Score | P-value |
|---|---|---|---|---|---|---|
| 3178466_c2_2134 | 2507 | 9678 | 246 | 81 | | |

Description

NO-HIT

| ORF Name | NT ID | AA ID | NT/LN | AA/LN | Score | P-value |
|---|---|---|---|---|---|---|
| 31815893_f1_177 | 2508 | 9679 | 477 | 158 | 164 | 3.5e-12 |

Description gp:[GI:e1179979:g2073394] [LN:BC332AB] [AC:Y09323] [PN:hypothetical protein]
[GN:332b] [FN:unknown] [OR:Bacillus cereus] [DB:genpept-bct1] [DE:B.cereus DNA,
two genes with unknown function.] [LE:761] [RE:1198] [DI:direct]

| ORF Name | NT ID | AA ID | NT/LN | AA/LN | Score | P-value |
|---|---|---|---|---|---|---|
| 31895937_f2_725 | 2509 | 9680 | 1314 | 437 | 990 | 1.0e-99 |

Description sp:[LN:T12022] [AC:T12022] [PN:3-oxoacyl-[acyl-carrier-protein] synthase, II]
[GN:fabF] [CL:3-oxoacyl-[acyl-carrier-protein] synthase
I:3-oxoacyl-[acyl-carrier-protein] synthase I homology] [OR:Pseudomonas
aeruginosa] [EC:2.3.1.41] [DB:pir2] >gp:[GI:g2738156] [LN:PAU91631] [AC:U91631]
[PN:3-oxoacyl-acyl carrier protein synthase II] [GN:fabF] [OR:Pseudomonas
aeruginosa] [DB:genpept-bct2] [DE:Pseudomonas aeruginosa PlsX protein homolog
(plsX) gene, partialcds; and malonyl-CoA:acyl carrier protein transacylase
(fabD),3-oxoacyl-acyl carrier protein reductase (fabG), acyl carrierprotein
(acpP), and 3-oxoacyl-acyl carrier protein synthase II(fabF) genes, complete
cds.] [LE:2550] [RE:3794] [DI:direct]

| ORF Name | NT ID | AA ID | NT/LN | AA/LN | Score | P-value |
|---|---|---|---|---|---|---|
| 31900761_f2_871 | 2510 | 9681 | 702 | 233 | 1047 | 9.4e-106 |

Description sp:[LN:NARV_ECOLI] [AC:P19316] [GN:NARV] [OR:Escherichia coli] [EC:1.7.99.4]
[DE:RESPIRATORY NITRATE REDUCTASE 2 GAMMA CHAIN,] [SP:P19316] [DB:swissprot]
>sp:[LN:S11430] [AC:S11430:D64899] [PN:nitrate reductase, 2 gamma chain:narV
protein] [GN:narV] [CL:nitrate reductase gamma chain] [OR:Escherichia coli]
[EC:1.7.99.4] [DB:pir2] >gp:[GI:d1015821:g1742384] [LN:D90786]
[AC:D90786:AB001340] [PN:NarV protein] [GN:narV] [OR:Escherichia coli]
[SR:Escherichia coli (strain:K12) DNA, clone_lib:Kohara lambda minise]
[DB:genpept-bct1] [DE:E.coli genomic DNA, Kohara clone #275(32.8-33.2 min.).]
[NT:ORF_ID:o276#4; similar to [PIR Accession Number] [LE:12241] [RE:12921]
[DI:complement] >gp:[GI:d1015833:g1742397] [LN:D90787] [AC:D90787:AB001340]
[PN:NarV protein] [GN:narV] [OR:Escherichia coli [SR:Escherichia coli
(strain:K12) DNA, clone_lib:Kohara lambda minise] [DB:genpept-bct1] [DE:E.coli
genomic DNA, Kohara clone #276(33.0-33.3 min.).] [NT:ORF_ID:o276#4; similar to
[PIR Accession Number] [LE:6167] [RE:6847] [DI:complement] >gp:[GI:g42111]
[LN:ECNARZYW] [AC:X17110] [PN:apocytochrome b(NR)] [GN:narV] [OR:Escherichia
coli] [DB:genpept-bct1] [DE:E. coli transcription unit narZYWV DNA for nitrate
reductasesubunits.] [SP:P19316] [LE:6218] [RE:6898] [DI:direct] >gp:[GI:g1787738]
[LN:AE000243] [AC:AE000243:U00096] [PN:cryptic nitrate reductase 2, gamma
subunit] [GN:narV] [FN:enzyme; Energy metabolism, carbon: Anaerobic]
[OR:Escherichia coli] [DB:genpept-bct2] [EC:1.7.99.4] [DE:Escherichia coli K-12
MG1655 section 133 of 400 of the completegenome.] [NT:f226; 100 pct identical to
NARV_ECOLI SW: P19316;] [LE:5472] [RE:6152] [DI:complement]

| ORF_Name | NT_ID | AA_ID | NT/LN | AA/LN | Score | P-value |
|---|---|---|---|---|---|---|
| 32031577_f1_454 | 2511 | 9682 | 468 | 155 | 654 | 4.1e-64 |

Description sp:[LN:SLYB_SALTY] [AC:Q53549] [GN:SLYB] [OR:Salmonella typhimurium] [DE:OUTER MEMBRANE LIPOPROTEIN SLYB PRECURSOR] [SP:Q53549] [DB:swissprot] >gp:[GI:g1246075] [LN:S80790] [AC:S80790] [PN:SlyB] [GN:slyB] [OR:Salmonella typhimurium] [SR:Salmonella typhimurium 14028s] [DB:genpept-bct1] [DE:slyB=outer membrane lipoprotein PCP homolog {5' region} [Salmonellatyphimurium, 14028s, Genomic, 250 nt].] [NT:outer membrane lipoprotein PCP homolog; Haemophilus] [LE:164] [RE:250] [DI:direct]

| ORF_Name | NT_ID | AA_ID | NT/LN | AA/LN | Score | P-value |
|---|---|---|---|---|---|---|
| 32041580_f1_376 | 2512 | 9683 | 777 | 258 | 527 | 1.2e-50 |

Description gp:[GI:e1290214:g3116018] [LN:PFPHCOAHL] [AC:Y13067] [PN:vanillin: NAD+ oxidoreductase] [GN:vdh] [OR:Pseudomonas fluorescens] [DB:genpept-bct1] [DE:Pseudomonas fluorescens genes encoding p-hydroxycinnamoyl CoAhydratase/lyase and vanillin: NAD+ oxidoreductase.] [LE:1058] [RE:2506] [DI:direct]

| ORF_Name | NT_ID | AA_ID | NT/LN | AA/LN | Score | P-value |
|---|---|---|---|---|---|---|
| 32057041_c2_2436 | 2513 | 9684 | 546 | 181 | | |

Description

NO-HIT

| ORF_Name | NT_ID | AA_ID | NT/LN | AA/LN | Score | P-value |
|---|---|---|---|---|---|---|
| 32070908_f2_537 | 2514 | 9685 | 1428 | 475 | 1864 | 2.5e-192 |

Description sp:[LN:YNEI_ECOLI] [AC:P76149:P78220] [GN:YNEI] [OR:Escherichia coli] [EC:1.2.1.-] [DE:INTERGENIC REGION,] [SP:P76149:P78220] [DB:swissprot]

| ORF_Name | NT_ID | AA_ID | NT/LN | AA/LN | Score | P-value |
|---|---|---|---|---|---|---|
| 32125275_f1_438 | 2515 | 9686 | 321 | 106 | 326 | 2.4e-29 |

Description sp:[LN:YDGT_ECOLI] [AC:P76179] [GN:YDGT] [OR:Escherichia coli] [DE:HYPOTHETICAL 8.4 KD PROTEIN IN ADD-NTH INTERGENIC REGION] [SP:P76179] [DB:swissprot] >sp:[LN:C64919] [AC:C64919] [PN:modulating protein ymoA homolog b1625] [CL:modulating protein ymoA] [OR:Escherichia coli] [DB:pir2] >gp:[GI:g1787912] [LN:AE000258] [AC:AE000258:U00096] [PN:orf, hypothetical protein] [GN:b1625] [FN:orf; Unknown] [OR:Escherichia coli] [DB:genpept-bct2] [DE:Escherichia coli K-12 MG1655 section 148 of 400 of the completegenome.] [NT:o71; This 71 aa ORF is 42 pct identical (4 gaps)] [LE:5670] [RE:5885] [DI:direct]

| ORF_Name | NT_ID | AA_ID | NT LN | AA LN | Score | P-value |
|---|---|---|---|---|---|---|
| 32133465_c2_2128 | 2516 | 9687 | 498 | 165 | 278 | 2.9e-24 |

Description sp:[LN:YIIS_ECOLI] [AC:P32162] [GN:YIIS] [OR:Escherichia coli] [DE:HYPOTHETICAL
10.8 KD PROTEIN IN TPIA-FPR INTERGENIC REGION] [SP:P32162] [DB:swissprot]
>sp:[LN:S40865] [AC:S40865:E65198] [PN:C4-dicarboxylate transport protein homolog
(tpia-fpr intergenic region):hypothetical protein o99] [GN:yiiS]
[CL:C4-dicarboxylate carrier protein] [OR:Escherichia coli] [DB:pir1]
>gp:[GI:g305025] [LN:ECOUW87] [AC:L19201] [OR:Escherichia coli] [SR:Escherichia
coli (sub_strain MG1655, strain K-12) (library: lambda) [DB:genpept-bct1] [DE:E.
coli chromosomal region from 87.2 to 89.2 minutes.] [LE:74600] [RE:74899]
[DI:direct] >gp:[GI:g1790357] [LN:AE000467] [AC:AE000467:U00096] [PN:orf,
hypothetical protein] [GN:yiiS] [FN:orf; Unknown] [OR:Escherichia coli]
[DB:genpept-bct2] [DE:Escherichia coli K-12 MG1655 section 357 of 400 of the
completegenome.] [NT:o99; 100 pct identical amino acid sequence and] [LE:93]
[RE:392] [DI:direct]

| ORF_Name | NT_ID | AA_ID | NT LN | AA LN | Score | P-value |
|---|---|---|---|---|---|---|
| 32135182_f2_876 | 2517 | 9688 | 393 | 130 | 154 | 1.1e-10 |

Description gp:[GI:g805006] [LN:PPHP1G] [AC:X80272] [GN:pprB] [OR:Pseudomonas putida]
[DB:genpept-bct1] [DE:P.putida pprB gene.] [LE:77] [RE:973] [DI:direct]

| ORF_Name | NT_ID | AA_ID | NT LN | AA LN | Score | P-value |
|---|---|---|---|---|---|---|
| 32208581_c1_1926 | 2518 | 9689 | 624 | 207 | 158 | 4.8e-11 |

Description sp:[LN:MRKD_KLEPN] [AC:P21648] [GN:MRKD] [OR:Klebsiella pneumoniae] [DE:FIMBRIA
ADHESIN PROTEIN PRECURSOR] [SP:P21648] [DB:swissprot] >sp:[LN:B32801]
[AC:B32801:E39142] [PN:fimbrial adhesin precursor, type 3] [OR:Klebsiella
pneumoniae] [DB:pir2] >gp:[GI:g149239] [LN:KPNMRKAA] [AC:M55912] [GN:mrkD]
[OR:Klebsiella pneumoniae] [SR:K.pneumoniae (strain IA565) DNA] [DB:genpept-bct1]
[DE:K.pneumoniae mrk[A-E] genes, complete cds.] [LE:4970] [RE:5935] [DI:direct]
>gp:[GI:g511858] [LN:KPNMRKD] [AC:M24536] [PN:fimbrial adhesin] [GN:mrkD]
[OR:Klebsiella pneumoniae] [SR:Klebsiella pneumoniae DNA] [DB:genpept-bct1]
[DE:Klebsiella pneumoniae type 3 fimbrial adhesin (mrkD) gene, completecds.]
[LE:397] [RE:1362] [DI:direct]

| ORF Name | NT ID | AA ID | NT/LN | AA/LN | Score | P-value |
|---|---|---|---|---|---|---|
| 32209537_c3_2984 | 2519 | 9690 | 831 | 276 | 664 | 3.6e-65 |

Description sp:[LN:ABC_ECOLI] [AC:P30750:P77517] [GN:ABC] [OR:Escherichia coli]
[DE:ATP-BINDING PROTEIN ABC] [SP:P30750:P77517] [DB:swissprot] >sp:[LN:G64744]
[AC:G64744:I41113] [PN:probable ABC-type transport protein abc] [GN:abc]
[CL:unassigned ATP-binding cassette proteins:ATP-binding cassette homology]
[OR:Escherichia coli] [DB:pir2] >gp:[GI:g1552775] [LN:ECU70214] [AC:U70214]
[PN:ATP-binding protein] [GN:abc] [OR:Escherichia coli] [DB:genpept-bct1]
[DE:Escherichia coli chromosome minutes 4-6.] [LE:52689] [RE:53720]
[DI:complement] >gp:[GI:g1786398] [LN:AE000129] [AC:AE000129:U00096]
[PN:ATP-binding component of a transporter] [GN:abc] [FN:transport; Not
classified] [OR:Escherichia coli] [DB:genpept-bct2] [DE:Escherichia coli K-12
MG1655 section 19 of 400 of the completegenome.] [NT:f343; 98 pct identical to
fragment (231] [LE:1590] [RE:2621] [DI:complement]

| ORF Name | NT ID | AA ID | NT/LN | AA/LN | Score | P-value |
|---|---|---|---|---|---|---|
| 32212717_f1_392 | 2520 | 9691 | 216 | 71 | 74 | 0.015 |

Description sp:[LN:C70531] [AC:C70531] [PN:hypothetical protein Rv2704] [GN:Rv2704]
[OR:Mycobacterium tuberculosis] [DB:pir2] >gp:[GI:e321102:g2181995] [LN:MTCY05A6]
[AC:Z96072:AL123456] [PN:hypothetical protein Rv2704] [GN:Rv2704]
[OR:Mycobacterium tuberculosis] [DB:genpept-bct1] [DE:Mycobacterium tuberculosis
H37Rv complete genome; segment 120/162.] [NT:Rv2704, (MTCY05A6.25), len: 142.
Function:] [LE:23455] [RE:23883] [DI:direct]

| ORF Name | NT ID | AA ID | NT/LN | AA/LN | Score | P-value |
|---|---|---|---|---|---|---|
| 32212777_f1_18 | 2521 | 9692 | 1275 | 424 | 947 | 3.7e-95 |

Description sp:[LN:S76228] [AC:S76228] [PN:hypothetical protein] [OR:Synechocystis sp.]
[SR:PCC 6803, , PCC 6803] [SR:PCC 6803, ] [DB:pir2] >gp:[GI:d1019220:g1653574]
[LN:D90914] [AC:D90914:AB001339] [PN:negative aliphatic amidase regulator]
[GN:amiC] [OR:Synechocystis sp.] [SR:Synechocystis sp. (strain:PCC6803) DNA]
[DB:genpept-bct1] [DE:Synechocystis sp. PCC6803 complete genome, 16/27,
1991550-2137258.] [NT:ORF_ID:slr0447] [LE:107372] [RE:108712] [DI:direct]

| ORF_Name | NT_ID | AA_ID | NT/LN | AA/LN | Score | P-value |
|---|---|---|---|---|---|---|
| 32239133_c1_1901 | 2522 | 9693 | 1404 | 467 | 791 | 1.3e-78 |

Description sp:[LN:TUB3_AGRVI] [AC:P70786] [GN:TTUB] [OR:Agrobacterium vitis] [DE:PUTATIVE TARTRATE TRANSPORTER] [SP:P70786] [DB:swissprot] >gp:[GI:g984367] [LN:AVU32375] [AC:U32375] [GN:ttuB] [OR:Agrobacterium vitis] [SR:plasmid pTrAB3] [DB:genpept-bct2] [DE:Agrobacterium vitis plasmid pTrAB3 tartrate utilization generegion, including LysR-like regulator (ttuA), membrane protein(ttuB), tartrate dehydrogenase (ttuC and ttuC'), enzyme degradingprimary tartrate degradation product (ttuD) and pyruvate kinase(ttuE) genes, complete cds.] [NT:membrane protein] [LE:1579] [RE:2928] [DI:direct]

| ORF_Name | NT_ID | AA_ID | NT/LN | AA/LN | Score | P-value |
|---|---|---|---|---|---|---|
| 32245837_c2_2286 | 2523 | 9694 | 336 | 111 | | |

Description

NO-HIT

| ORF_Name | NT_ID | AA_ID | NT/LN | AA/LN | Score | P-value |
|---|---|---|---|---|---|---|
| 32320966_f3_1403 | 2524 | 9695 | 1584 | 527 | | |

Description

NO-HIT

| ORF_Name | NT_ID | AA_ID | NT/LN | AA/LN | Score | P-value |
|---|---|---|---|---|---|---|
| 32453293_c2_2394 | 2525 | 9696 | 696 | 231 | 615 | 5.6e-60 |

Description sp:[LN:ALSE_ECOLI] [AC:P32719] [GN:ALSE] [OR:Escherichia coli] [EC:5.1.3.-] [DE:D-ALLULOSE-6-PHOSPHATE 3-EPIMERASE,] [SP:P32719] [DB:swissprot] >sp:[LN:D65217] [AC:D65217] [PN:hypothetical 26.1 kD protein in fdhf-phnp intergenic region] [GN:yjcU] [CL:yeast ribulose-5-phosphate-epimerase] [OR:Escherichia coli] [DB:pir2] >gp:[GI:g1790523] [LN:AE000482] [AC:AE000482:U00096] [PN:putative epimerase] [GN:yjcU] [FN:putative enzyme; Not classified] [OR:Escherichia coli] [DB:genpept-bct2] [DE:Escherichia coli K-12 MG1655 section 372 of 400 of the completegenome.] [NT:f231; 100 pct identical to YJCU_ECOLI SW:] [LE:3431] [RE:4126] [DI:complement] >gp:[GI:g396420] [LN:ECOUW89] [AC:U00006] [OR:Escherichia coli] [SR:Escherichia coli (sub_strain MG1655, strain K-12) (library: lambda] [DB:genpept-bct2] [DE:E. coli chromosomal region from 89.2 to 92.8 minutes.] [NT:similar to Alcaligenes eutrophus pHG1] [LE:173022] [RE:173717] [DI:complement]

| ORF Name | NT ID | AA ID | NT LN | AA LN | Score | P-value |
|---|---|---|---|---|---|---|
| 32511566_f1_326 | 2526 | 9697 | 1578 | 525 | 2545 | 1.7e-264 |

Description sp:[LN:NARY_ECOLI] [AC:P19318:P78267] [GN:NARY] [OR:Escherichia coli]
[EC:1.7.99.4] [DE:RESPIRATORY NITRATE REDUCTASE 2 BETA CHAIN,] [SP:P19318:P78267]
[DB:swissprot] >sp:[LN:F64899] [AC:F64899:S11428] [PN:nitrate reductase, 2 beta
chain] [GN:narY] [CL:nitrate reductase beta chain:ferredoxin 2[4Fe-4S] homology]
[OR:Escherichia coli] [EC:1.7.99.4] [DB:pir2] >gp:[GI:d1015823:g1742386]
[LN:D90786] [AC:D90786:AB001340] [PN:NarY protein] [GN:narY] [OR:Escherichia
coli] [SR:Escherichia coli (strain:K12) DNA, clone_lib:Kohara lambda minise]
[DB:genpept-bct1] [DE:E.coli genomic DNA, Kohara clone #275(32.8-33.2 min.).]
[NT:ORF_ID:o276#6; similar to [PIR Accession Number] [LE:13613] [RE:15157]
[DI:complement] >gp:[GI:d1015835:g1742399] [LN:D90787] [AC:D90787:AB001340]
[PN:NarY protein] [GN:narY] [OR:Escherichia coli] [SR:Escherichia coli
(strain:K12) DNA, clone_lib:Kohara lambda minise] [DB:genpept-bct1] [DE:E.coli
genomic DNA, Kohara clone #276(33.0-33.3 min.).] [NT:ORF_ID:o276#6; similar to
[PIR Accession Number] [LE:7539] [RE:9083] [DI:complement] >gp:[GI:g1787740]
[LN:AE000243] [AC:AE000243:U00096] [PN:cryptic nitrate reductase 2, beta subunit]
[GN:narY] [FN:enzyme; Energy metabolism, carbon: Anaerobic] [OR:Escherichia coli]
[DB:genpept-bct2] [EC:1.7.99.4] [DE:Escherichia coli K-12 MG1655 section 133 of
400 of the completegenome.] [NT:f514; 99 pct identical to NARY_ECOLI SW: P19318;
CG] [LE:6844] [RE:8388] [DI:complement]

| ORF Name | NT ID | AA ID | NT LN | AA LN | Score | P-value |
|---|---|---|---|---|---|---|
| 32516941_c3_2944 | 2527 | 9698 | 345 | 114 | 114 | 3.1e-06 |

Description gp:[GI:e1345662:g3875920] [LN:CEF14F7] [AC:Z81503] [GN:F14F7.1]
[OR:Caenorhabditis elegans] [DB:genpept-inv1] [DE:Caenorhabditis elegans cosmid
F14F7, complete sequence.] [NT:predicted using Genefinder; similar to collagen;]
[LE:9598:9801:9925] [RE:9678:9866:10695] [DI:directJoin]

| ORF Name | NT ID | AA ID | NT LN | AA LN | Score | P-value |
|---|---|---|---|---|---|---|
| 32556417_c2_2431 | 2528 | 9699 | 360 | 119 | 233 | 1.7e-19 |

Description sp:[LN:AMPM_SALTY] [AC:P10882] [GN:MAP:PEPM] [OR:Salmonella typhimurium]
[EC:3.4.11.18] [DE:METHIONINE AMINOPEPTIDASE, (MAP) (PEPTIDASE M)] [SP:P10882]
[DB:swissprot]

| ORF Name | NT ID | AA ID | NT LN | AA LN | Score | P-value |
|---|---|---|---|---|---|---|
| 32556925_c2_2406 | 2529 | 9700 | 981 | 326 | 362 | 3.6e-33 |

Description sp:[LN:SM30_RAT] [AC:Q03336:Q63496] [GN:RGN:SMP30] [OR:Rattus norvegicus]
[SR:,Rat] [DE:SENESCENCE MARKER PROTEIN-30 (SMP-30) (REGUCALCIN) (RC)]
[SP:Q03336:Q63496] [DB:swissprot] >sp:[LN:S34588] [AC:S34588:S34589:S27203]
[PN:senescence marker protein SMP-30:regucalcin] [CL:senescence marker
protein-30] [OR:Rattus norvegicus] [SR:, Norway rat] [DB:pir2]
>gp:[GI:d1008070:g408807] [LN:RATCBP1] [AC:D38467:D14327:D16386] [PN:regucalcin]
[OR:Rattus norvegicus] [SR:Rattus norvegicus (strain:Wistar) liver cDNA to mRNA]
[DB:genpept-rod] [DE:Rat mRNA for calcium-binding protein, complete cds.] [LE:93]
[RE:992] [DI:direct]

| ORF Name | NT ID | AA ID | NT LN | AA LN | Score | P-value |
|---|---|---|---|---|---|---|
| 32666457_f3_1095 | 2530 | 9701 | 531 | 176 | 135 | 4.1e-09 |

Description sp:[LN:F72636] [AC:F72636] [PN:hypothetical protein APE1549] [GN:APE1549]
[OR:Aeropyrum pernix] [DB:pir2] >gp:[GI:d1044334:g5105234] [LN:AP000061]
[AC:AP000061] [PN:122aa long hypothetical protein] [GN:APE1549] [OR:Aeropyrum
pernix] [SR:Aeropyrum pernix (strain:K1) DNA] [DB:genpept-bct1] [DE:Aeropyrum
pernix genomic DNA, section 4/7.] [NT:similar to OWL:AB00946832 percent
identity:39.604] [LE:261337] [RE:261705] [DI:complement]

| ORF Name | NT ID | AA ID | NT LN | AA LN | Score | P-value |
|---|---|---|---|---|---|---|
| 32677337_c3_2562 | 2531 | 9702 | 1365 | 454 | 2111 | 1.7e-218 |

Description sp:[LN:SYECYT] [AC:A01178:C43261:G64920] [PN:tyrosine--tRNA ligase,:tyrosyl-tRNA
synthetase] [GN:tyrS] [CL:tyrosine--tRNA ligase] [OR:Escherichia coli]
[EC:6.1.1.1] [DB:pir1] [MP:36 min] >gp:[GI:g148094] [LN:ECOTYRS] [AC:J01719]
[OR:Escherichia coli] [SR:Escherichia coli K12 DNA] [DB:genpept-bct1] [DE:E.coli
tyrS gene coding for tyrosyl-tRNA synthetase.] [NT:tyrosyl-tRNA synthetase
(tyrS)] [LE:1] [RE:1275] [DI:direct] >gp:[GI:g1787925] [LN:AE000259]
[AC:AE000259:U00096] [PN:tyrosine tRNA synthetase] [GN:tyrS] [FN:enzyme;
Aminoacyl tRNA synthetases, tRNA] [OR:Escherichia coli] [DB:genpept-bct2]
[EC:6.1.1.1] [DE:Escherichia coli K-12 MG1655 section 149 of 400 of the
completegenome.] [NT:f424; 100 pct identical to SYY_ECOLI SW: P00951; CG]
[LE:3555] [RE:4829] [DI:complement]

| ORF Name | NT ID | AA ID | NT LN | AA LN | Score | P-value |
|---|---|---|---|---|---|---|
| 32681406_f3_1337 | 2532 | 9703 | 318 | 105 | 133 | 6.7e-09 |

Description sp:[LN:RS22_ECOLI] [AC:P28690] [GN:RPSV] [OR:Escherichia coli] [DE:VERY
HYPOTHETICAL 30S RIBOSOMAL PROTEIN S22] [SP:P28690] [DB:swissprot]
>sp:[LN:C64901] [AC:C64901] [PN:ribosomal protein S22] [GN:rpsV] [CL:Escherichia
coli ribosomal protein S22] [OR:Escherichia coli] [DB:pir1]
>gp:[GI:d1002974:g216642] [LN:ECORPSVW] [AC:D13179] [PN:ribosomal protein S22]
[GN:rpsV] [OR:Escherichia coli] [SR:Escherichia coli (sub_strain W3110, strain
K-12) (library: Kohar] [DB:genpept-bct1] [DE:Escherichia coli rpsV gene for
ribosomal protein S22.] [LE:1289] [RE:1426] [DI:direct] >gp:[GI:g1787755]
[LN:AE000245] [AC:AE000245:U00096] [PN:30S ribosomal subunit protein S22]
[GN:rpsV] [FN:structural component; Ribosomal proteins -] [OR:Escherichia coli]
[DB:genpept-bct2] [DE:Escherichia coli K-12 MG1655 section 135 of 400 of the
completegenome.] [NT:f45; 100 pct identical to RS22_ECOLI SW: P28690; CG]
[LE:3062] [RE:3199] [DI:complement]

| ORF Name | NT ID | AA ID | NT LN | AA LN | Score | P-value |
|---|---|---|---|---|---|---|
| 32683266_c1_1900 | 2533 | 9704 | 1227 | 408 | 903 | 1.7e-90 |

Description gp:[GI:e281310:g1667356] [LN:CTZ82038] [AC:Z82038] [PN:acetyl coenzyme A
acetyltransferase (thiolase)] [GN:thlA] [OR:Thermoanaerobacterium
thermosaccharolyticum] [DB:genpept-bct1] [EC:2.3.1.9] [DE:C.thermosaccharolyticum
etfB, etfA, hbd, thlA and actA genes.] [LE:2642] [RE:3820] [DI:direct]
>gp:[GI:e308220:g1903332] [LN:TTBCSOPRN] [AC:Z92974] [PN:acetyl coenzyme A
acetyltransferase (thiolase)] [GN:thl] [OR:Thermoanaerobacterium
thermosaccharolyticum] [DB:genpept-bct1] [EC:2.3.1.9] [DE:T.thermosaccharolyticum
BCS operon DNA.] [LE:4835] [RE:6013] [DI:direct]

| ORF_Name | NT ID | AA ID | NT LN | AA LN | Score | P-value |
|---|---|---|---|---|---|---|
| 32703305_f1_478 | 2534 | 9705 | 1173 | 390 | 1807 | 2.7e-186 |

Description sp:[LN:A44292] [AC:A44292:G64923] [PN:cyclopropane-fatty-acyl-phospholipid synthase,] [GN:cfa] [CL:cyclopropane-fatty-acyl-phospholipid synthase:MCM homology] [OR:Escherichia coli] [EC:2.1.1.79] [DB:pir2]
>gp:[GI:d1016149:g1742735] [LN:D90809] [AC:D90809:AB001340] [PN:Cyclopropane fatty acid synthase] [GN:cfa] [OR:Escherichia coli] [SR:Escherichia coli (strain:K12) DNA, clone_lib:Kohara lambda minise] [DB:genpept-bct1] [DE:E.coli genomic DNA, Kohara clone #318(37.2-37.6 min.).] [NT:ORF_ID:o319#5; similar to [PIR Accession Number] [LE:13006] [RE:14154] [DI:direct]
>gp:[GI:d1016158:g1742745] [LN:D90810] [AC:D90810:AB001340] [PN:Cyclopropane fatty acid synthase] [GN:cfa] [OR:Escherichia coli] [SR:Escherichia coli (strain:K12) DNA, clone_lib:Kohara lambda minise] [DB:genpept-bct1] [DE:E.coli genomic DNA, Kohara clone #319(37.4-37.8 min.).] [NT:ORF_ID:o319#5; similar to [PIR Accession Number] [LE:5400] [RE:6548] [DI:direct] >gp:[GI:g145514] [LN:ECOCFAX] [AC:M98330] [PN:cyclopropane fatty acid synthase] [GN:cfa] [OR:Escherichia coli] [SR:Escherichia coli (strain K-12) HfrC DNA] [DB:genpept-bct1] [DE:Escherichia coli cyclopropane fatty acid synthase (cfa) gene,complete cds.] [LE:286] [RE:1434] [DI:direct] >gp:[GI:g1787951] [LN:AE000261] [AC:AE000261:U00096] [PN:cyclopropane fatty acyl phospholipid synthase] [GN:cfa] [FN:enzyme; Fatty acid and phosphatidic acid] [OR:Escherichia coli] [DB:genpept-bct2] [EC:2.1.1.79] [DE:Escherichia coli K-12 MG1655 section 151 of 400 of the completegenome.] [NT:o382; 100 pct identical to CFA_ECOLI SW: P30010; CG] [LE:6129] [RE:7277] [DI:direct]

| ORF_Name | NT ID | AA ID | NT LN | AA LN | Score | P-value |
|---|---|---|---|---|---|---|
| 32712706_c2_2146 | 2535 | 9706 | 588 | 195 | 135 | 3.3e-08 |

Description sp:[LN:A69190] [AC:A69190] [PN:hypothetical protein MTH676] [GN:MTH676] [OR:Methanobacterium thermoautotrophicum] [DB:pir2] >gp:[GI:g2621760] [LN:AE000847] [AC:AE000847:AE000666] [PN:unknown] [GN:MTH676] [OR:Methanobacterium thermoautotrophicum] [DB:genpept-bct2] [DE:Methanobacterium thermoautotrophicum from bases 597721 to 608106(section 53 of 148) of the complete genome.] [NT:Function Code:14.00 - Unknown, ; similar to,] [LE:9595] [RE:10212] [DI:direct]

| ORF_Name | NT ID | AA ID | NT LN | AA LN | Score | P-value |
|---|---|---|---|---|---|---|
| 32713456_c2_2259 | 2536 | 9707 | 366 | 121 | 117 | 2.6e-06 |

Description sp:[LN:SKXLAG] [AC:S07498:A34140] [PN:dermal gland protein APEG precursor] [CL:dermal gland protein APEG:trefoil homology] [OR:Xenopus laevis] [SR:, African clawed frog] [DB:pir1]

| ORF Name | NT ID | AA ID | NT LN | AA LN | Score | P-value |
|---|---|---|---|---|---|---|
| 33219006_f2_818 | 2537 | 9708 | 957 | 318 | 854 | 2.7e-85 |

Description sp:[LN:YHXD_BACSU] [AC:P40398:O07554] [GN:YHXD] [OR:Bacillus subtilis]
[EC:1.-.-.-] [DE:(EC 1.-.-.-) (ORFY)] [SP:P40398:O07554] [DB:swissprot]
>sp:[LN:E69835] [AC:E69835:S43612] [PN:ribitol dehydrogenase homolog yhxD]
[GN:yhxD] [CL:short-chain alcohol dehydrogenase homology] [OR:Bacillus subtilis]
[DB:pir2] >gp:[GI:e1183045:g2633379] [LN:BSUB0006] [AC:Z99109:AL009126] [GN:yhxD]
[FN:unknown] [OR:Bacillus subtilis] [DB:genpept-bct1] [DE:Bacillus subtilis
complete genome (section 6 of 21): from 999501 to1209940.] [NT:similar to ribitol
dehydrogenase] [SP:P40398] [LE:117706] [RE:118605] [DI:complement]
>gp:[GI:e324973:g2226172] [LN:BSY14081] [AC:Y14081] [PN:hypothetical protein]
[GN:yhxD] [OR:Bacillus subtilis] [DB:genpept-bct1] [DE:Bacillus subtilis
chromosomal DNA, region 92 degrees: regionbetween comK and addAB.] [NT:bp 1-501
overlaps with bp 1525-1947 (end) from EMBL] [SP:P40398] [LE:1] [RE:900]
[DI:complement]

| ORF Name | NT ID | AA ID | NT LN | AA LN | Score | P-value |
|---|---|---|---|---|---|---|
| 33401081_c1_1927 | 2538 | 9709 | 1389 | 462 | 1741 | 2.7e-179 |

Description sp:[LN:F64902] [AC:F64902] [PN:hypothetical protein b1491] [OR:Escherichia coli]
[DB:pir2] >gp:[GI:g1787767] [LN:AE000246] [AC:AE000246:U00096] [PN:orf,
hypothetical protein] [GN:b1491] [FN:orf; Unknown] [OR:Escherichia coli]
[DB:genpept-bct2] [DE:Escherichia coli K-12 MG1655 section 136 of 400 of the
completegenome.] [NT:f439; This 439 aa ORF is 30 pct identical (20 gaps)]
[LE:4361] [RE:5680] [DI:complement]

| ORF Name | NT ID | AA ID | NT LN | AA LN | Score | P-value |
|---|---|---|---|---|---|---|
| 33409806_f2_643 | 2539 | 9710 | 264 | 87 | | |

Description

NO-HIT

| ORF Name | NT ID | AA ID | NT LN | AA LN | Score | P-value |
|---|---|---|---|---|---|---|
| 33594202_f2_987 | 2540 | 9711 | 1053 | 350 | 1598 | 3.8e-164 |

Description sp:[LN:YDGO_ECOLI] [AC:P76182] [GN:YDGO] [OR:Escherichia coli] [DE:HYPOTHETICAL
38.1 KD PROTEIN IN ADD-NTH INTERGENIC REGION] [SP:P76182] [DB:swissprot]
>sp:[LN:H64919] [AC:H64919] [PN:probable membrane protein ydgO precursor]
[GN:ydgO] [OR:Escherichia coli] [DB:pir2] >gp:[GI:g1787917] [LN:AE000258]
[AC:AE000258:U00096] [PN:orf, hypothetical protein] [GN:ydgO] [FN:orf; Unknown]
[OR:Escherichia coli] [DB:genpept-bct2] [DE:Escherichia coli K-12 MG1655 section
148 of 400 of the completegenome.] [NT:o352; residues 7-306 are 46 pct identical
to] [LE:9863] [RE:10921] [DI:direct]

| ORF Name | NT ID | AA ID | NT LN | AA LN | Score | P-value |
|---|---|---|---|---|---|---|
| 33697582_c1_1684 | 2541 | 9712 | 408 | 135 | 122 | 7.1e-07 |

Description gp:[GI:e1486707;g5019347] [LN:SCH35] [AC:AL078610] [PN:putative oxidoreductase]
[GN:SCH35.27] [OR:Streptomyces coelicolor] [DB:genpept-bct1] [DE:Streptomyces
coelicolor cosmid H35.] [NT:SCH35.27, possible oxidoreductase, len: 406aa;]
[LE:23964] [RE:25184] [DI:complement]

| ORF Name | NT ID | AA ID | NT LN | AA LN | Score | P-value |
|---|---|---|---|---|---|---|
| 33711588_c2_2184 | 2542 | 9713 | 939 | 312 | 972 | 8.3e-98 |

Description sp:[LN:S66469] [AC:S66469] [PN:catechol 1,2-dioxygenase] [CL:catechol
1,2-dioxygenase] [OR:Pseudomonas putida] [DB:pir2] >gp:[GI:d1007613;g1008924]
[LN:PSECATDIO] [AC:D37782] [PN:catechol 1,2-dioxygenase] [OR:Pseudomonas putida]
[SR:Pseudomonas putida (strain:mt-2) DNA, clone:pCN12] [DB:genpept-bct1]
[DE:Pseudomonas putida gene for catechol 1,2-dioxygenase, complete cds.] [LE:46]
[RE:981] [DI:direct]

| ORF Name | NT ID | AA ID | NT LN | AA LN | Score | P-value |
|---|---|---|---|---|---|---|
| 33711592_f3_1469 | 2543 | 9714 | 909 | 302 | 367 | 1.1e-33 |

Description gp:[GI:g5354193] [LN:AF157493] [AC:AF157493] [PN:hypothetical protein]
[GN:zm10orf5] [OR:Zymomonas mobilis] [DB:genpept-bct2] [DE:Zymomonas mobilis ZM4
fosmid clone 42D7, complete sequence.] [LE:10772] [RE:11728] [DI:direct]

| ORF Name | NT ID | AA ID | NT LN | AA LN | Score | P-value |
|---|---|---|---|---|---|---|
| 33719581_c3_3054 | 2544 | 9715 | 3015 | 1004 | 5291 | 0.0 |

Description sp:[LN:BGAL_KLEPN] [AC:P06219] [GN:LACZ] [OR:Klebsiella pneumoniae] [EC:3.2.1.23]
[DE:BETA-GALACTOSIDASE, (LACTASE)] [SP:P06219] [DB:swissprot] >sp:[LN:A24925]
[AC:A24925] [PN:beta-galactosidase,] [GN:lacZ] [CL:beta-galactosidase]
[OR:Klebsiella pneumoniae] [EC:3.2.1.23] [DB:pir2] >gp:[GI:g149218] [LN:KPNLAC]
[AC:M11441;M11416] [OR:Klebsiella pneumoniae] [SR:K.pneumoniae T17R1 DNA]
[DB:genpept-bct1] [DE:K.pneumoniae lac operon.] [NT:beta-galactosidase (lacZ)]
[LE:1259] [RE:4363] [DI:direct]

| ORF_Name | NT_ID | AA_ID | NT/LN | AA/LN | Score | P-value |
|---|---|---|---|---|---|---|
| 33720312_c3_2764 | 2545 | 9716 | 2652 | 883 | 266 | 2.7e-30 |

Description gp:[GI:e1538054:g5763989] [LN:CST238748] [AC:AJ238748] [PN:alfa-L-rhamnosidase]
[GN:ramA] [OR:Clostridium stercorarium] [DB:genpept-bct1] [EC:3.2.1.40]
[DE:Clostridium stercorarium ramA gene for alfa-L-rhamnosidase.] [LE:112]
[RE:2736] [DI:direct]

| ORF_Name | NT_ID | AA_ID | NT/LN | AA/LN | Score | P-value |
|---|---|---|---|---|---|---|
| 33750043_c2_2101 | 2546 | 9717 | 897 | 298 | 887 | 8.4e-89 |

Description gp:[GI:g4323638] [LN:AF102513] [AC:AF102513] [PN:regulatory protein GdhBR]
[GN:gdhBR] [OR:Pantoea citrea] [DB:genpept-bct2] [DE:Pantoea citrea regulatory
protein GdhBR (gdhBR) gene, complete cds.] [NT:similar to the AraC-like
transcriptional] [LE:1134] [RE:2000] [DI:direct]

| ORF_Name | NT_ID | AA_ID | NT/LN | AA/LN | Score | P-value |
|---|---|---|---|---|---|---|
| 33759825_c3_2539 | 2547 | 9718 | 1104 | 367 | 1471 | 1.1e-150 |

Description gp:[GI:d1016146:g1742732] [LN:D90809] [AC:D90809:AB001340] [PN:cyn operon
transcriptional activator.] [GN:ydhB] [OR:Escherichia coli] [SR:Escherichia coli
(strain:K12) DNA, clone_lib:Kohara lambda minise] [DB:genpept-bct1] [DE:E.coli
genomic DNA, Kohara clone #318(37.2-37.6 min.).] [NT:ORF_ID:o319#2; similar to
[SwissProt Accession] [LE:10459] [RE:11391] [DI:complement]
>gp:[GI:d1016155:g1742742] [LN:D90810] [AC:D90810:AB001340] [PN:cyn operon
transcriptional activator.] [GN:ydhB] [OR:Escherichia coli] [SR:Escherichia coli
(strain:K12) DNA, clone_lib:Kohara lambda minise] [DB:genpept-bct1] [DE:E.coli
genomic DNA, Kohara clone #319(37.4-37.8 min.).] [NT:ORF_ID:o319#2; similar to
[SwissProt Accession] [LE:2853] [RE:3785] [DI:complement]

| ORF_Name | NT_ID | AA_ID | NT/LN | AA/LN | Score | P-value |
|---|---|---|---|---|---|---|
| 3376532_c1_1765 | 2548 | 9719 | 993 | 330 | 881 | 3.7e-88 |

Description sp:[LN:C64906] [AC:C64906] [PN:probable membrane protein b1520] [OR:Escherichia
coli] [DB:pir2] >gp:[GI:g1787799] [LN:AE000249] [AC:AE000249:U00096] [PN:orf,
hypothetical protein] [GN:b1520] [FN:orf; Unknown] [OR:Escherichia coli]
[DB:genpept-bct2] [DE:Escherichia coli K-12 MG1655 section 139 of 400 of the
completegenome.] [NT:f321; This 321 aa ORF is 27 pct identical (11 gaps)]
[LE:7890] [RE:8855] [DI:complement]

| ORF Name | NT ID | AA ID | NT/LN | AA/LN | Score | P-value |
|---|---|---|---|---|---|---|
| 33766890_f3_1049 | 2549 | 9720 | 426 | 141 | 113 | 1.9e-06 |

Description sp:[LN:E70526] [AC:E70526] [PN:hypothetical protein Rv0324] [GN:Rv0324]
[OR:Mycobacterium tuberculosis] [DB:pir2] >gp:[GI:e321679:g2193945] [LN:MTCY63]
[AC:Z96800:AL123456] [PN:hypothetical protein Rv0324] [GN:Rv0324]
[OR:Mycobacterium tuberculosis] [DB:genpept-bct1] [DE:Mycobacterium tuberculosis
H37Rv complete genome; segment 16/162.] [NT:Rv0324, (MTCY63.29), len: 226.
Function: unknown,] [LE:30100] [RE:30780] [DI:direct]

| ORF Name | NT ID | AA ID | NT/LN | AA/LN | Score | P-value |
|---|---|---|---|---|---|---|
| 33775250_f1_174 | 2550 | 9721 | 1590 | 529 | 997 | 1.9e-100 |

Description sp:[LN:F70068] [AC:F70068] [PN:gamma-glutamyltransferase homolog ywrD] [GN:ywrD]
[CL:gamma-glutamyltransferase] [OR:Bacillus subtilis] [DB:pir2]
>gp:[GI:e1184516:g2636135] [LN:BSUB0019] [AC:Z99122:AL009126] [GN:ywrD]
[FN:unknown] [OR:Bacillus subtilis] [DB:genpept-bct1] [DE:Bacillus subtilis
complete genome (section 19 of 21): from 3597091to 3809700.] [NT:similar to
gamma-glutamyltransferase] [LE:121101] [RE:122678] [DI:complement]
>gp:[GI:e311282:g1929331] [LN:BSZ93767] [AC:Z93767] [GN:ywrD] [OR:Bacillus
subtilis] [DB:genpept-bct1] [DE:B.subtilis DNA; 15.2 kb fragment, from ywqN gene
to ywrO gene.] [NT:similar to gamma glutamyl transpeptidase precursor,] [LE:2493]
[RE:4070] [DI:direct]

| ORF Name | NT ID | AA ID | NT/LN | AA/LN | Score | P-value |
|---|---|---|---|---|---|---|
| 33801905_f2_647 | 2551 | 9722 | 417 | 138 | | |

Description

NO-HIT

| ORF Name | NT ID | AA ID | NT/LN | AA/LN | Score | P-value |
|---|---|---|---|---|---|---|
| 33833453_c1_2002 | 2552 | 9723 | 1818 | 605 | | |

Description

NO-HIT

| ORF_Name | NT_ID | AA_ID | NT/LN | AA/LN | Score | P-value |
|---|---|---|---|---|---|---|
| 33869187_c3_2930 | 2553 | 9724 | 1596 | 531 | 889 | 5.2e-89 |

Description sp:[LN:YDIF_ECOLI] [AC:P37766:P76199:P76898] [GN:YDIF] [OR:Escherichia coli]
[DE:HYPOTHETICAL 56.2 KD PROTEIN IN AROD-PPSA INTERGENIC REGION]
[SP:P37766:P76199:P76898] [DB:swissprot] >gp:[GI:d1016168:g1742756] [LN:D90811]
[AC:D90811:AB001340] [PN:Acetyl-CoA:acetoacetyl-CoA transferase a subunit]
[GN:ydiF] [OR:Escherichia coli] [SR:Escherichia coli (strain:K12) DNA,
clone_lib:Kohara lambda minise] [DB:genpept-bct1] [DE:E.coli genomic DNA, Kohara
clone #320(37.9-38.3 min.).] [NT:ORF_ID:o320#2; similar to [SwissProt Accession]
[LE:366] [RE:1925] [DI:complement]

| ORF_Name | NT_ID | AA_ID | NT/LN | AA/LN | Score | P-value |
|---|---|---|---|---|---|---|
| 34019800_c1_1777 | 2554 | 9725 | 1260 | 419 | 434 | 3.2e-44 |

Description sp:[LN:YHCM_ECOLI] [AC:P46442] [GN:YHCM] [OR:Escherichia coli] [DE:HYPOTHETICAL
43.1 KD PROTEIN IN RPLM-HHOA INTERGENIC REGION (F375)] [SP:P46442] [DB:swissprot]
>sp:[LN:B65115] [AC:B65115] [PN:hypothetical 43.1 kD protein in rplM-hhoA
intergenic region] [GN:yhcM] [OR:Escherichia coli] [DB:pir2] >gp:[GI:g1789627]
[LN:AE000402] [AC:AE000402:U00096] [PN:orf, hypothetical protein] [GN:yhcM]
[FN:orf; Unknown] [OR:Escherichia coli] [DB:genpept-bct2] [DE:Escherichia coli
K-12 MG1655 section 292 of 400 of the completegenome.] [NT:f375; 100 pct
identical amino acid sequence and] [LE:6257] [RE:7384] [DI:complement]
>gp:[GI:g606171] [LN:ECOUW67] [AC:U18997] [OR:Escherichia coli] [DB:genpept-bct2]
[DE:Escherichia coli K-12 chromosomal region from 67.4 to 76.0 minutes.]
[NT:ORF_f375] [LE:159615] [RE:160742] [DI:complement]

| ORF_Name | NT_ID | AA_ID | NT/LN | AA/LN | Score | P-value |
|---|---|---|---|---|---|---|
| 34035825_c1_1762 | 2555 | 9726 | 891 | 296 | 154 | 1.5e-08 |

Description sp:[LN:B70811] [AC:B70811] [PN:hypothetical protein Rv0826] [GN:Rv0826]
[OR:Mycobacterium tuberculosis] [DB:pir2] >gp:[GI:e1253967:g2916884] [LN:MTV043]
[AC:AL022004:AL123456] [PN:hypothetical protein Rv0826] [GN:Rv0826]
[OR:Mycobacterium tuberculosis] [DB:genpept-bct1] [DE:Mycobacterium tuberculosis
H37Rv complete genome; segment 40/162.] [NT:Rv0826, (MTV043.18), len: 351.
Unknown but similar] [LE:15940] [RE:16995] [DI:direct]

| ORF Name | NT ID | AA ID | NT LN | AA LN | Score | P-value |
|---|---|---|---|---|---|---|
| 34040952_f1_74 | 2556 | 9727 | 288 | 95 | 264 | 8.8e-23 |

Description sp:[LN:HIPB_ECOLI] [AC:P23873] [GN:HIPB] [OR:Escherichia coli] [DE:HIPB PROTEIN]
[SP:P23873] [DB:swissprot] >sp:[LN:A38112] [AC:A38112:G64904] [PN:hipB protein]
[GN:hipB] [OR:Escherichia coli] [DB:pir2] >gp:[GI:d1015899:g1742468] [LN:D90792]
[AC:D90792:AB001340] [PN:HipB protein] [GN:hipB] [OR:Escherichia coli]
[SR:Escherichia coli (strain:K12) DNA, clone_lib:Kohara lambda minise]
[DB:genpept-bct1] [DE:E.coli genomic DNA, Kohara clone #301(34.0-34.3 min.).]
[NT:ORF_ID:o301#11; similar to [PIR Accession Number] [LE:13869] [RE:14135]
[DI:complement] >gp:[GI:d1015907:g1742477] [LN:D90793] [AC:D90793:AB001340]
[PN:HipB protein] [GN:hipB] [OR:Escherichia coli] [SR:Escherichia coli
(strain:K12) DNA, clone_lib:Kohara lambda minise] [DB:genpept-bct1] [DE:E.coli
genomic DNA, Kohara clone #302(34.1-34.5 min.).] [NT:ORF_ID:o301#11; similar to
[PIR Accession Number] [LE:7913] [RE:8179] [DI:complement]
>gp:[GI:d1015914:g1742485] [LN:D90794] [AC:D90794:AB001340] [PN:HipB protein]
[GN:hipB] [OR:Escherichia coli] [SR:Escherichia coli (strain:K12) DNA,
clone_lib:Kohara lambda minise] [DB:genpept-bct1] [DE:E.coli genomic DNA, Kohara
clone #303(34.3-34.6 min.).] [NT:ORF_ID:o301#11; similar to [PIR Accession
Number] [LE:586] [RE:852] [DI:complement] >gp:[GI:g146353] [LN:ECOHIPO]
[AC:M61242] [GN:hipB] [OR:Escherichia coli] [DB:genpept-bct] [DE:Escherichia
coli hipA gene, complete cds, and hipB gene, completecds.] [LE:337] [RE:603]
[DI:direct] >gp:[GI:g1787786] [LN:AE000248] [AC:AE000248:U00096] [PN:persistence
to inhibition of murein or DNA] [GN:hipB] [FN:regulator; Murein sacculus,
peptidoglycan] [OR:Escherichia coli] [DB:genpept-bct2] [DE:Escherichia coli K-12
MG1655 section 138 of 400 of the completegenome.] [NT:f88; 100 pct identical to
HIPB_ECOLI SW: P23873; CG] [LE:2109] [RE:2375] [DI:complement]

| ORF Name | NT ID | AA ID | NT LN | AA LN | Score | P-value |
|---|---|---|---|---|---|---|
| 3407287_f2_916 | 2557 | 9728 | 570 | 189 | 620 | 1.7e-60 |

Description sp:[LN:YDCZ_ECOLI] [AC:P76111] [GN:YDCZ] [OR:Escherichia coli] [DE:HYPOTHETICAL
15.9 KD PROTEIN IN TEHB-ANSP INTERGENIC REGION] [SP:P76111] [DB:swissprot]
>sp:[LN:B64897] [AC:B64897] [PN:probable membrane protein b1447] [OR:Escherichia
coli] [DB:pir2] >gp:[GI:g1787718] [LN:AE000241] [AC:AE000241:U00096] [PN:orf,
hypothetical protein] [GN:b1447] [FN:orf; Unknown] [OR:Escherichia coli]
[DB:genpept-bct2] [DE:Escherichia coli K-12 MG1655 section 131 of 400 of the
completegenome.] [NT:f149; This 149 aa ORF is 31 pct identical (11 gaps)]
[LE:9124] [RE:9573] [DI:complement]

| ORF Name | NT ID | AA ID | NT LN | AA LN | Score | P-value |
|---|---|---|---|---|---|---|
| 34384712_c2_2368 | 2558 | 9729 | 1254 | 417 | 1701 | 4.7e-175 |

Description sp:[LN:PGTA_SALTY] [AC:P06184] [GN:PGTA] [OR:Salmonella typhimurium] [DE:PGTA]
[SP:P06184] [DB:swissprot] >gp:[GI:g154255] [LN:STYPGTA] [AC:M13923]
[OR:Salmonella typhimurium] [SR:S.typhimurium (strain LTZ) DNA clones pJH552,
pJH555, pJH556] [DB:genpept-bct1] [DE:Salmonella typhimurium phosphoglycerate
transport system activator(pgtA) gene, complete cds.] [NT:phosphoglycerate
transport system activator] [LE:60] [RE:1307] [DI:direct]

| ORF Name | NT ID | AA ID | NT LN | AA LN | Score | P-value |
|---|---|---|---|---|---|---|
| 34415786_c2_2114 | 2559 | 9730 | 1152 | 383 | 1808 | 2.1e-186 |

Description sp:[LN:C64896] [AC:C64896] [PN:hypothetical protein b1440 precursor]
[OR:Escherichia coli] [DB:pir2] >gp:[GI:g1787711] [LN:AE000241]
[AC:AE000241:U00096] [PN:putative transport protein] [GN:b1440] [FN:putative
transport; Not classified] [OR:Escherichia coli] [DB:genpept-bct2]
[DE:Escherichia coli K-12 MG1655 section 131 of 400 of the completegenome.]
[NT:o381; This 381 aa ORF is 28 pct identical (16 gaps)] [LE:2896] [RE:4041]
[DI:direct]

| ORF Name | NT ID | AA ID | NT LN | AA LN | Score | P-value |
|---|---|---|---|---|---|---|
| 34487965_c1_1985 | 2560 | 9731 | 1131 | 376 | 543 | 2.4e-52 |

Description sp:[LN:SERA_METJA] [AC:Q58424] [GN:SERA:MJ1018] [OR:Methanococcus jannaschii]
[EC:1.1.1.95] [DE:D-3-PHOSPHOGLYCERATE DEHYDROGENASE, (PGDH)] [SP:Q58424]
[DB:swissprot] >sp:[LN:A64427] [AC:A64427] [PN:phosphoglycerate dehydrogenase,]
[CL:Bacillus phosphoglycerate dehydrogenase] [OR:Methanococcus jannaschii]
[EC:1.1.1.95] [DB:pir2] [MP:REV949128-947554] >gp:[GI:g1591676] [LN:U67544]
[AC:U67544:L77117] [PN:phosphoglycerate dehydrogenase (serA)] [GN:MJ1018]
[OR:Methanococcus jannaschii] [DB:genpept-bct2] [DE:Methanococcus jannaschii
section 86 of 150 of the complete genome.] [NT:similar to GB:L09228 SP:P35136
PID:1146196] [LE:5684] [RE:7258] [DI:complement]

| ORF Name | NT ID | AA ID | NT/LN | AA/LN | Score | P-value |
|---|---|---|---|---|---|---|
| 34549152_c3_2836 | 2561 | 9732 | 714 | 237 | 290 | 1.5e-25 |

Description sp:[LN:YEAM_ECOLI] [AC:P76241] [GN:YEAM] [OR:Escherichia coli] [DE:HYPOTHETICAL TRANSCRIPTIONAL REGULATOR IN GAPA-RND INTERGENIC REGION] [SP:P76241] [DB:swissprot] >sp:[LN:F64939] [AC:F64939] [PN:hypothetical protein b1790] [OR:Escherichia coli] [DB:pir2] >gp:[GI:g1788091] [LN:AE000274] [AC:AE000274:U00096] [PN:putative ARAC-type regulatory protein] [GN:yeaM] [FN:putative regulator; Not classified] [OR:Escherichia coli] [DB:genpept-bct2] [DE:Escherichia coli K-12 MG1655 section 164 of 400 of the completegenome.] [NT:f273; This 273 aa ORF is 21 pct identical (7 gaps)] [LE:494] [RE:1315] [DI:complement]

| ORF Name | NT ID | AA ID | NT/LN | AA/LN | Score | P-value |
|---|---|---|---|---|---|---|
| 34569756_c1_1962 | 2562 | 9733 | 339 | 112 | 158 | 1.5e-11 |

Description sp:[LN:B69129] [AC:B69129] [PN:gamma-carboxymuconolactone decarboxylase] [GN:MTH234] [CL:4-carboxymuconolactone decarboxylase] [OR:Methanobacterium thermoautotrophicum] [DB:pir2] >gp:[GI:g2621282] [LN:AE000810] [AC:AE000810:AE000666] [PN:gamma-carboxymuconolactone decarboxylase] [GN:MTH234] [OR:Methanobacterium thermoautotrophicum] [DB:genpept-bct2] [DE:Methanobacterium thermoautotrophicum from bases 172512 to 182957(section 16 of 148) of the complete genome.] [NT:Function Code:13.07 - Other, Unclassified ; similar] [LE:3518] [RE:3895] [DI:complement]

| ORF Name | NT ID | AA ID | NT/LN | AA/LN | Score | P-value |
|---|---|---|---|---|---|---|
| 34619461_c1_1865 | 2563 | 9734 | 471 | 156 | 486 | 2.6e-46 |

Description sp:[LN:B65046] [AC:B65046] [PN:hypothetical protein b2665] [OR:Escherichia coli] [DB:pir2] >gp:[GI:g1789019] [LN:AE000351] [AC:AE000351:U00096] [PN:orf, hypothetical protein] [GN:ygaU] [FN:orf; Unknown] [OR:Escherichia coli] [DB:genpept-bct2] [DE:Escherichia coli K-12 MG1655 section 241 of 400 of the completegenome.] [NT:f149; This 149 aa ORF is 42 pct identical (10 gaps)] [LE:8060] [RE:8509] [DI:complement]

| ORF Name | NT ID | AA ID | NT/LN | AA/LN | Score | P-value |
|---|---|---|---|---|---|---|
| 34650432_c1_2025 | 2564 | 9735 | 708 | 236 | 661 | 7.5e-65 |

Description sp:[LN:YGBK_ECOLI] [AC:Q46889] [GN:YGBK] [OR:Escherichia coli] [DE:HYPOTHETICAL
41.3 KD PROTEIN IN PPHB-RPOS INTERGENIC REGION] [SP:Q46889] [DB:swissprot]
>sp:[LN:E65054] [AC:E65054] [PN:hypothetical protein b2737] [OR:Escherichia coli]
[DB:pir2] >gp:[GI:g882630] [LN:ECU29579] [AC:U29579] [OR:Escherichia coli]
[DB:genpept-bct1] [DE:Escherichia coli K-12 genome; approximately 61 to 62
minutes.] [NT:ORF_o388] [LE:34640] [RE:35806] [DI:direct] >gp:[GI:g1789093]
[LN:AE000357] [AC:AE000357:U00096] [PN:orf, hypothetical protein] [GN:b2737]
[FN:orf; Unknown] [OR:Escherichia coli] [DB:genpept-bct2] [DE:Escherichia coli
K-12 MG1655 section 247 of 400 of the completegenome.] [NT:o388; This 388 aa ORF
is 55 pct identical (6 gaps)] [LE:8064] [RE:9230] [DI:direct]

| ORF Name | NT ID | AA ID | NT/LN | AA/LN | Score | P-value |
|---|---|---|---|---|---|---|
| 34658567_c2_2335 | 2565 | 9736 | 918 | 305 | 545 | 1.5e-52 |

Description sp:[LN:S47741] [AC:S47741:D65150] [PN:hypothetical transcription regulator
treF-kdgK intergenic region:hypothetical protein o323] [GN:yhjC] [CL:conserved
hypothetical protein HI1364] [OR:Escherichia coli] [DB:pir2] >gp:[GI:g466658]
[LN:ECOUW76] [AC:U00039] [OR:Escherichia coli] [SR:Escherichia coli (sub_strain
MG1655, strain K-12) (library: lambda) [DB:genpept-bct1] [DE:E. coli chromosomal
region from 76.0 to 81.5 minutes.] [LE:86601] [RE:87572] [DI:direct]
>gp:[GI:g1789938] [LN:AE000428] [AC:AE000428:U00096] [PN:putative transcriptional
regulator LYSR-type] [GN:yhjC] [FN:putative regulator; Not classified]
[OR:Escherichia coli] [DB:genpept-bct2] [DE:Escherichia coli K-12 MG1655 section
318 of 400 of the completegenome.] [NT:o323; 100 pct identical amino acid
sequence and] [LE:8664] [RE:9635] [DI:direct]

| ORF Name | NT ID | AA ID | NT/LN | AA/LN | Score | P-value |
|---|---|---|---|---|---|---|
| 34660257_f2_650 | 2566 | 9737 | 1422 | 473 | 972 | 8.3e-98 |

Description sp:[LN:Y4BF_RHISN] [AC:P55373] [GN:Y4BF] [OR:Rhizobium sp] [SR:,strain NGR234]
[DE:PUTATIVE TRANSPOSASE Y4BF] [SP:P55373] [DB:swissprot] >gp:[GI:g2182313]
[LN:AE000065] [AC:AE000065:U00090] [PN:Y4bF] [GN:y4bF] [OR:Rhizobium sp. NGR234]
[DB:genpept-bct2] [DE:Rhizobium sp. NGR234 plasmid pNGR234a, section 2 of 46 of
thecomplete plasmid sequence.] [NT:putative transposase homologous to
Streptococcus] [LE:12108] [RE:13481] [DI:direct]

| ORF_Name | NT_ID | AA_ID | NT LN | AA LN | Score | P-value |
|---|---|---|---|---|---|---|
| 35160027_f1_250 | 2567 | 9738 | 795 | 264 | 332 | 5.5e-30 |

Description sp:[LN:YYAJ_BACSU] [AC:P37514] [GN:YYAJ] [OR:Bacillus subtilis] [DE:REGION] [SP:P37514] [DB:swissprot] >sp:[LN:S66008] [AC:S66008:A70085:I39919] [PN:transporter homolog yyaJ] [GN:yyaJ] [OR:Bacillus subtilis] [DB:pir2] >gp:[GI:d1005756:g467368] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:42385] [RE:43740] [DI:direct] >gp:[GI:e1184810:g2636631] [LN:BSUB0021] [AC:Z99124:AL009126] [GN:yyaJ] [FN:unknown] [OR:Bacillus subtilis] [DB:genpept-bct1] [DE:Bacillus subtilis complete genome (section 21 of 21): from 3999281to 4214814.] [NT:similar to transporter] [SP:P37514] [LE:194317] [RE:195672] [DI:direct]

| ORF_Name | NT_ID | AA_ID | NT LN | AA LN | Score | P-value |
|---|---|---|---|---|---|---|
| 35210936_c3_2689 | 2568 | 9739 | 1587 | 528 | 1795 | 5.1e-185 |

Description sp:[LN:SMVA_SALTY] [AC:P37594] [GN:SMVA] [OR:Salmonella typhimurium] [DE:METHYL VIOLOGEN RESISTANCE PROTEIN SMVA] [SP:P37594] [DB:swissprot] >gp:[GI:d1005596:g517158] [LN:STYNARK] [AC:D26057] [PN:SmvA protein] [GN:smvA] [OR:Salmonella typhimurium] [SR:Salmonella typhimurium (strain SL1303) (library: pMVSt1) DNA, clon] [DB:genpept-bct1] [DE:Salmonella typhimurium genes for SmvA protein (complete) ,NarKprotein (partial) and NmpC rotein (partial cds).] [NT:methyl viologen-resistant gene, homology with QacA] [LE:1300] [RE:2790] [DI:direct]

| ORF_Name | NT_ID | AA_ID | NT LN | AA LN | Score | P-value |
|---|---|---|---|---|---|---|
| 35283531_f1_234 | 2569 | 9740 | 510 | 169 | 122 | 1.2e-06 |

Description gp:[GI:g805006] [LN:PPHP1G] [AC:X80272] [GN:pprB] [OR:Pseudomonas putida] [DB:genpept-bct1] [DE:P.putida pprB gene.] [LE:77] [RE:973] [DI:direct]

| ORF_Name | NT_ID | AA_ID | NT LN | AA LN | Score | P-value |
|---|---|---|---|---|---|---|
| 35329381_c2_2120 | 2570 | 9741 | 771 | 256 | 166 | 2.8e-10 |

Description gp:[GI:g529563] [LN:PSEACOX] [AC:L35343] [PN:dihydrolipoamide acetyltransferase] [GN:acoC] [FN:E2 of acetoin cleaving system] [OR:Pseudomonas putida] [DB:genpept-bct2] [EC:2.3.1.12] [DE:Pseudomonas putida TPP-dependent acetoin dehydrogenase alpha andbeta-subunits (acoA and acoB), dihydrolipoamide acetyltransferase(acoC), g2,3-butanediol dehydrogenase (adh) and acoX genes,complete cds.] [NT:putative] [LE:3194] [RE:4306] [DI:direct]

| ORF Name | NT ID | AA ID | NT LN | AA LN | Score | P-value |
|---|---|---|---|---|---|---|
| 35433287_c2_2297 | 2571 | 9742 | 732 | 243 | 230 | 3.5e-19 |

Description gp:[GI:e1359141:g4007683] [LN:SC4B5] [AC:AL034443] [PN:putative transcriptional regulator] [GN:SC4B5.15] [OR:Streptomyces coelicolor] [DB:genpept-bct1] [DE:Streptomyces coelicolor cosmid 4B5.] [NT:SC4B5.15, probable transcriptional regulator, len:] [LE:19374] [RE:20051] [DI:direct]

| ORF Name | NT ID | AA ID | NT LN | AA LN | Score | P-value |
|---|---|---|---|---|---|---|
| 35438343_c3_2625 | 2572 | 9743 | 1503 | 500 | 2108 | 3.5e-218 |

Description sp:[LN:YDCW_ECOLI] [AC:P77674] [GN:YDCW] [OR:Escherichia coli] [EC:1.2.1.8] [DE:PUTATIVE BETAINE ALDEHYDE DEHYDROGENASE, (BADH)] [SP:P77674] [DB:swissprot] >sp:[LN:G64896] [AC:G64896] [PN:probable aldehyde dehydrogenase,] [CL:aldehyde dehydrogenase (NAD+):aldehyde dehydrogenase homology] [OR:Escherichia coli] [EC:1.2.1.-] [DB:pir2] >gp:[GI:d1015792:g1742352] [LN:D90783] [AC:D90783:AB001340] [PN:Betaine-aldehyde dehydrogenase precursor (EC] [OR:Escherichia coli] [SR:Escherichia coli (strain:K12) DNA, clone_lib:Kohara lambda minise] [DB:genpept-bct1] [DE:E.coli genomic DNA, Kohara clone #272(32.4-32.7 min.).] [NT:ORF_ID:o272#9; similar to [SwissProt Accession] [LE:13958] [RE:15382] [DI:direct] >gp:[GI:d1015798:g1742359] [LN:D90784] [AC:D90784:AB001340] [PN:Betaine-aldehyde dehydrogenase precursor (EC] [OR:Escherichia coli] [SR:Escherichia coli (strain:K12) DNA, clone_lib:Kohara lambda minise] [DB:genpept-bct1] [DE:E.coli genomic DNA, Kohara clone #273(32.5-32.8 min.).] [NT:ORF_ID:o272#9; similar to [SwissProt Accession] [LE:7616] [RE:9040] [DI:direct] >gp:[GI:g1787715] [LN:AE000241] [AC:AE000241:U00096] [PN:putative aldehyde dehydrogenase] [GN:b1444] [FN:putative enzyme; Not classified] [OR:Escherichia coli] [DB:genpept-bct2] [DE:Escherichia coli K-12 MG1655 section 131 of 400 of the completegenome.] [NT:o474; This 474 aa ORF is 40 pct identical (8 gaps)] [LE:6820] [RE:8244] [DI:direct]

| ORF Name | NT ID | AA ID | NT LN | AA LN | Score | P-value |
|---|---|---|---|---|---|---|
| 35439177_c1_1827 | 2573 | 9744 | 1302 | 433 | 125 | 6.6e-05 |

Description gp:[GI:g482892] [LN:PVU08982] [AC:U08982] [PN:circumsporozoite protein] [OR:Plasmodium vivax] [SR:malaria parasite P. vivax] [DB:genpept-inv2] [DE:Plasmodium vivax isolate SOL-83 circumsporozoite protein gene,partial cds.] [LE:<1] [RE:1043] [DI:direct]

| ORF Name | NT ID | AA ID | NT LN | AA LN | Score | P-value |
|---|---|---|---|---|---|---|
| 35555191_c2_2472 | 2574 | 9745 | 456 | 151 | | |

Description

NO-HIT

| ORF_Name | NT_ID | AA_ID | NT/LN | AA/LN | Score | P-value |
|---|---|---|---|---|---|---|
| 35567893_f1_168 | 2575 | 9746 | 1512 | 503 | | |

Description

NO-HIT

| ORF_Name | NT_ID | AA_ID | NT/LN | AA/LN | Score | P-value |
|---|---|---|---|---|---|---|
| 35625637_f2_830 | 2576 | 9747 | 270 | 89 | | |

Description

NO-HIT

| ORF_Name | NT_ID | AA_ID | NT/LN | AA/LN | Score | P-value |
|---|---|---|---|---|---|---|
| 35648916_f2_771 | 2577 | 9748 | 2433 | 810 | 3901 | 0.0 |

Description sp:[LN:PQQF_KLEPN] [AC:P27508] [GN:PQQF] [OR:Klebsiella pneumoniae] [EC:3.4.99.-]
[DE:COENZYME PQQ SYNTHESIS PROTEIN F,] [SP:P27508] [DB:swissprot] >sp:[LN:S20458]
[AC:S20458] [PN:pqqF protein] [GN:pqqF] [CL:pyrroloquinoline quinone synthesis F
protein] [OR:Klebsiella pneumoniae] [DB:pir2] >gp:[GI:g43909] [LN:KPPQQAF]
[AC:X58778:S92172] [GN:pqqF] [OR:Klebsiella pneumoniae] [DB:genpept-bct1]
[DE:K.pneumoniae pqqABCDEF genes, involved in pyrroloquinolinebiosynthesis.]
[SP:P27508] [LE:4165] [RE:6450] [DI:direct]

| ORF_Name | NT_ID | AA_ID | NT/LN | AA/LN | Score | P-value |
|---|---|---|---|---|---|---|
| 35650755_c3_3023 | 2578 | 9749 | 306 | 101 | 76 | 8.3e-08 |

Description gp:[GI:g1185397] [LN:RNU25281] [AC:U25281] [PN:SH3 domain binding protein]
[GN:CR16] [OR:Rattus norvegicus] [SR:Norway rat] [DB:genpept-rod] [DE:Rattus
norvegicus SH3 domain binding protein (CR16) mRNA, completecds.] [NT:ORF1;
proline rich protein] [LE:192] [RE:1547] [DI:direct]

| ORF_Name | NT_ID | AA_ID | NT/LN | AA/LN | Score | P-value |
|---|---|---|---|---|---|---|
| 35658160_f2_553 | 2579 | 9750 | 1335 | 444 | 582 | 1.8e-56 |

Description sp:[LN:YJIJ_ECOLI] [AC:P39381] [GN:YJIJ] [OR:Escherichia coli] [DE:HYPOTHETICAL 41.4 KD PROTEIN IN IADA-MCRD INTERGENIC REGION (F392)] [SP:P39381] [DB:swissprot] >sp:[LN:S56557] [AC:S56557:F65247] [PN:hypothetical 41.4K protein (iadA-mcrD intergenic region):hypothetical protein f392] [GN:yjiJ] [OR:Escherichia coli] [DB:pir2] >gp:[GI:g537173] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_f392] [LE:252329] [RE:253507] [DI:complement] >gp:[GI:g1790788] [LN:AE000503] [AC:AE000503:U00096] [PN:putative transport protein] [GN:yjiJ] [FN:putative transport; Not classified] [OR:Escherichia coli] [DB:genpept-bct2] [DE:Escherichia coli K-12 MG1655 section 393 of 400 of the completegenome.] [NT:f392; 100 pct identical amino acid sequence and] [LE:10037] [RE:11215] [DI:complement]

| ORF_Name | NT_ID | AA_ID | NT/LN | AA/LN | Score | P-value |
|---|---|---|---|---|---|---|
| 35672910_f2_1006 | 2580 | 9751 | 1557 | 518 | 1468 | 2.7e-155 |

Description sp:[LN:G64921] [AC:G64921] [PN:probable membrane protein b1645] [OR:Escherichia coli] [DB:pir2] >gp:[GI:g1787933] [LN:AE000259] [AC:AE000259:U00096] [PN:orf, hypothetical protein] [GN:b1645] [FN:orf; Unknown] [OR:Escherichia coli] [DB:genpept-bct2] [DE:Escherichia coli K-12 MG1655 section 149 of 400 of the completegenome.] [NT:o670; This 670 aa ORF is 25 pct identical (35 gaps)] [LE:9728] [RE:11740] [DI:direct]

| ORF_Name | NT_ID | AA_ID | NT/LN | AA/LN | Score | P-value |
|---|---|---|---|---|---|---|
| 35745333_f2_727 | 2581 | 9752 | 522 | 173 | 145 | 3.6e-10 |

Description gp:[GI:e1316465:g3449253] [LN:SC6G4] [AC:AL031317] [PN:hypothetical protein SC6G4.19c] [GN:SC6G4.19c] [OR:Streptomyces coelicolor] [DB:genpept-bct1] [DE:Streptomyces coelicolor cosmid 6G4.] [NT:SC6G4.19c, unknown, len: 190 aa; contains Pro-Ser-] [LE:15878] [RE:16450] [DI:complement]

| ORF_Name | NT_ID | AA_ID | NT/LN | AA/LN | Score | P-value |
|---|---|---|---|---|---|---|
| 35785067_f3_1452 | 2582 | 9753 | 282 | 93 | 177 | 1.5e-13 |

Description sp:[LN:G72510] [AC:G72510] [PN:hypothetical protein APE2061] [GN:APE2061] [OR:Aeropyrum pernix] [DB:pir2] >gp:[GI:d1044857:g5105759] [LN:AP000063] [AC:AP000063] [PN:114aa long hypothetical protein] [GN:APE2061] [OR:Aeropyrum pernix] [SR:Aeropyrum pernix (strain:K1) DNA] [DB:genpept-bct1] [DE:Aeropyrum pernix genomic DNA, section 6/7.] [NT:similar to OWL:AP00000656 percent identity:52.747] [LE:58153] [RE:58497] [DI:direct]

| ORF_Name | NT_ID | AA_ID | NT/LN | AA/LN | Score | P-value |
|---|---|---|---|---|---|---|
| 35820165_f1_167 | 2583 | 9754 | 339 | 112 | 116 | 4.9e-06 |

Description gp:[GI:g3044086] [LN:AF055904] [AC:AF055904] [PN:unknown] [OR:Myxococcus xanthus] [DB:genpept-bct2] [DE:Myxococcus xanthus acetylornithine deacetylase (argE) gene,complete cds; and unknown gene.] [NT:ORF2; no developmental phenotype] [LE:10] [RE:1638] [DI:complement]

| ORF_Name | NT_ID | AA_ID | NT/LN | AA/LN | Score | P-value |
|---|---|---|---|---|---|---|
| 35820817_f3_1417 | 2584 | 9755 | 510 | 169 | 138 | 2.1e-08 |

Description gp:[GI:g1947160] [LN:CELW03D2] [AC:AF000298] [GN:W03D2.1] [OR:Caenorhabditis elegans] [SR:Caenorhabditis elegans strain=Bristol N2] [DB:genpept-inv2] [DE:Caenorhabditis elegans cosmid W03D2.] [NT:weak similarity to collagens; glycine- and] [LE:27621:27799:27989:28126] [RE:27740:27942:28069:28218] [DI:directJoin]

| ORF_Name | NT_ID | AA_ID | NT/LN | AA/LN | Score | P-value |
|---|---|---|---|---|---|---|
| 35822701_c1_1941 | 2585 | 9756 | 429 | 142 | 132 | 1.9e-08 |

Description gp:[GI:g1835597] [LN:CGU85507] [AC:U85507] [PN:unknown] [GN:ORF6] [OR:Corynebacterium glutamicum] [DB:genpept-bct1] [DE:Corynebacterium glutamicum plasmid pXZ10145.1 putative replicase(repA), chloramphenicol resistance protein (CMR), and putativetransposase (tnp) genes, complete cds, and complete plasmidsequence.] [LE:3532] [RE:4290] [DI:complement]

| ORF_Name | NT_ID | AA_ID | NT/LN | AA/LN | Score | P-value |
|---|---|---|---|---|---|---|
| 35829211_c3_2978 | 2586 | 9757 | 1173 | 390 | 285 | 5.2e-25 |

Description gp:[GI:e1370593:g4158194] [LN:SC9B5] [AC:AL035206] [PN:putative AraC-like transcriptional regulator] [GN:SC9B5.15] [OR:Streptomyces coelicolor] [DB:genpept-bct1] [DE:Streptomyces coelicolor cosmid 9B5.] [NT:SC9B5.15, AraC-like transcriptional regulator, len:] [LE:15377] [RE:16318] [DI:direct]

| ORF_Name | NT_ID | AA_ID | NT/LN | AA/LN | Score | P-value |
|---|---|---|---|---|---|---|
| 35839208_c2_2053 | 2587 | 9758 | 372 | 123 | 443 | 9.5e-42 |

Description sp:[LN:YDHA_ECOLI] [AC:P28224] [GN:YDHA] [OR:Escherichia coli] [DE:HYPOTHETICAL 12.6 KD PROTEIN IN PDXH-SLYB INTERGENIC REGION] [SP:P28224] [DB:swissprot]

| ORF_Name | NT_ID | AA_ID | NT LN | AA LN | Score | P-value |
|---|---|---|---|---|---|---|
| 35937_f3_1244 | 2588 | 9759 | 936 | 311 | | |

Description

NO-HIT

| ORF_Name | NT_ID | AA_ID | NT LN | AA LN | Score | P-value |
|---|---|---|---|---|---|---|
| 35944043_c1_1642 | 2589 | 9760 | 282 | 93 | | |

Description

NO-HIT

| ORF_Name | NT_ID | AA_ID | NT LN | AA LN | Score | P-value |
|---|---|---|---|---|---|---|
| 36023538_c1_1643 | 2590 | 9761 | 303 | 100 | 192 | 3.8e-15 |

Description sp:[LN:YDCX_ECOLI] [AC:P76109] [GN:YDCX] [OR:Escherichia coli] [DE:HYPOTHETICAL
9.6 KD PROTEIN IN TEHB-ANSP INTERGENIC REGION] [SP:P76109] [DB:swissprot]
>sp:[LN:H64896] [AC:H64896] [PN:probable membrane protein b1445] [OR:Escherichia
coli] [DB:pir2] >gp:[GI:g1787716] [LN:AE000241] [AC:AE000241:U00096] [PN:orf,
hypothetical protein] [GN:b1445] [FN:orf; Unknown] [OR:Escherichia coli]
[DB:genpept-bct2] [DE:Escherichia coli K-12 MG1655 section 131 of 400 of the
completegenome.] [NT:o82; This 82 aa ORF is 33 pct identical (1 gap)] [LE:8556]
[RE:8804] [DI:direct]

| ORF_Name | NT_ID | AA_ID | NT LN | AA LN | Score | P-value |
|---|---|---|---|---|---|---|
| 36027257_f1_21 | 2591 | 9762 | 1302 | 433 | 662 | 5.9e-65 |

Description sp:[LN:S77535] [AC:S77535] [PN:hypothetical protein slr1201] [OR:Synechocystis
sp.] [SR:PCC 6803, , PCC 6803] [SR:PCC 6803, ] [DB:pir2]
>gp:[GI:d1018115:g1652460] [LN:D90905] [AC:D90905:AB001339] [PN:hypothetical
protein] [OR:Synechocystis sp.] [SR:Synechocystis sp. (strain:PCC6803) DNA]
[DB:genpept-bct1] [DE:Synechocystis sp. PCC6803 complete genome, 7/27,
781449-920915.] [NT:ORF_ID:slr1201] [LE:101839] [RE:103071] [DI:direct]

| ORF_Name | NT_ID | AA_ID | NT LN | AA LN | Score | P-value |
|---|---|---|---|---|---|---|
| 36035166_f1_165 | 2592 | 9763 | 480 | 159 | 140 | 6.1e-10 |

Description gp:[GI:g2708709] [LN:AF038575] [AC:AF038575] [PN:Wiskott-Aldrich Syndrome protein
homolog] [GN:wsp1+] [FN:actin patch assembly and localization]
[OR:Schizosaccharomyces pombe] [SR:fission yeast] [DB:genpept-pln2]
[DE:Schizosaccharomyces pombe Wiskott-Aldrich Syndrome protein homolog(wsp1+)
gene, complete cds, and BTF3/beta-NAC gene, partialsequence.] [NT:WASP homolog;
Wsp1p] [LE:404:705:2096:2288] [RE:619:2045:2228:2322] [DI:directJoin]

| ORF Name | NT ID | AA ID | NT LN | AA LN | Score | P-value |
|---|---|---|---|---|---|---|
| 36053500_c2_2227 | 2593 | 9764 | 246 | 81 | 274 | 7.7e-24 |

Description sp:[LN:YCIG_ECOLI] [AC:P21361:P76030:P76832] [GN:YCIG] [OR:Escherichia coli]
[DE:HYPOTHETICAL 6.0 KD PROTEIN IN TONB-TRPA INTERGENIC REGION (ORF1)]
[SP:P21361:P76030:P76832] [DB:swissprot] >gp:[GI:g43208] [LN:ECTRTOI] [AC:X13583]
[OR:Escherichia coli] [DB:genpept-bct1] [DE:E. coli DNA for intervening region
between trp operon and tonBgene.] [NT:ORF1 protein (AA 1-59)] [SP:P21361] [LE:56]
[RE:235] [DI:direct] >gp:[GI:g775134] [LN:ECU23490] [AC:U23490] [PN:unknown]
[GN:yciG] [OR:Escherichia coli] [DB:genpept-bct1] [DE:Escherichia coli ECOR 1
anthranilate isomerase (trpC), tryptophansynthase beta subunit (trpB), tryptophan
synthase alpha subunit(trpA), (yciG), (yciF), and (yciE) genes, complete cds.]
[LE:3765] [RE:3944] [DI:direct] >gp:[GI:g775141] [LN:ECU23491] [AC:U23491]
[PN:unknown] [GN:yciG] [OR:Escherichia coli] [DB:genpept-bct1] [DE:Escherichia
coli ECOR 4 anthranilate isomerase (trpC), tryptophansynthase beta subunit
(trpB), tryptophan synthase alpha subunit(trpA), (yciG), (yciF), and (yciE)
genes, complete cds.] [LE:3765] [RE:3944] [DI:direct] >gp:[GI:g775148]
[LN:ECU23492] [AC:U23492] [PN:unknown] [GN:yciG] [OR:Escherichia coli]
[DB:genpept-bct1] [DE:Escherichia coli ECOR 16 anthranilate isomerase (trpC),
tryptophansynthase beta subunit (trpB), tryptophan synthase alpha subunit(trpA),
(yciG), (yciF), and (yciE) genes, complete cds.] [LE:3765] [RE:3944] [DI:direct]
>gp:[GI:g775155] [LN:ECU23493] [AC:U23493] [PN:unknown] [GN:yciG] [OR:Escherichia
coli] [DB:genpept-bct1] [DE:Escherichia coli ECOR 28 anthranilate isomerase
(trpC), tryptophansynthase beta subunit (trpB), tryptophan synthase alpha
subunit(trpA), (yciG), (yciF), and (yciE) genes, complete cds.] [LE:3765]
[RE:3944] [DI:direct] >gp:[GI:g775175] [LN:ECU23496] [AC:U23496] [PN:unknown]
[GN:yciG] [OR:Escherichia coli] [DB:genpept-bct1] [DE:Escherichia coli ECOR 37
anthranilate isomerase (trpC), tryptophansynthase beta subunit (trpB), tryptophan
synthase alpha subunit(trpA), (yciG), (yciF), and (yciE) genes, complete cds.]
[LE:3765] [RE:3944] [DI:direct] >gp:[GI:g924765] [LN:ECU25417] [AC:U25417]
[GN:yciG] [OR:Escherichia coli] [DB:genpept-bct1] [DE:Escherichia coli ECOR 8
anthranilate isomerase (trpC), tryptophansynthase beta subunit (trpB), tryptophan
synthase alpha subunit(trpA), (yciG), (yciF), and (yciE) genes, complete cds.]
[LE:3765] [RE:3944] [DI:direct] >gp:[GI:g924772] [LN:ECU25418] [AC:U25418]
[GN:yciG] [OR:Escherichia coli] [DB:genpept-bct1] [DE:Escherichia coli ECOR 15
anthranilate isomerase (trpC), tryptophansynthase beta subunit (trpB), tryptophan
synthase alpha subunit(trpA), (yciG), (yciF), and (yciE) genes, complete cds.]
[LE:3765] [RE:3944] [DI:direct] >gp:[GI:g924779] [LN:ECU25419] [AC:U25419]
[GN:yciG] [OR:Escherichia coli] [DB:genpept-bct1] [DE:Escherichia coli ECOR 17

| ORF_Name | NT_ID | AA_ID | NT LN | AA LN | Score | P-value |
|---|---|---|---|---|---|---|
| 36056566_c1_1675 | 2594 | 9765 | 1338 | 445 | 1335 | 2.8e-136 |

Description sp:[LN:E69997] [AC:E69997] [PN:nitrilotriacetate monooxygenase, component A homolog ytnJ] [GN:ytnJ] [CL:nitrilotriacetate monooxygenase] [OR:Bacillus subtilis] [EC:1.14.13.-] [DB:pir1] >gp:[GI:e1184180:g2635396] [LN:BSUB0015] [AC:Z99118:AL009126] [GN:ytnJ] [FN:unknown] [OR:Bacillus subtilis] [DB:genpept-bct1] [DE:Bacillus subtilis complete genome (section 15 of 21): from 2795131to 3013540.] [NT:similar to nitrilotriacetate monooxygenase] [LE:205667] [RE:206995] [DI:complement] >gp:[GI:e1185804:g2635415] [LN:BSUB0016] [AC:Z99119:AL009126] [GN:ytnJ] [FN:unknown] [OR:Bacillus subtilis] [DB:genpept-bct1] [DE:Bacillus subtilis complete genome (section 16 of 21): from 2997771to 3213410.] [NT:similar to nitrilotriacetate monooxygenase] [LE:3027] [RE:4355] [DI:complement] >gp:[GI:g2293254] [LN:AF008220] [AC:AF008220] [PN:YtnJ] [GN:ytnJ] [OR:Bacillus subtilis] [DB:genpept-bct2] [DE:Bacillus subtilis rrnB-dnaB genomic region.] [NT:similarity to nitrilotriacetate monooxygenase] [LE:176072] [RE:177400] [DI:direct]

| ORF_Name | NT_ID | AA_ID | NT LN | AA LN | Score | P-value |
|---|---|---|---|---|---|---|
| 36066656_c2_2269 | 2595 | 9766 | 885 | 294 | 558 | 6.2e-54 |

Description gp:[GI:g1621045] [LN:PAU50932] [AC:U50932] [PN:GltR] [GN:gltR] [OR:Pseudomonas aeruginosa] [SR:Pseudomonas aeruginosa strain=PAO1] [DB:genpept-bct2] [DE:Pseudomonas aeruginosa glucose uptake regulatory protein (gltR)gene, complete cds.] [NT:glucose uptake regulatory gene; two-component] [LE:65] [RE:793] [DI:direct]

| ORF_Name | NT_ID | AA_ID | NT LN | AA LN | Score | P-value |
|---|---|---|---|---|---|---|
| 36073463_f2_739 | 2596 | 9767 | 1326 | 441 | 1379 | 6.2e-141 |

Description sp:[LN:YGFP_ECOLI] [AC:P76641:Q46816] [GN:YGFP] [OR:Escherichia coli] [DE:HYPOTHETICAL 50.2 KD PROTEIN IN KDUI-LYSS INTERGENIC REGION] [SP:P76641:Q46816] [DB:swissprot] >sp:[LN:C65072] [AC:C65072] [PN:hypothetical protein b2883] [OR:Escherichia coli] [DB:pir2] >gp:[GI:g1789249] [LN:AE000372] [AC:AE000372:U00096] [PN:orf, hypothetical protein] [GN:ygfP] [FN:orf; Unknown] [OR:Escherichia coli] [DB:genpept-bct2] [DE:Escherichia coli K-12 MG1655 section 262 of 400 of the completegenome.] [NT:o439; This 439 aa ORF is 22 pct identical (34 gaps)] [LE:1556] [RE:2875] [DI:direct]

| ORF Name | NT ID | AA ID | NT LN | AA LN | Score | P-value |
|---|---|---|---|---|---|---|
| 36126516_f3_1270 | 2597 | 9768 | 954 | 317 | 753 | 1.3e-74 |

Description sp:[LN:Y357_HAEIN] [AC:P44658] [GN:HI0357] [OR:Haemophilus influenzae] [DE:PUTATIVE THIAMINE BIOSYNTHESIS PROTEIN HI0357] [SP:P44658] [DB:swissprot] >sp:[LN:C64063] [AC:C64063] [PN:hypothetical protein HI0357] [OR:Haemophilus influenzae] [DB:pir2] >gp:[GI:g1573325] [LN:U32720] [AC:U32720:L42023] [PN:thiamine biosynthesis protein, putative] [GN:HI0357] [OR:Haemophilus influenzae Rd] [DB:genpept-bct2] [DE:Haemophilus influenzae Rd section 35 of 163 of the complete genome.] [NT:similar to SP:P42883 SP:P43534 SP:P47183] [LE:3006] [RE:3950] [DI:direct]

| ORF Name | NT ID | AA ID | NT LN | AA LN | Score | P-value |
|---|---|---|---|---|---|---|
| 36196031_f1_329 | 2598 | 9769 | 342 | 113 | 87 | 0.0011 |

Description gp:[GI:g3510458] [LN:AF012304] [AC:AF012304] [PN:nuclear mitotic apparatus protein-retinoic acid] [GN:NuMA-RARA fusion] [OR:Homo sapiens] [SR:human] [DB:genpept-pri3] [DE:Homo sapiens nuclear mitotic apparatus protein-retinoic acidreceptor alpha fusion protein (NuMA-RARA fusion) mRNA, partial cds.] [NT:fusion of structural nuclear protein to nuclear] [LE:<1] [RE:>583] [DI:direct]

| ORF Name | NT ID | AA ID | NT LN | AA LN | Score | P-value |
|---|---|---|---|---|---|---|
| 36211010_f2_546 | 2599 | 9770 | 501 | 166 | 163 | 4.4e-12 |

Description sp:[LN:T10891] [AC:T10891] [PN:hemolysin-coregulated protein] [GN:hcp] [OR:Vibrio cholerae] [DB:pir2] >gp:[GI:g1488371] [LN:S81006] [AC:S81006] [PN:Hcp] [GN:hcp] [OR:Vibrio cholerae] [SR:Vibrio cholerae O17] [DB:genpept-bct1] [DE:hcp=28 kda secreted hydrophilic protein [Vibrio cholerae, O17,Genomic, 1537 nt].] [NT:28 kda secreted hydrophilic protein; This sequence] [LE:690] [RE:1208] [DI:direct] >gp:[GI:e137862:g5805095] [LN:VCDNAHCPA] [AC:X84650] [PN:haemolysin co-regulated protein] [GN:hcpA] [OR:Vibrio cholerae] [DB:genpept-bct1] [DE:V.cholerae hcpA gene.] [LE:690] [RE:1208] [DI:direct]

| ORF Name | NT ID | AA ID | NT LN | AA LN | Score | P-value |
|---|---|---|---|---|---|---|
| 36220302_f2_748 | 2600 | 9771 | 711 | 236 | 462 | 9.2e-44 |

Description sp:[LN:Y358_HAEIN] [AC:P44659] [GN:HI0358] [OR:Haemophilus influenzae] [DE:HYPOTHETICAL PROTEIN HI0358] [SP:P44659] [DB:swissprot] >sp:[LN:D64063] [AC:D64063] [PN:transcription activator homolog HI0358] [OR:Haemophilus influenzae] [DB:pir2] >gp:[GI:g1573326] [LN:U32720] [AC:U32720:L42023] [PN:transcriptional activator, putative] [GN:HI0358] [OR:Haemophilus influenzae Rd] [DB:genpept-bct2] [DE:Haemophilus influenzae Rd section 35 of 163 of the complete genome.] [NT:similar to GB:AE000511 PID:2314455 percent] [LE:3960] [RE:4607] [DI:direct]

| ORF_Name | NT ID | AA ID | NT LN | AA LN | Score | P-value |
|---|---|---|---|---|---|---|
| 36230058_f3_1390 | 2601 | 9772 | 714 | 237 | 948 | 2.9e-95 |

Description sp:[LN:NARW_ECOLI] [AC:P19317] [GN:NARW] [OR:Escherichia coli] [EC:1.7.99.4]
[DE:RESPIRATORY NITRATE REDUCTASE 2 DELTA CHAIN,] [SP:P19317] [DB:swissprot]
>sp:[LN:S11429] [AC:S11429;E64899] [PN:nitrate reductase, 2 delta chain:narW
protein] [GN:narW] [CL:narJ protein] [OR:Escherichia coli] [EC:1.7.99.4]
[DB:pir2] >gp:[GI:d1015822;g1742385] [LN:D90786] [AC:D90786:AB001340] [PN:NarW
protein] [GN:narW] [OR:Escherichia coli] [SR:Escherichia coli (strain:K12) DNA,
clone_lib:Kohara lambda minise] [DB:genpept-bct1] [DE:E.coli genomic DNA, Kohara
clone #275(32.8-33.2 min.).] [NT:ORF_ID:o276#5; similar to [PIR Accession Number]
[LE:12918] [RE:13613] [DI:complement] >gp:[GI:d1015834;g1742398] [LN:D90787]
[AC:D90787:AB001340] [PN:NarW protein] [GN:narW] [OR:Escherichia coli]
[SR:Escherichia coli (strain:K12) DNA, clone_lib:Kohara lambda minise]
[DB:genpept-bct1] [DE:E.coli genomic DNA, Kohara clone #276(33.0-33.3 min.).]
[NT:ORF_ID:o276#5; similar to [PIR Accession Number] [LE:6844] [RE:7539]
[DI:complement] >gp:[GI:g42110] [LN:ECNARZYW] [AC:X17110] [PN:narW product]
[GN:narW] [OR:Escherichia coli] [DB:genpept-bct1] [DE:E. coli transcription unit
narZYWV DNA for nitrate reductasesubunits.] [SP:P19317] [LE:5526] [RE:6221]
[DI:direct] >gp:[GI:g1787739] [LN:AE000243] [AC:AE000243:U00096] [PN:cryptic
nitrate reductase 2, delta subunit,] [GN:narW] [FN:enzyme; Energy metabolism,
carbon: Anaerobic] [OR:Escherichia coli] [DB:genpept-bct2] [EC:1.7.99.4]
[DE:Escherichia coli K-12 MG1655 section 133 of 400 of the completegenome.]
[NT:f231; 100 pct identical to NARW_ECOLI SW: P19317;] [LE:6149] [RE:6844]
[DI:complement]

| ORF_Name | NT ID | AA ID | NT LN | AA LN | Score | P-value |
|---|---|---|---|---|---|---|
| 36410157_c1_1861 | 2602 | 9773 | 456 | 151 | 269 | 2.6e-23 |

Description sp:[LN:PTYA_ECOLI] [AC:P32058] [GN:CMTB] [OR:Escherichia coli] [EC:2.7.1.69]
[DE:ENZYME II, A COMPONENT),] [SP:P32058] [DB:swissprot] >sp:[LN:S36122]
[AC:S36122;E65078:S34369] [PN:phosphotransferase system enzyme II, factor III,
mannitol-specific:protein-Npi-phosphohistidine--sugar phosphotransferase]
[GN:cmtB] [CL:probable phosphotransferase protein yjfU:phosphotransferase system
mannitol-specific enzyme II factor III homology] [OR:Escherichia coli]
[EC:2.7.1.69] [DB:pir1] >gp:[GI:g312762] [LN:ECCMT] [AC:X72677]
[PN:protein-N(pi)-phosphohistidine-sugar] [GN:cmtB (cryptic mannitol transport]
[OR:Escherichia coli] [DB:genpept-bct1] [EC:2.7.1.69] [DE:E.coli genes cmtB and
cmtA.] [NT:putative enzyme III of PEP-phosphotranferase system] [SP:P32058]
[LE:31] [RE:474] [DI:direct] >gp:[GI:g882463] [LN:ECU28377] [AC:U28377]
[PN:protein-N(pi)-phosphohistidine-sugar] [GN:cmtB] [FN:cryptic mannitol
transport; putative enzyme III] [OR:Escherichia coli] [DB:genpept-bct1]
[EC:2.7.1.69] [DE:Escherichia coli K-12 genome; approximately 65 to 68 minutes.]
[NT:alternate name tolM] [LE:33277] [RE:33720] [DI:complement] >gp:[GI:g1789302]
[LN:AE000376] [AC:AE000376:U00096] [PN:PTS system, mannitol-specific enzyme II]
[GN:cmtB] [FN:transport; Transport of small molecules:] [OR:Escherichia coli]
[DB:genpept-bct2] [EC:2.7.1.69] [DE:Escherichia coli K-12 MG1655 section 266 of
400 of the completegenome.] [NT:f147; 100 pct identical to PTYA_ECOLI SW:
P32058;] [LE:8930] [RE:9373] [DI:complement]

| ORF_Name | NT_ID | AA_ID | NT/LN | AA/LN | Score | P-value |
|---|---|---|---|---|---|---|
| 36432161_c3_2992 | 2603 | 9774 | 483 | 160 | 243 | 1.5e-20 |

Description sp:[LN:YYCE_BACSU] [AC:P37479] [GN:YYCE] [OR:Bacillus subtilis] [DE:HYPOTHETICAL 15.6 KD PROTEIN IN PURA-DNAC INTERGENIC REGION] [SP:P37479] [DB:swissprot] >sp:[LN:S65969] [AC:S65969:D70089] [PN:hypothetical protein yycE] [GN:yycE] [OR:Bacillus subtilis] [DB:pir2] >gp:[GI:d1005717:g467329] [LN:BAC180K] [AC:D26185] [PN:unknown] [OR:Bacillus subtilis] [SR:Bacillus subtilis (sub_species:Marburg, strain:168) DNA] [DB:genpept-bct1] [DE:B. subtilis DNA, 180 kilobase region of replication origin.] [LE:4927] [RE:5346] [DI:complement] >gp:[GI:e1184769:g2636590] [LN:BSUB0021] [AC:Z99124:AL009126] [GN:yycE] [FN:unknown] [OR:Bacillus subtilis] [DB:genpept-bct1] [DE:Bacillus subtilis complete genome (section 21 of 21): from 3999281to 4214814.] [LE:156859] [RE:157278] [DI:complement]

| ORF_Name | NT_ID | AA_ID | NT/LN | AA/LN | Score | P-value |
|---|---|---|---|---|---|---|
| 36457213_f3_1165 | 2604 | 9775 | 1554 | 517 | 709 | 6.2e-70 |

Description gp:[GI:g2581798] [LN:AF001974] [AC:AF001974] [PN:xylulose kinase] [GN:xylB] [FN:ATP-dependent phosphorylation of xylulose to] [OR:Thermoanaerobacter ethanolicus] [DB:genpept-bct2] [DE:Thermoanaerobacter ethanolicus putative TrkG gene, partial cds, andputative TrkA, xylose isomerase (xylA) and xylulose kinase (xylB)genes, complete cds.] [NT:XylB] [LE:3402] [RE:4904] [DI:direct]

| ORF_Name | NT_ID | AA_ID | NT/LN | AA/LN | Score | P-value |
|---|---|---|---|---|---|---|
| 36515687_c2_2073 | 2605 | 9776 | 585 | 194 | 763 | 1.2e-75 |

Description sp:[LN:E64893] [AC:E64893:S00693] [PN:cytochrome b561] [GN:cybB] [CL:cytochrome b561] [OR:Escherichia coli] [DB:pir2] >gp:[GI:g1787687] [LN:AE000239] [AC:AE000239:U00096] [PN:cytochrome b(561)] [GN:cybB] [FN:enzyme; Energy metabolism, carbon: Electron] [OR:Escherichia coli] [DB:genpept-bct2] [DE:Escherichia coli K-12 MG1655 section 129 of 400 of the completegenome.] [NT:o188; residues 41-177 are 100 pct identical] [LE:3797] [RE:4363] [DI:direct]

| ORF Name | NT ID | AA ID | NT LN | AA LN | Score | P-value |
|---|---|---|---|---|---|---|
| 36533465_c3_2559 | 2606 | 9777 | 1167 | 388 | 1629 | 2.0e-167 |

Description sp:[LN:YDHH_ECOLI] [AC:P77570] [GN:YDHH] [OR:Escherichia coli] [DE:HYPOTHETICAL
39.5 KD PROTEIN IN PDXH-SLYB INTERGENIC REGION] [SP:P77570] [DB:swissprot]
>sp:[LN:B64921] [AC:B64921] [PN:conserved hypothetical protein b1640]
[CL:hypothetical protein HI0753] [OR:Escherichia coli] [DB:pir1]
>gp:[GI:d1016122:g1742706] [LN:D90807] [AC:D90807:AB001340] [OR:Escherichia coli]
[SR:Escherichia coli (strain:K12) DNA, clone_lib:Kohara lambda minise]
[DB:genpept-bct1] [DE:E.coli genomic DNA, Kohara clone #316(36.7-37.1 min.).]
[NT:ORF_ID:o316#19; similar to [SwissProt Accession] [LE:16099] [RE:17208]
[DI:complement] >gp:[GI:g1787928] [LN:AE000259] [AC:AE000259:U00096] [PN:orf,
hypothetical protein] [GN:b1640] [FN:orf; Unknown] [OR:Escherichia coli]
[DB:genpept-bct2] [DE:Escherichia coli K-12 MG1655 section 149 of 400 of the
completegenome.] [NT:f369; This 369 aa ORF is 50 pct identical (15 gaps)]
[LE:6100] [RE:7209] [DI:complement]

| ORF Name | NT ID | AA ID | NT LN | AA LN | Score | P-value |
|---|---|---|---|---|---|---|
| 36588916_f3_1226 | 2607 | 9778 | 831 | 276 | 138 | 2.5e-06 |

Description sp:[LN:B35363] [AC:B35363] [PN:synapsin Ib] [OR:Homo sapiens] [SR:, man]
[DB:pir2]

| ORF Name | NT ID | AA ID | NT LN | AA LN | Score | P-value |
|---|---|---|---|---|---|---|
| 36597302_c1_1620 | 2608 | 9779 | 1878 | 625 | 2601 | 2.0e-270 |

Description sp:[LN:C64894] [AC:C64894] [PN:hypothetical protein b1424] [CL:periplasmic
glucans biosynthesis protein mdoG] [OR:Escherichia coli] [DB:pir2]
>gp:[GI:g1787693] [LN:AE000239] [AC:AE000239:U00096] [PN:putative glycoprotein]
[GN:ydcG] [FN:putative structure; Not classified] [OR:Escherichia coli]
[DB:genpept-bct2] [DE:Escherichia coli K-12 MG1655 section 129 of 400 of the
completegenome.] [NT:o551; This 551 aa ORF is 38 pct identical (21 gaps)]
[LE:9787] [RE:11442] [DI:direct]

| ORF Name | NT ID | AA ID | NT LN | AA LN | Score | P-value |
|---|---|---|---|---|---|---|
| 36610452_c3_2860 | 2609 | 9780 | 678 | 225 | 321 | 2.3e-28 |

Description sp:[LN:S77250] [AC:S77250] [PN:hypothetical protein] [OR:Synechocystis sp.]
[SR:PCC 6803, , PCC 6803] [SR:PCC 6803] [DB:pir2] >gp:[GI:d1018317:g1652664]
[LN:D90907] [AC:D90907:AB001339] [PN:glutamine-binding periplasmic protein]
[GN:glnH] [OR:Synechocystis sp.] [SR:Synechocystis sp. (strain:PCC6803) DNA]
[DB:genpept-bct1] [DE:Synechocystis sp. PCC6803 complete genome, 9/27,
1056467-1188885.] [NT:ORF_ID:sll1270] [LE:57963] [RE:59555] [DI:complement]

| ORF Name | NT ID | AA ID | NT/LN | AA/LN | Score | P-value |
|---|---|---|---|---|---|---|
| 37512_f3_1255 | 2610 | 9781 | 1596 | 531 | 774 | 8.0e-77 |

Description sp:[LN:YWOE_BACSU] [AC:P94575] [GN:YWOE] [OR:Bacillus subtilis] [DE:HYPOTHETICAL 54.0 KD PROTEIN IN NRGA-USD INTERGENIC REGION] [SP:P94575] [DB:swissprot]
>sp:[LN:H70064] [AC:H70064] [PN:permease homolog ywoE] [GN:ywoE] [CL:Escherichia coli probable transport protein b0511] [OR:Bacillus subtilis] [DB:pir1]
>gp:[GI:e1184553:g2636172] [LN:BSUB0019] [AC:Z99122:AL009126] [GN:ywoE] [FN:unknown] [OR:Bacillus subtilis] [DB:genpept-bct1] [DE:Bacillus subtilis complete genome (section 19 of 21): from 3597091to 3809700.] [NT:similar to permease] [SP:P94575] [LE:154244] [RE:155716] [DI:complement]
>gp:[GI:e283115:g1684649] [LN:BSZ82987] [AC:Z82987] [PN:unknown, similar to uracil permease from] [GN:ywoE] [OR:Bacillus subtilis] [DB:genpept-bct1] [DE:B.subtilis ywo[A,B,C,D,E,F,G,H], nrg[A,B], spoIIID and mbl genes.] [SP:P94575] [LE:5587] [RE:7059] [DI:direct]

| ORF Name | NT ID | AA ID | NT/LN | AA/LN | Score | P-value |
|---|---|---|---|---|---|---|
| 3917531_c3_2839 | 2611 | 9782 | 186 | 61 | | |

Description

NO-HIT

| ORF Name | NT ID | AA ID | NT/LN | AA/LN | Score | P-value |
|---|---|---|---|---|---|---|
| 3926262_c3_2841 | 2612 | 9783 | 219 | 72 | | |

Description

NO-HIT

| ORF Name | NT ID | AA ID | NT/LN | AA/LN | Score | P-value |
|---|---|---|---|---|---|---|
| 3926416_c2_2054 | 2613 | 9784 | 687 | 228 | 1082 | 1.8e-109 |

Description sp:[LN:B43261] [AC:B43261:H64920] [PN:pyridoxamine-phosphate oxidase, pdxH] [GN:pdxH] [CL:pyridoxamine-phosphate oxidase] [OR:Escherichia coli] [EC:1.4.3.5] [DB:pir1] >gp:[GI:g148097] [LN:ECOTYSPDH] [AC:M92351] [PN:pyridoxamine phosphate oxidase] [GN:pdxH] [FN:oxidize PNP and PMP into pyridoxal 5'-phosphate] [OR:Escherichia coli] [SR:Escherichia coli (strain K-12) DNA] [DB:genpept-bct1] [EC:1.4.3.5] [DE:Escherichia coli pyridoxamine 5'-phosphate oxidase (pdxH) gene,complete cds, tyrosyl-tRNA synthetase (tyrS) gene, 3' end, ORF, 5'end.] [LE:310] [RE:966] [DI:direct] >gp:[GI:g1787926] [LN:AE000259] [AC:AE000259:U00096] [PN:pyridoxinephosphate oxidase] [GN:pdxH] [FN:enzyme; Biosynthesis of cofactors, carriers:] [OR:Escherichia coli] [DB:genpept-bct2] [EC:1.4.3.5] [DE:Escherichia coli K-12 MG1655 section 149 of 400 of the completegenome.] [NT:f218; 100 pct identical to PDXH_ECOLI SW: P28225;] [LE:4958] [RE:5614] [DI:complement]

| ORF_Name | NT ID | AA ID | NT LN | AA LN | Score | P-value |
|---|---|---|---|---|---|---|
| 3930430_c3_2632 | 2614 | 9785 | 1614 | 537 | 1474 | 5.3e-151 |

Description sp:[LN:DPPA_ECOLI] [AC:P23847] [GN:DPPA] [OR:Escherichia coli] [DE:PROTEIN) (DBP)] [SP:P23847] [DB:swissprot] >sp:[LN:A39194] [AC:A39194:S15292:S47766:S61403:C65153:S61431] [PN:periplasmic dipeptide transport protein precursor dppA:dipeptide transport protein dppA:dipeptide-binding protein dppA] [GN:dppA] [CL:dipeptide transport protein] [OR:Escherichia coli] [DB:pir1] >gp:[GI:g349225] [LN:ECODPP] [AC:L08399] [PN:dipeptide-binding protein] [GN:dppA] [FN:binds dipeptides containing L-amino acids] [OR:Escherichia coli] [SR:Escherichia coli (sub_species MM500, strain K-12) DNA] [DB:genpept-bct1] [DE:Escherichia coli dpp locus encoding dipeptide transporter,chemotaxis, dipeptide-binding protein, transmembrane proteins, andperipheral membrane proteins, complete cds.] [LE:147] [RE:1754] [DI:direct] >gp:[GI:g145797] [LN:ECODPPA] [AC:M35045] [PN:dipeptide transporter protein] [GN:dppA] [OR:Escherichia coli] [SR:E.coli (strain K12; isolate E1222) DNA, clone lambda-10] [DB:genpept-bct1] [DE:E.coli dipeptide transport protein (fpp) gene, complete cds.] [LE:147] [RE:1754] [DI:direct] >gp:[GI:g466683] [LN:ECOUW76] [AC:U00039] [GN:dppA] [FN:dipeptide transporter] [OR:Escherichia coli] [SR:Escherichia coli (sub_strain MG1655, strain K-12) (library: lambda] [DB:genpept-bct1] [DE:E. coli chromosomal region from 76.0 to 81.5 minutes.] [LE:120351] [RE:121958] [DI:complement] >gp:[GI:g42475] [LN:ECPPA] [AC:X58051:S67867] [PN:dipeptide binding protein (DBP)] [GN:dppA] [OR:Escherichia coli] [DB:genpept-bct1] [DE:E.coli dppA gene for dipeptide binding protein (DBP).] [SP:P23847] [LE:147] [RE:1754] [DI:direct] >gp:[GI:g1789966] [LN:AE000431] [AC:AE000431:U00096] [PN:dipeptide transport protein] [GN:dppA] [FN:transport; Protein, peptide secretion] [OR:Escherichia coli] [DB:genpept-bct2] [DE:Escherichia coli K-12 MG1655 section 321 of 400 of the completegenome.] [NT:f535; 100 pct identical amino acid sequence and] [LE:9854] [RE:11461] [DI:complement]

| ORF_Name | NT ID | AA ID | NT LN | AA LN | Score | P-value |
|---|---|---|---|---|---|---|
| 3942943_c2_2147 | 2615 | 9786 | 936 | 311 | 208 | 1.2e-25 |

Description sp:[LN:YQIY_BACSU] [AC:P54536] [GN:YQIY] [OR:Bacillus subtilis] [DE:INTERGENIC REGION] [SP:P54536] [DB:swissprot] >sp:[LN:G69962] [AC:G69962] [PN:amino acid ABC transporter (permease) homolog yqiY] [GN:yqiY] [CL:histidine permease protein M] [OR:Bacillus subtilis] [DB:pir2] >gp:[GI:d1013285:g1303950] [LN:BACJH642] [AC:D84432:D82370] [PN:YqiY] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:227702] [RE:228361] [DI:direct] >gp:[GI:e1185665:g2634831] [LN:BSUB0013] [AC:Z99116:AL009126] [GN:yqiY] [FN:unknown] [OR:Bacillus subtilis] [DB:genpept-bct1] [DE:Bacillus subtilis complete genome (section 13 of 21): from 2395261to 2613730.] [NT:similar to amino acid ABC transporter (permease)] [SP:P54536] [LE:95258] [RE:95917] [DI:complement]

| ORF Name | NT ID | AA ID | NT LN | AA LN | Score | P-value |
|---|---|---|---|---|---|---|
| 3945958_f1_189 | 2616 | 9787 | 705 | 234 | 191 | 4.8e-15 |

Description sp:[LN:S76456] [AC:S76456] [PN:hypothetical protein] [OR:Synechocystis sp.]
[SR:PCC 6803, , PCC 6803] [SR:PCC 6803, ] [DB:pir2] >gp:[GI:d1019318:g1653673]
[LN:D90915] [AC:D90915:AB001339] [PN:hypothetical protein] [OR:Synechocystis sp.]
[SR:Synechocystis sp. (strain:PCC6803) DNA] [DB:genpept-bct1] [DE:Synechocystis
sp. PCC6803 complete genome, 17/27, 2137259-2267259.] [NT:ORF_ID:slr1932]
[LE:86615] [RE:87310] [DI:direct]

| ORF Name | NT ID | AA ID | NT LN | AA LN | Score | P-value |
|---|---|---|---|---|---|---|
| 3957515_c2_2125 | 2617 | 9788 | 591 | 196 | 144 | 4.6e-10 |

Description sp:[LN:E72348] [AC:E72348] [PN:conserved hypothetical protein] [GN:TM0656]
[OR:Thermotoga maritima] [DB:pir2] >gp:[GI:g4981179] [LN:AE001739]
[AC:AE001739:AE000512] [PN:conserved hypothetical protein] [GN:TM0656]
[OR:Thermotoga maritima] [DB:genpept-bct2] [DE:Thermotoga maritima section 51 of
136 of the complete genome.] [NT:similar to SP:P38522 GB:U00096 PID:1742120]
[LE:1379] [RE:1909] [DI:complement]

| ORF Name | NT ID | AA ID | NT LN | AA LN | Score | P-value |
|---|---|---|---|---|---|---|
| 3963462_f2_859 | 2618 | 9789 | 912 | 303 | 576 | 7.6e-56 |

Description sp:[LN:PCAR_PSEPU] [AC:Q52154] [GN:PCAR] [OR:Pseudomonas putida] [DE:PCA REGULON
REGULATORY PROTEIN] [SP:Q52154] [DB:swissprot] >gp:[GI:g498030] [LN:PSEPCAR]
[AC:L33795] [PN:regulatory protein] [GN:pcaR] [FN:required for degradation of
p-hydroxybenzoate] [OR:Pseudomonas putida] [SR:Pseudomonas putida (strain PRS1)
(library: ATCC12633) DNA] [DB:genpept-bct1] [DE:Pseudomonas putida regulatory
protein (pcaR) gene, complete cds.] [LE:178] [RE:1053] [DI:direct]

| ORF Name | NT ID | AA ID | NT LN | AA LN | Score | P-value |
|---|---|---|---|---|---|---|
| 3986390_c1_2023 | 2619 | 9790 | 243 | 80 | | |

Description

NO-HIT

| ORF Name | NT ID | AA ID | NT LN | AA LN | Score | P-value |
|---|---|---|---|---|---|---|
| 3991313_f3_1466 | 2620 | 9791 | 1176 | 391 | 1377 | 1.0e-140 |

Description sp:[LN:D64895] [AC:D64895] [PN:probable membrane protein b1433] [OR:Escherichia coli] [DB:pir2] >gp:[GI:g1787703] [LN:AE000240] [AC:AE000240:U00096] [PN:putative membrane transport protein] [GN:b1433] [FN:putative transport; Not classified] [OR:Escherichia coli] [DB:genpept-bct2] [DE:Escherichia coli K-12 MG1655 section 130 of 400 of the completegenome.] [NT:f478; This 478 aa ORF is 38 pct identical (2 gaps)] [LE:6264] [RE:7700] [DI:complement]

| ORF Name | NT ID | AA ID | NT LN | AA LN | Score | P-value |
|---|---|---|---|---|---|---|
| 4020266_f2_915 | 2621 | 9792 | 183 | 60 | | |

Description

NO-HIT

| ORF Name | NT ID | AA ID | NT LN | AA LN | Score | P-value |
|---|---|---|---|---|---|---|
| 408131_c1_1863 | 2622 | 9793 | 645 | 214 | 362 | 3.6e-33 |

Description gp:[GI:g5354198] [LN:AF157493] [AC:AF157493] [PN:hypothetical protein] [GN:zm10orf7] [OR:Zymomonas mobilis] [DB:genpept-bct2] [DE:Zymomonas mobilis ZM4 fosmid clone 42D7, complete sequence.] [LE:19010] [RE:19486] [DI:direct]

| ORF Name | NT ID | AA ID | NT LN | AA LN | Score | P-value |
|---|---|---|---|---|---|---|
| 4103263_c3_3017 | 2623 | 9794 | 954 | 317 | 637 | 2.6e-62 |

Description sp:[LN:LDHP_BACPS] [AC:P14561] [GN:LCTA:LDHP] [OR:Bacillus psychrosaccharolyticus] [EC:1.1.1.27] [DE:L-LACTATE DEHYDROGENASE P,] [SP:P14561] [DB:swissprot] >sp:[LN:S08182] [AC:S08182:A38030:S00175] [PN:L-lactate dehydrogenase, P] [CL:L-lactate dehydrogenase] [OR:Bacillus psychrosaccharolyticus] [EC:1.1.1.27] [DB:pir2] >gp:[GI:g39758] [LN:BPLCTA] [AC:X55118] [PN:L- lactate dehydrogenase] [GN:lctA] [OR:Bacillus psychrosaccharolyticus] [DB:genpept-bct1] [EC:1.1.1.27] [DE:B. psychrosaccharolyticus lctA gene for L-lactate dehydrogenase.] [SP:P14561] [LE:139] [RE:1095] [DI:direct]

| ORF Name | NT ID | AA ID | NT LN | AA LN | Score | P-value |
|---|---|---|---|---|---|---|
| 4111062_f3_1369 | 2624 | 9795 | 927 | 308 | 1163 | 4.8e-118 |

Description sp:[LN:D64900] [AC:D64900] [PN:membrane protein yddG] [GN:yddG] [OR:Escherichia coli] [DB:pir2] >gp:[GI:g1787747] [LN:AE000244] [AC:AE000244:U00096] [PN:orf, hypothetical protein] [GN:yddG] [FN:orf; Unknown] [OR:Escherichia coli] [DB:genpept-bct2] [DE:Escherichia coli K-12 MG1655 section 134 of 400 of the completegenome.] [NT:f293; 100 pct identical to fragment YDDG_ECOLI] [LE:3687] [RE:4568] [DI:complement]

| ORF Name | NT ID | AA ID | NT LN | AA LN | Score | P-value |
|---|---|---|---|---|---|---|
| 4119027_c1_1862 | 2625 | 9796 | 474 | 157 | 213 | 2.3e-16 |

Description sp:[LN:H69626] [AC:H69626] [PN:PTS fructose-specific enzyme IIBC component fruA] [GN:fruA] [CL:phosphotransferase system enzyme II, fructose-specific:phosphotransferase system mannitol-specific enzyme II factor III homology] [OR:Bacillus subtilis] [DB:pir2] >gp:[GI:e1185030:g2633811] [LN:BSUB0008] [AC:Z99111:AL009126] [PN:phosphotransferase system (PTS)] [GN:fruA] [OR:Bacillus subtilis] [DB:genpept-bct1] [DE:Bacillus subtilis complete genome (section 8 of 21): from 1394791to 1603020.] [LE:113871] [RE:115778] [DI:direct] >gp:[GI:g3282125] [LN:AF012285] [AC:AF012285:AF012284:U51911] [PN:fructose PTS IIABC] [GN:fruA] [OR:Bacillus subtilis] [DB:genpept-bct2] [DE:Bacillus subtilis mobA-nprE gene region.] [NT:similar to fructose-specific PTS system IIBC] [LE:14359] [RE:16266] [DI:direct]

| ORF Name | NT ID | AA ID | NT LN | AA LN | Score | P-value |
|---|---|---|---|---|---|---|
| 4120317_f1_397 | 2626 | 9797 | 357 | 118 | 132 | 8.6e-09 |

Description sp:[LN:B36298] [AC:B36298] [PN:proline-rich protein PRB3S (cys)] [GN:PRB3] [CL:proline-rich protein] [OR:Homo sapiens] [SR:, man] [DB:pir2] [MP:12p13.2-12p13.2]

| ORF_Name | NT_ID | AA_ID | NT LN | AA LN | Score | P-value |
|---|---|---|---|---|---|---|
| 4160943_c3_2769 | 2627 | 9798 | 324 | 107 | 244 | 1.2e-20 |

Description sp:[LN:PTCA_ECOLI] [AC:P17335:Q57128:Q47092:Q47093:Q47094] [GN:CELC]
[OR:Escherichia coli] [EC:2.7.1.69] [DE:(EC 2.7.1.69) (EIII-CEL)]
[SP:P17335:Q57128:Q47092:Q47093:Q47094] [DB:swissprot] >sp:[LN:H64932]
[AC:H64932:S10872:I41161] [PN:phosphotransferase system enzyme II,,
cellobiose-specific, factor III:phosphotransferase system enzyme III,
phosphoenolpyruvate-dependent] [GN:celC] [CL:phosphotransferase system
lactose-specific enzyme II, factor III] [OR:Escherichia coli] [EC:2.7.1.69]
[DB:pir2] [MP:38 min] >gp:[GI:d1016240:g1742833] [LN:D90816] [AC:D90816:AB001340]
[PN:Phosphotransferase system enzyme II (EC)] [GN:celC] [OR:Escherichia coli]
[SR:Escherichia coli (strain:K12) DNA, clone_lib:Kohara lambda minise]
[DB:genpept-bct1] [DE:E.coli genomic DNA, Kohara clone #325(38.9-39.2 min.).]
[NT:ORF_ID:o326#5; similar to [PIR Accession Number] [LE:12044] [RE:12394]
[DI:complement] >gp:[GI:d1016248:g1742842] [LN:D90817] [AC:D90817:AB001340]
[PN:Phosphotransferase system enzyme II (EC)] [GN:celC] [OR:Escherichia coli]
[SR:Escherichia coli (strain:K12) DNA, clone_lib:Kohara lambda minise]
[DB:genpept-bct1] [DE:E.coli genomic DNA, Kohara clone #326(39.1-39.4 min.).]
[NT:ORF_ID:o326#5; similar to [PIR Accession Number] [LE:4815] [RE:5165]
[DI:complement] >gp:[GI:g145480] [LN:ECOCELA] [AC:M64438] [GN:celC]
[OR:Escherichia coli] [SR:E.coli DNA] [DB:genpept-bct1] [DE:E.coli cellobiose
permease proteins celA, celB, celC, cellobioseoperon repressor protein celD and
cellobiose phospho-B-glucosidaseprotein celF gene, complete cds.] [NT:putative]
[LE:2089] [RE:2439] [DI:direct] >gp:[GI:g145486] [LN:ECOCELCB] [AC:M93575]
[PN:PTS enzyme III cel] [GN:celC] [OR:Escherichia coli] [SR:Escherichia coli
(individual_isolate RM66C/human/Iowa, strain ECO] [DB:genpept-bct1]
[DE:Escherichia coli (strain ECOR 6, isolate RM66C/human/Iowa) PTSenzyme III cel
(celC) gene, complete cds.] [NT:putative] [LE:1] [RE:351] [DI:direct]
>gp:[GI:g145488] [LN:ECOCELCC] [AC:M93571] [PN:PTS enzyme III cel] [GN:celC]
[OR:Escherichia coli] [SR:Escherichia coli (individual_isolate RM52B/human/Iowa,
strain ECO] [DB:genpept-bct1] [DE:Escherichia coli (strain ECOR 28, isolate
RM52B/human/Iowa) PTSenzyme III cel (celC) gene, complete cds.] [NT:putative]
[LE:1] [RE:351] [DI:direct] >gp:[GI:g145490] [LN:ECOCELCD] [AC:M93572] [PN:PTS
enzyme III cel] [GN:celC] [OR:Escherichia coli] [SR:Escherichia coli
(individual_isolate RM42B/human/Iowa, strain ECO] [DB:genpept-bct1]
[DE:Escherichia coli (strain ECOR 35, isolate RM42B/human/Iowa) PTSenzyme III cel
(celC) gene, complete cds.] [NT:putative] [LE:1] [RE:351] [DI:direct]
>gp:[GI:g145492] [LN:ECOCELCE] [AC:M93592] [PN:PTS enzyme III cel] [GN:celC]

| ORF Name | NT ID | AA ID | NT LN | AA LN | Score | P-value |
|---|---|---|---|---|---|---|
| 4164591_f3_1536 | 2628 | 9799 | 471 | 156 | 669 | 1.1e-65 |

Description sp:[LN:LGUL_ECOLI] [AC:Q59384:P77036] [GN:GLOA] [OR:Escherichia coli]
[EC:4.4.1.5] [DE:(S-D-LACTOYLGLUTATHIONE METHYLGLYOXAL LYASE)] [SP:Q59384:P77036]
[DB:swissprot] >sp:[LN:E64922] [AC:E64922] [PN:lactoylglutathione lyase, gloA]
[GN:gloA] [OR:Escherichia coli] [EC:4.4.1.5] [DB:pir2] >gp:[GI:g1787940]
[LN:AE000260] [AC:AE000260:U00096] [PN:lactoylglutathione lyase] [GN:gloA]
[FN:enzyme; Central intermediary metabolism: Pool,] [OR:Escherichia coli]
[DB:genpept-bct2] [DE:Escherichia coli K-12 MG1655 section 150 of 400 of the
completegenome.] [NT:o135; 74 pct identical amino acid sequence and] [LE:3172]
[RE:3579] [DI:direct] >gp:[GI:g1354845] [LN:ECU57363] [AC:U57363]
[PN:S-D-lactoylglutathione methylglyoxal lyase] [GN:GloA] [OR:Escherichia coli]
[DB:genpept-bct2] [EC:4.4.1.5] [DE:Escherichia coli S-D-lactoylglutathione
methylglyoxal lyase (GloA)gene, complete cds.] [NT:homodimeric enzyme; not
activated by zinc; one] [LE:1] [RE:408] [DI:direct]

| ORF Name | NT ID | AA ID | NT LN | AA LN | Score | P-value |
|---|---|---|---|---|---|---|
| 416541_f1_430 | 2629 | 9800 | 498 | 165 | | |

Description

NO-HIT

| ORF Name | NT ID | AA ID | NT LN | AA LN | Score | P-value |
|---|---|---|---|---|---|---|
| 4181268_c2_2432 | 2630 | 9801 | 573 | 190 | 183 | 3.4e-14 |

Description gp:[GI:g4574187] [LN:AF083907] [AC:AF083907] [PN:major pilin protein FimA]
[GN:fimA] [OR:Salmonella enterica VII] [DB:genpept-bct2] [DE:Salmonella enterica
VII strain RKS3013 major pilin protein FimA(fimA) and fimbrin-like protein FimI
(fimI) genes, partial cds.] [LE:<1] [RE:486] [DI:direct]

| ORF Name | NT ID | AA ID | NT LN | AA LN | Score | P-value |
|---|---|---|---|---|---|---|
| 4198318_f1_29 | 2631 | 9802 | 804 | 267 | 216 | 2.7e-35 |

Description gp:[GI:e1348844:g3879387] [LN:CET04A11] [AC:Z83123] [GN:T04A11.2]
[OR:Caenorhabditis elegans] [DB:genpept-inv1] [DE:Caenorhabditis elegans cosmid
T04A11, complete sequence.] [LE:4853:5007:5814] [RE:4960:5351:5867]
[DI:complementJoin] >gp:[GI:e1348845:g3879388] [LN:CET04A11] [AC:Z83123]
[GN:T04A11.5] [OR:Caenorhabditis elegans] [DB:genpept-inv1] [DE:Caenorhabditis
elegans cosmid T04A11, complete sequence.] [LE:12390:12544:13351]
[RE:12497:12888:13404] [DI:complementJoin]

| ORF_Name | NT_ID | AA_ID | NT/LN | AA/LN | Score | P-value |
|---|---|---|---|---|---|---|
| 4201_c1_2021 | 2632 | 9803 | 429 | 142 | 709 | 6.0e-73 |

Description gp:[GI:g150545] [LN:PBWIABB] [AC:M37911] [PN:beta-lactamase] [OR:Plasmid pBWH77]
[SR:Plasmid pBWH77 DNA] [DB:genpept-bct1] [DE:Plasmid pBWH77 (from K.pneumonia)
beta-lactamase DNA, complete cds.] [LE:59] [RE:1057] [DI:direct]

| ORF_Name | NT_ID | AA_ID | NT/LN | AA/LN | Score | P-value |
|---|---|---|---|---|---|---|
| 4329752_c3_2601 | 2633 | 9804 | 1023 | 340 | 1322 | 6.8e-135 |

Description sp:[LN:TEHA_ECOLI] [AC:P25396:P76864] [GN:TEHA] [OR:Escherichia coli]
[DE:TELLURITE RESISTANCE PROTEIN TEHA] [SP:P25396:P76864] [DB:swissprot]
>sp:[LN:H64894] [AC:H64894:JQ1017] [PN:tellurite resistance protein tehA]
[GN:tehA] [OR:Escherichia coli] [DB:pir2] >gp:[GI:d1015777:g1742336] [LN:D90782]
[AC:D90782:AB001340] [PN:Tellurite resistance protein TehA.] [GN:tehA]
[OR:Escherichia coli] [SR:Escherichia coli (strain:K12) DNA, clone_lib:Kohara
lambda minise] [DB:genpept-bct1] [DE:E.coli genomic DNA, Kohara clone
271(32.1-32.5 min.).] [NT:ORF_ID:o271#1; similar to [SwissProt Accession]
[LE:8983] [RE:9975] [DI:direct] >gp:[GI:g149017] [LN:ECOTEHAB] [AC:M74072:M38696]
[GN:tehA] [FN:confers resistance to potassium tellurite] [OR:Escherichia coli]
[DB:genpept-bct1] [DE:Escherichia coli tellurite-resistance (tehA) and tehB
genes,complete cds.] [LE:133] [RE:1125] [DI:direct] >gp:[GI:g1787699]
[LN:AE000240] [AC:AE000240:U00096] [PN:tellurite resistance] [GN:tehA]
[FN:transport; Drug/analog sensitivity] [OR:Escherichia coli] [DB:genpept-bct2]
[DE:Escherichia coli K-12 MG1655 section 130 of 400 of the completegenome.]
[NT:o330; 100 pct identical to TEHA_ECOLI SW: P25396;] [LE:1932] [RE:2924]
[DI:direct]

| ORF_Name | NT_ID | AA_ID | NT/LN | AA/LN | Score | P-value |
|---|---|---|---|---|---|---|
| 4339811_c3_3055 | 2634 | 9805 | 1281 | 426 | 1956 | 4.4e-202 |

Description sp:[LN:JT0487] [AC:JT0487] [PN:lactose permease:lactose transport protein]
[GN:lacY] [CL:lactose permease] [OR:Klebsiella pneumoniae] [DB:pir2]

| ORF_Name | NT_ID | AA_ID | NT/LN | AA/LN | Score | P-value |
|---|---|---|---|---|---|---|
| 4343928_c1_1965 | 2635 | 9806 | 195 | 64 | | |

Description

NO-HIT

| ORF Name | NT ID | AA ID | $\frac{NT}{LN}$ | $\frac{AA}{LN}$ | Score | P-value |
|---|---|---|---|---|---|---|
| 4347137_f2_722 | 2636 | 9807 | 1128 | 375 | 482 | 7.0e-46 |

Description gp:[GI:g5852499] [LN:AF132909] [AC:AF132909] [PN:efflux pump protein FarA] [OR:Neisseria gonorrhoeae] [DB:genpept-bct2] [DE:Neisseria gonorrhoeae efflux pump protein FarA gene, complete cds.] [LE:1] [RE:1185] [DI:direct]

| ORF Name | NT ID | AA ID | $\frac{NT}{LN}$ | $\frac{AA}{LN}$ | Score | P-value |
|---|---|---|---|---|---|---|
| 4377077_c1_1752 | 2637 | 9808 | 984 | 327 | 389 | 5.0e-36 |

Description sp:[LN:S74869] [AC:S74869] [PN:transcription regulator slr1245:protein slr1245:protein slr1245] [CL:conserved hypothetical protein HI1364] [OR:Synechocystis sp.] [SR:PCC 6803, , PCC 6803] [SR:PCC 6803, ] [DB:pir2] >gp:[GI:d1018563:g1652912] [LN:D90909] [AC:D90909:AB001339] [PN:transcriptional regulator] [OR:Synechocystis sp.] [SR:Synechocystis sp. (strain:PCC6803) DNA] [DB:genpept-bct1] [DE:Synechocystis sp. PCC6803 complete genome, 11/27, 1311235-1430418.] [NT:ORF_ID:slr1245] [LE:72594] [RE:73502] [DI:direct]

| ORF Name | NT ID | AA ID | $\frac{NT}{LN}$ | $\frac{AA}{LN}$ | Score | P-value |
|---|---|---|---|---|---|---|
| 4394193_f1_296 | 2638 | 9809 | 1101 | 366 | 80 | 0.0037 |

Description sp:[LN:YCIW_ECOLI] [AC:P76035] [GN:YCIW] [OR:Escherichia coli] [DE:HYPOTHETICAL 45.1 KD PROTEIN IN RNB-FABI INTERGENIC REGION] [SP:P76035] [DB:swissprot] >sp:[LN:B64877] [AC:B64877] [PN:probable membrane protein yciW] [GN:yciW] [OR:Escherichia coli] [DB:pir2] >gp:[GI:g1787544] [LN:AE000227] [AC:AE000227:U00096] [PN:putative oxidoreductase] [GN:yciW] [FN:putative enzyme; Not classified] [OR:Escherichia coli] [DB:genpept-bct2] [DE:Escherichia coli K-12 MG1655 section 117 of 400 of the completegenome.] [NT:f401; This 401 aa ORF is 25 pct identical (7 gaps)] [LE:64] [RE:1269] [DI:complement]

| ORF Name | NT ID | AA ID | $\frac{NT}{LN}$ | $\frac{AA}{LN}$ | Score | P-value |
|---|---|---|---|---|---|---|
| 4398592_f1_46 | 2639 | 9810 | 1464 | 487 | 2156 | 2.8e-223 |

Description gp:[GI:d1015923:g1742495] [LN:D90795] [AC:D90795:AB001340] [PN:Altronate oxidoreductase (EC 1.1.1.58)] [GN:uxaB] [OR:Escherichia coli] [SR:Escherichia coli (strain:K12) DNA, clone_lib:Kohara lambda minise] [DB:genpept-bct1] [DE:E.coli genomic DNA, Kohara clone #304(34.6-34.9 min.).] [NT:ORF_ID:o304#7; similar to [SwissProt Accession] [LE:5095] [RE:6546] [DI:complement] >gp:[GI:d1003089:g1154624] [LN:ECOUXAB1] [AC:D13327] [PN:altronate oxidoreductase,UxaB] [GN:uxaB] [OR:Escherichia coli] [SR:Escherichia coli (strain:K12) cell_line:W3110 DNA] [DB:genpept-bct1] [EC:1.1.1.58] [DE:Escherichia coli uxaB gene for altronate oxidoreductase, completecds.] [LE:1253] [RE:2704] [DI:direct]

| ORF_Name | NT_ID | AA_ID | NT/LN | AA/LN | Score | P-value |
|---|---|---|---|---|---|---|
| 4425953_f3_1272 | 2640 | 9811 | 1482 | 493 | 2362 | 4.2e-245 |

Description gp:[GI:d1048388:g5917596] [LN:AB032468] [AC:AB032468] [PN:L-2,4-diaminobutyrate decarboxylase] [GN:ddc] [OR:Enterobacter aerogenes] [SR:Enterobacter aerogenes (strain:ATCC 13048) DNA] [DB:genpept-bct1] [DE:Enterobacter aerogenes genes for ORF, L-2,4-diaminobutyratedecarboxylase, partial and complete cds.] [NT:The ddc gene lacking the typical bacterial promoter] [LE:155] [RE:1627] [DI:direct]

| ORF_Name | NT_ID | AA_ID | NT/LN | AA/LN | Score | P-value |
|---|---|---|---|---|---|---|
| 4431943_f2_950 | 2641 | 9812 | 990 | 329 | 955 | 5.3e-96 |

Description sp:[LN:G64894] [AC:G64894] [PN:hypothetical protein b1428] [OR:Escherichia coli] [DB:pir2] >gp:[GI:g1787698] [LN:AE000240] [AC:AE000240:U00096] [PN:orf, hypothetical protein] [GN:b1428] [FN:orf; Unknown] [OR:Escherichia coli] [DB:genpept-bct2] [DE:Escherichia coli K-12 MG1655 section 130 of 400 of the completegenome.] [NT:f326; This 326 aa ORF is 19 pct identical (7 gaps)] [LE:828] [RE:1808] [DI:complement]

| ORF_Name | NT_ID | AA_ID | NT/LN | AA/LN | Score | P-value |
|---|---|---|---|---|---|---|
| 4454818_f1_424 | 2642 | 9813 | 2067 | 688 | 1702 | 3.7e-175 |

Description sp:[LN:A55547] [AC:A55547] [PN:quinate-shikimate dehydrogenase,] [GN:quiA] [CL:glucose dehydrogenase (pyrroloquinoline-quinone)] [OR:Acinetobacter calcoaceticus] [EC:1.1.99.-] [DB:pir2] >gp:[GI:g3172123] [LN:ACCPCAOP] [AC:L05770:U04359:M33798:U20284:U11554:L13114:L03407] [PN:pyrroloquinoline-quinone QuiA] [GN:quiA] [FN:quinate + PQQ = 5-dehydroquinate + reduced PQQ] [OR:Acinetobacter sp. ADP1] [DB:genpept-bct2] [DE:Acinetobacter sp. ADP1 pca-qui-pob supraoperonic cluster, completesequence.] [LE:14835] [RE:17264] [DI:direct]

| ORF_Name | NT_ID | AA_ID | NT/LN | AA/LN | Score | P-value |
|---|---|---|---|---|---|---|
| 4491091_c1_1837 | 2643 | 9814 | 798 | 265 | 292 | 9.5e-26 |

Description sp:[LN:D64666] [AC:D64666] [PN:glutamine ABC transporter, periplasmic glutamine-binding protein] [CL:lysine-arginine-ornithine-binding protein] [OR:Helicobacter pylori] [DB:pir2] >gp:[GI:g2314331] [LN:AE000623] [AC:AE000623:AE000511] [PN:glutamine ABC transporter, periplasmic] [GN:HP1172] [OR:Helicobacter pylori 26695] [DB:genpept-bct2] [DE:Helicobacter pylori 26695 section 101 of 134 of the completegenome.] [NT:similar to PID:1183885 GB:AL009126 percent] [LE:2260] [RE:3093] [DI:direct]

| ORF Name | NT ID | AA ID | NT LN | AA LN | Score | P-value |
|---|---|---|---|---|---|---|
| 4492843_f1_439 | 2644 | 9815 | 450 | 149 | 512 | 4.6e-49 |

Description sp:[LN:D64919] [AC:D64919] [PN:probable membrane protein b1626] [OR:Escherichia coli] [DB:pir2] >gp:[GI:g1787913] [LN:AE000258] [AC:AE000258:U00096] [PN:orf, hypothetical protein] [GN:b1626] [FN:orf; Unknown] [OR:Escherichia coli] [DB:genpept-bct2] [DE:Escherichia coli K-12 MG1655 section 148 of 400 of the completegenome.] [NT:o154; This 154 aa ORF is 27 pct identical (5 gaps)] [LE:5947] [RE:6411] [DI:direct]

| ORF Name | NT ID | AA ID | NT LN | AA LN | Score | P-value |
|---|---|---|---|---|---|---|
| 4493826_c3_2896 | 2645 | 9816 | 528 | 175 | 366 | 1.4e-33 |

Description sp:[LN:YQKA_BACSU] [AC:P54564] [GN:YQKA] [OR:Bacillus subtilis] [DE:HYPOTHETICAL 39.0 KD PROTEIN IN GLNQ-ANSR INTERGENIC REGION] [SP:P54564] [DB:swissprot] >sp:[LN:C69966] [AC:C69966] [PN:hypothetical protein yqkA] [GN:yqkA] [OR:Bacillus subtilis] [DB:pir2] >gp:[GI:d1013313:g1303978] [LN:BACJH642] [AC:D84432:D82370] [PN:YqkA] [OR:Bacillus subtilis] [SR:Bacillus subtilis (strain:JH642(trpC2 PheA1)) DNA] [DB:genpept-bct1] [DE:Bacillus subtilis DNA, 283 Kb region containing skin element.] [LE:256426] [RE:257457] [DI:direct]
>gp:[GI:e1185636:g2634802] [LN:BSUB0013] [AC:Z99116:AL009126] [GN:yqkA] [FN:unknown] [OR:Bacillus subtilis] [DB:genpept-bct1] [DE:Bacillus subtilis complete genome (section 13 of 21): from 2395261to 2613730.] [SP:P54564] [LE:66162] [RE:67193] [DI:complement]

| ORF Name | NT ID | AA ID | NT LN | AA LN | Score | P-value |
|---|---|---|---|---|---|---|
| 4506931_f1_455 | 2646 | 9817 | 1506 | 501 | 452 | 1.1e-42 |

Description sp:[LN:YCDT_ECOLI] [AC:P75908] [GN:YCDT] [OR:Escherichia coli] [DE:HYPOTHETICAL 51.8 KD PROTEIN IN PHOH-CSGG INTERGENIC REGION] [SP:P75908] [DB:swissprot] >sp:[LN:G64844] [AC:G64844] [PN:probable membrane protein ycdT] [GN:ycdT] [CL:hypothetical protein b1785] [OR:Escherichia coli] [DB:pir2] >gp:[GI:g1787262] [LN:AE000204] [AC:AE000204:U00096] [PN:orf, hypothetical protein] [GN:ycdT] [FN:orf; Unknown] [OR:Escherichia coli] [DB:genpept-bct2] [DE:Escherichia coli K-12 MG1655 section 94 of 400 of the completegenome.] [NT:o452; This 452 aa ORF is 31 pct identical (20 gaps)] [LE:8087] [RE:9445] [DI:direct]

| ORF_Name | NT_ID | AA_ID | NT/LN | AA/LN | Score | P-value |
|---|---|---|---|---|---|---|
| 4567318_f1_17 | 2647 | 9818 | 1113 | 370 | 923 | 1.3e-92 |

Description sp:[LN:YXJG_BACSU] [AC:P42318] [GN:YXJG:N15NR] [OR:Bacillus subtilis]
[DE:HYPOTHETICAL 38.0 KD PROTEIN IN KATB 3'REGION] [SP:P42318] [DB:swissprot]
>sp:[LN:E70079] [AC:E70079] [PN:conserved hypothetical protein yxjG] [GN:yxjG]
[OR:Bacillus subtilis] [DB:pir2] >gp:[GI:e1186395:g2636431] [LN:BSUB0020]
[AC:Z99123:AL009126] [GN:yxjG] [FN:unknown] [OR:Bacillus subtilis]
[DB:genpept-bct1] [DE:Bacillus subtilis complete genome (section 20 of 21): from
3798401to 4010550.] [NT:similar to hypothetical proteins from B. subtilis]
[SP:P42318] [LE:199741] [RE:200745] [DI:direct] >gp:[GI:d1012375:g666005]
[LN:D83026] [AC:D83026:D45911] [GN:yxjG] [OR:Bacillus subtilis] [SR:Bacillus
subtilis (strain:BGSC 1A1) DNA] [DB:genpept-bct1] [DE:Bacillus subtilis genome
sequence covering lic-cel region.] [NT:hypothetical] [LE:23720] [RE:24724]
[DI:complement]

| ORF_Name | NT_ID | AA_ID | NT/LN | AA/LN | Score | P-value |
|---|---|---|---|---|---|---|
| 4583_f3_1099 | 2648 | 9819 | 297 | 98 | 74 | 0.012 |

Description gp:[GI:g196844] [LN:MUSIGKBP] [AC:M14840] [OR:Mus musculus] [SR:Mouse (strain
CBA/J) CP5 B5-3 hybridoma, cDNA to mRNA] [DB:genpept-rod] [DE:Mouse IgM
monoclonal anti-BrMRBC autoantibody rearrangedkappa-chain V-JK2 mRNA from CP5
B5-3 hybridoma.] [NT:Ig kappa-chain precursor (V-JK2)] [LE:<1] [RE:>321]
[DI:direct]

| ORF_Name | NT_ID | AA_ID | NT/LN | AA/LN | Score | P-value |
|---|---|---|---|---|---|---|
| 4693952_c3_2868 | 2649 | 9820 | 543 | 180 | 139 | 1.3e-08 |

Description sp:[LN:S39475] [AC:S39475:S28385] [PN:embryonic protein BP8] [GN:BP8] [OR:Betula
pendula] [SR:, European white birch] [DB:pir2] >gp:[GI:g4539485] [LN:BPBP8GEN]
[AC:Z18891] [GN:BP8] [OR:Betula pendula] [SR:European white birch]
[DB:genpept-pln2] [DE:Betula pendula BP8 gene.] [NT:embryogenic gene]
[LE:1443:2538:2774] [RE:2444:2665:3068] [DI:directJoin]

| ORF_Name | NT_ID | AA_ID | NT/LN | AA/LN | Score | P-value |
|---|---|---|---|---|---|---|
| 4720325_f1_36 | 2650 | 9821 | 1281 | 426 | 208 | 4.3e-14 |

Description sp:[LN:YGBK_HAEIN] [AC:P44093] [GN:HI1011] [OR:Haemophilus influenzae]
[DE:HYPOTHETICAL PROTEIN HI1011] [SP:P44093] [DB:swissprot] >sp:[LN:C64018]
[AC:C64018] [PN:hypothetical protein HI1011] [OR:Haemophilus influenzae]
[DB:pir2] >gp:[GI:g1574043] [LN:U32782] [AC:U32782:L42023] [PN:conserved
hypothetical protein] [GN:HI1011] [OR:Haemophilus influenzae Rd]
[DB:genpept-bct2] [DE:Haemophilus influenzae Rd section 97 of 163 of the complete
genome.] [NT:similar to PID:882630 GB:U00096 PID:1789093 percent] [LE:1018]
[RE:2259] [DI:direct]

| ORF Name | NT ID | AA ID | NT LN | AA LN | Score | P-value |
|---|---|---|---|---|---|---|
| 4725187_cl_1769 | 2651 | 9822 | 1308 | 435 | 674 | 3.1e-66 |

Description sp:[LN:PTCC_BACST] [AC:Q45400] [GN:CELB] [OR:Bacillus stearothermophilus] [DE:PERMEASE IIC COMPONENT) (PHOSPHOTRANSFERASE ENZYME II, C COMPONENT)] [SP:Q45400] [DB:swissprot] >sp:[LN:C49898] [AC:C49898] [PN:cellobiose phosphotransferase system celB] [CL:phosphotransferase system enzyme II factor II, phosphoenolpyruvate-dependent] [OR:Bacillus stearothermophilus] [DB:pir2] >gp:[GI:g466474] [LN:BSU07818] [AC:U07818:S66216] [PN:cellobiose phosphotransferase enzyme II''] [GN:celB] [OR:Bacillus stearothermophilus] [DB:genpept-bct1] [DE:Bacillus stearothermophilus XL-65-6 PTS regulatory protein (celR')gene, partial cds, and cellobiose phosphotransferase system operon(celA, celB, celC, and celD) genes, complete cds.] [NT:cellobiose PTS enzyme II''] [LE:1861] [RE:3216] [DI:direct]

| ORF Name | NT ID | AA ID | NT LN | AA LN | Score | P-value |
|---|---|---|---|---|---|---|
| 4727082_cl_1646 | 2652 | 9823 | 549 | 182 | 124 | 9.4e-08 |

Description gp:[GI:g642965] [LN:ABCARRA] [AC:X70360] [GN:carR] [OR:Azospirillum brasilense] [DB:genpept-bct1] [DE:A.brasilense carR gene.] [NT:ORF2] [LE:59] [RE:580] [DI:direct]

| ORF Name | NT ID | AA ID | NT LN | AA LN | Score | P-value |
|---|---|---|---|---|---|---|
| 4728385_cl_1635 | 2653 | 9824 | 1452 | 483 | 2031 | 5.0e-210 |

Description sp:[LN:B64896] [AC:B64896] [PN:hypothetical protein b1439] [CL:hypothetical protein b1439] [OR:Escherichia coli] [DB:pir1] >gp:[GI:d1015788:g1742348] [LN:D90783] [AC:D90783:AB001340] [PN:Tyrosine aminotransferase (EC 2.6.1.5)] [OR:Escherichia coli] [SR:Escherichia coli (strain:K12) DNA, clone_lib:Kohara lambda minise] [DB:genpept-bct1] [DE:E.coli genomic DNA, Kohara clone #272(32.4-32.7 min.).] [NT:ORF_ID:o272#4; similar to [SwissProt Accession] [LE:8383] [RE:9789] [DI:direct] >gp:[GI:d1015794:g1742355] [LN:D90784] [AC:D90784:AB001340] [PN:Tyrosine aminotransferase (EC 2.6.1.5)] [OR:Escherichia coli] [SR:Escherichia coli (strain:K12) DNA, clone_lib:Kohara lambda minise] [DB:genpept-bct1] [DE:E.coli genomic DNA, Kohara clone #273(32.5-32.8 min.).] [NT:ORF_ID:o272#4; similar to [SwissProt Accession] [LE:2041] [RE:3447] [DI:direct] >gp:[GI:g1787710] [LN:AE000241] [AC:AE000241:U00096] [PN:multi modular; putative transcriptional] [GN:b1439] [FN:putative regulator; Not classified] [OR:Escherichia coli] [DB:genpept-bct2] [DE:Escherichia coli K-12 MG1655 section 131 of 400 of the completegenome.] [NT:o468; This 468 aa ORF is 35 pct identical (5 gaps)] [LE:1245] [RE:2651] [DI:direct]

| ORF Name | NT ID | AA ID | NT LN | AA LN | Score | P-value |
|---|---|---|---|---|---|---|
| 4739702_c3_2826 | 2654 | 9825 | 276 | 91 | | |

Description

NO-HIT

| ORF Name | NT ID | AA ID | NT LN | AA LN | Score | P-value |
|---|---|---|---|---|---|---|
| 4772125_c3_2952 | 2655 | 9826 | 369 | 122 | | |

Description

NO-HIT

| ORF Name | NT ID | AA ID | NT LN | AA LN | Score | P-value |
|---|---|---|---|---|---|---|
| 4773252_c1_1983 | 2656 | 9827 | 1179 | 392 | 490 | 9.9e-47 |

Description gp:[GI:g5508822] [LN:U59485] [AC:U59485:L63540] [PN:AttL] [GN:attL] [FN:required for attachment to host cells and] [OR:Agrobacterium tumefaciens] [DB:genpept-bct2] [DE:Agrobacterium tumefaciens AtrC (atrC) gene, partial cds; AtrB(atrB), AtrA (atrA), AttA1 (attA1), AttA2 (attA2), AttB (attB),AttC (attC), AttD (attD), AttE (attE), and AttF (attF) genes,complete cds; AttG (attG) gene, alternative splice products,complete cds; AttH (attH), AttI (attI), AttJ (attJ), AttK (attK),AttL (attL), AttM (attM), AttO (attO), AttP (attP), AttR (attR),AttS (attS), AttT (attT), AttU (attU), attV (attV), AttW (attW),AttX (attX), AttY (attY), AttZ (attZ), AtsA (atsA), AtsB (atsB),AtsC (atsC), and AtsD (atsD) genes, complete cds; and AtsE (atsE)gene, partial cds.] [NT:alcohol dehydrogenase homolog] [LE:14606] [RE:15766] [DI:direct]

| ORF Name | NT ID | AA ID | NT LN | AA LN | Score | P-value |
|---|---|---|---|---|---|---|
| 4791693_f3_1060 | 2657 | 9828 | 708 | 235 | 609 | 2.4e-59 |

Description sp:[LN:S76552] [AC:S76552] [PN:hypothetical protein] [CL:ATP-binding cassette homology] [OR:Synechocystis sp.] [SR:PCC 6803, , PCC 6803] [SR:PCC 6803, ] [DB:pir2] >gp:[GI:d1011049:g1001664] [LN:SYCSLRD] [AC:D64002:AB001339] [PN:high-affinity branched-chain amino acid] [GN:braG] [OR:Synechocystis sp.] [SR:Synechocystis sp. (strain:PCC6803) DNA] [DB:genpept-bct1] [DE:Synechocystis sp. PCC6803 complete genome, 21/27, 2644795-2755702.] [NT:ORF_ID:sll0374] [LE:63463] [RE:64212] [DI:complement]

| ORF Name | NT ID | AA ID | NT LN | AA LN | Score | P-value |
|---|---|---|---|---|---|---|
| 4802306_f2_562 | 2658 | 9829 | 780 | 259 | | |

Description

NO-HIT

904

| ORF Name | NT ID | AA ID | NT LN | AA LN | Score | P-value |
|---|---|---|---|---|---|---|
| 4807191_c1_2012 | 2659 | 9830 | 282 | 93 | 190 | 1.4e-13 |

Description sp:[LN:BGAL_KLEPN] [AC:P06219] [GN:LACZ] [OR:Klebsiella pneumoniae] [EC:3.2.1.23]
[DE:BETA-GALACTOSIDASE, (LACTASE)] [SP:P06219] [DB:swissprot] >sp:[LN:A24925]
[AC:A24925] [PN:beta-galactosidase,] [GN:lacZ] [CL:beta-galactosidase]
[OR:Klebsiella pneumoniae] [EC:3.2.1.23] [DB:pir2] >gp:[GI:g149218] [LN:KPNLAC]
[AC:M11441:M11416] [OR:Klebsiella pneumoniae] [SR:K.pneumoniae T17R1 DNA]
[DB:genpept-bct1] [DE:K.pneumoniae lac operon.] [NT:beta-galactosidase (lacZ)]
[LE:1259] [RE:4363] [DI:direct]

| ORF Name | NT ID | AA ID | NT LN | AA LN | Score | P-value |
|---|---|---|---|---|---|---|
| 4820327_f3_1164 | 2660 | 9831 | 705 | 234 | 290 | 1.5e-25 |

Description sp:[LN:DEOC_BACSU] [AC:P39121] [GN:DRA] [OR:Bacillus subtilis] [EC:4.1.2.4]
[DE:(DEOXYRIBOALDOLASE)] [SP:P39121] [DB:swissprot] >sp:[LN:A69619]
[AC:A69619:S49455] [PN:deoxyribose-phosphate aldolase,] [GN:dra]
[CL:deoxyribose-phosphate aldolase] [OR:Bacillus subtilis] [EC:4.1.2.4] [DB:pir2]
>gp:[GI:e1184667:g2636488] [LN:BSUB0021] [AC:Z99124:AL009126]
[PN:deoxyribose-phosphate aldolase] [GN:dra] [FN:nucleotide/deoxyribonucleotide
catabolism] [OR:Bacillus subtilis] [DB:genpept-bct1] [EC:4.1.2.4] [DE:Bacillus
subtilis complete genome (section 21 of 21): from 3999281to 4214814.] [SP:P39121]
[LE:51149] [RE:51784] [DI:complement] >gp:[GI:d1008933:g1408506] [LN:D45912]
[AC:D45912] [PN:deoxyribose-phosphate aldolase] [GN:dra] [OR:Bacillus subtilis]
[SR:Bacillus subtilis (strain:BGSC 1A1 (Marburg 168; trpC2)) DNA]
[DB:genpept-bct1] [DE:Bacillus subtilis genome sequence between the iol and hut
operon,partial and complete cds.] [LE:19692] [RE:20327] [DI:direct]

| ORF Name | NT ID | AA ID | NT LN | AA LN | Score | P-value |
|---|---|---|---|---|---|---|
| 4822957_c2_2396 | 2661 | 9832 | 486 | 161 | 124 | 6.0e-08 |

Description sp:[LN:YWBC_BACSU] [AC:P39586] [GN:YWBC:IPA-18R] [OR:Bacillus subtilis]
[DE:HYPOTHETICAL 14.4 KD PROTEIN IN EPR-GALK INTERGENIC REGION] [SP:P39586]
[DB:swissprot] >sp:[LN:S39673] [AC:S39673:A70051] [PN:ywbC protein:protein
ipa-18r] [GN:ywbC] [OR:Bacillus subtilis] [DB:pir2] >gp:[GI:g413942] [LN:BSGENR]
[AC:X73124] [GN:ipa-18r] [OR:Bacillus subtilis] [DB:genpept-bct1] [DE:B.subtilis
genomic region (325 to 333).] [SP:P39586] [LE:20050] [RE:20430] [DI:complement]
>gp:[GI:e1186336:g2636372] [LN:BSUB0020] [AC:Z99123:AL009126] [GN:ywbC]
[FN:unknown] [OR:Bacillus subtilis] [DB:genpept-bct1] [DE:Bacillus subtilis
complete genome (section 20 of 21): from 3798401to 4010550.] [NT:alternate gene
name: ipa-18r; similar to] [SP:P39586] [LE:137529] [RE:137909] [DI:direct]

| ORF Name | NT ID | AA ID | NT LN | AA LN | Score | P-value |
|---|---|---|---|---|---|---|
| 4876518_c1_1756 | 2662 | 9833 | 225 | 74 | | |

Description

NO-HIT

| ORF Name | NT ID | AA ID | NT LN | AA LN | Score | P-value |
|---|---|---|---|---|---|---|
| 4879818_c3_2696 | 2663 | 9834 | 783 | 260 | 816 | 2.8e-81 |

Description sp:[LN:XYLL_PSEPU] [AC:P23102] [GN:XYLL] [OR:Pseudomonas putida] [EC:1.3.1.55]
[DE:DEHYDROGENASE)] [SP:P23102] [DB:swissprot] >gp:[GI:g151722] [LN:PWWXYL]
[AC:M64747] [PN:1,2-dihydroxycyclohexa-3,4-diene carboxylate] [GN:xylL]
[OR:Plasmid pWW0] [SR:Plasmid pWW0, DNA] [DB:genpept-bct1] [DE:Pseudomonas putida
plasmid pWW0 meta operon, 5' genes.] [LE:3457] [RE:4266] [DI:direct]

| ORF Name | NT ID | AA ID | NT LN | AA LN | Score | P-value |
|---|---|---|---|---|---|---|
| 4882906_c3_2961 | 2664 | 9835 | 354 | 117 | | |

Description

NO-HIT

| ORF Name | NT ID | AA ID | NT LN | AA LN | Score | P-value |
|---|---|---|---|---|---|---|
| 4895658_c3_2655 | 2665 | 9836 | 1017 | 338 | 585 | 8.5e-57 |

Description sp:[LN:H69996] [AC:H69996] [PN:conserved hypothetical protein ytmO] [GN:ytmO]
[CL:ynbW protein] [OR:Bacillus subtilis] [DB:pir2] >gp:[GI:e1184182:g2635398]
[LN:BSUB0015] [AC:Z99118:AL009126] [GN:ytmO] [FN:unknown] [OR:Bacillus subtilis]
[DB:genpept-bct1] [DE:Bacillus subtilis complete genome (section 15 of 21): from
2795131to 3013540.] [NT:similar to hypothetical proteins] [LE:207288] [RE:208292]
[DI:complement] >gp:[GI:e1185806:g2635417] [LN:BSUB0016] [AC:Z99119:AL009126]
[GN:ytmO] [FN:unknown] [OR:Bacillus subtilis] [DB:genpept-bct1] [DE:Bacillus
subtilis complete genome (section 16 of 21): from 2997771to 3213410.] [NT:similar
to hypothetical proteins] [LE:4648] [RE:5652] [DI:complement] >gp:[GI:g2293252]
[LN:AF008220] [AC:AF008220] [PN:YtmO] [GN:ytmO] [OR:Bacillus subtilis]
[DB:genpept-bct2] [DE:Bacillus subtilis rrnB-dnaB genomic region.] [NT:similarity
to luciferase from Xenorhabdus lumenes] [LE:174775] [RE:175779] [DI:direct]

| ORF Name | NT ID | AA ID | NT LN | AA LN | Score | P-value |
|---|---|---|---|---|---|---|
| 494581_c1_1952 | 2666 | 9837 | 441 | 146 | 174 | 5.2e-13 |

Description sp:[LN:YNEJ_ECOLI] [AC:P77309] [GN:YNEJ] [OR:Escherichia coli] [DE:HYPOTHETICAL TRANSCRIPTIONAL REGULATOR IN UXAB-MARR INTERGENIC REGION] [SP:P77309] [DB:swissprot] >sp:[LN:A64907] [AC:A64907:S41477:S35950] [PN:probable transcription regulator yneJ] [GN:yneJ] [CL:Pseudomonas putida regulatory protein catR] [OR:Escherichia coli] [DB:pir2] >gp:[GI:d1015928:g1742500] [LN:D90795] [AC:D90795:AB001340] [PN:Pectinase gene transcriptional regulator.] [OR:Escherichia coli] [SR:Escherichia coli (strain:K12) DNA, clone_lib:Kohara lambda minise] [DB:genpept-bct1] [DE:E.coli genomic DNA, Kohara clone #304(34.6-34.9 min.).] [NT:ORF_ID:o304#13; similar to [SwissProt Accession] [LE:10668] [RE:11549] [DI:direct] >gp:[GI:d1015936:g1742509] [LN:D90796] [AC:D90796:AB001340] [PN:Pectinase gene transcriptional regulator.] [OR:Escherichia coli] [SR:Escherichia coli (strain:K12) DNA, clone_lib:Kohara lambda minise] [DB:genpept-bct1] [DE:E.coli genomic DNA, Kohara clone #305(34.7-35.1 min.).] [NT:ORF_ID:o304#13; similar to [SwissProt Accession] [LE:3951] [RE:4832] [DI:direct] >gp:[GI:g1787806] [LN:AE000250] [AC:AE000250:U00096] [PN:putative transcriptional regulator LYSR-type] [GN:yneJ] [FN:putative regulator; Not classified] [OR:Escherichia coli] [DB:genpept-bct2] [DE:Escherichia coli K-12 MG1655 section 140 of 400 of the completegenome.] [NT:o293; This 293 aa ORF is 27 pct identical (10 gaps)] [LE:4041] [RE:4922] [DI:direct]

| ORF Name | NT ID | AA ID | NT LN | AA LN | Score | P-value |
|---|---|---|---|---|---|---|
| 4980040_c1_1797 | 2667 | 9838 | 1218 | 405 | 465 | 4.4e-44 |

Description sp:[LN:I40646] [AC:I40646] [PN:sensor-like protein] [GN:qrsA] [CL:sensor histidine kinase homology] [OR:Coxiella burnetii] [DB:pir2] >gp:[GI:g460629] [LN:CBQRSA] [AC:U07186] [PN:sensor-like protein] [GN:qrsA] [OR:Coxiella burnetii] [DB:genpept-bct1] [DE:Coxiella burnetii Nine Mile RSA493 sensor-like protein (qrsA) gene,complete cds.] [NT:transmembrane sensor-like protein of a] [LE:121] [RE:1398] [DI:direct]

| ORF_Name | NT_ID | AA_ID | NT LN | AA LN | Score | P-value |
|---|---|---|---|---|---|---|
| 5095338_f2_1012 | 2668 | 9839 | 657 | 218 | 956 | 4.1e-96 |

Description sp:[LN:RNT_ECOLI] [AC:P30014:P76896] [GN:RNT] [OR:Escherichia coli] [EC:3.1.13.-]
[DE:RIBONUCLEASE T, (EXORIBONUCLEASE T) (RNASE T)] [SP:P30014:P76896]
[DB:swissprot] >sp:[LN:A45065] [AC:A45065:F64922] [PN:ribonuclease T, rnt:RNase
T] [GN:rnt] [OR:Escherichia coli] [EC:3.1.13.-] [DB:pir2] >gp:[GI:g1787941]
[LN:AE000260] [AC:AE000260:U00096] [PN:RNase T, degrades tRNA] [GN:rnt]
[FN:enzyme; Degradation of RNA] [OR:Escherichia coli] [DB:genpept-bct2]
[EC:3.1.13.-] [DE:Escherichia coli K-12 MG1655 section 150 of 400 of the
completegenome.] [NT:o215; 100 pct identical to RNT_ECOLI SW: P30014; CG]
[LE:3682] [RE:4329] [DI:direct] >gp:[GI:g147688] [LN:ECORNTLHR] [AC:L01622]
[PN:RNaseT] [GN:rnt] [OR:Escherichia coli] [SR:Escherichia coli (strain K-12)
DNA] [DB:genpept-bct2] [DE:E. coli RNaseT (rnt) gene, long helicase-related (lhr)
gene,complete cds, and glutaredoxin-like (yhdD) gene, 3' end.] [LE:193] [RE:840]
[DI:direct]

| ORF_Name | NT_ID | AA_ID | NT LN | AA LN | Score | P-value |
|---|---|---|---|---|---|---|
| 5120675_f3_1510 | 2669 | 9840 | 186 | 61 | | |

Description

NO-HIT

| ORF_Name | NT_ID | AA_ID | NT LN | AA LN | Score | P-value |
|---|---|---|---|---|---|---|
| 5162553_f2_908 | 2670 | 9841 | 2115 | 704 | 3003 | 0.0 |

Description sp:[LN:YNCD_ECOLI] [AC:P76115] [GN:YNCD] [OR:Escherichia coli] [DE:PROBABLE
TONB-DEPENDENT RECEPTOR YNCD PRECURSOR] [SP:P76115] [DB:swissprot]
>sp:[LN:F64897] [AC:F64897] [PN:hypothetical protein b1451 precursor]
[CL:tonB-dependent receptor amino-terminal homology:tonB-dependent receptor
carboxyl-terminal homology] [OR:Escherichia coli] [DB:pir2] >gp:[GI:g1787723]
[LN:AE000242] [AC:AE000242:U00096] [PN:putative outer membrane receptor for iron]
[GN:b1451] [FN:putative transport; Not classified] [OR:Escherichia coli]
[DB:genpept-bct2] [DE:Escherichia coli K-12 MG1655 section 132 of 400 of the
completegenome.] [NT:f700; This 700 aa ORF is 26 pct identical (64 gaps)]
[LE:2103] [RE:4205] [DI:complement]

| ORF_Name | NT_ID | AA_ID | NT LN | AA LN | Score | P-value |
|---|---|---|---|---|---|---|
| 5208530_f2_1020 | 2671 | 9842 | 282 | 93 | 121 | 3.3e-07 |

Description gp:[GI:g1835597] [LN:CGU85507] [AC:U85507] [PN:unknown] [GN:ORF6]
[OR:Corynebacterium glutamicum] [DB:genpept-bct1] [DE:Corynebacterium glutamicum
plasmid pXZ10145.1 putative replicase(repA), chloramphenicol resistance protein
(CMR), and putativetransposase (tnp) genes, complete cds, and complete
plasmidsequence.] [LE:3532] [RE:4290] [DI:complement]

| ORF_Name | NT ID | AA ID | NT/LN | AA/LN | Score | P-value |
|---|---|---|---|---|---|---|
| 5214582_c1_1593 | 2672 | 9843 | 753 | 250 | 260 | 2.3e-21 |

Description gp:[GI:g5001993] [LN:AF134321] [AC:AF134321] [PN:chimeric AFGP/trypsinogen-like serine protease] [OR:Dissostichus mawsoni] [DB:genpept-vrt] [DE:Dissostichus mawsoni clone Dm7m chimeric AFGP/trypsinogen-likeserine protease precursor, gene, partial cds.] [LE:<4472:6286:6513:8227] [RE:5948:6384:6676:8363] [DI:directJoin]

| ORF_Name | NT ID | AA ID | NT/LN | AA/LN | Score | P-value |
|---|---|---|---|---|---|---|
| 5258318_f3_1334 | 2673 | 9844 | 255 | 84 | 289 | 2.0e-25 |

Description sp:[LN:YMJA_ECOLI] [AC:P76036] [GN:YMJA] [OR:Escherichia coli] [DE:HYPOTHETICAL 9.3 KD PROTEIN IN SAPA-ALDH INTERGENIC REGION] [SP:P76036] [DB:swissprot] >sp:[LN:B64878] [AC:B64878] [PN:ymjA protein] [GN:ymjA] [OR:Escherichia coli] [DB:pir2] >gp:[GI:g1787552] [LN:AE000227] [AC:AE000227:U00096] [PN:orf, hypothetical protein] [GN:ymjA] [FN:orf; Unknown] [OR:Escherichia coli] [DB:genpept-bct2] [DE:Escherichia coli K-12 MG1655 section 117 of 400 of the completegenome.] [NT:f81; This 81 aa ORF is 31 pct identical (2 gaps)] [LE:8507] [RE:8752] [DI:complement]

| ORF_Name | NT ID | AA ID | NT/LN | AA/LN | Score | P-value |
|---|---|---|---|---|---|---|
| 5266328_f2_532 | 2674 | 9845 | 987 | 328 | 622 | 1.0e-60 |

Description gp:[GI:d1047750:g5822754] [LN:AB024550] [AC:AB024550] [OR:Bacillus halodurans] [SR:Bacillus halodurans (strain:C-125) DNA] [DB:genpept-bct1] [DE:Bacillus halodurans gene for GNTP and YULD, complete cds.] [NT:unknown] [LE:1192] [RE:2196] [DI:direct]

| ORF_Name | NT ID | AA ID | NT/LN | AA/LN | Score | P-value |
|---|---|---|---|---|---|---|
| 5272555_f3_1246 | 2675 | 9846 | 756 | 251 | 513 | 3.6e-49 |

Description sp:[LN:YFEJ_SALTY] [AC:P40194] [GN:YFEJ] [OR:Salmonella typhimurium] [DE:HYPOTHETICAL 18.7 KD PROTEIN IN PDXK-CYSM INTERGENIC REGION] [SP:P40194] [DB:swissprot] >gp:[GI:g507928] [LN:STU11243] [AC:U11243] [OR:Salmonella typhimurium] [DB:genpept-bct2] [DE:Salmonella typhimurium LT-2 region between crr and cysM,phosphotransferase system transcriptional regulator (ptsJ) gene andOrf287, Orf170, Orf120 and Orf179 genes, complete cds.] [NT:Orf170] [LE:2641] [RE:3153] [DI:direct]

| ORF_Name | NT_ID | AA_ID | NT LN | AA LN | Score | P-value |
|---|---|---|---|---|---|---|
| 5273568_f2_497 | 2676 | 9847 | 1074 | 357 | 1648 | 1.9e-169 |

Description sp:[LN:LACI_KLEPN] [AC:P06220] [GN:LACI] [OR:Klebsiella pneumoniae] [DE:LACTOSE OPERON REPRESSOR (FRAGMENT)] [SP:P06220] [DB:swissprot] >sp:[LN:B24925] [AC:B24925] [PN:lac repressor] [GN:lacI] [CL:lac repressor] [OR:Klebsiella pneumoniae] [DB:pir2]

| ORF_Name | NT_ID | AA_ID | NT LN | AA LN | Score | P-value |
|---|---|---|---|---|---|---|
| 5320393_f2_545 | 2677 | 9848 | 204 | 67 | 78 | 0.0045 |

Description sp:[LN:YIGF_SALTY] [AC:P31139] [GN:YIGF] [OR:Salmonella typhimurium] [DE:HYPOTHETICAL 14.6 KD PROTEIN IN CORA-RARD INTERGENIC REGION] [SP:P31139] [DB:swissprot] >gp:[GI:g153917] [LN:STYCRA] [AC:L11043] [FN:unknown] [OR:Salmonella typhimurium] [SR:Salmonella typhimurium DNA] [DB:genpept-bct1] [DE:Salmonella typhimurium Mg2+ transport protein (corA) gene, completecds.] [NT:ORF in opposite strand. Predicts protein of 14 kDa.] [LE:1513] [RE:1893] [DI:complement]

| ORF_Name | NT_ID | AA_ID | NT LN | AA LN | Score | P-value |
|---|---|---|---|---|---|---|
| 5347318_f2_576 | 2678 | 9849 | 510 | 169 | 219 | 5.2e-18 |

Description gp:[GI:e1388169:g4455754] [LN:SC2G5] [AC:AL035478] [PN:hypothetical protein SC2G5.30] [GN:SC2G5.30] [OR:Streptomyces coelicolor] [DB:genpept-bct1] [DE:Streptomyces coelicolor cosmid 2G5.] [NT:SC2G5.30, unknown, len: 191aa; limited similarity] [LE:37001] [RE:37576] [DI:direct]

| ORF_Name | NT_ID | AA_ID | NT LN | AA LN | Score | P-value |
|---|---|---|---|---|---|---|
| 5348412_c2_2376 | 2679 | 9850 | 654 | 217 | | |

Description

NO-HIT

| ORF Name | NT ID | AA ID | NT LN | AA LN | Score | P-value |
|---|---|---|---|---|---|---|
| 5352313_c2_2099 | 2680 | 9851 | 609 | 202 | 785 | 5.4e-78 |

Description sp:[LN:TEHB_ECOLI] [AC:P25397:P76866] [GN:TEHB] [OR:Escherichia coli]
[DE:TELLURITE RESISTANCE PROTEIN TEHB] [SP:P25397:P76866] [DB:swissprot]
>sp:[LN:A64895] [AC:A64895:JQ1018] [PN:tellurite resistance protein tehB]
[GN:tehB] [OR:Escherichia coli] [DB:pir2] >gp:[GI:d1015778:g1742337] [LN:D90782]
[AC:D90782:AB001340] [PN:Tellurite resistance protein TehB.] [GN:tehB]
[OR:Escherichia coli] [SR:Escherichia coli (strain:K12) DNA, clone_lib:Kohara
lambda minise] [DB:genpept-bct1] [DE:E.coli genomic DNA, Kohara clone
271(32.1-32.5 min.).] [NT:ORF_ID:o271#2; similar to [SwissProt Accession]
[LE:9972] [RE:10565] [DI:direct] >gp:[GI:g149018] [LN:ECOTEHAB]
[AC:M74072:M38696] [GN:tehB] [OR:Escherichia coli] [DB:genpept-bct1]
[DE:Escherichia coli tellurite-resistance (tehA) and tehB genes,complete cds.]
[LE:1122] [RE:1715] [DI:direct] >gp:[GI:g1787700] [LN:AE000240]
[AC:AE000240:U00096] [PN:tellurite resistance] [GN:tehB] [FN:putative transport;
Drug/analog sensitivity] [OR:Escherichia coli] [DB:genpept-bct2] [DE:Escherichia
coli K-12 MG1655 section 130 of 400 of the completegenome.] [NT:o197; 100 pct
identical to TEHB_ECOLI SW: P25397;] [LE:2921] [RE:3514] [DI:direct]

| ORF Name | NT ID | AA ID | NT LN | AA LN | Score | P-value |
|---|---|---|---|---|---|---|
| 5368893_c1_1838 | 2681 | 9852 | 675 | 224 | 376 | 1.2e-34 |

Description sp:[LN:A72357] [AC:A72357] [PN:amino acid ABC transporter, permease protein]
[GN:TM0592] [CL:histidine permease protein M] [OR:Thermotoga maritima] [DB:pir2]
>gp:[GI:g4981111] [LN:AE001734] [AC:AE001734:AE000512] [PN:amino acid ABC
transporter, permease protein] [GN:TM0592] [OR:Thermotoga maritima]
[DB:genpept-bct2] [DE:Thermotoga maritima section 46 of 136 of the complete
genome.] [NT:similar to GB:AE000782 percent identity: 72.86;] [LE:3214] [RE:3864]
[DI:complement]

| ORF Name | NT ID | AA ID | NT LN | AA LN | Score | P-value |
|---|---|---|---|---|---|---|
| 572156_f1_72 | 2682 | 9853 | 1413 | 470 | 879 | 6.0e-88 |

Description sp:[LN:YGFO_ECOLI] [AC:Q46815] [GN:YGFO] [OR:Escherichia coli] [DE:HYPOTHETICAL
51.4 KD PROTEIN IN KDUI-LYSS INTERGENIC REGION] [SP:Q46815] [DB:swissprot]
>sp:[LN:B65072] [AC:B65072] [PN:hypothetical protein b2882] [CL:hypothetical
protein b2882] [OR:Escherichia coli] [DB:pir2] >gp:[GI:g887832] [LN:ECU28375]
[AC:U28375] [OR:Escherichia coli] [DB:genpept-bct1] [DE:Escherichia coli K-12
genome; approximately 64 to 65 minutes.] [NT:ORF_o485] [LE:34109] [RE:35566]
[DI:direct] >gp:[GI:g1789248] [LN:AE000372] [AC:AE000372:U00096] [PN:putative
transport protein] [GN:ygfO] [FN:putative transport; Not classified]
[OR:Escherichia coli] [DB:genpept-bct2] [DE:Escherichia coli K-12 MG1655 section
262 of 400 of the completegenome.] [NT:o485; This 435 aa ORF is 44 pct identical
(2 gaps)] [LE:84] [RE:1541] [DI:direct]

| ORF Name | NT ID | AA ID | NT LN | AA LN | Score | P-value |
|---|---|---|---|---|---|---|
| 5860902_f1_395 | 2683 | 9854 | 1422 | 473 | 1944 | 8.3e-201 |

Description gp:[GI:e293295:g2208964] [LN:PACIOAB] [AC:Y10528] [PN:cyanide insensitive terminal oxidase] [GN:cioA] [OR:Pseudomonas aeruginosa] [DB:genpept-bct1] [DE:P.aeruginosa cioA and cioB genes.] [LE:276] [RE:1742] [DI:direct]

| ORF Name | NT ID | AA ID | NT LN | AA LN | Score | P-value |
|---|---|---|---|---|---|---|
| 5939007_f3_1169 | 2684 | 9855 | 1014 | 337 | 591 | 2.0e-57 |

Description gp:[GI:e1424145:g4584493] [LN:SC5F2A] [AC:AL049587] [PN:putative transcriptional regulator] [GN:SC5F2A.29] [OR:Streptomyces coelicolor] [DB:genpept-bct1] [DE:Streptomyces coelicolor cosmid 5F2A.] [NT:SC5F2A.29, possible transcriptional regulator, len:] [LE:31397] [RE:32374] [DI:direct]

| ORF Name | NT ID | AA ID | NT LN | AA LN | Score | P-value |
|---|---|---|---|---|---|---|
| 599066_f1_295 | 2685 | 9856 | 1272 | 423 | 253 | 2.1e-22 |

Description sp:[LN:Y4VJ_RHISN] [AC:Q53218] [GN:Y4VJ] [OR:Rhizobium sp] [SR:,strain NGR234] [DE:HYPOTHETICAL 39.2 KD PROTEIN Y4VJ] [SP:Q53218] [DB:swissprot]
>gp:[GI:g2182678] [LN:AE000101] [AC:AE000101:U00090] [PN:Y4vJ] [GN:y4vJ] [OR:Rhizobium sp. NGR234] [DB:genpept-bct2] [DE:Rhizobium sp. NGR234 plasmid pNGR234a, section 38 of 46 of thecomplete plasmid sequence.] [NT:hypothetical 39.2 kd protein; distantly related to] [LE:7446] [RE:8501] [DI:direct]

| ORF Name | NT ID | AA ID | NT LN | AA LN | Score | P-value |
|---|---|---|---|---|---|---|
| 5992667_c2_2162 | 2686 | 9857 | 1059 | 352 | 388 | 6.4e-36 |

Description gp:[GI:g3776222] [LN:AF030523] [AC:AF030523] [PN:putative periplasmic iron-binding protein] [GN:afuA] [OR:Sinorhizobium meliloti] [DB:genpept-bct2] [DE:Sinorhizobium meliloti putative periplasmic iron-binding protein(afuA), cold shock protein CspA (cspA), and probable ribosomalprotein (rpsU) genes, complete cds.] [NT:similar to AfuA of Actinobacillus pleuropneumonia.] [LE:18] [RE:998] [DI:complement]

| ORF Name | NT ID | AA ID | NT/LN | AA/LN | Score | P-value |
|---|---|---|---|---|---|---|
| 6017255_c1_1891 | 2687 | 9858 | 828 | 275 | 356 | 1.6e-32 |

Description sp:[LN:YULB_BACSU] [AC:O05261] [GN:YULB] [OR:Bacillus subtilis] [DE:HYPOTHETICAL TRANSCRIPTIONAL REGULATOR IN GBSA-TLPB INTERGENIC REGION] [SP:O05261] [DB:swissprot] >sp:[LN:D70014] [AC:D70014] [PN:transcription regulator DeoR family homolog yulB] [GN:yulB] [CL:regulatory protein gutR] [OR:Bacillus subtilis] [DB:pir1] >gp:[GI:e1185994:g2635605] [LN:BSUB0016] [AC:Z99119:AL009126] [GN:yulB] [FN:unknown] [OR:Bacillus subtilis] [DB:genpept-bct1] [DE:Bacillus subtilis complete genome (section 16 of 21): from 2997771to 3213410.] [NT:similar to transcriptional regulator (DeoR family)] [SP:O05261] [LE:202327] [RE:203103] [DI:complement] >gp:[GI:e1184199:g2635617] [LN:BSUB0017] [AC:Z99120:AL009126] [GN:yulB] [FN:unknown] [OR:Bacillus subtilis] [DB:genpept-bct1] [DE:Bacillus subtilis complete genome (section 17 of 21): from 3197001to 3414420.] [NT:similar to transcriptional regulator (DeoR family)] [SP:O05261] [LE:3097] [RE:3873] [DI:complement] >gp:[GI:e311496:g1934822] [LN:BSZ93938] [AC:Z93938] [PN:unknown] [GN:yulB] [OR:Bacillus subtilis] [DB:genpept-bct1] [DE:B.subtilis genomic DNA fragment from yulA to yulF.] [NT:potential regylatory protein of glucitol operon] [SP:O05261] [LE:2356] [RE:3132] [DI:direct]

| ORF Name | NT ID | AA ID | NT/LN | AA/LN | Score | P-value |
|---|---|---|---|---|---|---|
| 604542_c3_2646 | 2688 | 9859 | 186 | 61 | 114 | 4.1e-06 |

Description sp:[LN:G64897] [AC:G64897] [PN:hypothetical protein b1452] [OR:Escherichia coli] [DB:pir2] >gp:[GI:g1787724] [LN:AE000242] [AC:AE000242:U00096] [PN:putative receptor] [GN:b1452] [FN:putative factor; Not classified] [OR:Escherichia coli] [DB:genpept-bct2] [DE:Escherichia coli K-12 MG1655 section 132 of 400 of the completegenome.] [NT:o353; This 353 aa ORF is 22 pct identical (17 gaps)] [LE:4447] [RE:5508] [DI:direct]

| ORF Name | NT ID | AA ID | NT/LN | AA/LN | Score | P-value |
|---|---|---|---|---|---|---|
| 6047800_c2_2529 | 2689 | 9860 | 930 | 309 | 1124 | 6.5e-114 |

Description sp:[LN:YGBJ_ECOLI] [AC:Q46888] [GN:YGBJ] [OR:Escherichia coli] [DE:HYPOTHETICAL 30.8 KD PROTEIN IN PPHB-RPOS INTERGENIC REGION] [SP:Q46888] [DB:swissprot] >sp:[LN:D65054] [AC:D65054] [PN:hypothetical protein b2736] [CL:3-hydroxyisobutyrate dehydrogenase:3-hydroxyisobutyrate dehydrogenase homology] [OR:Escherichia coli] [DB:pir2] >gp:[GI:g882629] [LN:ECU29579] [AC:U29579] [OR:Escherichia coli] [DB:genpept-bct1] [DE:Escherichia coli K-12 genome; approximately 61 to 62 minutes.] [NT:ORF_o302] [LE:33735] [RE:34643] [DI:direct] >gp:[GI:g1789092] [LN:AE000357] [AC:AE000357:U00096] [PN:putative dehydrogenase] [GN:b2736] [FN:putative enzyme; Not classified] [OR:Escherichia coli] [DB:genpept-bct2] [DE:Escherichia coli K-12 MG1655 section 247 of 400 of the completegenome.] [NT:o302; This 302 aa ORF is 34 pct identical (2 gaps)] [LE:7159] [RE:8067] [DI:direct]

| ORF Name | NT ID | AA ID | NT LN | AA LN | Score | P-value |
|---|---|---|---|---|---|---|
| 6048577_f1_368 | 2690 | 9861 | 1707 | 568 | 249 | 6.8e-33 |

Description sp:[LN:F69989] [AC:F69989] [PN:conserved hypothetical protein ytcJ] [GN:ytcJ]
[OR:Bacillus subtilis] [DB:pir2] >gp:[GI:e1185828:g2635439] [LN:BSUB0016]
[AC:Z99119:AL009126] [GN:ytcJ] [FN:unknown] [OR:Bacillus subtilis]
[DB:genpept-bct1] [DE:Bacillus subtilis complete genome (section 16 of 21): from
2997771to 3213410.] [NT:similar to hypothetical proteins] [LE:23370] [RE:24959]
[DI:complement] >gp:[GI:g2293233] [LN:AF008220] [AC:AF008220] [PN:YtcJ] [GN:ytcJ]
[OR:Bacillus subtilis] [DB:genpept-bct2] [DE:Bacillus subtilis rrnB-dnaB genomic
region.] [LE:155468] [RE:157057] [DI:direct]

| ORF Name | NT ID | AA ID | NT LN | AA LN | Score | P-value |
|---|---|---|---|---|---|---|
| 6053383_c3_2675 | 2691 | 9862 | 882 | 293 | 1162 | 6.1e-118 |

Description sp:[LN:B64899] [AC:B64899] [PN:N-hydroxyarylamine O-acetyltransferase,]
[CL:arylamine acetyltransferase] [OR:Escherichia coli] [EC:2.3.1.118] [DB:pir2]
>gp:[GI:d1015819:g1742382] [LN:D90786] [AC:D90786:AB001340]
[PN:N-hydroxyarylamine O-acetyltransferase (EC) [OR:Escherichia coli]
[SR:Escherichia coli (strain:K12) DNA, clone_lib:Kohara lambda minise]
[DB:genpept-bct1] [DE:E.coli genomic DNA, Kohara clone #275(32.8-33.2 min.).]
[NT:ORF_ID:o276#2; similar to [SwissProt Accession] [LE:10328] [RE:11173]
[DI:direct] >gp:[GI:d1015831:g1742395] [LN:D90787] [AC:D90787:AB001340]
[PN:N-hydroxyarylamine O-acetyltransferase (EC) [OR:Escherichia coli]
[SR:Escherichia coli (strain:K12) DNA, clone_lib:Kohara lambda minise]
[DB:genpept-bct1] [DE:E.coli genomic DNA, Kohara clone #276(33.0-33.3 min.).]
[NT:ORF_ID:o276#2; similar to [SwissProt Accession] [LE:4254] [RE:5099]
[DI:direct] >gp:[GI:g1787736] [LN:AE000243] [AC:AE000243:U00096] [PN:putative
N-hydroxyarylamine O-acetyltransferase] [GN:b1463] [FN:putative enzyme; Not
classified] [OR:Escherichia coli] [DB:genpept-bct2] [DE:Escherichia coli K-12
MG1655 section 133 of 400 of the completegenome.] [NT:o281; 74 pct identical
amino acid sequence and] [LE:3559] [RE:4404] [DI:direct]

| ORF Name | NT ID | AA ID | NT LN | AA LN | Score | P-value |
|---|---|---|---|---|---|---|
| 6057760_f3_1323 | 2692 | 9863 | 561 | 186 | | |

Description

NO-HIT

| ORF_Name | NT_ID | AA_ID | NT LN | AA LN | Score | P-value |
|---|---|---|---|---|---|---|
| 6063208_c3_2965 | 2693 | 9864 | 2517 | 838 | 1406 | 8.5e-144 |

Description sp:[LN:YRAJ_ECOLI] [AC:P42915] [GN:YRAJ] [OR:Escherichia coli] [DE:REGION
PRECURSOR] [SP:P42915] [DB:swissprot] >sp:[LN:D65104] [AC:D65104] [PN:probable
outer membrane usher protein precursor (agaL-mtr intergenic region)] [GN:yraJ]
[CL:outer membrane usher protein fimD] [OR:Escherichia coli] [DB:pir1]
>gp:[GI:g1789533] [LN:AE000395] [AC:AE000395:U00096] [PN:putative outer membrane
protein] [GN:yraJ] [FN:putative membrane; Not classified] [OR:Escherichia coli]
[DB:genpept-bct2] [DE:Escherichia coli K-12 MG1655 section 285 of 400 of the
completegenome.] [NT:o838; 100 pct identical to YRAJ_ECOLI SW: P42915] [LE:7049]
[RE:9565] [DI:direct]

| ORF_Name | NT_ID | AA_ID | NT LN | AA LN | Score | P-value |
|---|---|---|---|---|---|---|
| 6063427_c3_3034 | 2694 | 9865 | 267 | 88 | 163 | 4.4e-12 |

Description sp:[LN:MARB_ECOLI] [AC:P31121] [GN:MARB] [OR:Escherichia coli] [DE:MULTIPLE
ANTIBIOTIC RESISTANCE PROTEIN MARB] [SP:P31121] [DB:swissprot] >sp:[LN:C47072]
[AC:C47072:G64907] [PN:marB protein] [GN:marB] [OR:Escherichia coli] [DB:pir2]
>gp:[GI:d1015941:g1742514] [LN:D90796] [AC:D90796:AB001340] [PN:MarB protein]
[GN:marB] [OR:Escherichia coli] [SR:Escherichia coli (strain:K12) DNA,
clone_lib:Kohara lambda minise] [DB:genpept-bct1] [DE:E.coli genomic DNA, Kohara
clone #305(34.7-35.1 min.).] [NT:ORF_ID:o306#3; similar to [PIR Accession Number]
[LE:9136] [RE:9354] [DI:direct] >gp:[GI:d1015954:g1742528] [LN:D90797]
[AC:D90797:AB001340] [PN:MarB protein] [GN:marB] [OR:Escherichia coli]
[SR:Escherichia coli (strain:K12) DNA, clone_lib:Kohara lambda minise]
[DB:genpept-bct1] [DE:E.coli genomic DNA, Kohara clone #306(34.8-35.1 min.).]
[NT:ORF_ID:o306#3; similar to [PIR Accession Number] [LE:2585] [RE:2803]
[DI:direct] >gp:[GI:g1787812] [LN:AE000250] [AC:AE000250:U00096] [PN:multiple
antibiotic resistance protein] [GN:marB] [FN:putative transport; Drug/analog
sensitivity] [OR:Escherichia coli] [DB:genpept-bct2] [DE:Escherichia coli K-12
MG1655 section 140 of 400 of the completegenome.] [NT:o72; 100 pct identical to
MARB_ECOLI SW: P31121; CG] [LE:9226] [RE:9444] [DI:direct]

| ORF Name | NT ID | AA ID | NT LN | AA LN | Score | P-value |
|---|---|---|---|---|---|---|
| 6073802_f1_446 | 2695 | 9866 | 1533 | 510 | 2243 | 1.7e-232 |

Description sp:[LN:YDGR_ECOLI] [AC:P77304] [GN:YDGR] [OR:Escherichia coli] [DE:HYPOTHETICAL
54.0 KD PROTEIN IN NTH-GST INTERGENIC REGION] [SP:P77304] [DB:swissprot]
>sp:[LN:D64920] [AC:D64920] [PN:probable membrane protein b1634] [CL:peptide
transporter protein] [OR:Escherichia coli] [DB:pir1] >gp:[GI:d1016116:g1742700]
[LN:D90807] [AC:D90807:AB001340] [PN:Di-tripeptide transporter.] [OR:Escherichia
coli] [SR:Escherichia coli (strain:K12) DNA, clone_lib:Kohara lambda minise]
[DB:genpept-bct1] [DE:E.coli genomic DNA, Kohara clone #316(36.7-37.1 min.).]
[NT:ORF_ID:o316#13; similar to [SwissProt Accession] [LE:10375] [RE:11877]
[DI:direct] >gp:[GI:g1787922] [LN:AE000259] [AC:AE000259:U00096] [PN:putative
transport protein] [GN:ydgR] [FN:putative transport; Not classified]
[OR:Escherichia coli] [DB:genpept-bct2] [DE:Escherichia coli K-12 MG1655 section
149 of 400 of the completegenome.] [NT:o500; This 500 aa ORF is 52 pct identical
(4 gaps)] [LE:376] [RE:1878] [DI:direct]

| ORF Name | NT ID | AA ID | NT LN | AA LN | Score | P-value |
|---|---|---|---|---|---|---|
| 6289716_c3_2888 | 2696 | 9867 | 324 | 107 | 259 | 3.0e-22 |

Description sp:[LN:PTWB_ECOLI] [AC:P32673] [GN:FRWB] [OR:Escherichia coli] [EC:2.7.1.69]
[DE:II, B COMPONENT),] [SP:P32673] [DB:swissprot] >sp:[LN:A65202] [AC:A65202]
[PN:pts system, fructose-like-2 IIb component 1] [GN:frwB] [CL:phosphotransferase
system, fructose-like component IIB] [OR:Escherichia coli] [DB:pir2]
>gp:[GI:g1790387] [LN:AE000469] [AC:AE000469:U00096] [PN:PTS system fructose-like
IIB component 1] [GN:frwB] [FN:enzyme; Degradation of small molecules: Carbon]
[OR:Escherichia coli] [DB:genpept-bct2] [DE:Escherichia coli K-12 MG1655 section
359 of 400 of the completegenome.] [NT:o106; 100 pct identical amino acid
sequence and] [LE:1392] [RE:1712] [DI:direct] >gp:[GI:g396297] [LN:ECOUW89]
[AC:U00006] [OR:Escherichia coli] [SR:Escherichia coli (sub_strain MG1655, strain
K-12) (library: lambda] [DB:genpept-bct2] [DE:E. coli chromosomal region from
89.2 to 92.8 minutes.] [NT:similar to phosphotransferase system enzyme II]
[LE:8865] [RE:9185] [DI:direct]

| ORF Name | NT ID | AA ID | NT LN | AA LN | Score | P-value |
|---|---|---|---|---|---|---|
| 6300062_c2_2105 | 2697 | 9868 | 2064 | 687 | 3054 | 0.0 |

Description sp:[LN:F64895] [AC:F64895] [PN:hypothetical protein b1435] [OR:Escherichia coli]
[DB:pir2] >gp:[GI:g1787705] [LN:AE000240] [AC:AE000240:U00096] [PN:putative
collagenase] [GN:ydcP] [FN:putative enzyme; Not classified] [OR:Escherichia coli]
[DB:genpept-bct2] [DE:Escherichia coli K-12 MG1655 section 130 of 400 of the
completegenome.] [NT:o667; This 667 aa ORF is 35 pct identical (11 gaps)]
[LE:8098] [RE:10101] [DI:direct]

| ORF Name | NT ID | AA ID | NT/LN | AA/LN | Score | P-value |
|---|---|---|---|---|---|---|
| 6376057_c3_2999 | 2698 | 9869 | 525 | 174 | 201 | 4.2e-16 |

Description sp:[LN:B70022] [AC:B70022] [PN:acyloate catabolism homolog yusQ] [GN:yusQ]
[CL:hypothetical protein yrdN] [OR:Bacillus subtilis] [DB:pir1]
>gp:[GI:e1184367:g2635785] [LN:BSUB0017] [AC:Z99120:AL009126] [GN:yusQ]
[FN:unknown] [OR:Bacillus subtilis] [DB:genpept-bct1] [DE:Bacillus subtilis
complete genome (section 17 of 21): from 3197001to 3414420.] [NT:similar to
acyloate catabolism] [LE:178676] [RE:179059] [DI:complement]

| ORF Name | NT ID | AA ID | NT/LN | AA/LN | Score | P-value |
|---|---|---|---|---|---|---|
| 6536576_c1_2005 | 2699 | 9870 | 255 | 84 | | |

Description

NO-HIT

| ORF Name | NT ID | AA ID | NT/LN | AA/LN | Score | P-value |
|---|---|---|---|---|---|---|
| 6539785_c1_1610 | 2700 | 9871 | 291 | 96 | 251 | 2.1e-21 |

Description sp:[LN:YOHL_SERMA] [AC:P55757] [OR:Serratia marcescens] [DE:HYPOTHETICAL 10.1 KD
PROTEIN IN BIOA 5'REGION] [SP:P55757] [DB:swissprot]

| ORF Name | NT ID | AA ID | NT/LN | AA/LN | Score | P-value |
|---|---|---|---|---|---|---|
| 6727133_c1_1608 | 2701 | 9872 | 501 | 166 | 241 | 2.4e-20 |

Description sp:[LN:F70918] [AC:F70918] [PN:probable regulatoryprotein] [GN:Rv3095]
[OR:Mycobacterium tuberculosis] [DB:pir2] >gp:[GI:e314984:g2076670] [LN:MTCY164]
[AC:Z95150:AL123456] [PN:hypothetical protein Rv3095] [GN:Rv3095]
[OR:Mycobacterium tuberculosis] [DB:genpept-bct1] [DE:Mycobacterium tuberculosis
H37Rv complete genome; segment 135/162.] [NT:Rv3095, (MTCY164.06), len: 158.
possible] [LE:6670] [RE:7146] [DI:direct]

| ORF Name | NT ID | AA ID | NT/LN | AA/LN | Score | P-value |
|---|---|---|---|---|---|---|
| 6754207_c1_2008 | 2702 | 9873 | 252 | 83 | | |

Description

NO-HIT

| ORF_Name | NT ID | AA ID | NT/LN | AA/LN | Score | P-value |
|---|---|---|---|---|---|---|
| 6830018_f1_299 | 2703 | 9874 | 483 | 160 | 117 | 1.2e-06 |

Description sp:[LN:LGUL_BRAOL] [AC:Q39366:Q39365] [OR:Brassica oleracea] [SR:,Cauliflower]
[EC:4.4.1.5] [DE:(S-D-LACTOYLGLUTATHIONE METHYLGLYOXAL LYASE)] [SP:Q39366:Q39365]
[DB:swissprot] >sp:[LN:T14440] [AC:T14440] [PN:hypothetical protein] [OR:Brassica
oleracea] [SR:, wild cabbage] [DB:pir2] >gp:[GI:e256075:g1469221] [LN:BO13G6IG]
[AC:Z74962] [GN:unknown] [OR:Brassica oleracea] [DB:genpept-pln1] [DE:B.oleracea
mRNA (unknown).] [NT:protein similar to bacterial YRN1 and HEAHIO] [SP:Q39366]
[LE:797:981:1180:1323:1623] [RE:894:1105:1244:1533:1670] [DI:directJoin]

| ORF_Name | NT ID | AA ID | NT/LN | AA/LN | Score | P-value |
|---|---|---|---|---|---|---|
| 6891317_f2_555 | 2704 | 9875 | 1173 | 390 | 525 | 1.9e-50 |

Description sp:[LN:B69978] [AC:B69978] [PN:2-nitropropane dioxygenase homolog yrpB] [GN:yrpB]
[OR:Bacillus subtilis] [DB:pir2] >gp:[GI:e1183909:g2635125] [LN:BSUB0014]
[AC:Z99117:AL009126] [GN:yrpB] [FN:unknown] [OR:Bacillus subtilis]
[DB:genpept-bct1] [DE:Bacillus subtilis complete genome (section 14 of 21): from
2599451to 2812870.] [NT:similar to 2-nitropropane dioxygenase] [LE:136734]
[RE:137777] [DI:direct] >gp:[GI:g1934639] [LN:BSU93875] [AC:U93875]
[PN:2-nitropropane dioxygenase] [GN:yrpB] [OR:Bacillus subtilis]
[DB:genpept-bct2] [DE:Bacillus subtilis alcohol dehydrogenase (adhB) gene,
partial cds,hypothetical spore coat protein (yraF), hypothetical spore
coatprotein (yraG), YraH (yraH), YraI (yraI), YraJ (yraJ), YraK (yraK),YraL
(yraL), chitosanase precursor (csn), YraM (yraM), LysR-familytranscription
regulator (yraN), YraO (yraO), YrpG (yrpG), RNApolymerase sigma factor SigZ
(sigZ), YrpE (yrpE), YrpD (yrpD), YrpC(yrpC) and 2-nitropropane dioxygenase
(yrpB) genes, complete cds,and aminoglycoside 6-adenylyltransferase (aadK) gene,
partial cds.] [NT:similar to 2-nitropropane dioxigenase of Williopsis] [LE:16473]
[RE:17516] [DI:complement]

| ORF Name | NT ID | AA ID | NT/LN | AA/LN | Score | P-value |
|---|---|---|---|---|---|---|
| 6929555_c2_2150 | 2705 | 9876 | 246 | 81 | 314 | 4.4e-28 |

Description sp:[LN:YDCE_ECOLI] [AC:P31992] [GN:YDCE] [OR:Escherichia coli] [DE:HYPOTHETICAL 8.7 KD PROTEIN IN RHSE-NARV INTERGENIC REGION] [SP:P31992] [DB:swissprot] >sp:[LN:H64898] [AC:H64898] [PN:ydcE protein] [GN:ydcE] [OR:Escherichia coli] [DB:pir2] >gp:[GI:d1015811:g1742373] [LN:D90785] [AC:D90785:AB001340] [GN:ydcE] [OR:Escherichia coli] [SR:Escherichia coli (strain:K12) DNA, clone_lib:Kohara lambda minise] [DB:genpept-bct1] [DE:E.coli genomic DNA, Kohara clone #274(32.7-33.0 min.).] [NT:ORF_ID:o274#10; similar to [SwissProt Accession] [LE:15288] [RE:15521] [DI:direct] >gp:[GI:d1015818:g1742381] [LN:D90786] [AC:D90786:AB001340] [GN:ydcE] [OR:Escherichia coli] [SR:Escherichia coli (strain:K12) DNA, clone_lib:Kohara lambda minise] [DB:genpept-bct1] [DE:E.coli genomic DNA, Kohara clone #275(32.8-33.2 min.).] [NT:ORF_ID:o274#10; similar to [SwissProt Accession] [LE:9356] [RE:9589] [DI:direct] >gp:[GI:d1015830:g1742394] [LN:D90787] [AC:D90787:AB001340] [GN:ydcE] [OR:Escherichia coli] [SR:Escherichia coli (strain:K12) DNA, clone_lib:Kohara lambda minise] [DB:genpept-bct1] [DE:E.coli genomic DNA, Kohara clone #276(33.0-33.3 min.).] [NT:ORF_ID:o274#10; similar to [SwissProt Accession] [LE:3282] [RE:3515] [DI:direct] >gp:[GI:g304948] [LN:ECORHSEX] [AC:L19083] [OR:Escherichia coli] [DB:genpept-bct1] [DE:Escherichia coli RhsE genetic element; defective RhsE core protein,complete cds; complete ORF-E2; H-rpt subelement; complete ORF-H.] [NT:unknown ORF] [LE:5162] [RE:5395] [DI:direct] >gp:[GI:e1387355:g4377521] [LN:ECRHSEG] [AC:X60998:L19083] [PN:hypothetical 8.7kDa protein] [OR:Escherichia coli] [DB:genpept-bct1] [DE:Escherichia coli partial rhsE gene, ORF E2, ORFH & unknown ORF.] [NT:unknown ORF] [SP:P31992] [LE:5161] [RE:5394] [DI:direct] >gp:[GI:g1787734] [LN:AE000243] [AC:AE000243:U00096] [PN:orf, hypothetical protein] [GN:ydcE] [FN:orf; Unknown] [OR:Escherichia coli] [DB:genpept-bct2] [DE:Escherichia coli K-12 MG1655 section 133 of 400 of the completegenome.] [NT:o77; 100 pct identical to YDCE_ECOLI SW: P31992;] [LE:2587] [RE:2820] [DI:direct]

| ORF Name | NT ID | AA ID | NT/LN | AA/LN | Score | P-value |
|---|---|---|---|---|---|---|
| 7112762_c3_3000 | 2706 | 9877 | 207 | 68 | 112 | 1.1e-06 |

Description sp:[LN:B70022] [AC:B70022] [PN:acyloate catabolism homolog yusQ] [GN:yusQ] [CL:hypothetical protein yrdN] [OR:Bacillus subtilis] [DB:pir1] >gp:[GI:e1184367:g2635785] [LN:BSUB0017] [AC:Z99120:AL009126] [GN:yusQ] [FN:unknown] [OR:Bacillus subtilis] [DB:genpept-bct1] [DE:Bacillus subtilis complete genome (section 17 of 21): from 3197001to 3414420.] [NT:similar to acyloate catabolism] [LE:178676] [RE:179059] [DI:complement]

| ORF Name | NT ID | AA ID | NT LN | AA LN | Score | P-value |
|---|---|---|---|---|---|---|
| 7214077_c3_2850 | 2707 | 9878 | 1119 | 372 | 1066 | 9.1e-108 |

Description sp:[LN:DHAS_ECOLI] [AC:P00353] [GN:ASD:HOM] [OR:Escherichia coli] [EC:1.2.1.11]
[DE:DEHYDROGENASE)] [SP:P00353] [DB:swissprot] >sp:[LN:DEECDA] [AC:A00364:D65139]
[PN:aspartate-semialdehyde dehydrogenase,] [GN:asd] [CL:aspartate-semialdehyde
dehydrogenase] [OR:Escherichia coli] [EC:1.2.1.11] [DB:pir1] >gp:[GI:g40992]
[LN:ECASDX] [AC:V00262] [OR:Escherichia coli] [DB:genpept-bct1] [DE:E. coli gene
asd coding for aspartic semialdehyde dehydrogenase.] [NT:dehydrogenase]
[SP:P00353] [LE:240] [RE:1343] [DI:direct] >gp:[GI:g1789841] [LN:AE000420]
[AC:AE000420:U00096] [PN:aspartate-semialdehyde dehydrogenase] [GN:asd]
[FN:enzyme; Amino acid biosynthesis: Lysine] [OR:Escherichia coli]
[DB:genpept-bct2] [EC:1.2.1.11] [DE:Escherichia coli K-12 MG1655 section 310 of
400 of the completegenome.] [NT:f367; CG Site No. 996; alternate names dap, hom;
99] [LE:167] [RE:1270] [DI:complement] >gp:[GI:g3859587] [LN:AF101226]
[AC:AF101226] [PN:aspartate semialdehyde dehydrogenase] [GN:asd] [OR:Shigella
sonnei] [DB:genpept-bct2] [DE:Shigella sonnei aspartate semialdehyde
dehydrogenase (asd) gene,complete cds.] [LE:242] [RE:1345] [DI:direct]

| ORF Name | NT ID | AA ID | NT LN | AA LN | Score | P-value |
|---|---|---|---|---|---|---|
| 7228937_f3_1445 | 2708 | 9879 | 372 | 123 | 175 | 2.4e-13 |

Description gp:[GI:g642965] [LN:ABCARRA] [AC:X70360] [GN:carR] [OR:Azospirillum brasilense]
[DB:genpept-bct1] [DE:A.brasilense carR gene.] [NT:ORF2] [LE:59] [RE:580]
[DI:direct]

| ORF Name | NT ID | AA ID | NT LN | AA LN | Score | P-value |
|---|---|---|---|---|---|---|
| 792793_c2_2276 | 2709 | 9880 | 1323 | 440 | | |

Description

NO-HIT

| ORF Name | NT ID | AA ID | NT/LN | AA/LN | Score | P-value |
|---|---|---|---|---|---|---|
| 804693_f1_136 | 2710 | 9881 | 924 | 307 | 589 | 3.2e-57 |

Description sp:[LN:YCAN_ECOLI] [AC:P75836] [GN:YCAN] [OR:Escherichia coli] [DE:HYPOTHETICAL
TRANSCRIPTIONAL REGULATOR IN DMSC-PFLA INTERGENIC REGION] [SP:P75836]
[DB:swissprot] >sp:[LN:C64829] [AC:C64829] [PN:transcription regulator ycaN]
[GN:ycaN] [CL:hypothetical protein b1328] [OR:Escherichia coli] [DB:pir2]
>gp:[GI:d1036621:g4062476] [LN:D90728] [AC:D90728:AB001340] [PN:Hypothetical
protein 3] [OR:Escherichia coli] [SR:Escherichia coli(strain:K12) DNA,
clone:Kohara clone #216] [DB:genpept-bct1] [DE:Escherichia coli genomic DNA.
(20.4 - 20.8 min).] [NT:ORF_ID:o216#4; similar to PIR Accession Number] [LE:4353]
[RE:5261] [DI:complement] >gp:[GI:g1787128] [LN:AE000192] [AC:AE000192:U00096]
[PN:putative transcriptional regulator LYSR-type] [GN:ycaN] [FN:putative
regulator; Not classified] [OR:Escherichia coli] [DB:genpept-bct2]
[DE:Escherichia coli K-12 MG1655 section 82 of 400 of the completegenome.]
[NT:f302; This 302 aa ORF is 43 pct identical (4 gaps)] [LE:2976] [RE:3884]
[DI:complement]

| ORF Name | NT ID | AA ID | NT/LN | AA/LN | Score | P-value |
|---|---|---|---|---|---|---|
| 806941_f2_813 | 2711 | 9882 | 498 | 165 | 198 | 8.7e-16 |

Description sp:[LN:F69972] [AC:F69972] [PN:probable membrane protein yrbG] [GN:yrbG]
[CL:probable membrane protein ycaP] [OR:Bacillus subtilis] [DB:pir2]
>gp:[GI:e1184017:g2635233] [LN:BSUB0015] [AC:Z99118:AL009126] [GN:yrbG]
[FN:unknown] [OR:Bacillus subtilis] [DB:genpept-bct1] [DE:Bacillus subtilis
complete genome (section 15 of 21): from 2795131to 3013540.] [NT:similar to
hypothetical proteins from B. subtilis] [LE:35255] [RE:35911] [DI:complement]

| ORF Name | NT ID | AA ID | NT/LN | AA/LN | Score | P-value |
|---|---|---|---|---|---|---|
| 822837_c2_2183 | 2712 | 9883 | 432 | 143 | 346 | 1.8e-31 |

Description sp:[LN:CATC_ACICA] [AC:Q43932] [GN:CATC] [OR:Acinetobacter calcoaceticus]
[EC:5.3.3.4] [DE:MUCONOLACTONE DELTA-ISOMERASE, (MIASE)] [SP:Q43932]
[DB:swissprot] >gp:[GI:g2996616] [LN:AF009224]
[AC:AF009224:M76991:M76990:M23245:M29848:M29714:M62649] [PN:muconolactone
isomerase] [GN:catC] [FN:conversion of muconolactone to ketoadipate]
[OR:Acinetobacter sp. ADP1] [DB:genpept-bct2] [DE:Acinetobacter sp. ADP1 ben
operon and cat operon, completesequence.] [LE:14281] [RE:14571] [DI:direct]

| ORF Name | NT ID | AA ID | NT LN | AA LN | Score | P-value |
|---|---|---|---|---|---|---|
| 865750_f1_204 | 2713 | 9884 | 1077 | 358 | 143 | 4.1e-07 |

Description sp:[LN:A72417] [AC:A72417] [PN:sugar ABC transporter, periplasmic sugar-binding protein] [GN:TM0114] [OR:Thermotoga maritima] [DB:pir2] >gp:[GI:g4980605] [LN:AE001697] [AC:AE001697:AE000512] [PN:sugar ABC transporter, periplasmic sugar-binding] [GN:TM0114] [OR:Thermotoga maritima] [DB:genpept-bct2] [DE:Thermotoga maritima section 9 of 136 of the complete genome.] [NT:similar to SP:P36949 GB:Z25798 PID:397499] [LE:6961] [RE:7968] [DI:direct]

| ORF Name | NT ID | AA ID | NT LN | AA LN | Score | P-value |
|---|---|---|---|---|---|---|
| 954628_f1_290 | 2714 | 9885 | 1041 | 346 | 1557 | 8.5e-160 |

Description sp:[LN:ADHP_ECOLI] [AC:P39451:P76126:P78268:P78157] [GN:ADHP] [OR:Escherichia coli] [EC:1.1.1.1] [DE:ALCOHOL DEHYDROGENASE, PROPANOL-PREFERRING,] [SP:P39451:P76126:P78268:P78157] [DB:swissprot] >gp:[GI:d1015845:g1742410] [LN:D90788] [AC:D90788:AB001340] [PN:Alcohol dehydrogenase I (EC 1.1.1.1) (ADH I).] [OR:Escherichia coli] [SR:Escherichia coli (strain:K12) DNA, clone_lib:Kohara lambda minise] [DB:genpept-bct1] [DE:E.coli genomic DNA, Kohara clone #277(33.2-33.6 min.).] [NT:ORF_ID:o277#9; similar to [SwissProt Accession] [LE:10632] [RE:11642] [DI:complement] >gp:[GI:d1015854:g1742420] [LN:D90789] [AC:D90789:AB001340] [PN:Alcohol dehydrogenase I (EC 1.1.1.1) (ADH I).] [OR:Escherichia coli] [SR:Escherichia coli (strain:K12) DNA, clone_lib:Kohara lambda minise] [DB:genpept-bct1] [DE:E.coli genomic DNA, Kohara clone #278(33.3-33.7 min.).] [NT:ORF_ID:o277#9; similar to [SwissProt Accession] [LE:7008] [RE:8018] [DI:complement]

| ORF Name | NT ID | AA ID | NT LN | AA LN | Score | P-value |
|---|---|---|---|---|---|---|
| 955051_f1_179 | 2715 | 9886 | 603 | 200 | 242 | 1.9e-20 |

Description sp:[LN:F70918] [AC:F70918] [PN:probable regulatoryprotein] [GN:Rv3095] [OR:Mycobacterium tuberculosis] [DB:pir2] >gp:[GI:e314984:g2076670] [LN:MTCY164] [AC:Z95150:AL123456] [PN:hypothetical protein Rv3095] [GN:Rv3095] [OR:Mycobacterium tuberculosis] [DB:genpept-bct1] [DE:Mycobacterium tuberculosis H37Rv complete genome; segment 135/162.] [NT:Rv3095, (MTCY164.06), len: 158. possible] [LE:6670] [RE:7146] [DI:direct]

| ORF Name | NT ID | AA ID | NT LN | AA LN | Score | P-value |
|---|---|---|---|---|---|---|
| 9772030_f1_292 | 2716 | 9887 | 1068 | 355 | 549 | 5.5e-53 |

Description gp:[GI:g3170567] [LN:AF058302] [AC:AF058302] [PN:membrane protein of putative ABC transporter] [GN:frnB] [OR:Streptomyces roseofulvus] [DB:genpept-bct2] [DE:Streptomyces roseofulvus frenolicin biosynthetic gene cluster,complete sequence.] [NT:FrnB; similar to Escherichia coli DPPB] [LE:3872] [RE:4843] [DI:direct]

| ORF Name | NT ID | AA ID | NT LN | AA LN | Score | P-value |
|---|---|---|---|---|---|---|
| 9773416_c2_2191 | 2717 | 9888 | 660 | 219 | 976 | 3.1e-98 |

Description sp:[LN:FDNG_ECOLI] [AC:P24183:P78261] [GN:FDNG] [OR:Escherichia coli]
[EC:1.2.1.2] [DE:(ANAEROBIC FORMATE DEHYDROGENASE MAJOR SUBUNIT)]
[SP:P24183:P78261] [DB:swissprot] >sp:[LN:JS0628] [AC:E64900:JS0628] [PN:formate
dehydrogenase, N (nitrate-inducible) alpha chain:formate dehydrogenase N
selenocysteine-containing protein] [GN:fdnG] [CL:formate dehydrogenase]
[OR:Escherichia coli] [EC:1.2.1.2] [DB:pir1] [MP:32 min]

| ORF Name | NT ID | AA ID | NT LN | AA LN | Score | P-value |
|---|---|---|---|---|---|---|
| 978402_f3_1336 | 2718 | 9889 | 855 | 284 | 102 | 0.0053 |

Description sp:[LN:B69900] [AC:B69900] [PN:conserved hypothetical protein yobT] [GN:yobT]
[CL:glyoxalase] [OR:Bacillus subtilis] [DB:pir2] >gp:[GI:e1185380:g2634301]
[LN:BSUB0011] [AC:Z99114:AL009126] [GN:yobT] [FN:unknown] [OR:Bacillus subtilis]
[DB:genpept-bct1] [DE:Bacillus subtilis complete genome (section 11 of 21): from
2000171to 2207900.] [NT:similar to hypothetical proteins] [LE:80838] [RE:81539]
[DI:complement] >gp:[GI:g2619046] [LN:AF027868] [AC:AF027868] [PN:YobT] [GN:yobT]
[OR:Bacillus subtilis] [DB:genpept-bct2] [DE:Bacillus subtilis chromosome region
between terC and odhAB.] [NT:similar toh Xanthomonas L1 metallo-beta-lactamase]
[LE:61747] [RE:62448] [DI:complement]

| ORF Name | NT ID | AA ID | NT LN | AA LN | Score | P-value |
|---|---|---|---|---|---|---|
| 9797081_f3_1191 | 2719 | 9890 | 1458 | 485 | 1881 | 3.9e-194 |

Description sp:[LN:PGTP_SALTY] [AC:P12681] [GN:PGTP] [OR:Salmonella typhimurium]
[DE:PHOSPHOGLYCERATE TRANSPORTER PROTEIN] [SP:P12681] [DB:swissprot]
>sp:[LN:JNEBPT] [AC:A31089] [PN:phosphoglycerate transport protein] [GN:pgtP]
[CL:hexose phosphate transport protein uhpT] [OR:Salmonella typhimurium]
[DB:pir1] >gp:[GI:g154262] [LN:STYPGTP] [AC:M21278] [OR:Salmonella typhimurium]
[SR:S.typhimurium (strain LT-2) DNA, clone pJH5] [DB:genpept-bct1]
[DE:S.typhimurium phosphoglycerate transporter protein (pgtP) gene,complete cds.]
[NT:transporter protein pgtP] [LE:642] [RE:1862] [DI:direct]

| ORF Name | NT ID | AA ID | NT LN | AA LN | Score | P-value |
|---|---|---|---|---|---|---|
| 9805432_c2_2464 | 2720 | 9891 | 714 | 237 | 518 | 1.1e-49 |

Description sp:[LN:G71800] [AC:G71800] [PN:ABC transporter, permease] [GN:jhp1485]
[CL:probable transport protein yaeE] [OR:Helicobacter pylori] [SR:strain J99, ,
strain J99] [SR:strain J99, ] [DB:pir2] >gp:[GI:g4156119] [LN:AE001570]
[AC:AE001570:AE001439] [PN:ABC transporter, permease] [GN:jhp1485]
[OR:Helicobacter pylori J99] [DB:genpept-bct2] [DE:Helicobacter pylori, strain
J99 section 131 of 132 of the completegenome.] [NT:similar to H. pylori 26695
gene HP1577] [LE:1965] [RE:2612] [DI:direct]

923

| ORF Name | NT ID | AA ID | NT/LN | AA/LN | Score | P-value |
|---|---|---|---|---|---|---|
| 9922012_f1_205 | 2721 | 9892 | 975 | 324 | 299 | 1.7e-26 |

Description gp:[GI:g3411177] [LN:AF076240] [AC:AF076240] [PN:MocC] [GN:mocC] [OR:Rhizobium leguminosarum bv. viciae] [DB:genpept-bct2] [DE:Rhizobium leguminosarum plasmid pSyma MocC (mocC), putativeNADH-inositol dehydrogenase MocA (mocA), putative rhizopineperiplasmic transport protein MocB precursor (mocB), putativeregulatory protein MocR (mocR), putative hydrocarbon oxygenase MocD(mocD), putative Rieske-like ferredoxin MocE (mocE), and putativeferredoxin reductase MocF (mocF) genes, complete cds; and unknowngenes.] [LE:215] [RE:1102] [DI:direct]

| ORF Name | NT ID | AA ID | NT/LN | AA/LN | Score | P-value |
|---|---|---|---|---|---|---|
| 9945758_f1_228 | 2722 | 9893 | 396 | 131 | 473 | 6.3e-45 |

Description sp:[LN:PQQD_KLEPN] [AC:P27506] [GN:PQQD] [OR:Klebsiella pneumoniae] [DE:COENZYME PQQ SYNTHESIS PROTEIN D] [SP:P27506] [DB:swissprot] >sp:[LN:S20456] [AC:S20456:S21841] [PN:pqqD protein] [GN:pqqD] [OR:Klebsiella pneumoniae] [DB:pir2] >gp:[GI:g43908] [LN:KPPQQAF] [AC:X58778:S92172] [GN:pqqD] [OR:Klebsiella pneumoniae] [DB:genpept-bct1] [DE:K.pneumoniae pqqABCDEF genes, involved in pyrroloquinolinebiosynthesis.] [SP:P27506] [LE:2758] [RE:3036] [DI:direct]

| ORF Name | NT ID | AA ID | NT/LN | AA/LN | Score | P-value |
|---|---|---|---|---|---|---|
| 9947808_c2_2484 | 2723 | 9894 | 906 | 301 | 1270 | 2.2e-129 |

Description sp:[LN:YNEJ_ECOLI] [AC:P77309] [GN:YNEJ] [OR:Escherichia coli] [DE:HYPOTHETICAL TRANSCRIPTIONAL REGULATOR IN UXAB-MARR INTERGENIC REGION] [SP:P77309] [DB:swissprot] >sp:[LN:A64907] [AC:A64907:S41477:S35950] [PN:probable transcription regulator yneJ] [GN:yneJ] [CL:Pseudomonas putida regulatory protein catR] [OR:Escherichia coli] [DB:pir2] >gp:[GI:d1015928:g1742500] [LN:D90795] [AC:D90795:AB001340] [PN:Pectinase gene transcriptional regulator.] [OR:Escherichia coli] [SR:Escherichia coli (strain:K12) DNA, clone_lib:Kohara lambda minise] [DB:genpept-bct1] [DE:E.coli genomic DNA, Kohara clone #304(34.6-34.9 min.).] [NT:ORF_ID:o304#13; similar to [SwissProt Accession] [LE:10668] [RE:11549] [DI:direct] >gp:[GI:d1015936:g1742509] [LN:D90796] [AC:D90796:AB001340] [PN:Pectinase gene transcriptional regulator.] [OR:Escherichia coli] [SR:Escherichia coli (strain:K12) DNA, clone_lib:Kohara lambda minise] [DB:genpept-bct1] [DE:E.coli genomic DNA, Kohara clone #305(34.7-35.1 min.).] [NT:ORF_ID:o304#13; similar to [SwissProt Accession] [LE:3951] [RE:4832] [DI:direct] >gp:[GI:g1787806] [LN:AE000250] [AC:AE000250:U00096] [PN:putative transcriptional regulator LYSR-type] [GN:yneJ] [FN:putative regulator; Not classified] [OR:Escherichia coli] [DB:genpept-bct2] [DE:Escherichia coli K-12 MG1655 section 140 of 400 of the completegenome.] [NT:o293; This 293 aa ORF is 27 pct identical (10 gaps)] [LE:4041] [RE:4922] [DI:direct]

| ORF Name | NT ID | AA ID | NT LN | AA LN | Score | P-value |
|---|---|---|---|---|---|---|
| 10022303_c2_1645 | 2724 | 9895 | 1455 | 484 | 1187 | 1.4e-120 |

Description sp:[LN:D69785] [AC:D69785] [PN:beta-glucosidase homolog ydhP] [GN:ydhP]
[CL:Agrobacterium beta-glucosidase] [OR:Bacillus subtilis] [DB:pir2]
>gp:[GI:e1182563:g2632897] [LN:BSUB0004] [AC:Z99107:AL009126] [GN:ydhP]
[FN:unknown] [OR:Bacillus subtilis] [DB:genpept-bct1] [DE:Bacillus subtilis
complete genome (section 4 of 21): from 600701 to813890.] [NT:similar to
beta-glucosidase] [LE:27646] [RE:29043] [DI:direct] >gp:[GI:d1020487:g1945100]
[LN:D88802] [AC:D88802] [GN:ydhP] [OR:Bacillus subtilis] [SR:Bacillus subtilis
(sub_species:Marburg, strain:168, isolate:JH642] [DB:genpept-bct1] [DE:Bacillus
subtilis DNA for phoB-rrnE-groESL region, complete cds.] [NT:C. thermocellum
beta-glucosidase; P26208 (985)] [LE:14648] [RE:16045] [DI:direct]

| ORF Name | NT ID | AA ID | NT LN | AA LN | Score | P-value |
|---|---|---|---|---|---|---|
| 10034552_c3_2109 | 2725 | 9896 | 945 | 314 | 236 | 8.2e-20 |

Description sp:[LN:CBL_ECOLI] [AC:Q47083:P76353] [GN:CBL] [OR:Escherichia coli]
[DE:TRANSCRIPTIONAL REGULATOR CBL] [SP:Q47083:P76353] [DB:swissprot]
>sp:[LN:C64963] [AC:C64963:I41150] [PN:transcription regulator cbl:cysB protein
homolog] [GN:cbl] [CL:regulatory protein lysR] [OR:Escherichia coli] [DB:pir2]
>gp:[GI:d1016529:g1736649] [LN:D90837] [AC:D90837:AB001340] [PN:Cys regulon
transcriptional activator.] [OR:Escherichia coli] [SR:Escherichia coli
(strain:K12) DNA, clone_lib:Kohara lambda minise] [DB:genpept-bct1] [DE:E.coli
genomic DNA, Kohara clone #347(44.2-44.5 min.).] [NT:ORF_ID:o347#6; similar to
[SwissProt Accession] [LE:8752] [RE:9702] [DI:complement] >gp:[GI:g1788296]
[LN:AE000290] [AC:AE000290:U00096] [PN:transcriptional regulator cys regulon;
accessory] [GN:cbl] [FN:regulator; Amino acid biosynthesis: Cysteine]
[OR:Escherichia coli] [DB:genpept-bct2] [DE:Escherichia coli K-12 MG1655 section
180 of 400 of the completegenome.] [NT:f316; 99 pct identical to PIR: I41150]
[LE:7849] [RE:8799] [DI:complement]

| ORF Name | NT ID | AA ID | NT LN | AA LN | Score | P-value |
|---|---|---|---|---|---|---|
| 10048955_f1_95 | 2726 | 9897 | 411 | 136 | 495 | 2.9e-47 |

Description gp:[GI:g146286] [LN:ECOGUTBB] [AC:M93589] [PN:PTS enzyme III glucitol] [GN:gutB]
[OR:Escherichia coli] [SR:Escherichia coli (individual_isolate RM66C/human/Iowa,
strain ECO] [DB:genpept-bct1] [DE:Escherichia coli (strain ECOR 6, isolate
RM66C/human/Iowa) PTSenzyme III glucitol (gutB) gene, complete cds.]
[NT:putative] [LE:1] [RE:372] [DI:direct] >gp:[GI:g146290] [LN:ECOGUTBD]
[AC:M93590] [PN:PTS enzyme III glucitol] [GN:gutB] [OR:Escherichia coli]
[SR:Escherichia coli (individual_isolate RM42B/human/Iowa, strain ECO]
[DB:genpept-bct1] [DE:Escherichia coli (strain ECOR 35, isolate RM42B/human/Iowa)
PTSenzyme III glucitol (gutB) gene, complete cds.] [NT:putative] [LE:1] [RE:372]
[DI:direct]

| ORF Name | NT ID | AA ID | NT/LN | AA/LN | Score | P-value |
|---|---|---|---|---|---|---|
| 10268800_c2_1770 | 2727 | 9898 | 537 | 178 | 102 | 1.5e-05 |

Description sp:[LN:F72361] [AC:F72361] [PN:conserved hypothetical protein] [GN:TM0567] [OR:Thermotoga maritima] [DB:pir2] >gp:[GI:g4981083] [LN:AE001731] [AC:AE001731:AE000512] [PN:conserved hypothetical protein] [GN:TM0567] [OR:Thermotoga maritima] [DB:genpept-bct2] [DE:Thermotoga maritima section 43 of 136 of the complete genome.] [NT:similar to PID:633731 percent identity: 58.96;] [LE:6508] [RE:6921] [DI:complement]

| ORF Name | NT ID | AA ID | NT/LN | AA/LN | Score | P-value |
|---|---|---|---|---|---|---|
| 10354766_f1_320 | 2728 | 9899 | 1404 | 467 | 2007 | 1.7e-207 |

Description gp:[GI:g5069459] [LN:AF026270] [AC:AF026270:L31414] [PN:PduP] [GN:pduP] [OR:Salmonella enterica serovar Typhimurium] [DB:genpept-bct2] [DE:Salmonella enterica serovar Typhimurium PocR (pocR) gene, partialcds; PduF (pudF) gene, complete cds and pdu operon, completesequence.] [NT:probable CoA-dependent propionaldehyde] [LE:11822] [RE:13216] [DI:direct]

| ORF Name | NT ID | AA ID | NT/LN | AA/LN | Score | P-value |
|---|---|---|---|---|---|---|
| 10557083_c2_1588 | 2729 | 9900 | 1740 | 579 | 2888 | 7.7e-301 |

Description sp:[LN:A34354] [AC:A34354] [PN:sulfite reductase (NADPH), hemoprotein] [CL:sulfite reductase (ferredoxin)] [OR:Salmonella typhimurium] [EC:1.8.1.2] [DB:pir1]

| ORF Name | NT ID | AA ID | NT/LN | AA/LN | Score | P-value |
|---|---|---|---|---|---|---|
| 10626343_f1_282 | 2730 | 9901 | 636 | 211 | 549 | 5.5e-53 |

Description sp:[LN:YGDK_ECOLI] [AC:Q46926] [GN:YGDK] [OR:Escherichia coli] [DE:HYPOTHETICAL 15.9 KD PROTEIN IN GCVA-METZ INTERGENIC REGION (O147)] [SP:Q46926] [DB:swissprot] >sp:[LN:G65063] [AC:G65063] [PN:hypothetical protein b2811] [CL:hypothetical protein b2811] [OR:Escherichia coli] [DB:pir1] >gp:[GI:g882706] [LN:ECU29581] [AC:U29581] [OR:Escherichia coli] [DB:genpept-bct1] [DE:Escherichia coli K-12 genome; approximately 63 to 64 minutes.] [NT:ORF_o147] [LE:26097] [RE:26540] [DI:direct] >gp:[GI:g1789176] [LN:AE000364] [AC:AE000364:U00096] [PN:orf, hypothetical protein] [GN:ygdK] [FN:orf; Unknown] [OR:Escherichia coli] [DB:genpept-bct2] [DE:Escherichia coli K-12 MG1655 section 254 of 400 of the completegenome.] [NT:o147; This 147 aa ORF is 35 pct identical (0 gaps)] [LE:10611] [RE:11054] [DI:direct]

| ORF Name | NT ID | AA ID | NT LN | AA LN | Score | P-value |
|---|---|---|---|---|---|---|
| 10822150_f3_1025 | 2731 | 9902 | 1668 | 555 | 2822 | 7.6e-294 |

Description gp:[GI:g4063702] [LN:AF102064] [AC:AF102064] [PN:adenosylcobalamin-dependent diol dehydratase] [GN:pddA] [OR:Klebsiella pneumoniae] [DB:genpept-bct2] [EC:4.2.1.28] [DE:Klebsiella pneumoniae adenosylcobalamin-dependent diol dehydratasealpha subunit (pddA), adenosylcobalamin-dependent diol dehydratasebeta subunit (pddB), and adenosylcobalamin-dependent dioldehydratase gamma subunit (pddC) genes, complete cds.] [LE:121] [RE:1785] [DI:direct]

| ORF Name | NT ID | AA ID | NT LN | AA LN | Score | P-value |
|---|---|---|---|---|---|---|
| 10822591_c3_2004 | 2732 | 9903 | 351 | 116 | 91 | 4.8e-06 |

Description gp:[GI:g1507721] [LN:PSEMONOX] [AC:L81125] [PN:monooxygenase subunit] [OR:Pseudomonas sp.] [SR:Pseudomonas sp (strain IMT37) DNA] [DB:genpept-bct1] [DE:Pseudomonas sp. (strain IMT37) monooxygenase subunit gene, completecds.] [LE:502] [RE:2016] [DI:direct]

| ORF Name | NT ID | AA ID | NT LN | AA LN | Score | P-value |
|---|---|---|---|---|---|---|
| 10828841_c2_1459 | 2733 | 9904 | 1890 | 629 | 2199 | 7.9e-228 |

Description sp:[LN:EX5A_ECOLI] [AC:P04993;Q59378] [GN:RECD] [OR:Escherichia coli] [EC:3.1.11.5] [DE:ALPHA CHAIN)] [SP:P04993;Q59378] [DB:swissprot] >sp:[LN:NCECXF] [AC:D65064;A25533;C25532] [PN:exodeoxyribonuclease V, 67K chain:exonuclease V alpha chain:recBC DNase alpha chain] [GN:recD] [CL:exodeoxyribonuclease V 67K chain] [OR:Escherichia coli] [EC:3.1.11.5] [DB:pir1] [MP:61 min] >gp:[GI:g882711] [LN:ECU29581] [AC:U29581] [PN:exonuclease V alpha-subunit] [GN:recD] [OR:Escherichia coli] [DB:genpept-bct1] [EC:3.1.11.5] [DE:Escherichia coli K-12 genome; approximately 63 to 64 minutes.] [NT:CG Site No. 4975] [LE:32190] [RE:34016] [DI:complement] >gp:[GI:g1789182] [LN:AE000365] [AC:AE000365;U00096] [PN:DNA helicase, ATP-dependent dsDNA/ssDNA] [GN:recD] [FN:enzyme; Degradation of DNA] [OR:Escherichia coli] [DB:genpept-bct2] [EC:3.1.11.5] [DE:Escherichia coli K-12 MG1655 section 255 of 400 of the completegenome.] [NT:f608; 99 pct identical to EX5A_ECOLI SW: P04993; CG] [LE:4704] [RE:6530] [DI:complement]

| ORF Name | NT ID | AA ID | NT LN | AA LN | Score | P-value |
|---|---|---|---|---|---|---|
| 10839131_f1_269 | 2734 | 9905 | 1791 | 596 | 2928 | 0.0 |

Description sp:[LN:FUCI_ECOLI] [AC:P11552] [GN:FUCI] [OR:Escherichia coli] [EC:5.3.1.25]
[DE:L-FUCOSE ISOMERASE,] [SP:P11552] [DB:swissprot] >sp:[LN:ISECFI]
[AC:JS0185:F65062:S49564] [PN:L-fuculose isomerase,] [GN:fucI] [CL:isomerase
fucI] [OR:Escherichia coli] [EC:5.3.1.-] [DB:pir1] [MP:60 min] >gp:[GI:g41505]
[LN:ECFUCOSE] [AC:X15025] [OR:Escherichia coli] [DB:genpept-bct1] [DE:Escherichia
coli fucose operon.] [NT:fucI ORF (AA 1-591)] [SP:P11552] [LE:3957] [RE:5732]
[DI:direct] >gp:[GI:g882697] [LN:ECU29581] [AC:U29581] [PN:L-fuculose isomerase]
[GN:fucI] [OR:Escherichia coli] [DB:genpept-bct1] [EC:5.3.1.-] [DE:Escherichia
coli K-12 genome; approximately 63 to 64 minutes.] [NT:CG Site no. 10878;
ORF_o591] [LE:17139] [RE:18914] [DI:direct] >gp:[GI:g1789167] [LN:AE000364]
[AC:AE000364:U00096] [PN:L-fucose isomerase] [GN:fucI] [FN:enzyme; Degradation of
small molecules: Carbon] [OR:Escherichia coli] [DB:genpept-bct2] [EC:5.3.1.-]
[DE:Escherichia coli K-12 MG1655 section 254 of 400 of the completegenome.]
[NT:o591; 100 pct identical to FUCI_ECOLI SW: P11552;] [LE:1653] [RE:3428]
[DI:direct]

| ORF Name | NT ID | AA ID | NT LN | AA LN | Score | P-value |
|---|---|---|---|---|---|---|
| 10839540_f2_657 | 2735 | 9906 | 1452 | 483 | 119 | 0.00048 |

Description gp:[GI:g3643164] [LN:AF086702] [AC:AF086702] [PN:glycoprotein gD precursor]
[GN:gD] [OR:Pseudorabies virus] [DB:genpept-vrl] [DE:Pseudorabies virus
glycoprotein gD precursor (gD) gene, completecds.] [LE:33] [RE:1247] [DI:direct]

| ORF Name | NT ID | AA ID | NT LN | AA LN | Score | P-value |
|---|---|---|---|---|---|---|
| 10938330_f2_517 | 2736 | 9907 | 507 | 168 | 135 | 8.5e-09 |

Description sp:[LN:S61499] [AC:S61499] [PN:transcription activator fhlA homolog] [GN:fhlA]
[CL:transcription activator fhlA:RNA polymerase sigma factor interaction domain
homology] [OR:Salmonella typhimurium] [DB:pir2]

| ORF Name | NT ID | AA ID | NT LN | AA LN | Score | P-value |
|---|---|---|---|---|---|---|
| 10969393_c1_1174 | 2737 | 9908 | 828 | 275 | 1268 | 3.6e-129 |

Description sp:[LN:YGDL_ECOLI] [AC:Q46927] [GN:YGDL] [OR:Escherichia coli] [DE:HYPOTHETICAL 28.6 KD PROTEIN IN GCVA-MLTA INTERGENIC REGION] [SP:Q46927] [DB:swissprot] >sp:[LN:H65063] [AC:H65063] [PN:hypothetical protein b2812] [OR:Escherichia coli] [DB:pir2] >gp:[GI:g882707] [LN:ECU29581] [AC:U29581] [OR:Escherichia coli] [DB:genpept-bct1] [DE:Escherichia coli K-12 genome; approximately 63 to 64 minutes.] [NT:ORF_f268] [LE:26591] [RE:27397] [DI:complement] >gp:[GI:g1789177] [LN:AE000364] [AC:AE000364:U00096] [PN:putative enzyme] [GN:ygdL] [FN:putative enzyme; Not classified] [OR:Escherichia coli] [DB:genpept-bct2] [DE:Escherichia coli K-12 MG1655 section 254 of 400 of the completegenome.] [NT:f268; This 268 aa ORF is 31 pct identical (11 gaps)] [LE:11105] [RE:11911] [DI:complement]

| ORF Name | NT ID | AA ID | NT LN | AA LN | Score | P-value |
|---|---|---|---|---|---|---|
| 10978887_f2_470 | 2738 | 9909 | 1449 | 482 | 2137 | 2.9e-221 |

Description gp:[GI:g145387] [LN:ECOASCBFG] [AC:M73326] [PN:PTS enzyme II-asc] [GN:ascF] [OR:Escherichia coli] [SR:Escherichia coli (sub_strain LP103, strain K-12) DNA] [DB:genpept-bct1] [DE:Escherichia coli phospho-beta-glucosidase (ascB), asc repressor(ascG), PTS enzyme II-asc (ascF) genes, complete cds.] [LE:1390] [RE:2847] [DI:direct]

| ORF Name | NT ID | AA ID | NT LN | AA LN | Score | P-value |
|---|---|---|---|---|---|---|
| 11023906_c2_1530 | 2739 | 9910 | 684 | 227 | 978 | 1.9e-98 |

Description sp:[LN:YGDE_ECOLI] [AC:P32066] [GN:YGDE] [OR:Escherichia coli] [DE:HYPOTHETICAL 41.9 KD PROTEIN IN FUCR-GCVA INTERGENIC REGION (ORF3)] [SP:P32066] [DB:swissprot] >sp:[LN:I41067] [AC:I41067:B65063:S34373] [PN:hypothetical 41.9K protein (fucR-gcvA intergenic region)] [GN:ygdE] [OR:Escherichia coli] [DB:pir2] >gp:[GI:g312768] [LN:ECGCVA] [AC:X73413] [OR:Escherichia coli] [DB:genpept-bct1] [DE:E.coli gene for glycine cleavage activator protein and orf 2 and 3.] [NT:ORF3] [SP:P32066] [LE:1367] [RE:2467] [DI:direct] >gp:[GI:g882701] [LN:ECU29581] [AC:U29581] [OR:Escherichia coli] [DB:genpept-bct1] [DE:Escherichia coli K-12 genome; approximately 63 to 64 minutes.] [NT:alternate name Orf2 of X73413 and U01030; ORF_f366] [LE:21698] [RE:22798] [DI:complement] >gp:[GI:g1789171] [LN:AE000364] [AC:AE000364:U00096] [PN:orf, hypothetical protein] [GN:ygdE] [FN:orf; Unknown] [OR:Escherichia coli] [DB:genpept-bct2] [DE:Escherichia coli K-12 MG1655 section 254 of 400 of the completegenome.] [NT:f366; 100 pct identical to YGDE_ECOLI SW: P32066;] [LE:6212] [RE:7312] [DI:complement]

| ORF_Name | NT ID | AA ID | NT LN | AA LN | Score | P-value |
|---|---|---|---|---|---|---|
| 11063801_c3_2006 | 2740 | 9911 | 534 | 177 | 619 | 2.1e-60 |

Description sp:[LN:HYCH_ECOLI] [AC:P16434] [GN:HYCH:HEVH] [OR:Escherichia coli] [DE:FORMATE HYDROGENLYASE MATURATION PROTEIN HYCH] [SP:P16434] [DB:swissprot] >sp:[LN:S08626] [AC:S08626:B65052] [PN:formate hydrogenlyase maturation protein:hydrogenase-3 protein H] [GN:hycH] [CL:formate hydrogenlyase maturation protein] [OR:Escherichia coli] [DB:pir2] [MP:58-59 min] >gp:[GI:g41687] [LN:ECHYC] [AC:X17506] [GN:hycH] [OR:Escherichia coli] [DB:genpept-bct1] [DE:E.coli hyc operon hycA,B,C,D,E,F,G,H,I genes.] [SP:P16434] [LE:7201] [RE:7611] [DI:direct] >gp:[GI:g882611] [LN:ECU29579] [AC:U29579] [PN:formate hydrogenlyase maturation protein] [GN:hycH] [OR:Escherichia coli] [DB:genpept-bct1] [DE:Escherichia coli K-12 genome; approximately 61 to 62 minutes.] [NT:CG Site No. 33140; alternate gene name hevH] [LE:15340] [RE:15750] [DI:complement] >gp:[GI:g1789073] [LN:AE000356] [AC:AE000356:U00096] [PN:processing of large subunit (HycE) of] [GN:hycH] [FN:factor; Energy metabolism, carbon;] [OR:Escherichia coli] [DB:genpept-bct2] [DE:Escherichia coli K-12 MG1655 section 246 of 400 of the completegenome.] [NT:f136; 100 pct identical to HYCH_ECOLI SW: P16434;] [LE:573] [RE:983] [DI:complement]

| ORF_Name | NT ID | AA ID | NT LN | AA LN | Score | P-value |
|---|---|---|---|---|---|---|
| 11067907_f3_863 | 2741 | 9912 | 987 | 328 | 1130 | 1.5e-114 |

Description gp:[GI:g5231095] [LN:AF128999] [AC:AF128999] [PN:SitB] [GN:sitB] [OR:Salmonella typhimurium] [DB:genpept-bct2] [DE:Salmonella typhimurium SitA (sitA), SitB (sitB), SitC (sitC), andSitD (sitD) genes, complete cds.] [LE:1224] [RE:2045] [DI:direct]

| ORF_Name | NT ID | AA ID | NT LN | AA LN | Score | P-value |
|---|---|---|---|---|---|---|
| 11205311_f2_646 | 2742 | 9913 | 312 | 103 | 121 | 2.3e-07 |

Description gp:[GI:g296670] [LN:HSPRB4S] [AC:X07882:S53102] [PN:Po protein] [OR:Homo sapiens] [SR:human] [DB:genpept-pri1] [DE:Human PRB4 gene for proline-rich protein Po, allele S.] [SP:P10163] [LE:629:1622:2213] [RE:692:1657:2793] [DI:directJoin]

| ORF_Name | NT ID | AA ID | NT LN | AA LN | Score | P-value |
|---|---|---|---|---|---|---|
| 11807062_c2_1745 | 2743 | 9914 | 1134 | 377 | 134 | 3.1e-08 |

Description sp:[LN:FM1A_SERMA] [AC:P22595] [GN:FIMA] [OR:Serratia marcescens] [DE:TYPE-1 FIMBRIAL PROTEIN SUBUNIT PRECURSOR] [SP:P22595] [DB:swissprot] >sp:[LN:YQSE1] [AC:S12398:S14465] [PN:type 1 fimbrial protein precursor] [GN:fimA] [CL:type 1 fimbrial protein] [OR:Serratia marcescens] [DB:pir1] >gp:[GI:g47282] [LN:SNFIMA] [AC:X55025] [PN:type 1 fimbrial subunit] [GN:fimA] [OR:Serratia marcescens] [DB:genpept-bct1] [DE:S. marcescens fimA gene.] [SP:P22595] [LE:396] [RE:938] [DI:direct]

| ORF Name | NT ID | AA ID | NT LN | AA LN | Score | P-value |
|---|---|---|---|---|---|---|
| 11891655_f3_855 | 2744 | 9915 | 348 | 115 | 225 | 1.2e-18 |

Description sp:[LN:A69785] [AC:A69785] [PN:cellobiose phosphotransferase system enzym homolog ydhM] [GN:ydhM] [CL:phosphotransferase system enzyme II cellobiose-specific factor IIB] [OR:Bacillus subtilis] [DB:pir2] >gp:[GI:e1182560:g2632894] [LN:BSUB0004] [AC:Z99107:AL009126] [GN:ydhM] [FN:unknown] [OR:Bacillus subtilis] [DB:genpept-bct1] [DE:Bacillus subtilis complete genome (section 4 of 21): from 600701 to813890.] [NT:similar to cellobiose phosphotransferase system] [LE:25638] [RE:25949] [DI:direct] >gp:[GI:d1020484:g1945097] [LN:D88802] [AC:D88802] [GN:ydhM] [OR:Bacillus subtilis] [SR:Bacillus subtilis (sub_species:Marburg, strain:168, isolate:JH642] [DB:genpept-bct1] [DE:Bacillus subtilis DNA for phoB-rrnE-groESL region, complete cds.] [NT:B. subtilis, cellobiose phosphotransferase system,] [LE:12640] [RE:12951] [DI:direct]

| ORF Name | NT ID | AA ID | NT LN | AA LN | Score | P-value |
|---|---|---|---|---|---|---|
| 11891882_c1_1436 | 2745 | 9916 | 366 | 121 | 576 | 7.6e-56 |

Description sp:[LN:JQ1544] [AC:JQ1544] [PN:hypothetical protein] [CL:Salmonella typhimurium conserved hypothetical protein] [OR:Salmonella typhimurium] [DB:pir2] >gp:[GI:g150423] [LN:NT1NMRKAN] [AC:L05392] [PN:26.5 kDa protein] [FN:transposition of IS176] [OR:Plasmid NTP16] [SR:Plasmid NTP16 DNA] [DB:genpept-bct1] [DE:Plasmid NTP16 complete nucleotide sequence.] [NT:putative] [LE:5559] [RE:6263] [DI:complement]

| ORF Name | NT ID | AA ID | NT LN | AA LN | Score | P-value |
|---|---|---|---|---|---|---|
| 11980467_c2_1541 | 2746 | 9917 | 486 | 161 | 129 | 1.3e-08 |

Description sp:[LN:IE18_PRVKA] [AC:P33479] [GN:IE] [OR:Pseudorabies virus] [SR:,strain Kaplan:PRV] [DE:IMMEDIATE-EARLY PROTEIN IE180] [SP:P33479] [DB:swissprot] >sp:[LN:A45344] [AC:A45344] [PN:immediate-early protein] [CL:herpesvirus immediate-early protein IE175] [OR:suid herpesvirus 1] [DB:pir1] >gp:[GI:g334071] [LN:SH1PROIE] [AC:M34651:X12904] [PN:immediate-early protein] [OR:Pseudorabies virus] [SR:Pseudorabies virus (individual_isolate Kaplan) DNA] [DB:genpept-vrl] [DE:Pseudorabies virus with upstream and downsteam sequences.] [NT:IE protein] [LE:5515] [RE:9855] [DI:direct]

| ORF Name | NT ID | AA ID | NT/LN | AA/LN | Score | P-value |
|---|---|---|---|---|---|---|
| 12195415_f2_396 | 2747 | 9918 | 297 | 98 | 115 | 1.2e-05 |

Description sp:[LN:B70694] [AC:B70694] [PN:probable infB] [GN:infB] [CL:translation elongation factor Tu homology] [OR:Mycobacterium tuberculosis] [DB:pir2] >gp:[GI:e276776:g1648881] [LN:MTCY16B7] [AC:Z81331:AL123456] [PN:infB] [GN:infB] [OR:Mycobacterium tuberculosis] [DB:genpept-bct1] [DE:Mycobacterium tuberculosis H37Rv complete genome; segment 123/162.] [NT:Rv2839c, (MTCY16B7.03), len: 900. Probable infB,] [LE:40248] [RE:42950] [DI:complement]

| ORF Name | NT ID | AA ID | NT/LN | AA/LN | Score | P-value |
|---|---|---|---|---|---|---|
| 12244567_f1_1 | 2748 | 9919 | 441 | 146 | 632 | 8.9e-62 |

Description gp:[GI:g1196674] [LN:NT1TNIS] [AC:M20306] [PN:unknown protein] [OR:Plasmid NTP16] [SR:Plasmid NTP16 (tissue library: AB1157) DNA] [DB:genpept-bct1] [DE:Plasmid NTP16 DNA with inserted transposon Tn4352, flanked bydirect repeats of insertion element IS176, and encodesaminoglycoside 3'-phosphotransferase, complete cds.] [NT:ORF1; putative] [LE:256] [RE:852] [DI:direct]

| ORF Name | NT ID | AA ID | NT/LN | AA/LN | Score | P-value |
|---|---|---|---|---|---|---|
| 12345125_c1_1280 | 2749 | 9920 | 399 | 132 | 116 | 2.0e-06 |

Description gp:[GI:g1118122] [LN:CELF46C8] [AC:U41624] [GN:F46C8.2] [OR:Caenorhabditis elegans] [SR:Caenorhabditis elegans strain=Bristol N2] [DB:genpept-inv1] [DE:Caenorhabditis elegans cosmid F46C8.] [NT:Similar to cuticle collagen.] [LE:37556:37689:37900:38044] [RE:37617:37857:37975:38233] [DI:directJoin]

| ORF Name | NT ID | AA ID | NT/LN | AA/LN | Score | P-value |
|---|---|---|---|---|---|---|
| 12350807_f1_149 | 2750 | 9921 | 1212 | 403 | 1071 | 2.7e-108 |

Description gp:[GI:g5231097] [LN:AF128999] [AC:AF128999] [PN:SitD] [GN:sitD] [OR:Salmonella typhimurium] [DB:genpept-bct2] [DE:Salmonella typhimurium SitA (sitA), SitB (sitB), SitC (sitC), andSitD (sitD) genes, complete cds.] [LE:2893] [RE:3741] [DI:direct]

| ORF Name | NT ID | AA ID | NT/LN | AA/LN | Score | P-value |
|---|---|---|---|---|---|---|
| 12364506_f1_162 | 2751 | 9922 | 270 | 89 | 121 | 5.4e-07 |

Description gp:[GI:g1589837] [LN:MIU68729] [AC:U68729] [PN:cuticle preprocollagen] [GN:col-2] [OR:Meloidogyne incognita] [SR:southern root-knot nematode] [DB:genpept-inv2] [DE:Meloidogyne incognita cuticle preprocollagen (col-2) mRNA, completecds.] [LE:16] [RE:942] [DI:direct]

| ORF_Name | NT_ID | AA_ID | NT/LN | AA/LN | Score | P-value |
|---|---|---|---|---|---|---|
| 12369443_f1_263 | 2752 | 9923 | 633 | 210 | 154 | 2.0e-09 |

Description sp:[LN:CGHU1V] [AC:S18802:S16024:A61142:S11303:S03978:S43642:S58665] [PN:collagen alpha 1(V) chain precursor:procollagen alpha 1(V) chain] [GN:COL5A1] [CL:collagen alpha 1(V) chain:fibrillar collagen carboxyl-terminal homology] [OR:Homo sapiens] [SR:, man] [DB:pir1] [MP:9q34.2-9q34.3] >gp:[GI:g189520] [LN:HUMPA1V] [AC:M76729] [PN:pro-alpha-1 type V collagen] [GN:COL5A1] [OR:Homo sapiens] [SR:Homo sapiens cDNA to mRNA] [DB:genpept-pri2] [DE:Human pro-alpha-1 (V) collagen mRNA, complete cds.] [LE:230] [RE:5746] [DI:direct]

| ORF_Name | NT_ID | AA_ID | NT/LN | AA/LN | Score | P-value |
|---|---|---|---|---|---|---|
| 12379767_c1_1278 | 2753 | 9924 | 1128 | 375 | 207 | 1.2e-13 |

Description sp:[LN:S18733] [AC:S18733] [PN:glutenin high molecular weight chain 1By9 precursor] [CL:glutenin] [OR:Triticum aestivum] [SR:, common wheat] [DB:pir2] >gp:[GI:g22090] [LN:X61026] [AC:X61026] [PN:HMW glutenin subunit 1By9] [GN:Glu-1By9] [OR:Triticum aestivum] [DB:genpept-pln1] [DE:Wheat Glu-1By9 gene for HMW glutenin subunit 1By9.] [LE:751] [RE:2868] [DI:direct]

| ORF_Name | NT_ID | AA_ID | NT/LN | AA/LN | Score | P-value |
|---|---|---|---|---|---|---|
| 12382711_c1_1341 | 2754 | 9925 | 630 | 209 | 865 | 1.8e-86 |

Description sp:[LN:HYDN_ECOLI] [AC:P30132] [GN:HYDN] [OR:Escherichia coli] [DE:ELECTRON TRANSPORT PROTEIN HYDN] [SP:P30132] [DB:swissprot] >sp:[LN:E65051] [AC:E65051] [PN:4Fe-4S iron-sulfur protein] [GN:hydN] [CL:nrfC protein:ferredoxin 2[4Fe-4S] homology] [OR:Escherichia coli] [DB:pir2] >gp:[GI:d1003824:g216575] [LN:ECOHYDA] [AC:D14422] [PN:4Fe-4S iron-sulfer protein, putative] [GN:hydN] [FN:electron transport from formate to hydrogen,] [OR:Escherichia coli] [SR:Escherichia coli (strain:K-12) cell_line:KLF43/KL259 DNA] [DB:genpept-bct1] [DE:E.coli hydA gene for HYDA and hydN gene for 4Fe-4S iron-sulferprotein, complete cds.] [NT:This CDS is located between ascG and hydA on genome] [LE:310] [RE:837] [DI:direct] >gp:[GI:g882606] [LN:ECU29579] [AC:U29579] [PN:4Fe-4S iron-sulfur protein] [GN:hydN] [FN:electron transport from formate to hydrogen] [OR:Escherichia coli] [DB:genpept-bct1] [DE:Escherichia coli K-12 genome; approximately 61 to 62 minutes.] [NT:CG Site No. 33521] [LE:9882] [RE:10409] [DI:complement] >gp:[GI:g1789067] [LN:AE000355] [AC:AE000355:U00096] [PN:involved in electron transport from formate to] [GN:hydN] [FN:enzyme; Energy metabolism, carbon: Anaerobic] [OR:Escherichia coli] [DB:genpept-bct2] [DE:Escherichia coli K-12 MG1655 section 245 of 400 of the completegenome.] [NT:f175; 100 pct identical to HYDN_ECOLI SW: P30132] [LE:5188] [RE:5715] [DI:complement]

| ORF Name | NT ID | AA ID | $\frac{NT}{LN}$ | $\frac{AA}{LN}$ | Score | P-value |
|---|---|---|---|---|---|---|
| 12555308_c2_1548 | 2755 | 9926 | 1152 | 383 | 531 | 4.5e-51 |

Description sp:[LN:ABC_ECOLI] [AC:P30750:P77517] [GN:ABC] [OR:Escherichia coli]
[DE:ATP-BINDING PROTEIN ABC] [SP:P30750:P77517] [DB:swissprot] >sp:[LN:G64744]
[AC:G64744:I41113] [PN:probable ABC-type transport protein abc] [GN:abc]
[CL:unassigned ATP-binding cassette proteins:ATP-binding cassette homology]
[OR:Escherichia coli] [DB:pir2] >gp:[GI:g1552775] [LN:ECU70214] [AC:U70214]
[PN:ATP-binding protein] [GN:abc] [OR:Escherichia coli] [DB:genpept-bct1]
[DE:Escherichia coli chromosome minutes 4-6.] [LE:52689] [RE:53720]
[DI:complement] >gp:[GI:g1786398] [LN:AE000129] [AC:AE000129:U00096]
[PN:ATP-binding component of a transporter] [GN:abc] [FN:transport; Not
classified] [OR:Escherichia coli] [DB:genpept-bct2] [DE:Escherichia coli K-12
MG1655 section 19 of 400 of the completegenome.] [NT:f343; 98 pct identical to
fragment (231) [LE:1590] [RE:2621] [DI:complement]

| ORF Name | NT ID | AA ID | $\frac{NT}{LN}$ | $\frac{AA}{LN}$ | Score | P-value |
|---|---|---|---|---|---|---|
| 12579165_f1_326 | 2756 | 9927 | 480 | 159 | 570 | 3.3e-55 |

Description gp:[GI:g5069464] [LN:AF026270] [AC:AF026270:L31414] [PN:PduV] [GN:pduV]
[OR:Salmonella enterica serovar Typhimurium] [DB:genpept-bct2] [DE:Salmonella
enterica serovar Typhimurium PocR (pocR) gene, partialcds; PduF (pudF) gene,
complete cds and pdu operon, completesequence.] [NT:related to EutP.] [LE:16604]
[RE:17056] [DI:direct]

| ORF Name | NT ID | AA ID | $\frac{NT}{LN}$ | $\frac{AA}{LN}$ | Score | P-value |
|---|---|---|---|---|---|---|
| 12600686_f2_485 | 2757 | 9928 | 246 | 81 | 110 | 3.6e-06 |

Description sp:[LN:S29309] [AC:S29309] [PN:hypothetical protein 4 (phaC2 3' region)]
[OR:Pseudomonas aeruginosa] [DB:pir2]

| ORF Name | NT ID | AA ID | NT LN | AA LN | Score | P-value |
|---|---|---|---|---|---|---|
| 12613452_f2_404 | 2758 | 9929 | 300 | 99 | 326 | 2.4e-29 |

Description sp:[LN:D65046] [AC:D65046] [PN:hypothetical protein b2667] [CL:arsenical resistance operon repressor] [OR:Escherichia coli] [DB:pir2] >gp:[GI:d1017262:g1800053] [LN:D90890] [AC:D90890:AB001340] [PN:TRANSCRIPTIONAL ACTIVATOR HLYU.] [GN:HLYU] [OR:Escherichia coli] [SR:Escherichia coli (strain:K12) DNA, clone_lib:Kohara lambda minise] [DB:genpept-bct1] [DE:E.coli genomic DNA, Kohara clone #443(59.8-60.2 min.).] [NT:similar to [SwissProt Accession Number P52695]] [LE:17380] [RE:17679] [DI:direct] >gp:[GI:d1017266:g1800057] [LN:D90891] [AC:D90891:AB001340] [PN:TRANSCRIPTIONAL ACTIVATOR HLYU.] [GN:HLYU] [OR:Escherichia coli] [SR:Escherichia coli (strain:K12) DNA, clone_lib:Kohara lambda minise] [DB:genpept-bct1] [DE:E.coli genomic DNA, Kohara clone #445(60.2-60.6 min.).] [NT:similar to [SwissProt Accession Number P52695]] [LE:681] [RE:980] [DI:direct] >gp:[GI:g1789021] [LN:AE000351] [AC:AE000351:U00096] [PN:orf, hypothetical protein] [GN:b2667] [FN:orf; Unknown] [OR:Escherichia coli] [DB:genpept-bct2] [DE:Escherichia coli K-12 MG1655 section 241 of 400 of the completegenome.] [NT:o99; This 99 aa ORF is 45 pct identical (1 gap)] [LE:8934] [RE:9233] [DI:direct]

| ORF Name | NT ID | AA ID | NT LN | AA LN | Score | P-value |
|---|---|---|---|---|---|---|
| 12698567_c2_1559 | 2759 | 9930 | 558 | 185 | 645 | 3.7e-63 |

Description sp:[LN:SYDP_ECOLI] [AC:P43526] [GN:SYD:YDR] [OR:Escherichia coli] [DE:SYD PROTEIN] [SP:P43526] [DB:swissprot] >sp:[LN:A55944] [AC:A55944:E65061] [PN:syd protein] [GN:syd] [CL:Escherichia coli syd protein] [OR:Escherichia coli] [DB:pir2] >gp:[GI:d1008106:g780114] [LN:ECOSYDP] [AC:D38520] [PN:Syd protein] [GN:syd] [FN:Interacts with SecY protein in vivo] [OR:Escherichia coli] [SR:Escherichia coli (strain:K-12) DNA] [DB:genpept-bct1] [DE:Escherichia coli syd gene for Syd protein, complete cds.] [NT:Identified as a multicopy suppressor of a dominant] [LE:554] [RE:1099] [DI:direct] >gp:[GI:g882688] [LN:ECU29581] [AC:U29581] [OR:Escherichia coli] [DB:genpept-bct1] [DE:Escherichia coli K-12 genome; approximately 63 to 64 minutes.] [NT:GTG start] [LE:6290] [RE:6835] [DI:complement] >gp:[GI:g1789157] [LN:AE000363] [AC:AE000363:U00096] [PN:interacts with secY] [GN:syd] [FN:orf; Unknown function] [OR:Escherichia coli] [DB:genpept-bct2] [DE:Escherichia coli K-12 MG1655 section 253 of 400 of the completegenome.] [NT:f181; 100 pct identical to SYDP_ECOLI SW:] [LE:2448] [RE:2993] [DI:complement]

| ORF_Name | NT_ID | AA_ID | NT/LN | AA/LN | Score | P-value |
|---|---|---|---|---|---|---|
| 1275316_c3_2040 | 2760 | 9931 | 519 | 172 | 848 | 1.1e-84 |

Description sp:[LN:H65048] [AC:H65048] [PN:hypothetical protein in emrB 3' region] [GN:ygaG]
[CL:conserved hypothetical protein HI0491] [OR:Escherichia coli] [DB:pir2]
>gp:[GI:d1017281:g1800072] [LN:D90891] [AC:D90891:AB001340] [GN:ygaG]
[OR:Escherichia coli] [SR:Escherichia coli (strain:K12) DNA, clone_lib:Kohara
lambda minise] [DB:genpept-bct1] [DE:E.coli genomic DNA, Kohara clone
445(60.2-60.6 min.).] [NT:similar to [SwissProt Accession Number P45578]]
[LE:17691] [RE:18206] [DI:complement] >gp:[GI:d1017286:g1800078] [LN:D90892]
[AC:D90892:AB001340] [GN:ygaG] [OR:Escherichia coli] [SR:Escherichia coli
(strain:K12) DNA, clone_lib:Kohara lambda minise] [DB:genpept-bct1] [DE:E.coli
genomic DNA, Kohara clone #446(60.5-60.9 min.).] [NT:similar to [SwissProt
Accession Number P45578]] [LE:3125] [RE:3640] [DI:complement] >gp:[GI:g1789043]
[LN:AE000353] [AC:AE000353:U00096] [PN:orf, hypothetical protein] [GN:ygaG]
[FN:orf; Unknown] [OR:Escherichia coli] [DB:genpept-bct2] [DE:Escherichia coli
K-12 MG1655 section 243 of 400 of the completegenome.] [NT:f171; 100 pct
identical to 119 aa] [LE:4693] [RE:5208] [DI:complement]

| ORF_Name | NT_ID | AA_ID | NT/LN | AA/LN | Score | P-value |
|---|---|---|---|---|---|---|
| 12925956_c3_1886 | 2761 | 9932 | 1560 | 519 | 671 | 6.5e-66 |

Description sp:[LN:SOXA_RHOSO] [AC:P54995] [GN:SOXA:DSZA] [OR:Rhodococcus sp] [SR:,strain
IGTS8] [DE:DIBENZOTHIOPHENE DESULFURIZATION ENZYME A] [SP:P54995] [DB:swissprot]
>gp:[GI:g567869] [LN:RERDSZA] [AC:L37363] [GN:dszA] [OR:Rhodococcus sp.]
[SR:Rhodococcus sp. (strain IGTS8) DNA] [DB:genpept-bct1] [DE:Rhodococcus sp.
dibenzothiophene desulfurization (dszABC) genes,complete cds.] [LE:790] [RE:2151]
[DI:direct] >gp:[GI:g595291] [LN:RSU08850] [AC:U08850] [PN:dibenzothiophene
desulfurization enzyme] [GN:soxA] [FN:metabolizes DBT 5,5-dioxide to]
[OR:Rhodococcus sp.] [SR:Rhodococcus sp] [DB:genpept-bct1] [DE:Rhodococcus sp.
IGTS8 sox dibenzothiophene desulfurization operon(soxA, soxB, and soxC) genes,
complete cds, and IS1166 transposasegenes, complete cds.] [NT:The entire operon
removes organically bound sulfur] [LE:1545] [RE:2906] [DI:direct]

| ORF Name | NT ID | AA ID | NT/LN | AA/LN | Score | P-value |
|---|---|---|---|---|---|---|
| 12932050_f3_811 | 2762 | 9933 | 1047 | 348 | 1313 | 6.1e-134 |

Description sp:[LN:GUTQ_ECOLI] [AC:P17115:Q46874] [GN:GUTQ:SRLQ] [OR:Escherichia coli]
[DE:GUTQ PROTEIN] [SP:P17115:Q46874] [DB:swissprot] >sp:[LN:H65050]
[AC:H65050:A48429:S10373] [PN:probable ATP-binding protein gutQ] [GN:gutQ]
[CL:probable ATP-binding protein gutQ:CBS homology] [OR:Escherichia coli]
[DB:pir1] [MP:58 min] >gp:[GI:g882600] [LN:ECU29579] [AC:U29579] [GN:gutQ]
[OR:Escherichia coli] [DB:genpept-bct1] [DE:Escherichia coli K-12 genome;
approximately 61 to 62 minutes.] [NT:alternate gene name srlQ] [LE:2155]
[RE:3081] [DI:direct] >gp:[GI:g1789060] [LN:AE000354] [AC:AE000354:U00096]
[PN:orf, hypothetical protein] [GN:gutQ] [FN:orf; Unknown] [OR:Escherichia coli]
[DB:genpept-bct2] [DE:Escherichia coli K-12 MG1655 section 244 of 400 of the
completegenome.] [NT:o308; 100 pct identical to GB: ECU29579_4] [LE:7808]
[RE:8734] [DI:direct]

| ORF Name | NT ID | AA ID | NT/LN | AA/LN | Score | P-value |
|---|---|---|---|---|---|---|
| 12989132_c1_1329 | 2763 | 9934 | 798 | 265 | 1254 | 1.1e-127 |

Description sp:[LN:HYCG_ECOLI] [AC:P16433:Q46881] [GN:HYCG:HEVG] [OR:Escherichia coli]
[DE:COMPONENT G)] [SP:P16433:Q46881] [DB:swissprot] >sp:[LN:S08625]
[AC:S08625:C65052] [PN:hydrogenase, 3 chain 7:formate hydrogenlyase chain
7:hydrogenase-3 protein G] [GN:hycG] [CL:psbG protein] [OR:Escherichia coli]
[EC:1.18.99.1] [DB:pir2] [MP:58-59 min] >gp:[GI:g882612] [LN:ECU29579]
[AC:U29579] [PN:formate hydrogenlyase subunit 7] [GN:hycG] [OR:Escherichia coli]
[DB:genpept-bct1] [DE:Escherichia coli K-12 genome; approximately 61 to 62
minutes.] [NT:CG Site No. 33151; alternate gene name hevG] [LE:15747] [RE:16514]
[DI:complement] >gp:[GI:g1789074] [LN:AE000356] [AC:AE000356:U00096]
[PN:hydrogenase activity] [GN:hycG] [FN:phenotype; Energy metabolism, carbon:]
[OR:Escherichia coli] [DB:genpept-bct2] [DE:Escherichia coli K-12 MG1655 section
246 of 400 of the completegenome.] [NT:f255; 99 pct identical to HYCG_ECOLI SW:
P16433; CG] [LE:980] [RE:1747] [DI:complement]

| ORF Name | NT ID | AA ID | NT/LN | AA/LN | Score | P-value |
|---|---|---|---|---|---|---|
| 12991331_f2_525 | 2764 | 9935 | 513 | 170 | 155 | 2.8e-10 |

Description gp:[GI:g2078483] [LN:BSU43200] [AC:U43200] [PN:antifreeze glycopeptide AFGP
polyprotein] [OR:Boreogadus saida] [DB:genpept-vrt] [DE:Boreogadus saida
antifreeze glycopeptide AFGP polyprotein precursorgene, complete cds.]
[NT:cleavage of polyprotein at conserved spacers R or] [LE:209:281] [RE:211:1801]
[DI:directJoin]

| ORF Name | NT ID | AA ID | NT/LN | AA/LN | Score | P-value |
|---|---|---|---|---|---|---|
| 13067956_c3_1849 | 2765 | 9936 | 1083 | 360 | 1513 | 3.9e-155 |

Description sp:[LN:COBT_SALTY] [AC:Q05603] [GN:COBT] [OR:Salmonella typhimurium]
[EC:2.4.2.21] [DE:(EC 2.4.2.21) (NN:DBI PRT)
(N1-ALPHA-PHOSPHORIBOSYLTRANSFERASE)] [SP:Q05603] [DB:swissprot]

| ORF Name | NT ID | AA ID | NT/LN | AA/LN | Score | P-value |
|---|---|---|---|---|---|---|
| 13133333_f3_860 | 2766 | 9937 | 1434 | 477 | 308 | 3.4e-27 |

Description sp:[LN:GALR_ECOLI] [AC:P03024] [GN:GALR] [OR:Escherichia coli] [DE:GALACTOSE
OPERON REPRESSOR] [SP:P03024] [DB:swissprot] >sp:[LN:RPECG]
[AC:A93910:A92900:F65066:A03559] [PN:gal operon repressor] [GN:galR] [CL:lac
repressor] [OR:Escherichia coli] [DB:pir1] [MP:62 min] >gp:[GI:g41534]
[LN:ECGALR] [AC:V00280] [OR:Escherichia coli] [DB:genpept-bct1] [DE:E. coli gene
galR coding for galactose repressor.] [NT:repressor] [SP:P03024] [LE:81]
[RE:1112] [DI:direct] >gp:[GI:g146068] [LN:ECOGALLYS] [AC:J01614] [PN:operon
repressor] [GN:galR] [OR:Escherichia coli] [SR:Escherichia coli [1]: K-12
bmh71-18[lac-pro]-del/f' pro-laci-q-zm1] [DB:genpept-bct1] [DE:E.coli galR, lysA,
and lysR genes coding for galETK operonrepressor protein (gal repressor),
diaminopimelate decarboxylaseand LysA activatory protein.] [LE:81] [RE:1112]
[DI:direct] >gp:[GI:g882730] [LN:ECU29581] [AC:U29581] [PN:repressor of
galETK operon] [OR:Escherichia coli] [DB:genpept-bct1] [DE:Escherichia coli K-12
genome; approximately 63 to 64 minutes.] [NT:CG Site No. 721; alternate gene name
Rgal] [LE:58154] [RE:59185] [DI:direct] >gp:[GI:g1789202] [LN:AE000367]
[AC:AE000367:U00096] [PN:repressor of galETK operon] [GN:galR] [FN:regulator;
Degradation of small molecules:] [OR:Escherichia coli] [DB:genpept-bct2]
[DE:Escherichia coli K-12 MG1655 section 257 of 400 of the completegenome.]
[NT:o343; 100 pct identical to GALR_ECOLI SW: P03024;] [LE:7310] [RE:8341]
[DI:direct]

| ORF Name | NT ID | AA ID | NT/LN | AA/LN | Score | P-value |
|---|---|---|---|---|---|---|
| 13151427_f3_954 | 2767 | 9938 | 1518 | 505 | 2185 | 2.4e-226 |

Description sp:[LN:SDHM_ECOLI] [AC:P30744:Q59377] [GN:SDAB] [OR:Escherichia coli]
[EC:4.2.1.13] [DE:(L-SD2)] [SP:P30744:Q59377] [DB:swissprot] >sp:[LN:A65062]
[AC:A65062:S30351] [PN:L-serine dehydratase, 2:L-serine deaminase 2] [GN:sdaB]
[CL:microbial L-serine dehydratase] [OR:Escherichia coli] [EC:4.2.1.13] [DB:pir2]
>gp:[GI:g882692] [LN:ECU29581] [AC:U29581] [PN:L-serine dehydratase 2 (L-serine
deaminase 2)] [GN:sdaB] [OR:Escherichia coli] [DB:genpept-bct1] [EC:4.2.1.13]
[DE:Escherichia coli K-12 genome; approximately 63 to 64 minutes.] [NT:CG Site
no. 33324; ORF_o455] [LE:11131] [RE:12498] [DI:direct] >gp:[GI:g1789161]
[LN:AE000363] [AC:AE000363:U00096] [PN:L-serine dehydratase (deaminase), L-SD2]
[GN:sdaB] [FN:enzyme; Degradation of small molecules: Amino] [OR:Escherichia
coli] [DB:genpept-bct2] [EC:4.2.1.13] [DE:Escherichia coli K-12 MG1655 section
253 of 400 of the completegenome.] [NT:o455; 97 pct identical to SDHM_ECOLI SW:
P30744; CG] [LE:7289] [RE:8656] [DI:direct]

| ORF Name | NT ID | AA ID | NT/LN | AA/LN | Score | P-value |
|---|---|---|---|---|---|---|
| 13175333_f2_574 | 2768 | 9939 | 462 | 153 | 122 | 9.8e-08 |

Description sp:[LN:H72476] [AC:H72476] [PN:hypothetical protein APE2457] [GN:APE2457]
[OR:Aeropyrum pernix] [DB:pir2] >gp:[GI:d1045258:g5106161] [LN:AP000064]
[AC:AP000064] [PN:133aa long hypothetical protein] [GN:APE2457] [OR:Aeropyrum
pernix] [SR:Aeropyrum pernix (strain:K1) DNA] [DB:genpept-bct1] [DE:Aeropyrum
pernix genomic DNA, section 7/7.] [LE:137708] [RE:138109] [DI:complement]

| ORF Name | NT ID | AA ID | NT/LN | AA/LN | Score | P-value |
|---|---|---|---|---|---|---|
| 1382811_c2_1553 | 2769 | 9940 | 1485 | 494 | 129 | 4.3e-05 |

Description gp:[GI:g1067167] [LN:PFHRPII2B] [AC:X69924] [PN:HRPII] [GN:HRPII] [OR:Plasmodium
falciparum] [SR:malaria parasite P. falciparum] [DB:genpept-inv1]
[DE:P.falciparum (S14) HRPII gene, exon 2.] [LE:<7] [RE:1299] [DI:direct]

| ORF Name | NT ID | AA ID | NT/LN | AA/LN | Score | P-value |
|---|---|---|---|---|---|---|
| 13915877_f2_489 | 2770 | 9941 | 876 | 291 | 1361 | 5.0e-139 |

Description gp:[GI:g41776] [LN:ECHYP] [AC:X54543] [PN:hydrogenase isoenzyme hypB] [GN:hypB]
[OR:Escherichia coli] [DB:genpept-bct1] [DE:E. coli hyp operon encoding
hydrogenase isoenzymes.] [SP:P24190] [LE:456] [RE:1328] [DI:direct]

| ORF Name | NT ID | AA ID | NT/LN | AA/LN | Score | P-value |
|---|---|---|---|---|---|---|
| 13949025_c3_1907 | 2771 | 9942 | 1368 | 455 | 2233 | 2.0e-231 |

Description sp:[LN:GUDT_ECOLI] [AC:Q46916] [GN:YGCZ] [OR:Escherichia coli] [DE:PROBABLE
GLUCARATE TRANSPORTER] [SP:Q46916] [DB:swissprot] >sp:[LN:A65061] [AC:A65061]
[PN:hypothetical protein b2789] [CL:hexuronate transporter] [OR:Escherichia coli]
[DB:pir2] >gp:[GI:g882684] [LN:ECU29581] [AC:U29581] [OR:Escherichia coli]
[DB:genpept-bct1] [DE:Escherichia coli K-12 genome; approximately 63 to 64
minutes.] [NT:ORF_f450] [LE:2303] [RE:3655] [DI:complement] >gp:[GI:g1789152]
[LN:AE000362] [AC:AE000362:U00096] [PN:putative transport protein] [GN:b2789]
[FN:putative transport; Not classified] [OR:Escherichia coli] [DB:genpept-bct2]
[DE:Escherichia coli K-12 MG1655 section 252 of 400 of the completegenome.]
[NT:f450; This 450 aa ORF is 65 pct identical (2 gaps)] [LE:10998] [RE:12350]
[DI:complement]

| ORF Name | NT ID | AA ID | NT/LN | AA/LN | Score | P-value |
|---|---|---|---|---|---|---|
| 14095063_f3_869 | 2772 | 9943 | 954 | 317 | 394 | 1.5e-36 |

Description sp:[LN:A65011] [AC:A65011] [PN:hypothetical protein b2372] [OR:Escherichia coli] [DB:pir2] >gp:[GI:g1788715] [LN:AE000325] [AC:AE000325:U00096] [PN:putative receptor protein] [GN:b2372] [FN:putative factor; Not classified] [OR:Escherichia coli] [DB:genpept-bct2] [DE:Escherichia coli K-12 MG1655 section 215 of 400 of the completegenome.] [NT:f314; This 314 aa ORF is 26 pct identical (11 gaps)] [LE:8688] [RE:9632] [DI:complement]

| ORF Name | NT ID | AA ID | NT/LN | AA/LN | Score | P-value |
|---|---|---|---|---|---|---|
| 14269702_c3_1796 | 2773 | 9944 | 3537 | 1178 | 4547 | 0.0 |

Description sp:[LN:EX5B_ECOLI] [AC:P08394] [GN:RECB:RORA] [OR:Escherichia coli] [EC:3.1.11.5] [DE:BETA CHAIN)] [SP:P08394] [DB:swissprot] >sp:[LN:NCECX5] [AC:A25532:E65064] [PN:exodeoxyribonuclease V, 135K chain:exonuclease 135K polypeptide:recBC DNase 135K polypeptide] [GN:recB] [CL:exodeoxyribonuclease V 135K chain] [OR:Escherichia coli] [EC:3.1.11.5] [DB:pir1] [MP:61 min] >gp:[GI:g42682] [LN:ECRECB] [AC:X04581] [OR:Escherichia coli] [DB:genpept-bct1] [DE:E.coli recB gene for exonuclease V.] [NT:exonuclease V (AA 1-1180)] [SP:P08394] [LE:327] [RE:3869] [DI:direct] >gp:[GI:g882712] [LN:ECU29581] [AC:U29581] [PN:exonuclease V subunit] [GN:recB] [FN:recombination and DNA repair] [OR:Escherichia coli] [DB:genpept-bct1] [EC:3.1.11.5] [DE:Escherichia coli K-12 genome; approximately 63 to 64 minutes.] [NT:CG Site No. 311; alternate name rorA] [LE:34016] [RE:37558] [DI:complement] >gp:[GI:g1789183] [LN:AE000365] [AC:AE000365:U00096] [PN:DNA helicase, ATP-dependent dsDNA/ssDNA] [GN:recB] [FN:enzyme; Degradation of DNA] [OR:Escherichia coli] [DB:genpept-bct2] [EC:3.1.11.5] [DE:Escherichia coli K-12 MG1655 section 255 of 400 of the completegenome.] [NT:f1180; 100 pct identical to EX5B_ECOLI SW:] [LE:6530] [RE:10072] [DI:complement] >gp:[GI:g5923820] [LN:AF179304] [AC:AF179304] [PN:RecB2109] [GN:recB] [FN:functions in homologous recombination and] [OR:Escherichia coli] [DB:genpept-bct2] [DE:Escherichia coli RecB2109 (recB) gene, recB-2109 allele, completecds.] [NT:mutant subunit of RecBCD enzyme] [LE:1] [RE:3543] [DI:direct]

| ORF Name | NT ID | AA ID | NT/LN | AA/LN | Score | P-value |
|---|---|---|---|---|---|---|
| 14344187_f2_460 | 2774 | 9945 | 1518 | 505 | 2356 | 1.8e-244 |

Description sp:[LN:B65051] [AC:B65051] [PN:hypothetical protein b2710] [CL:Escherichia coli hypothetical protein b2710:rubredoxin homology] [OR:Escherichia coli] [DB:pir1] >gp:[GI:g882603] [LN:ECU29579] [AC:U29579] [OR:Escherichia coli] [DB:genpept-bct1] [DE:Escherichia coli K-12 genome; approximately 61 to 62 minutes.] [NT:ORF_o479] [LE:4780] [RE:6219] [DI:direct] >gp:[GI:g1789064] [LN:AE000355] [AC:AE000355:U00096] [PN:putative flavodoxin] [GN:b2710] [FN:putative enzyme; Not classified] [OR:Escherichia coli] [DB:genpept-bct2] [DE:Escherichia coli K-12 MG1655 section 245 of 400 of the completegenome.] [NT:o479; This 479 aa ORF is 34 pct identical (6 gaps)] [LE:86] [RE:1525] [DI:direct]

| ORF Name | NT ID | AA ID | $\frac{NT}{LN}$ | $\frac{AA}{LN}$ | Score | P-value |
|---|---|---|---|---|---|---|
| 1440751_c1_1236 | 2775 | 9946 | 1653 | 550 | 2688 | 1.2e-279 |

Description sp:[LN:SYECTP] [AC:H65059:A25608] [PN:CTP synthase,:CTP-synthetase:UTP--ammonia ligase] [GN:pyrG] [CL:CTP synthase] [OR:Escherichia coli] [EC:6.3.4.2] [DB:pir1] [MP:60 min] >gp:[GI:g1789142] [LN:AE000361] [AC:AE000361:U00096] [PN:CTP synthetase] [GN:pyrG] [FN:enzyme; Central intermediary metabolism:] [OR:Escherichia coli] [DB:genpept-bct2] [EC:6.3.4.2] [DE:Escherichia coli K-12 MG1655 section 251 of 400 of the completegenome.] [NT:f545; 99 pct identical to PYRG_ECOLI SW: P08398; CG] [LE:8606] [RE:10243] [DI:complement] >gp:[GI:g882674] [LN:ECU29580] [AC:U29580] [PN:CTP synthetase] [GN:pyrG] [OR:Escherichia coli] [DB:genpept-bct2] [EC:6.3.4.2] [DE:Escherichia coli K-12 genome; approximately 62 minute region.] [NT:CG Site No. 325] [LE:5894] [RE:7531] [DI:complement]

| ORF Name | NT ID | AA ID | $\frac{NT}{LN}$ | $\frac{AA}{LN}$ | Score | P-value |
|---|---|---|---|---|---|---|
| 1445916_f3_1030 | 2776 | 9947 | 231 | 76 | 188 | 1.0e-14 |

Description gp:[GI:g5069454] [LN:AF026270] [AC:AF026270:L31414] [PN:PduK] [GN:pduK] [OR:Salmonella enterica serovar Typhimurium] [DB:genpept-bct2] [DE:Salmonella enterica serovar Typhimurium PocR (pocR) gene, partialcds; PduF (pudF) gene, complete cds and pdu operon, completesequence.] [NT:related to the major shell proteins of] [LE:8921] [RE:9403] [DI:direct]

| ORF Name | NT ID | AA ID | $\frac{NT}{LN}$ | $\frac{AA}{LN}$ | Score | P-value |
|---|---|---|---|---|---|---|
| 14461590_c3_2095 | 2777 | 9948 | 285 | 94 | | |

Description

NO-HIT

| ORF Name | NT ID | AA ID | NT LN | AA LN | Score | P-value |
|---|---|---|---|---|---|---|
| 14492783_c2_1528 | 2778 | 9949 | 930 | 309 | 1505 | 2.7e-154 |

Description sp:[LN:GCVA_ECOLI] [AC:P32064] [GN:GCVA] [OR:Escherichia coli] [DE:ACTIVATOR)]
[SP:P32064] [DB:swissprot] >sp:[LN:I41065] [AC:I41065:I41229:D65063:S34371]
[PN:glycine cleavage system transcription activator] [GN:gcvA] [CL:regulatory
protein ampR] [OR:Escherichia coli] [DB:pir2] >gp:[GI:g312766] [LN:ECGCVA]
[AC:X73413] [PN:glycine cleavage activator protein] [GN:gcvA] [OR:Escherichia
coli] [DB:genpept-bct1] [DE:E.coli gene for glycine cleavage activator protein
and orf 2 and 3.] [SP:P32064] [LE:43] [RE:960] [DI:direct] >gp:[GI:g882703]
[LN:ECU29581] [AC:U29581] [GN:gcvA] [FN:regulatory protein for glycine cleavage]
[OR:Escherichia coli] [DB:genpept-bct1] [DE:Escherichia coli K-12 genome;
approximately 63 to 64 minutes.] [NT:CG Site No. 28676] [LE:23205] [RE:24122]
[DI:complement] >gp:[GI:g1789173] [LN:AE000364] [AC:AE000364:U00096] [PN:positive
regulator of gcv operon] [GN:gcvA] [FN:regulator; Central intermediary
metabolism;] [OR:Escherichia coli] [DB:genpept-bct2] [DE:Escherichia coli K-12
MG1655 section 254 of 400 of the completegenome.] [NT:f305; 100 pct identical to
GCVA_ECOLI SW: P32064;] [LE:7719] [RE:8636] [DI:complement] >gp:[GI:g523331]
[LN:ECOGCVA] [AC:U01030] [PN:GcvA] [FN:regulatory protein for glycine cleavage
enzyme] [OR:Escherichia coli] [DB:genpept-bct2] [DE:Escherichia coli K12 glycine
cleavage activator protein (gcvA)gene, complete cds.] [LE:304] [RE:1221]
[DI:direct]

| ORF Name | NT ID | AA ID | NT LN | AA LN | Score | P-value |
|---|---|---|---|---|---|---|
| 14508550_c1_1360 | 2779 | 9950 | 1071 | 356 | 1654 | 4.5e-170 |

Description sp:[LN:RQECA] [AC:G65049:A93847:A93846:S11931:S63525:S69129:S63979;]
[PN:recombination protein recA:recombinase A] [GN:recA] [CL:recombination protein
recA] [OR:Escherichia coli] [DB:pir1] [MP:58 min] >gp:[GI:g42673] [LN:ECRECA]
[AC:V00328:J01672] [PN:recA gene product] [GN:recA] [OR:Escherichia coli]
[DB:genpept-bct1] [DE:E. coli recA gene.] [SP:P03017] [LE:239] [RE:1300]
[DI:direct] >gp:[GI:g6006602] [LN:SFRECAGEN] [AC:X55553] [GN:recA] [OR:Shigella
flexneri] [DB:genpept-bct1] [DE:Shigella flexneri recA gene for RecA protein.]
[LE:1] [RE:1062] [DI:direct] >gp:[GI:g1789051] [LN:AE000354] [AC:AE000354:U00096]
[PN:DNA strand exchange and renaturation,] [GN:recA] [FN:enzyme; DNA -
replication, repair,] [OR:Escherichia coli] [DB:genpept-bct2] [DE:Escherichia
coli K-12 MG1655 section 244 of 400 of the completegenome.] [NT:f353; 100 pct
identical to RECA_ECOLI SW: P03017;] [LE:664] [RE:1725] [DI:complement]

| ORF Name | NT ID | AA ID | NT LN | AA LN | Score | P-value |
|---|---|---|---|---|---|---|
| 14573568_c3_1991 | 2780 | 9951 | 2205 | 734 | 166 | 1.5e-08 |

Description gp:[GI:g3834388] [LN:AF038547] [AC:AF038547] [PN:beta-1,4-mannanase] [GN:manF]
[OR:Bacillus stearothermophilus] [DB:genpept-bct2] [DE:Bacillus
stearothermophilus beta-1,4-mannanase (manF) gene,complete cds.] [NT:glycosyl
hydrolase family 5] [LE:351] [RE:2435] [DI:direct]

| ORF_Name | NT_ID | AA_ID | NT/LN | AA/LN | Score | P-value |
|---|---|---|---|---|---|---|
| 1460952_c3_1906 | 2781 | 9952 | 516 | 171 | 609 | 2.4e-59 |

Description sp:[LN:B65061] [AC:B65061] [PN:hypothetical protein b2790] [CL:mioC protein:flavodoxin homology] [OR:Escherichia coli] [DB:pir1] >gp:[GI:g882685] [LN:ECU29581] [AC:U29581] [OR:Escherichia coli] [DB:genpept-bct1] [DE:Escherichia coli K-12 genome; approximately 63 to 64 minutes.] [NT:corresponds to hypothetical protein from E.] [LE:4090] [RE:4539] [DI:complement] >gp:[GI:g1789154] [LN:AE000363] [AC:AE000363:U00096] [PN:orf, hypothetical protein] [GN:b2790] [FN:orf; Unknown] [OR:Escherichia coli] [DB:genpept-bct2] [DE:Escherichia coli K-12 MG1655 section 253 of 400 of the completegenome.] [NT:f149; similar to GenBank Accession] [LE:248] [RE:697] [DI:complement]

| ORF_Name | NT_ID | AA_ID | NT/LN | AA/LN | Score | P-value |
|---|---|---|---|---|---|---|
| 14650263_f2_387 | 2782 | 9953 | 672 | 223 | 325 | 3.0e-29 |

Description sp:[LN:ECPD_ECOLI] [AC:P33128] [GN:ECPD] [OR:Escherichia coli] [DE:CHAPERONE PROTEIN ECPD PRECURSOR] [SP:P33128] [DB:swissprot] >sp:[LN:S45209] [AC:S45209:D64737:A53303] [PN:pili assembly chaperone ecpD precursor, periplasmic:fimbriae biogenesis protein homolog] [GN:ecpD] [CL:chaperone protein papD] [OR:Escherichia coli] [DB:pir1] >gp:[GI:d1006132:g473799] [LN:ECO82K] [AC:D26562] [PN:'ORF'] [OR:Escherichia coli] [SR:Escherichia coli (sub_strain W3110, strain K-12) (library: Kohara'] [DB:genpept-bct1] [DE:Escherichia coli genome, 2.4-4.1 min region (110,917-193,643 bpfrom 0 min).] [NT:'fimbriae biogenesis protein mrkB homology'] [LE:44059] [RE:44799] [DI:complement] >gp:[GI:g1786333] [LN:AE000123] [AC:AE000123:U00096] [PN:probable pilin chaperone similar to PapD] [GN:ecpD] [FN:putative factor; Surface structures] [OR:Escherichia coli] [DB:genpept-bct2] [DE:Escherichia coli K-12 MG1655 section 13 of 400 of the completegenome.] [NT:f246; 98 pct identical to ECPD_ECOLI SW: P33128] [LE:5833] [RE:6573] [DI:complement]

| ORF_Name | NT_ID | AA_ID | NT/LN | AA/LN | Score | P-value |
|---|---|---|---|---|---|---|
| 14665942_f3_1050 | 2783 | 9954 | 324 | 107 | | |

Description

NO-HIT

| ORF_Name | NT_ID | AA_ID | NT LN | AA LN | Score | P-value |
|---|---|---|---|---|---|---|
| 14711658_cl_1247 | 2784 | 9955 | 783 | 260 | 1232 | 2.3e-125 |

Description sp:[LN:RDECPA] [AC:S14221:S07486:D34354:F65057:A34134] [PN:3'-phosphoadenosine 5'-phosphosulfate reductase,:3'-phosphoadenylylsulfate reductase, thioredoxin dependent:PAPS reductase:PAPS sulfotransferase] [GN:cysH] [CL:3'-phosphoadenosine 5'-phosphosulfate reductase] [OR:Escherichia coli] [EC:1.8.99.4] [DB:pir1] [MP:59 min] >gp:[GI:g41198] [LN:ECCYSH] [AC:Y07525] [PN:PAPS-reductase] [OR:Escherichia coli] [DB:genpept-bct1] [DE:Escherichia coli cysH and cysI (partial) genes for PAPS-reductaseand sulfite reductase.] [SP:P17854] [LE:769] [RE:1503] [DI:direct] >gp:[GI:g882655] [LN:ECU29579] [AC:U29579] [PN:3'-phosphoadenosine 5'-phosphosulfate] [GN:cysH] [OR:Escherichia coli] [DB:genpept-bct1] [EC:2.8.2.-] [DE:Escherichia coli K-12 genome; approximately 61 to 62 minutes.] [NT:CG Site No. 892] [LE:59880] [RE:60614] [DI:complement] >gp:[GI:g1789121] [LN:AE000360] [AC:AE000360:U00096] [PN:3'-phosphoadenosine 5'-phosphosulfate reductase] [GN:cysH] [FN:enzyme; Central intermediary metabolism: Sulfur] [OR:Escherichia coli] [DB:genpept-bct2] [EC:2.8.2.-] [DE:Escherichia coli K-12 MG1655 section 250 of 400 of the completegenome.] [NT:f244; 100 pct identical to CYSH_ECOLI SW: P17854;] [LE:210] [RE:944] [DI:complement]

| ORF_Name | NT_ID | AA_ID | NT LN | AA LN | Score | P-value |
|---|---|---|---|---|---|---|
| 14722212_cl_1371 | 2785 | 9956 | 993 | 330 | 316 | 2.7e-28 |

Description sp:[LN:YEAM_ECOLI] [AC:P76241] [GN:YEAM] [OR:Escherichia coli] [DE:HYPOTHETICAL TRANSCRIPTIONAL REGULATOR IN GAPA-RND INTERGENIC REGION] [SP:P76241] [DB:swissprot] >sp:[LN:F64939] [AC:F64939] [PN:hypothetical protein b1790] [OR:Escherichia coli] [DB:pir2] >gp:[GI:g1788091] [LN:AE000274] [AC:AE000274:U00096] [PN:putative ARAC-type regulatory protein] [GN:yeaM] [FN:putative regulator; Not classified] [OR:Escherichia coli] [DB:genpept-bct2] [DE:Escherichia coli K-12 MG1655 section 164 of 400 of the completegenome.] [NT:f273; This 273 aa ORF is 21 pct identical (7 gaps)] [LE:494] [RE:1315] [DI:complement]

| ORF_Name | NT_ID | AA_ID | NT LN | AA LN | Score | P-value |
|---|---|---|---|---|---|---|
| 14843802_cl_1270 | 2786 | 9957 | 915 | 304 | 527 | 1.2e-50 |

Description sp:[LN:S77670] [AC:S77670:S77669] [PN:probable transcription activator ptxR] [GN:ptxR] [CL:conserved hypothetical protein HI1364] [OR:Pseudomonas aeruginosa] [DB:pir2] >gp:[GI:g1493807] [LN:PAU35068] [AC:U35068] [PN:PtxR] [GN:ptxR] [FN:transcriptional activator of the LysR family;] [OR:Pseudomonas aeruginosa] [DB:genpept-bct2] [DE:Pseudomonas aeruginosa transcription activator (ptxR) gene,complete cds.] [LE:557] [RE:1495] [DI:direct]

| ORF_Name | NT_ID | AA_ID | NT LN | AA LN | Score | P-value |
|---|---|---|---|---|---|---|
| 14844406_f2_635 | 2787 | 9958 | 1314 | 437 | 1720 | 4.5e-177 |

Description sp:[LN:F65063] [AC:F65063] [PN:hypothetical protein b2810] [CL:nifS protein]
[OR:Escherichia coli] [DB:pir2] >gp:[GI:g882705] [LN:ECU29581] [AC:U29581]
[OR:Escherichia coli] [DB:genpept-bct1] [DE:Escherichia coli K-12 genome;
approximately 63 to 64 minutes.] [NT:ORF_o401] [LE:24892] [RE:26097] [DI:direct]
>gp:[GI:g1789175] [LN:AE000364] [AC:AE000364:U00096] [PN:orf, hypothetical
protein] [GN:b2810] [FN:orf; Unknown] [OR:Escherichia coli] [DB:genpept-bct2]
[DE:Escherichia coli K-12 MG1655 section 254 of 400 of the completegenome.]
[NT:o401; This 401 aa ORF is 29 pct identical (36 gaps)] [LE:9406] [RE:10611]
[DI:direct]

| ORF_Name | NT_ID | AA_ID | NT LN | AA LN | Score | P-value |
|---|---|---|---|---|---|---|
| 14885165_f1_2 | 2788 | 9959 | 297 | 98 | 504 | 3.3e-48 |

Description sp:[LN:IEECE9] [AC:D93826:D93117:S40544:A04462] [PN:hypothetical protein, 11K]
[CL:Escherichia coli insertion sequence IS1 hypothetical 11K protein]
[OR:Escherichia coli] [DB:pir1]

| ORF_Name | NT_ID | AA_ID | NT LN | AA LN | Score | P-value |
|---|---|---|---|---|---|---|
| 14927030_f2_415 | 2789 | 9960 | 882 | 293 | 1369 | 7.1e-140 |

Description sp:[LN:PROW_ECOLI] [AC:P14176] [GN:PROW] [OR:Escherichia coli] [DE:GLYCINE
BETAINE/L-PROLINE TRANSPORT SYSTEM PERMEASE PROTEIN PROW] [SP:P14176]
[DB:swissprot] >sp:[LN:MMECPW] [AC:JS0129:G65047] [PN:glycine betaine/L-proline
transport system permease protein P] [GN:proW] [CL:glycine
betaine/carnitine/choline ABC transporter] [OR:Escherichia coli] [DB:pir1]
>gp:[GI:d1017275:g1800066] [LN:D90891] [AC:D90891:AB001340] [PN:glycine
betaine/proline transport system protein] [GN:proW] [OR:Escherichia coli]
[SR:Escherichia coli (strain:K12) DNA, clone_lib:Kohara lambda minise]
[DB:genpept-bct1] [DE:E.coli genomic DNA, Kohara clone #445(60.2-60.6 min.).]
[NT:similar to [PIR Accession Number JS0129]] [LE:9482] [RE:10546] [DI:direct]
>gp:[GI:g147374] [LN:ECOPROU] [AC:M24856] [OR:Escherichia coli] [SR:E.coli (K12)
DNA] [DB:genpept-bct1] [DE:E.coli proV, proW and proX genes (proU operon),
complete cds.] [NT:proW peptide] [LE:1883] [RE:2947] [DI:direct]
>gp:[GI:g1789033] [LN:AE000352] [AC:AE000352:U00096] [PN:high-affinity transport
system for glycine] [GN:proW] [FN:transport; Transport of small molecules: Amino]
[OR:Escherichia coli] [DB:genpept-bct2] [DE:Escherichia coli K-12 MG1655 section
242 of 400 of the completegenome.] [NT:o354; CG Site No. 18019; 100 pct
identical] [LE:7211] [RE:8275] [DI:direct]

| ORF Name | NT ID | AA ID | NT LN | AA LN | Score | P-value |
|---|---|---|---|---|---|---|
| 14941302_c1_1281 | 2790 | 9961 | 1845 | 614 | 108 | 0.0076 |

Description gp:[GI:g212742] [LN:CHKTELAS] [AC:M21880] [OR:Gallus gallus] [SR:Chicken (10-day old) embryo, cDNA to mRNA, clones CEL[1,2B]] [DB:genpept-vrt] [DE:Chicken tropoelastin mRNA, 3' end.] [NT:tropoelastin] [LE:<1] [RE:2103] [DI:direct]

| ORF Name | NT ID | AA ID | NT LN | AA LN | Score | P-value |
|---|---|---|---|---|---|---|
| 14946918_c2_1577 | 2791 | 9962 | 2229 | 742 | 3577 | 0.0 |

Description sp:[LN:RELA_ECOLI] [AC:P11585] [GN:RELA] [OR:Escherichia coli] [EC:2.7.6.5] [DE:(PPGPP SYNTHETASE I)] [SP:P11585] [DB:swissprot] >sp:[LN:KIECG] [AC:D65060:A31996] [PN:GTP pyrophosphokinase,:guanosine 3',5'-polyphosphate synthase:stringent factor] [GN:relA] [CL:guanosine 3',5'-bis(diphosphate) 3'-pyrophosphatase] [OR:Escherichia coli] [EC:2.7.6.5] [DB:pir1] [MP:60 min] >gp:[GI:g1789147] [LN:AE000362] [AC:AE000362:U00096] [PN:(p)ppGpp synthetase I (GTP pyrophosphokinase);] [GN:relA] [FN:enzyme; Global regulatory functions] [OR:Escherichia coli] [DB:genpept-bct2] [DE:Escherichia coli K-12 MG1655 section 252 of 400 of the completegenome.] [NT:f744; 99 pct identical to RELA_ECOLI SW: P11585; CG] [LE:1667] [RE:3901] [DI:complement] >gp:[GI:g882678] [LN:ECU29580] [AC:U29580] [PN:GTP pyrophosphokinase] [GN:relA] [OR:Escherichia coli] [DB:genpept-bct2] [EC:2.7.6.5] [DE:Escherichia coli K-12 genome; approximately 62 minute region.] [NT:CG Site No. 306] [LE:9282] [RE:11516] [DI:complement]

| ORF Name | NT ID | AA ID | NT LN | AA LN | Score | P-value |
|---|---|---|---|---|---|---|
| 15023568_f3_955 | 2792 | 9963 | 954 | 317 | 771 | 1.7e-76 |

Description gp:[GI:g3420605] [LN:AF075709] [AC:AF075709] [PN:putative sulfonate binding protein precursor] [GN:ssuA] [OR:Pseudomonas putida] [DB:genpept-bct2] [DE:Pseudomonas putida LsfA (lsfA), complete cds; and ssu locus,complete sequence.] [NT:SsuA] [LE:1703] [RE:2668] [DI:direct]

| ORF_Name | NT_ID | AA_ID | NT LN | AA LN | Score | P-value |
|---|---|---|---|---|---|---|
| 15026562_c2_1726 | 2793 | 9964 | 1368 | 455 | 620 | 1.7e-60 |

Description sp:[LN:F69778] [AC:F69778] [PN:transcription regulator GntR family homolog ydeL]
[GN:ydeL] [CL:hypothetical protein b1439] [OR:Bacillus subtilis] [DB:pir2]
>gp:[GI:d1020112:g1881332] [LN:AB001488] [AC:AB001488] [GN:ydeL] [OR:Bacillus
subtilis] [SR:Bacillus subtilis (strain:168) DNA] [DB:genpept-bct1] [DE:Bacillus
subtilis genome sequence, 148 kb sequence of the regionbetween 35 and 47 degree.]
[NT:SIMILAR TO THE RHIZOPINE CATABOLISM (MOCR) GENE OF] [LE:104608] [RE:105999]
[DI:direct] >gp:[GI:e1182490:g2632824] [LN:BSUB0003] [AC:Z99106:AL009126]
[GN:ydeL] [FN:unknown] [OR:Bacillus subtilis] [DB:genpept-bct1] [DE:Bacillus
subtilis complete genome (section 3 of 21): from 402751 to611850.] [NT:similar to
transcriptional regulator (GntR family)] [LE:168353] [RE:169744] [DI:direct]

| ORF_Name | NT_ID | AA_ID | NT LN | AA LN | Score | P-value |
|---|---|---|---|---|---|---|
| 15133557_f2_367 | 2794 | 9965 | 204 | 67 | 106 | 4.9e-06 |

Description gp:[GI:g5532459] [LN:AF141323] [AC:AF141323] [PN:ShiE] [GN:shiE] [OR:Shigella
flexneri] [DB:genpept-bct2] [DE:Shigella flexneri SHI-2 pathogenicity island,
complete sequence.] [LE:12113] [RE:12643] [DI:direct]

| ORF_Name | NT_ID | AA_ID | NT LN | AA LN | Score | P-value |
|---|---|---|---|---|---|---|
| 15634627_f2_406 | 2795 | 9966 | 183 | 60 | 48 | 0.035 |

Description gp:[GI:d1016428:g1736541] [LN:D90830] [AC:D90830:AB001340] [PN:Chemotaxis protein
CheA (EC 2.7.3.-).] [GN:cheA] [OR:Escherichia coli] [SR:Escherichia coli
(strain:K12) DNA, clone_lib:Kohara lambda minise] [DB:genpept-bct1] [DE:E.coli
genomic DNA, Kohara clone #338(42.1-42.5 min.).] [NT:ORF_ID:o339#1; similar to
[SwissProt Accession] [LE:17727] [RE:>18071] [DI:complement]

| ORF_Name | NT_ID | AA_ID | NT LN | AA LN | Score | P-value |
|---|---|---|---|---|---|---|
| 15635391_c3_2038 | 2796 | 9967 | 441 | 146 | 669 | 1.1e-65 |

Description sp:[LN:YQAA_ECOLI] [AC:P76631:P77028] [GN:YQAA] [OR:Escherichia coli]
[DE:HYPOTHETICAL 15.6 KD PROTEIN IN GSHA-CSRA INTERGENIC REGION]
[SP:P76631:P77028] [DB:swissprot] >sp:[LN:B65049] [AC:B65049] [PN:hypothetical
protein b2689] [CL:hypothetical protein HI0489] [OR:Escherichia coli] [DB:pir2]
>gp:[GI:g1789045] [LN:AE000353] [AC:AE000353:U00096] [PN:orf, hypothetical
protein] [GN:b2689] [FN:orf; Unknown] [OR:Escherichia coli] [DB:genpept-bct2]
[DE:Escherichia coli K-12 MG1655 section 243 of 400 of the completegenome.]
[NT:f142; This 142 aa ORF is 50 pct identical (8 gaps)] [LE:6988] [RE:7416]
[DI:complement]

| ORF Name | NT ID | AA ID | NT/LN | AA/LN | Score | P-value |
|---|---|---|---|---|---|---|
| 15650928_f2_616 | 2797 | 9968 | 492 | 163 | 144 | 6.5e-09 |

Description sp:[LN:CA11_RAT] [AC:P02454:P02455] [GN:COL1A1] [OR:Rattus norvegicus] [SR:,Rat]
[DE:COLLAGEN ALPHA 1(I) CHAIN (FRAGMENTS)] [SP:P02454:P02455] [DB:swissprot]

| ORF Name | NT ID | AA ID | NT/LN | AA/LN | Score | P-value |
|---|---|---|---|---|---|---|
| 15714818_f3_1036 | 2798 | 9969 | 1368 | 455 | 1488 | 1.7e-152 |

Description gp:[GI:g5069460] [LN:AF026270] [AC:AF026270:L31414] [PN:PduQ] [GN:pduQ]
[OR:Salmonella enterica serovar Typhimurium] [DB:genpept-bct2] [DE:Salmonella
enterica serovar Typhimurium PocR (pocR) gene, partialcds; PduF (pudF) gene,
complete cds and pdu operon, completesequence.] [NT:probable propanol
dehydrogenase; related to EutG] [LE:13228] [RE:14340] [DI:direct]

| ORF Name | NT ID | AA ID | NT/LN | AA/LN | Score | P-value |
|---|---|---|---|---|---|---|
| 15729018_f1_352 | 2799 | 9970 | 372 | 123 | 135 | 1.4e-08 |

Description gp:[GI:g805006] [LN:PPHP1G] [AC:X80272] [GN:pprB] [OR:Pseudomonas putida]
[DB:genpept-bct1] [DE:P.putida pprB gene.] [LE:77] [RE:973] [DI:direct]

| ORF Name | NT ID | AA ID | NT/LN | AA/LN | Score | P-value |
|---|---|---|---|---|---|---|
| 15729512_f1_93 | 2800 | 9971 | 612 | 203 | 953 | 8.6e-96 |

Description gp:[GI:d1019621:g1800088] [LN:D90892] [AC:D90892:AB001340] [PN:PTS SYSTEM,
GLUCITOL/SORBITOL-SPECIFIC IIBC] [GN:gutA] [OR:Escherichia coli] [SR:Escherichia
coli (strain:K12) DNA, clone_lib:Kohara lambda minise] [DB:genpept-bct1]
[DE:E.coli genomic DNA, Kohara clone #446(60.5-60.9 min.).] [NT:similar to
[SwissProt Accession Number P05705]] [LE:14720] [RE:15301] [DI:direct]

| ORF Name | NT ID | AA ID | NT/LN | AA/LN | Score | P-value |
|---|---|---|---|---|---|---|
| 15789555_f2_619 | 2801 | 9972 | 234 | 77 | | |

Description

NO-HIT

| ORF_Name | NT ID | AA ID | NT LN | AA LN | Score | P-value |
|---|---|---|---|---|---|---|
| 15911633_c1_1325 | 2802 | 9973 | 969 | 322 | 1395 | 1.2e-142 |

Description sp:[LN:HYCD_ECOLI] [AC:P16430] [GN:HYCD:HEVD] [OR:Escherichia coli] [DE:COMPONENT D)] [SP:P16430] [DB:swissprot] >sp:[LN:S08622] [AC:S08622:F65052] [PN:hydrogenase, 3 chain 4:formate hydrogenlyase chain 4:hydrogenase-3 protein D] [GN:hycD] [CL:NADH dehydrogenase (ubiquinone) chain 1] [OR:Escherichia coli] [EC:1.18.99.1] [DB:pir2] [MP:58-59 min] >gp:[GI:g41683] [LN:ECHYC] [AC:X17506] [GN:hycD] [OR:Escherichia coli] [DB:genpept-bct1] [DE:E.coli hyc operon hycA,B,C,D,E,F,G,H,I genes.] [SP:P16430] [LE:3235] [RE:4158] [DI:direct] >gp:[GI:g882615] [LN:ECU29579] [AC:U29579] [PN:formate hydrogenlyase subunit 4] [GN:hycD] [OR:Escherichia coli] [DB:genpept-bct1] [DE:Escherichia coli K-12 genome; approximately 61 to 62 minutes.] [NT:CG Site no. 33162; alternate gene name hevD;] [LE:18793] [RE:19716] [DI:complement] >gp:[GI:g1789077] [LN:AE000356] [AC:AE000356:U00096] [PN:membrane-spanning protein of hydrogenase 3 (part] [GN:hycD] [FN:enzyme; Energy metabolism, carbon:] [OR:Escherichia coli] [DB:genpept-bct2] [DE:Escherichia coli K-12 MG1655 section 246 of 400 of the completegenome.] [NT:f307; 100 pct identical to HYCD_ECOLI SW: P16430;] [LE:4026] [RE:4949] [DI:complement]

| ORF_Name | NT ID | AA ID | NT LN | AA LN | Score | P-value |
|---|---|---|---|---|---|---|
| 16109432_c1_1255 | 2803 | 9974 | 651 | 216 | 964 | 5.9e-97 |

Description sp:[LN:B65056] [AC:B65056:JN0328:PS0431:A44200] [PN:adenylylsulfate kinase, precursor] [GN:cysC] [CL:adenylylsulfate kinase:adenylylsulfate kinase homology] [OR:Escherichia coli] [EC:2.7.1.25] [DB:pir1] [MP:59 min] >gp:[GI:g145395] [LN:ECOATP] [AC:M86936] [PN:adenylylsulfate 3'-phosphotransferase] [GN:ATP] [OR:Escherichia coli] [SR:Escherichia coli (strain K-12) DNA] [DB:genpept-bct1] [EC:2.7.1.25] [DE:Esherichia coli adenylylsulfate 3'-phosphotransferase (ATP),complete cds.] [LE:1] [RE:606] [DI:direct] >gp:[GI:g882643] [LN:ECU29579] [AC:U29579] [PN:adenosine 5-phosphosulfate kinase] [GN:cysC] [OR:Escherichia coli] [DB:genpept-bct1] [EC:2.7.1.25] [DE:Escherichia coli K-12 genome; approximately 61 to 62 minutes.] [NT:CG Site No. 896] [LE:45690] [RE:46295] [DI:complement] >gp:[GI:g1789107] [LN:AE000358] [AC:AE000358:U00096] [PN:adenosine 5'-phosphosulfate kinase] [GN:cysC] [FN:enzyme; Central intermediary metabolism: Sulfur] [OR:Escherichia coli] [DB:genpept-bct2] [EC:2.7.1.25] [DE:Escherichia coli K-12 MG1655 section 248 of 400 of the completegenome.] [NT:f201; 99 pct identical to CYSC_ECOLI SW: 23846 but] [LE:8361] [RE:8966] [DI:complement]

| ORF_Name | NT ID | AA ID | NT LN | AA LN | Score | P-value |
|---|---|---|---|---|---|---|
| 16129130_c3_2013 | 2804 | 9975 | 1248 | 415 | 1320 | 1.1e-134 |

Description sp:[LN:ASCG_ECOLI] [AC:P24242:Q46879] [GN:ASCG] [OR:Escherichia coli] [DE:CRYPTIC ASC OPERON REPRESSOR] [SP:P24242:Q46879] [DB:swissprot]

| ORF Name | NT ID | AA ID | NT LN | AA LN | Score | P-value |
|---|---|---|---|---|---|---|
| 16133557_f3_734 | 2805 | 9976 | 1083 | 360 | 310 | 1.2e-27 |

Description sp:[LN:IPNS_NOCLA] [AC:P27744] [GN:PCBC] [OR:Nocardia lactamdurans] [EC:1.-.-.-]
[DE:SYNTHASE)] [SP:P27744] [DB:swissprot] >sp:[LN:S15284] [AC:S15284:A56281]
[PN:isopenicillin N synthase,] [GN:pcbC] [CL:isopenicillin N synthase]
[OR:Streptomyces lactamdurans] [EC:1.-.-.-] [DB:pir2] >gp:[GI:g45007]
[LN:NLPCBABC] [AC:X57310:S67344] [PN:isopenicillin N synthase] [GN:pcbC]
[OR:Streptomyces lactamdurans] [DB:genpept-bct1] [DE:Nocardia lactamdurans pcbAB
and pcbC genes foralpha-aminoadipyl-L-cysteinyl-D-valine synthetase and
isopenicillinN synthase.] [SP:P27744] [LE:11018] [RE:12004] [DI:direct]

| ORF Name | NT ID | AA ID | NT LN | AA LN | Score | P-value |
|---|---|---|---|---|---|---|
| 16208290_c2_1540 | 2806 | 9977 | 1176 | 391 | 1686 | 1.8e-173 |

Description sp:[LN:FUCO_ECOLI] [AC:P11549] [GN:FUCO] [OR:Escherichia coli] [EC:1.1.1.77]
[DE:LACTALDEHYDE REDUCTASE, (PROPANEDIOL OXIDOREDUCTASE)] [SP:P11549]
[DB:swissprot] >sp:[LN:RDECLA] [AC:A32883:A33495:S30352:C65062:JV0034:S04702]
[PN:lactaldehyde reductase,] [GN:fucO] [CL:lactaldehyde reductase:lactaldehyde
reductase homology] [OR:Escherichia coli] [EC:1.1.1.77] [DB:pir1] [MP:60 min]
>gp:[GI:g146043] [LN:ECOFUCAO] [AC:M31059] [OR:Escherichia coli] [SR:E.coli K12
DNA] [DB:genpept-bct1] [DE:E.coli NAD+-linked oxireductase (fucO) and
fuculose-1-phosphatealdolase (fucA) genes, complete cds, and L-fucose
utilizationprotein (fucP) gene, 5' end.] [NT:oxireductase (fucO)] [LE:1312]
[RE:2463] [DI:direct] >gp:[GI:g146045] [LN:ECOFUCO] [AC:M27177]
[PN:1,2-propanediol oxidoreductase] [GN:fucO] [OR:Escherichia coli]
[SR:Escherichia coli DNA] [DB:genpept-bct1] [DE:Escherichia coli (DH5-alpha
strain) fucO gene, complete cds.] [LE:354] [RE:1505] [DI:direct] >gp:[GI:g882694]
[LN:ECU29581] [AC:U29581] [PN:1,2-propanediol oxidoreductase (lactaldehyde]
[GN:fucO] [OR:Escherichia coli] [DB:genpept-bct1] [DE:Escherichia
coli K-12 genome; approximately 63 to 64 minutes.] [NT:CG Site no. 17698;
ORF_f383] [LE:13420] [RE:14571] [DI:complement] >gp:[GI:g1789163] [LN:AE000363]
[AC:AE000363:U00096] [PN:L-1,2-propanediol oxidoreductase] [GN:fucO] [FN:enzyme;
Degradation of small molecules: Carbon] [OR:Escherichia coli] [DB:genpept-bct2]
[EC:1.1.1.77] [DE:Escherichia coli K-12 MG1655 section 253 of 400 of the
completegenome.] [NT:f383; 100 pct identical to FUCO_ECOLI SW: P11549;] [LE:9578]
[RE:10729] [DI:complement]

| ORF Name | NT ID | AA ID | NT/LN | AA/LN | Score | P-value |
|---|---|---|---|---|---|---|
| 16255381_c3_1860 | 2807 | 9978 | 339 | 112 | 424 | 9.8e-40 |

Description sp:[LN:YGDE_ECOLI] [AC:P32066] [GN:YGDE] [OR:Escherichia coli] [DE:HYPOTHETICAL
41.9 KD PROTEIN IN FUCR-GCVA INTERGENIC REGION (ORF3)] [SP:P32066] [DB:swissprot]
>sp:[LN:I41067] [AC:I41067:B65063:S34373] [PN:hypothetical 41.9K protein
(fucR-gcvA intergenic region)] [GN:ygdE] [OR:Escherichia coli] [DB:pir2]
>gp:[GI:g312768] [LN:ECGCVA] [AC:X73413] [OR:Escherichia coli] [DB:genpept-bct1]
[DE:E.coli gene for glycine cleavage activator protein and orf 2 and 3.]
[NT:ORF3] [SP:P32066] [LE:1367] [RE:2467] [DI:direct] >gp:[GI:g882701]
[LN:ECU29581] [AC:U29581] [OR:Escherichia coli] [DB:genpept-bct1] [DE:Escherichia
coli K-12 genome; approximately 63 to 64 minutes.] [NT:alternate name Orf2 of
X73413 and U01030; ORF_f366] [LE:21698] [RE:22798] [DI:complement]
>gp:[GI:g1789171] [LN:AE000364] [AC:AE000364:U00096] [PN:orf, hypothetical
protein] [GN:ygdE] [FN:orf; Unknown] [OR:Escherichia coli] [DB:genpept-bct2]
[DE:Escherichia coli K-12 MG1655 section 254 of 400 of the completegenome.]
[NT:f366; 100 pct identical to YGDE_ECOLI SW: P32066;] [LE:6212] [RE:7312]
[DI:complement]

| ORF Name | NT ID | AA ID | NT/LN | AA/LN | Score | P-value |
|---|---|---|---|---|---|---|
| 16256458_f2_681 | 2808 | 9979 | 1620 | 539 | 1888 | 7.1e-195 |

Description gp:[GI:g5069461] [LN:AF026270] [AC:AF026270:L31414] [PN:PduS] [GN:pduS]
[OR:Salmonella enterica serovar Typhimurium] [DB:genpept-bct2] [DE:Salmonella
enterica serovar Typhimurium PocR (pocR) gene, partialcds; PduF (pudF) gene,
complete cds and pdu operon, completesequence.] [NT:related to
membrane-associated oxidoreductase] [LE:14337] [RE:15692] [DI:direct]

| ORF Name | NT ID | AA ID | NT/LN | AA/LN | Score | P-value |
|---|---|---|---|---|---|---|
| 16302061_f2_509 | 2809 | 9980 | 360 | 119 | 310 | 1.2e-27 |

Description gp:[GI:g145484] [LN:ECOCELCA] [AC:M93570] [PN:PTS enzyme III cel] [GN:celC]
[OR:Escherichia coli] [SR:Escherichia coli (individual_isolate RM74A/human/Iowa,
strain ECO] [DB:genpept-bct1] [DE:Escherichia coli (strain ECOR 1, isolate
RM74A/human/Iowa) PTSenzyme III cel (celC) gene, complete cds.] [NT:putative]
[LE:1] [RE:351] [DI:direct]

| ORF Name | NT ID | AA ID | NT LN | AA LN | Score | P-value |
|---|---|---|---|---|---|---|
| 16501038_c3_1837 | 2810 | 9981 | 1083 | 360 | 1392 | 2.6e-142 |

Description sp:[LN:CBIB_SALTY] [AC:Q05600] [GN:CBIB] [OR:Salmonella typhimurium] [DE:CBIB PROTEIN] [SP:Q05600] [DB:swissprot] >gp:[GI:g154421] [LN:STYVB12AA] [AC:L12006] [GN:cbiB] [FN:involved in aminopropanol addition to cobyric] [OR:Salmonella typhimurium] [SR:Salmonella typhimurium (strain LT2) DNA] [DB:genpept-bct1] [DE:Salmonella typhimurium vitamin B12/cobalamin biosynthetic (cob)operon 5' end including: (cbiA, cbiB, cbiC, cbiD, cbiE, cbiT, cbiF,cbiG, cbiH, cbiJ, cbiK, cbiL, cbiM, cbiN, cbiQ, cbiO, cbiP, cobU,cobS, cobT) genes and regulatory protein (PocR).] [NT:putative] [LE:2664] [RE:3623] [DI:direct]

| ORF Name | NT ID | AA ID | NT LN | AA LN | Score | P-value |
|---|---|---|---|---|---|---|
| 16532292_c1_1132 | 2811 | 9982 | 1308 | 435 | 84 | 0.0051 |

Description sp:[LN:B40505] [AC:B40505] [PN:hypothetical protein] [OR:suid herpesvirus 1] [DB:pir2] >gp:[GI:g334068] [LN:SH1LLT] [AC:M57505] [OR:Pseudorabies virus] [SR:Pseudorabies virus (strain Indiana-Funkhauser) cDNA to mRNA] [DB:genpept-vrl] [DE:Pseudorabies virus ORF1, ORF2, and ORF3 mRNA, complete cds.] [NT:ORF2] [LE:622] [RE:6498] [DI:direct]

| ORF Name | NT ID | AA ID | NT LN | AA LN | Score | P-value |
|---|---|---|---|---|---|---|
| 16538506_c3_1793 | 2812 | 9983 | 633 | 210 | 291 | 1.2e-25 |

Description sp:[LN:PPDC_ECOLI] [AC:P08372] [GN:PPDC] [OR:Escherichia coli] [DE:PREPILIN PEPTIDASE DEPENDENT PROTEIN C PRECURSOR] [SP:P08372] [DB:swissprot] >sp:[LN:QQEC12] [AC:E24137:H65064] [PN:prepilin peptidase dependent protein C precursor] [GN:ppdC] [CL:prepilin peptidase dependent protein C precursor] [OR:Escherichia coli] [DB:pir1] [MP:61 min] >gp:[GI:g42688] [LN:ECRECC] [AC:X03966] [OR:Escherichia coli] [DB:genpept-bct1] [DE:E. coli recC gene and thyA-recC intergenic region including URF1-3.] [NT:URF3 (aa 1-107)] [SP:P08372] [LE:2206] [RE:2529] [DI:direct] >gp:[GI:g882715] [LN:ECU29581] [AC:U29581] [PN:prepilin peptidase dependent protein C] [GN:ppdC] [OR:Escherichia coli] [DB:genpept-bct1] [DE:Escherichia coli K-12 genome; approximately 63 to 64 minutes.] [NT:alternate name URF3; orf of X03966] [LE:43996] [RE:44319] [DI:complement] >gp:[GI:g1789187] [LN:AE000366] [AC:AE000366:U00096] [PN:prepilin peptidase dependent protein C] [GN:ppdC] [FN:putative enzyme; Not classified] [OR:Escherichia coli] [DB:genpept-bct2] [DE:Escherichia coli K-12 MG1655 section 256 of 400 of the completegenome.] [NT:f107; 100 pct identical to PPDC_ECOLI SW: P08372;] [LE:3499] [RE:3822] [DI:complement]

| ORF Name | NT ID | AA ID | NT LN | AA LN | Score | P-value |
|---|---|---|---|---|---|---|
| 16539077_f2_632 | 2813 | 9984 | 711 | 236 | 1026 | 1.6e-103 |

Description sp:[LN:FUCR_ECOLI] [AC:P11554] [GN:FUCR] [OR:Escherichia coli] [DE:L-FUCOSE OPERON ACTIVATOR] [SP:P11554] [DB:swissprot] >sp:[LN:RGECFO] [AC:JS0188:A65063] [PN:fuc operon regulatory protein] [GN:fucR] [CL:fuc operon regulatory protein] [OR:Escherichia coli] [DB:pir1] [MP:60 min] >gp:[GI:g41508] [LN:ECFUCOSE] [AC:X15025] [OR:Escherichia coli] [DB:genpept-bct1] [DE:Escherichia coli fucose operon.] [NT:fucR ORF (AA 1-243)] [SP:P11554] [LE:7740] [RE:8471] [DI:direct] >gp:[GI:g882700] [LN:ECU29581] [AC:U29581] [GN:fucR] [FN:positive regulatory gene] [OR:Escherichia coli] [DB:genpept-bct1] [DE:Escherichia coli K-12 genome; approximately 63 to 64 minutes.] [NT:CG Site No. 10884] [LE:20923] [RE:21654] [DI:direct] >gp:[GI:g1789170] [LN:AE000364] [AC:AE000364:U00096] [PN:positive regulator of the fuc operon] [GN:fucR] [FN:regulator; Degradation of small molecules:] [OR:Escherichia coli] [DB:genpept-bct2] [DE:Escherichia coli K-12 MG1655 section 254 of 400 of the completegenome.] [NT:o243; 100 pct identical to FUCR_ECOLI SW: P11554;] [LE:5437] [RE:6168] [DI:direct]

| ORF Name | NT ID | AA ID | NT LN | AA LN | Score | P-value |
|---|---|---|---|---|---|---|
| 16620816_f3_956 | 2814 | 9985 | 1344 | 447 | | |

Description

NO-HIT

| ORF Name | NT ID | AA ID | NT LN | AA LN | Score | P-value |
|---|---|---|---|---|---|---|
| 16667662_f2_523 | 2815 | 9986 | 1836 | 611 | 286 | 5.1e-22 |

Description sp:[LN:ILVI_HAEIN] [AC:P45261] [GN:ILVI:HI1585] [OR:Haemophilus influenzae] [EC:4.1.3.18] [DE:(ACETOHYDROXY-ACID SYNTHASE LARGE SUBUNIT) (ALS)] [SP:P45261] [DB:swissprot] >sp:[LN:C64131] [AC:C64131] [PN:acetolactate synthase, III large chain] [CL:acetolactate synthase large chain:thiamine pyrophosphate-binding domain homology] [OR:Haemophilus influenzae] [EC:4.1.3.18] [DB:pir1] >gp:[GI:g1574426] [LN:U32832] [AC:U32832:L42023] [PN:acetolactate synthase III large subunit (ilvI)] [GN:HI1585] [OR:Haemophilus influenzae Rd] [DB:genpept-bct2] [DE:Haemophilus influenzae Rd section 147 of 163 of the completegenome.] [NT:similar to GB:D10483 SP:P00893 GB:X01609 PID:216494] [LE:5753] [RE:7474] [DI:complement]

| ORF Name | NT ID | AA ID | NT LN | AA LN | Score | P-value |
|---|---|---|---|---|---|---|
| 16808252_f2_676 | 2816 | 9987 | 1158 | 385 | 1265 | 7.4e-129 |

Description gp:[GI:g5069458] [LN:AF026270] [AC:AF026270:L31414] [PN:PduO] [GN:pduO] [OR:Salmonella enterica serovar Typhimurium] [DB:genpept-bct2] [DE:Salmonella enterica serovar Typhimurium PocR (pocR) gene, partialcds; PduF (pudF) gene, complete cds and pdu operon, completesequence.] [NT:related to Citrobacter freundii hypothetical genes] [LE:10812] [RE:11825] [DI:direct]

| ORF_Name | NT_ID | AA_ID | NT/LN | AA/LN | Score | P-value |
|---|---|---|---|---|---|---|
| 16817678_f3_745 | 2817 | 9988 | 597 | 198 | 228 | 5.7e-19 |

Description sp:[LN:FM1A_SERMA] [AC:P22595] [GN:FIMA] [OR:Serratia marcescens] [DE:TYPE-1 FIMBRIAL PROTEIN SUBUNIT PRECURSOR] [SP:P22595] [DB:swissprot] >sp:[LN:YQSE1] [AC:S12398:S14465] [PN:type 1 fimbrial protein precursor] [GN:fimA] [CL:type 1 fimbrial protein] [OR:Serratia marcescens] [DB:pir1] >gp:[GI:g47282] [LN:SNFIMA] [AC:X55025] [PN:type 1 fimbrial subunit] [GN:fimA] [OR:Serratia marcescens] [DB:genpept-bct1] [DE:S. marcescens fimA gene.] [SP:P22595] [LE:396] [RE:938] [DI:direct]

| ORF_Name | NT_ID | AA_ID | NT/LN | AA/LN | Score | P-value |
|---|---|---|---|---|---|---|
| 16886280_c2_1509 | 2818 | 9989 | 1122 | 373 | 1450 | 1.8e-148 |

Description sp:[LN:CBIG_SALTY] [AC:Q05631] [GN:CBIG] [OR:Salmonella typhimurium] [DE:CBIG PROTEIN] [SP:Q05631] [DB:swissprot] >gp:[GI:g154427] [LN:STYVB12AA] [AC:L12006] [GN:cbiG] [OR:Salmonella typhimurium] [SR:Salmonella typhimurium (strain LT2) DNA] [DB:genpept-bct1] [DE:Salmonella typhimurium vitamin B12/cobalamin biosynthetic (cob)operon 5' end including: (cbiA, cbiB, cbiC, cbiD, cbiE, cbiT, cbiF,cbiG, cbiH, cbiJ, cbiK, cbiL, cbiM, cbiN, cbiQ, cbiO, cbiP, cobU,cobS, cobT) genes and regulatory protein (PocR).] [NT:putative] [LE:7310] [RE:8365] [DI:direct]

| ORF_Name | NT_ID | AA_ID | NT/LN | AA/LN | Score | P-value |
|---|---|---|---|---|---|---|
| 16897033_f2_671 | 2819 | 9990 | 552 | 183 | 405 | 1.0e-37 |

Description gp:[GI:g5069452] [LN:AF026270] [AC:AF026270:L31414] [PN:PduH] [GN:pduH] [OR:Salmonella enterica serovar Typhimurium] [DB:genpept-bct2] [DE:Salmonella enterica serovar Typhimurium PocR (pocR) gene, partialcds; PduF (pudF) gene, complete cds and pdu operon, completesequence.] [NT:diol dehydratase reactivation; related to diol] [LE:8274] [RE:8645] [DI:direct]

| ORF Name | NT ID | AA ID | NT LN | AA LN | Score | P-value |
|---|---|---|---|---|---|---|
| 16913556_f2_474 | 2820 | 9991 | 516 | 171 | 97 | 5.1e-05 |

Description sp:[LN:YJIW_ECOLI] [AC:P39394] [GN:YJIW] [OR:Escherichia coli] [DE:HYPOTHETICAL 14.6 KD PROTEIN IN MCRB-HSDS INTERGENIC REGION (F132)] [SP:P39394] [DB:swissprot] >sp:[LN:S56573] [AC:S56573:E65249] [PN:hypothetical 14.6K protein (mcrB-hsdS intergenic region):hypothetical protein f132] [GN:yjiW] [CL:Escherichia coli hypothetical 14.6K protein (mcrB-hsdS intergenic region)] [OR:Escherichia coli] [DB:pir2] >gp:[GI:g537189] [LN:ECOUW93] [AC:U14003] [OR:Escherichia coli] [DB:genpept-bct1] [DE:Escherichia coli K-12 chromosomal region from 92.8 to 00.1 minutes.] [NT:ORF_f132] [LE:270332] [RE:270730] [DI:complement] >gp:[GI:g1790806] [LN:AE000505] [AC:AE000505:U00096] [PN:orf, hypothetical protein] [GN:yjiW] [FN:orf; Unknown] [OR:Escherichia coli] [DB:genpept-bct2] [DE:Escherichia coli K-12 MG1655 section 395 of 400 of the completegenome.] [NT:f132; 100 pct identical amino acid sequence and] [LE:5510] [RE:5908] [DI:complement]

| ORF Name | NT ID | AA ID | NT LN | AA LN | Score | P-value |
|---|---|---|---|---|---|---|
| 16931675_f3_941 | 2821 | 9992 | 1218 | 405 | | |

Description

NO-HIT

| ORF Name | NT ID | AA ID | NT LN | AA LN | Score | P-value |
|---|---|---|---|---|---|---|
| 17047041_c3_2067 | 2822 | 9993 | 297 | 98 | 71 | 0.031 |

Description gp:[GI:g4336050] [LN:AF068845] [AC:AF068845] [PN:gp13] [OR:Mycobacteriophage TM4] [DB:genpept-phg] [DE:Mycobacteriophage TM4, complete genome.] [LE:8014] [RE:8433] [DI:direct]

| ORF Name | NT ID | AA ID | NT LN | AA LN | Score | P-value |
|---|---|---|---|---|---|---|
| 17051031_c3_1942 | 2823 | 9994 | 816 | 271 | 1053 | 2.2e-106 |

Description sp:[LN:YGBP_ECOLI] [AC:Q46893] [GN:YGBP] [OR:Escherichia coli] [DE:HYPOTHETICAL 25.7 KD PROTEIN IN SURE-CYSC INTERGENIC REGION] [SP:Q46893] [DB:swissprot] >sp:[LN:G65055] [AC:G65055] [PN:hypothetical protein b2747] [OR:Escherichia coli] [DB:pir2] >gp:[GI:g882640] [LN:ECU29579] [AC:U29579] [OR:Escherichia coli] [DB:genpept-bct1] [DE:Escherichia coli K-12 genome; approximately 61 to 62 minutes.] [NT:ORF_f236] [LE:44085] [RE:44795] [DI:complement] >gp:[GI:g1789104] [LN:AE000358] [AC:AE000358:U00096] [PN:orf, hypothetical protein] [GN:ygbP] [FN:orf; Unknown] [OR:Escherichia coli] [DB:genpept-bct2] [DE:Escherichia coli K-12 MG1655 section 248 of 400 of the completegenome.] [NT:f236; This 236 aa ORF is 36 pct identical (7 gaps)] [LE:6754] [RE:7464] [DI:complement]

| ORF Name | NT ID | AA ID | NT LN | AA LN | Score | P-value |
|---|---|---|---|---|---|---|
| 17069162_cl_1179 | 2824 | 9995 | 441 | 146 | 440 | 2.0e-41 |

Description sp:[LN:YGDE_ECOLI] [AC:P32066] [GN:YGDE] [OR:Escherichia coli] [DE:HYPOTHETICAL 41.9 KD PROTEIN IN FUCR-GCVA INTERGENIC REGION (ORF3)] [SP:P32066] [DB:swissprot] >sp:[LN:I41067] [AC:I41067:B65063:S34373] [PN:hypothetical 41.9K protein (fucR-gcvA intergenic region)] [GN:ygdE] [OR:Escherichia coli] [DB:pir2] >gp:[GI:g312768] [LN:ECGCVA] [AC:X73413] [OR:Escherichia coli] [DB:genpept-bct1] [DE:E.coli gene for glycine cleavage activator protein and orf 2 and 3.] [NT:ORF3] [SP:P32066] [LE:1367] [RE:2467] [DI:direct] >gp:[GI:g882701] [LN:ECU29581] [AC:U29581] [OR:Escherichia coli] [DB:genpept-bct1] [DE:Escherichia coli K-12 genome; approximately 63 to 64 minutes.] [NT:alternate name Orf2 of X73413 and U01030; ORF_f366] [LE:21698] [RE:22798] [DI:complement] >gp:[GI:g1789171] [LN:AE000364] [AC:AE000364:U00096] [PN:orf, hypothetical protein] [GN:ygdE] [FN:orf; Unknown] [OR:Escherichia coli] [DB:genpept-bct2] [DE:Escherichia coli K-12 MG1655 section 254 of 400 of the completegenome.] [NT:f366; 100 pct identical to YGDE_ECOLI SW: P32066;] [LE:6212] [RE:7312] [DI:complement]

| ORF Name | NT ID | AA ID | NT LN | AA LN | Score | P-value |
|---|---|---|---|---|---|---|
| 17070830_f1_138 | 2825 | 9996 | 237 | 78 | 109 | 6.3e-06 |

Description sp:[LN:Y24K_STRGR] [AC:P12752] [OR:Streptomyces griseus] [DE:HYPOTHETICAL 24.7 KD PROTEIN IN PHOTOLYASE 5'REGION] [SP:P12752] [DB:swissprot] >sp:[LN:S05572] [AC:S05572] [PN:hypothetical protein 238] [OR:Streptomyces griseus] [DB:pir2] >gp:[GI:g47082] [LN:SGPHR] [AC:X15060] [OR:Streptomyces griseus] [DB:genpept-bct1] [DE:Streptomyces griseus phr gene for photolyase (EC 4.1.99.3).] [NT:ORF238 (AA 1-238)] [SP:P12752] [LE:338] [RE:1054] [DI:direct]

| ORF Name | NT ID | AA ID | NT LN | AA LN | Score | P-value |
|---|---|---|---|---|---|---|
| 176905_cl_1165 | 2826 | 9997 | 237 | 78 | 121 | 1.3e-07 |

Description sp:[LN:CBIN_SALTY] [AC:Q05595] [GN:CBIN] [OR:Salmonella typhimurium] [DE:COBALT TRANSPORT PROTEIN CBIN] [SP:Q05595] [DB:swissprot] >gp:[GI:g154433] [LN:STYVB12AA] [AC:L12006] [GN:cbiN] [FN:may be involved with cobalt transport with CbiQ] [OR:Salmonella typhimurium] [SR:Salmonella typhimurium (strain LT2) DNA] [DB:genpept-bct1] [DE:Salmonella typhimurium vitamin B12/cobalamin biosynthetic (cob)operon 5' end including: (cbiA, cbiB, cbiC, cbiD, cbiE, cbiT, cbiF,cbiG, cbiH, cbiJ, cbiK, cbiL, cbiM, cbiN, cbiQ, cbiO, cbiP, cobU,cobS, cobT) genes and regulatory protein (PocR).] [NT:putative] [LE:12121] [RE:12402] [DI:direct]

| ORF Name | NT ID | AA ID | NT LN | AA LN | Score | P-value |
|---|---|---|---|---|---|---|
| 19547715_c1_1359 | 2827 | 9998 | 531 | 176 | 732 | 2.2e-72 |

Description sp:[LN:YGAD_ECOLI] [AC:P41053] [GN:YGAD] [OR:Escherichia coli] [DE:HYPOTHETICAL
17.6 KD PROTEIN IN MLTB-RECA INTERGENIC REGION] [SP:P41053] [DB:swissprot]
>sp:[LN:H65049] [AC:H65049:S77643] [PN:ygaD protein] [GN:ygaD] [CL:Aquifex
aeolicus conserved hypothetical protein aq_1996] [OR:Escherichia coli] [DB:pir2]
>gp:[GI:d1017294:g1800086] [LN:D90892] [AC:D90892:AB001340] [GN:ygaD]
[OR:Escherichia coli] [SR:Escherichia coli (strain:K12) DNA, clone_lib:Kohara
lambda minise] [DB:genpept-bct1] [DE:E.coli genomic DNA, Kohara clone
446(60.5-60.9 min.).] [NT:similar to [SwissProt Accession Number P41053]]
[LE:12755] [RE:13252] [DI:complement] >gp:[GI:g1789052] [LN:AE000354]
[AC:AE000354:U00096] [PN:orf, hypothetical protein] [GN:ygaD] [FN:orf; Unknown]
[OR:Escherichia coli] [DB:genpept-bct2] [DE:Escherichia coli K-12 MG1655 section
244 of 400 of the completegenome.] [NT:f165; 100 pct identical to YGAD_ECOLI SW:
P41053] [LE:1805] [RE:2302] [DI:complement] >gp:[GI:g642539] [LN:ECU18785]
[AC:U18785] [PN:YgaD] [GN:ygaD] [OR:Escherichia coli] [DB:genpept-bct2]
[DE:Escherichia coli membrane-bound lytic transglycosylase (mltB) gene,and YgaD
(ygaD) gene, complete cds.] [NT:putative] [LE:1381] [RE:1878] [DI:direct]

| ORF Name | NT ID | AA ID | NT LN | AA LN | Score | P-value |
|---|---|---|---|---|---|---|
| 1969002_c3_1832 | 2828 | 9999 | 960 | 319 | 1175 | 2.6e-119 |

Description sp:[LN:PDUF_SALTY] [AC:P37451] [GN:PDUF] [OR:Salmonella typhimurium]
[DE:PROPANEDIOL DIFFUSION FACILITATOR] [SP:P37451] [DB:swissprot]
>gp:[GI:g2587035] [LN:AF026270] [AC:AF026270:L31414] [PN:PduF] [GN:pduF]
[OR:Salmonella enterica serovar Typhimurium] [DB:genpept-bct2] [DE:Salmonella
enterica serovar Typhimurium PocR (pocR) gene, partialcds; PduF (pudF) gene,
complete cds and pdu operon, completesequence.] [LE:1126] [RE:1920]
[DI:complement]

| ORF Name | NT ID | AA ID | NT LN | AA LN | Score | P-value |
|---|---|---|---|---|---|---|
| 19739830_f3_898 | 2829 | 10000 | 420 | 139 | | |

Description

NO-HIT

| ORF Name | NT ID | AA ID | NT LN | AA LN | Score | P-value |
|---|---|---|---|---|---|---|
| 19741582_f1_161 | 2830 | 10001 | 450 | 149 | 119 | 2.6e-06 |

Description sp:[LN:F70971] [AC:F70971] [PN:hypothetical glycine-rich protein Rv3367]
[GN:Rv3367] [OR:Mycobacterium tuberculosis] [DB:pir2] >gp:[GI:e1202285:g2661646]
[LN:MTV004] [AC:AL009198:AL123456] [PN:PE_PGRS] [GN:PE_PGRS] [OR:Mycobacterium
tuberculosis] [DB:genpept-bct1] [DE:Mycobacterium tuberculosis H37Rv complete
genome; segment 144/162.] [NT:Rv3367, (MTV004.25), member of the M. tuberculosis]
[LE:35514] [RE:37280] [DI:direct]

| ORF Name | NT ID | AA ID | NT LN | AA LN | Score | P-value |
|---|---|---|---|---|---|---|
| 19765711_f2_539 | 2831 | 10002 | 429 | 142 | 516 | 1.7e-49 |

Description gp:[GI:e1455618:g4887558] [LN:ECAJ6210] [AC:AJ006210] [PN:transcriptional regulator protein] [GN:slyA] [OR:Escherichia coli] [DB:genpept-bct1] [DE:Escherichia coli O157:H7 mutS, o218, yclC, pad1, slyA, rpoS genes.] [LE:5781] [RE:6188] [DI:direct]

| ORF Name | NT ID | AA ID | NT LN | AA LN | Score | P-value |
|---|---|---|---|---|---|---|
| 1976711_f3_776 | 2832 | 10003 | 1221 | 406 | 1856 | 1.8e-191 |

Description sp:[LN:PROV_SALTY] [AC:P17328] [GN:PROV] [OR:Salmonella typhimurium] [DE:GLYCINE BETAINE/L-PROLINE TRANSPORT ATP-BINDING PROTEIN PROV] [SP:P17328] [DB:swissprot] >sp:[LN:QREBVT] [AC:S05374:B45917:S34273] [PN:glycine betaine/proline transport protein proV:nucleotide-binding protein proV] [GN:proV] [CL:glycine betaine/proline transport protein proV:ATP-binding cassette homology:CBS homology] [OR:Salmonella typhimurium] [DB:pir1] [MP:57 min] >gp:[GI:g47831] [LN:STPROVW] [AC:X52693] [OR:Salmonella typhimurium] [DB:genpept-bct1] [DE:S. typhimurium proV gene and proW, 5' region.] [NT:proV protein (AA 1-400)] [SP:P17328] [LE:661] [RE:1863] [DI:direct]

| ORF Name | NT ID | AA ID | NT LN | AA LN | Score | P-value |
|---|---|---|---|---|---|---|
| 19773965_f2_622 | 2833 | 10004 | 798 | 265 | 1124 | 6.5e-114 |

Description sp:[LN:EX9_ECOLI] [AC:P38506:Q46922] [GN:XNI:EXO] [OR:Escherichia coli] [EC:3.1.11.-] [DE:EXODEOXYRIBONUCLEASE IX, (EXONUCLEASE IX) (EXO IX)] [SP:P38506:Q46922] [DB:swissprot] >sp:[LN:B65062] [AC:B65062] [PN:potential 5'-3' exonuclease,] [GN:exo] [OR:Escherichia coli] [EC:3.1.11.-] [DB:pir2] >gp:[GI:g882693] [LN:ECU29581] [AC:U29581] [OR:Escherichia coli] [DB:genpept-bct1] [DE:Escherichia coli K-12 genome; approximately 63 to 64 minutes.] [NT:TTG start; ORF_o281] [LE:12520] [RE:13365] [DI:direct] >gp:[GI:g1789162] [LN:AE000363] [AC:AE000363:U00096] [PN:5'-3' exonuclease] [GN:exo] [FN:enzyme; Degradation of DNA] [OR:Escherichia coli] [DB:genpept-bct2] [EC:3.1.11.-] [DE:Escherichia coli K-12 MG1655 section 253 of 400 of the completegenome.] [NT:o281; 99 pct identical to EXO_ECOLI SW: P38506 but] [LE:8678] [RE:9523] [DI:direct]

958

| ORF Name | NT ID | AA ID | NT LN | AA LN | Score | P-value |
|---|---|---|---|---|---|---|
| 19808_c2_1691 | 2834 | 10005 | 537 | 178 | 695 | 1.9e-68 |

Description sp:[LN:RECX_ECOLI] [AC:P33596:P77798] [GN:ORAA:RECX] [OR:Escherichia coli]
[DE:REGULATORY PROTEIN RECX (ORAA PROTEIN)] [SP:P33596:P77798] [DB:swissprot]
>sp:[LN:F65049] [AC:F65049:I58012] [PN:regulatory protein recX:oraA protein]
[GN:oraA:recX] [CL:recX protein] [OR:Escherichia coli] [DB:pir2]
>gp:[GI:d1017292:g1800084] [LN:D90892] [AC:D90892:AB001340] [PN:REGULATORY
PROTEIN RECX (ORAA PROTEIN).] [GN:oraA] [OR:Escherichia coli] [SR:Escherichia
coli (strain:K12) DNA, clone_lib:Kohara lambda minise] [DB:genpept-bct1]
[DE:E.coli genomic DNA, Kohara clone #446(60.5-60.9 min.).] [NT:similar to
[SwissProt Accession Number P33596]] [LE:11045] [RE:11545] [DI:complement]
>gp:[GI:g1789050] [LN:AE000354] [AC:AE000354:U00096] [PN:regulator, OraA protein]
[GN:oraA] [FN:putative regulator; Not classified] [OR:Escherichia coli]
[DB:genpept-bct2] [DE:Escherichia coli K-12 MG1655 section 244 of 400 of the
completegenome.] [NT:f166; 98 pct identical to RECX_ECOLI SW: P33596; CG] [LE:95]
[RE:595] [DI:complement]

| ORF Name | NT ID | AA ID | NT LN | AA LN | Score | P-value |
|---|---|---|---|---|---|---|
| 2001930_c3_1970 | 2835 | 10006 | 360 | 119 | 90 | 0.0017 |

Description sp:[LN:G69171] [AC:G69171] [PN:hypothetical protein MTH543] [GN:MTH543]
[OR:Methanobacterium thermoautotrophicum] [DB:pir2] >gp:[GI:g2621618]
[LN:AE000837] [AC:AE000837:AE000666] [PN:unknown] [GN:MTH543]
[OR:Methanobacterium thermoautotrophicum] [DB:genpept-bct2] [DE:Methanobacterium
thermoautotrophicum from bases 481808 to 494891(section 43 of 148) of the
complete genome.] [NT:Function Code:14.00 - Unknown, ; similar to,] [LE:6467]
[RE:7531] [DI:complement]

| ORF Name | NT ID | AA ID | NT LN | AA LN | Score | P-value |
|---|---|---|---|---|---|---|
| 20040907_f1_172 | 2836 | 10007 | 1206 | 401 | 308 | 8.7e-35 |

Description sp:[LN:YEGB_ECOLI] [AC:P36554:P76400] [GN:YEGB] [OR:Escherichia coli]
[DE:HYPOTHETICAL 50.9 KD PROTEIN IN ALKA-BAES INTERGENIC REGION]
[SP:P36554:P76400] [DB:swissprot] >sp:[LN:D64974] [AC:D64974] [PN:hypothetical
protein b2077] [CL:multidrug-efflux transporter] [OR:Escherichia coli] [DB:pir2]
>gp:[GI:d1016657:g1736786] [LN:D90846] [AC:D90846:AB001340] [PN:Methylenomycin A
resistance protein (MMR] [GN:yegB] [OR:Escherichia coli] [SR:Escherichia coli
(strain:K12) DNA, clone_lib:Kohara lambda minise] [DB:genpept-bct1] [DE:E.coli
genomic DNA, Kohara clone #357(46.5-46.8 min.).] [NT:ORF_ID:o357#2; similar to
[SwissProt Accession]] [LE:4216] [RE:5631] [DI:direct] >gp:[GI:g1788392]
[LN:AE000297] [AC:AE000297:U00096] [PN:putative transport protein] [GN:yegB]
[FN:putative transport; Not classified] [OR:Escherichia coli] [DB:genpept-bct2]
[DE:Escherichia coli K-12 MG1655 section 187 of 400 of the completegenome.]
[NT:o471; This 471 aa ORF is 46 pct identical (11 gaps)] [LE:14857] [RE:16272]
[DI:direct]

| ORF_Name | NT_ID | AA_ID | NT LN | AA LN | Score | P-value |
|---|---|---|---|---|---|---|
| 20517308_c3_2015 | 2837 | 10008 | 2289 | 762 | 2930 | 0.0 |

Description sp:[LN:HYPF_ECOLI] [AC:P30131;Q46878] [GN:HYPF;HYDA] [OR:Escherichia coli]
[DE:HYDROGENASE MATURATION PROTEIN HYPF] [SP:P30131;Q46878] [DB:swissprot]
>sp:[LN:D65051] [AC:D65051] [PN:hypF protein] [GN:hypF] [CL:probabe transcription
regulator hypF] [OR:Escherichia coli] [DB:pir2] >gp:[GI:g2367152] [LN:AE000355]
[AC:AE000355;U00096] [PN:transcriptional regulatory protein] [GN:hypF]
[FN:regulator; Energy metabolism, carbon: Anaerobic] [OR:Escherichia coli]
[DB:genpept-bct2] [DE:Escherichia coli K-12 MG1655 section 245 of 400 of the
completegenome.] [NT:f750; 96 pct identical (1 gap) to HYPF_ECOLI] [LE:2783]
[RE:5035] [DI:complement]

| ORF_Name | NT_ID | AA_ID | NT LN | AA LN | Score | P-value |
|---|---|---|---|---|---|---|
| 2053750_c1_1167 | 2838 | 10009 | 846 | 281 | 1142 | 8.0e-116 |

Description sp:[LN:CBIO_SALTY] [AC:Q05596] [GN:CBIO] [OR:Salmonella typhimurium] [DE:COBALT
TRANSPORT ATP-BINDING PROTEIN CBIO] [SP:Q05596] [DB:swissprot] >gp:[GI:g154435]
[LN:STYVB12AA] [AC:L12006] [PN:membrane associated ATPase] [GN:cbiO] [FN:may be
involved with cobalt transport with CbiN] [OR:Salmonella typhimurium]
[SR:Salmonella typhimurium (strain LT2) DNA] [DB:genpept-bct1] [DE:Salmonella
typhimurium vitamin B12/cobalamin biosynthetic (cob)operon 5' end including:
(cbiA, cbiB, cbiC, cbiD, cbiE, cbiT, cbiF,cbiG, cbiH, cbiJ, cbiK, cbiL, cbiM,
cbiN, cbiQ, cbiO, cbiP, cobU,cobS, cobT) genes and regulatory protein (PocR).]
[NT:putative] [LE:13075] [RE:13890] [DI:direct]

| ORF_Name | NT_ID | AA_ID | NT LN | AA LN | Score | P-value |
|---|---|---|---|---|---|---|
| 20563206_f3_740 | 2839 | 10010 | 966 | 321 | 472 | 8.0e-45 |

Description sp:[LN:YCDW_ECOLI] [AC:P75913] [GN:YCDW] [OR:Escherichia coli] [DE:PUTATIVE
2-HYDROXYACID DEHYDROGENASE IN PHOH-CSGG INTERGENIC REGION] [SP:P75913]
[DB:swissprot] >sp:[LN:F64845] [AC:F64845] [PN:probable 2-hydroxyacid
dehydrogenase ycdW] [GN:ycdW] [OR:Escherichia coli] [DB:pir2] >gp:[GI:g1787270]
[LN:AE000205] [AC:AE000205;U00096] [PN:putative dehydrogenase] [GN:ycdW]
[FN:putative enzyme; Not classified] [OR:Escherichia coli] [DB:genpept-bct2]
[DE:Escherichia coli K-12 MG1655 section 95 of 400 of the completegenome.]
[NT:o325; This 325 aa ORF is 32 pct identical (2 gaps)] [LE:2393] [RE:3370]
[DI:direct]

| ORF Name | NT ID | AA ID | NT LN | AA LN | Score | P-value |
|---|---|---|---|---|---|---|
| 20564637_c1_1352 | 2840 | 10011 | 1599 | 532 | 2081 | 2.5e-215 |

Description sp:[LN:YGAA_ECOLI] [AC:P37013:Q46876:Q46875] [GN:YGAA] [OR:Escherichia coli]
[DE:INTERGENIC REGION] [SP:P37013:Q46876:Q46875] [DB:swissprot] >sp:[LN:A65051]
[AC:A65051] [PN:ygaA protein] [GN:ygaA] [CL:nif-specific regulatory protein:RNA
polymerase sigma factor interaction domain homology] [OR:Escherichia coli]
[DB:pir2] >gp:[GI:g434587] [LN:ECU03846] [AC:U03846] [OR:Escherichia coli]
[DB:genpept-bct1] [DE:Escherichia coli K12 putative tripartite transcription
factor(ORF529 and ORF504) genes, complete cds, and (ORF>60) gene, partialcds.]
[NT:putative ORF 529AA; ORF529] [LE:265] [RE:1854] [DI:direct] >gp:[GI:g2367150]
[LN:AE000354] [AC:AE000354:U00096] [PN:putative 2-component transcriptional
regulator] [GN:ygaA] [FN:putative regulator; Not classified] [OR:Escherichia
coli] [DB:genpept-bct2] [DE:Escherichia coli K-12 MG1655 section 244 of 400 of
the completegenome.] [NT:f529; joins 2 ORFs from earlier version; now] [LE:8731]
[RE:10320] [DI:complement]

| ORF Name | NT ID | AA ID | NT LN | AA LN | Score | P-value |
|---|---|---|---|---|---|---|
| 20583337_c3_1842 | 2841 | 10012 | 966 | 321 | 1100 | 2.3e-111 |

Description sp:[LN:CBIJ_SALTY] [AC:Q05591] [GN:CBIJ] [OR:Salmonella typhimurium]
[EC:1.3.1.54] [DE:PRECORRIN-6X REDUCTASE,] [SP:Q05591] [DB:swissprot]
>gp:[GI:g154429] [LN:STYVB12AA] [AC:L12006] [GN:cbiJ] [OR:Salmonella typhimurium]
[SR:Salmonella typhimurium (strain LT2) DNA] [DB:genpept-bct1] [DE:Salmonella
typhimurium vitamin B12/cobalamin biosynthetic (cob)operon 5' end including:
(cbiA, cbiB, cbiC, cbiD, cbiE, cbiT, cbiF,cbiG, cbiH, cbiJ, cbiK, cbiL, cbiM,
cbiN, cbiQ, cbiO, cbiP, cobU,cobS, cobT) genes and regulatory protein (PocR).]
[NT:GTG start; putative] [LE:9087] [RE:9878] [DI:direct]

| ORF Name | NT ID | AA ID | NT LN | AA LN | Score | P-value |
|---|---|---|---|---|---|---|
| 20790933_f1_134 | 2842 | 10013 | 2076 | 691 | 2952 | 0.0 |

Description sp:[LN:FHLA_ECOLI] [AC:P19323:Q47214] [GN:FHLA] [OR:Escherichia coli] [DE:FORMATE HYDROGENLYASE TRANSCRIPTIONAL ACTIVATOR] [SP:P19323:Q47214] [DB:swissprot] >sp:[LN:S12079] [AC:S12079:G65053:A36705] [PN:transcription activator fhlA:formate hydrogen lyase system transcriptional activator] [GN:fhlA] [CL:transcription activator fhlA:RNA polymerase sigma factor interaction domain homology] [OR:Escherichia coli] [DB:pir2] >gp:[GI:g41437] [LN:ECFHLAT] [AC:X52227] [OR:Escherichia coli] [DB:genpept-bct1] [DE:E.coli fhlA gene for the transcriptional activator of the formatehydrogenlyase.] [NT:fhlA gene product (AA 1-692)] [SP:P19323] [LE:73] [RE:2151] [DI:direct] >gp:[GI:g882624] [LN:ECU29579] [AC:U29579] [PN:transcriptional activator of the formate] [GN:fhlA] [OR:Escherichia coli] [DB:genpept-bct1] [DE:Escherichia coli K-12 genome; approximately 61 to 62 minutes.] [NT:CG Site no. 18370; ORF_o692] [LE:26642] [RE:28720] [DI:direct] >gp:[GI:g1789087] [LN:AE000357] [AC:AE000357:U00096] [PN:formate hydrogen-lyase transcriptional activator] [GN:fhlA] [FN:regulator; Energy metabolism, carbon:] [OR:Escherichia coli] [DB:genpept-bct2] [DE:Escherichia coli K-12 MG1655 section 247 of 400 of the completegenome.] [NT:o692; 100 pct identical to FHLA_ECOLI SW: P19323;] [LE:67] [RE:2145] [DI:direct]

| ORF Name | NT ID | AA ID | NT LN | AA LN | Score | P-value |
|---|---|---|---|---|---|---|
| 2134632_f1_318 | 2843 | 10014 | 279 | 92 | 384 | 1.7e-35 |

Description gp:[GI:g5069457] [LN:AF026270] [AC:AF026270:L31414] [PN:PduN] [GN:pduN] [OR:Salmonella enterica serovar Typhimurium] [DB:genpept-bct2] [DE:Salmonella enterica serovar Typhimurium PocR (pocR) gene, partialcds; PduF (pudF) gene, complete cds and pdu operon, completesequence.] [NT:related to the CchB and CcmL family of carboxysome] [LE:10527] [RE:10802] [DI:direct]

| ORF Name | NT ID | AA ID | NT LN | AA LN | Score | P-value |
|---|---|---|---|---|---|---|
| 21517010_f3_1080 | 2844 | 10015 | 246 | 81 | | |

Description

NO-HIT

| ORF Name | NT ID | AA ID | NT LN | AA LN | Score | P-value |
|---|---|---|---|---|---|---|
| 21584377_c2_1601 | 2845 | 10016 | 519 | 172 | 812 | 7.5e-81 |

Description sp:[LN:YGBB_ECOLI] [AC:P36663] [GN:YGBB] [OR:Escherichia coli] [DE:HYPOTHETICAL
16.9 KD PROTEIN IN SURE-CYSC INTERGENIC REGION (ORF0)] [SP:P36663] [DB:swissprot]
>sp:[LN:I55083] [AC:I55083:F65055] [PN:hypothetical 16.9K protein (surE-cysC
intergenic region)] [GN:ygbB] [CL:conserved hypothetical protein HI0671]
[OR:Escherichia coli] [DB:pir2] >gp:[GI:g433711] [LN:ECOPCMORFS] [AC:L07942]
[OR:Escherichia coli] [SR:Escherichia coli (strain MP180) DNA] [DB:genpept-bct1]
[DE:Escherichia coli surE gene, complete cds and
L-isoaspartylproteinmethyltransferase (pcm) gene, partial cds.] [NT:ORF0]
[LE:320] [RE:799] [DI:direct] >gp:[GI:g882639] [LN:ECU29579] [AC:U29579]
[OR:Escherichia coli] [DB:genpept-bct1] [DE:Escherichia coli K-12 genome;
approximately 61 to 62 minutes.] [NT:alternate gene name ygbB; ORF0 of L07942;
ORF_f159] [LE:43606] [RE:44085] [DI:complement] >gp:[GI:g1789103] [LN:AE000358]
[AC:AE000358:U00096] [PN:orf, hypothetical protein] [GN:ygbB] [FN:orf; Unknown]
[OR:Escherichia coli] [DB:genpept-bct2] [DE:Escherichia coli K-12 MG1655 section
248 of 400 of the completegenome.] [NT:f159; 100 pct identical to YGBB_ECOLI SW:]
[LE:6275] [RE:6754] [DI:complement]

| ORF Name | NT ID | AA ID | NT LN | AA LN | Score | P-value |
|---|---|---|---|---|---|---|
| 2160400_c3_1879 | 2846 | 10017 | 513 | 170 | 143 | 9.8e-10 |

Description gp:[GI:g2160524] [LN:AHU56832] [AC:U56832] [OR:Aeromonas hydrophila]
[DB:genpept-bct2] [DE:Aeromonas hydrophila FK506 binding protein (fkpA) gene,
completecds in 3.9 kb fragment.] [NT:ORF5; no significant similarity with known]
[LE:2969] [RE:3721] [DI:complement]

| ORF Name | NT ID | AA ID | NT LN | AA LN | Score | P-value |
|---|---|---|---|---|---|---|
| 21613566_c2_1623 | 2847 | 10018 | 1278 | 425 | | |

Description

NO-HIT

| ORF Name | NT ID | AA ID | NT LN | AA LN | Score | P-value |
|---|---|---|---|---|---|---|
| 21661316_c3_2019 | 2848 | 10019 | 1500 | 499 | 273 | 3.8e-23 |

Description gp:[GI:g434586] [LN:ECU03846] [AC:U03846] [OR:Escherichia coli] [DB:genpept-bct1]
[DE:Escherichia coli K12 putative tripartite transcription factor(ORF529 and
ORF504) genes, complete cds, and (ORF>60) gene, partialcds.] [NT:putative ORF
>60AA] [LE:<1] [RE:183] [DI:direct]

| ORF_Name | NT_ID | AA_ID | NT/LN | AA/LN | Score | P-value |
|---|---|---|---|---|---|---|
| 21667208_c1_1265 | 2849 | 10020 | 1131 | 376 | 1668 | 1.5e-171 |

Description gp:[GI:e1175763;g2624188] [LN:KCAJ2492] [AC:AJ002492] [GN:rpoS gene] [OR:Kluyvera cryocrescens] [DB:genpept-bct1] [DE:Kluyvera cryocrescens rpoS gene.] [LE:107] [RE:1144] [DI:direct]

| ORF_Name | NT_ID | AA_ID | NT/LN | AA/LN | Score | P-value |
|---|---|---|---|---|---|---|
| 21672338_f3_1038 | 2850 | 10021 | 438 | 145 | 106 | 6.9e-06 |

Description gp:[GI:e1370577;g4158178] [LN:SC1A6] [AC:AL023496] [PN:hypothetical protein] [OR:Streptomyces coelicolor] [DB:genpept-bct1] [DE:Streptomyces coelicolor cosmid 1A6.] [NT:Protein sequence is in conflict with the conceptual] [LE:<1] [RE:574] [DI:direct]

| ORF_Name | NT_ID | AA_ID | NT/LN | AA/LN | Score | P-value |
|---|---|---|---|---|---|---|
| 21725691_f2_615 | 2851 | 10022 | 1404 | 467 | | |

Description

NO-HIT

| ORF_Name | NT_ID | AA_ID | NT/LN | AA/LN | Score | P-value |
|---|---|---|---|---|---|---|
| 21766331_c3_1892 | 2852 | 10023 | 921 | 306 | 245 | 9.1e-21 |

Description gp:[GI:e1288207;g3087788] [LN:LPN5668] [AC:AJ005668] [PN:29 kDa immunogenic protein] [OR:Legionella pneumophila] [DB:genpept-bct1] [DE:Legionella pneumophila gene encoding a 29 kDa immunogenic protein.] [LE:1371] [RE:2150] [DI:direct]

| ORF_Name | NT_ID | AA_ID | NT/LN | AA/LN | Score | P-value |
|---|---|---|---|---|---|---|
| 21909461_c3_2039 | 2853 | 10024 | 1614 | 537 | 2441 | 1.8e-253 |

Description gp:[GI:g3005690] [LN:AF055352] [AC:AF055352] [PN:gamma-glutamylcysteine synthetase] [GN:gshA] [OR:Salmonella typhimurium] [DB:genpept-bct2] [DE:Salmonella typhimurium gamma-glutamylcysteine synthetase (gshA)gene, complete cds.] [NT:GshA] [LE:311] [RE:1867] [DI:direct]

| ORF_Name | NT_ID | AA_ID | NT/LN | AA/LN | Score | P-value |
|---|---|---|---|---|---|---|
| 21932160_f1_168 | 2854 | 10025 | 1578 | 525 | | |

Description

NO-HIT

964

| ORF Name | NT ID | AA ID | NT LN | AA LN | Score | P-value |
|---|---|---|---|---|---|---|
| 21985768_f1_63 | 2855 | 10026 | 543 | 180 | 855 | 2.1e-85 |

Description sp:[LN:MPRA_ECOLI] [AC:P24201] [GN:MPRA:EMRR] [OR:Escherichia coli]
[DE:TRANSCRIPTIONAL REPRESSOR MPRA (EMRR PROTEIN)] [SP:P24201] [DB:swissprot]
>sp:[LN:S14473] [AC:S14473:PC1160:A39444:E65048:I55139] [PN:regulatory protein
mprA:emrR protein] [GN:emrR:mprA] [CL:regulatory protein mprA] [OR:Escherichia
coli] [DB:pir1] [MP:58 min] >gp:[GI:d1017278:g1800069] [LN:D90891]
[AC:D90891:AB001340] [PN:EMRR PROTEIN.] [GN:emrR] [OR:Escherichia coli]
[SR:Escherichia coli (strain:K12) DNA, clone_lib:Kohara lambda minise]
[DB:genpept-bct1] [DE:E.coli genomic DNA, Kohara clone #445(60.2-60.6 min.).]
[NT:similar to [SwissProt Accession Number P24201]] [LE:14243] [RE:14773]
[DI:direct] >gp:[GI:g42014] [LN:ECMPRA] [AC:X54151] [GN:mprA] [OR:Escherichia
coli] [DB:genpept-bct1] [DE:E. coli mprA gene.] [SP:P24201] [LE:98] [RE:628]
[DI:direct] >gp:[GI:g1789040] [LN:AE000353] [AC:AE000353:U00096] [PN:regulator of
plasmid mcrB operon (microcin B17)] [GN:emrR] [FN:regulator; Plasmid-related
functions] [OR:Escherichia coli] [DB:genpept-bct2] [DE:Escherichia coli K-12
MG1655 section 243 of 400 of the completegenome.] [NT:o176; 100 pct identical to
EMRR_ECOLI SW: P24201;] [LE:1245] [RE:1775] [DI:direct]

| ORF Name | NT ID | AA ID | NT LN | AA LN | Score | P-value |
|---|---|---|---|---|---|---|
| 22004042_c2_1735 | 2856 | 10027 | 1500 | 499 | | |

Description

NO-HIT

| ORF Name | NT ID | AA ID | NT LN | AA LN | Score | P-value |
|---|---|---|---|---|---|---|
| 22048191_c1_1272 | 2857 | 10028 | 1545 | 514 | 2432 | 1.6e-252 |

Description gp:[GI:e1455616:g4887556] [LN:ECAJ6210] [AC:AJ006210] [GN:yclC] [OR:Escherichia
coli] [DB:genpept-bct1] [DE:Escherichia coli O157:H7 mutS, o218, yclC, pad1,
slyA, rpoS genes.] [LE:3614] [RE:5041] [DI:complement]

| ORF Name | NT ID | AA ID | NT LN | AA LN | Score | P-value |
|---|---|---|---|---|---|---|
| 22117187_f1_203 | 2858 | 10029 | 1233 | 410 | 284 | 3.1e-23 |

Description gp:[GI:g561919] [LN:YSPPHHY] [AC:L37084] [PN:phosphopyruvate hydratase]
[OR:Schizosaccharomyces pombe] [SR:Schizosaccharomyces pombe cDNA to mRNA]
[DB:genpept-pln1] [EC:4.2.1.11] [DE:Schizosaccharomyces pombe phosphopyruvate
hydratase mRNA, completecds.] [LE:2] [RE:1342] [DI:complement]

| ORF_Name | NT_ID | AA_ID | NT LN | AA LN | Score | P-value |
|---|---|---|---|---|---|---|
| 22128125_f3_1051 | 2859 | 10030 | 1392 | 463 | | |

Description

NO-HIT

| ORF_Name | NT_ID | AA_ID | NT LN | AA LN | Score | P-value |
|---|---|---|---|---|---|---|
| 22131262_c2_1517 | 2860 | 10031 | 582 | 193 | 817 | 2.2e-81 |

Description sp:[LN:COBU_SALTY] [AC:Q05599] [GN:COBU] [OR:Salmonella typhimurium] [DE:KINASE; COBINAMIDE PHOSPHATE GUANYLYLTRANSFERASE]] [SP:Q05599] [DB:swissprot]

| ORF_Name | NT_ID | AA_ID | NT LN | AA LN | Score | P-value |
|---|---|---|---|---|---|---|
| 22152093_f3_738 | 2861 | 10032 | 297 | 98 | 91 | 6.6e-06 |

Description gp:[GI:e1533602:g5689949] [LN:SC4A10] [AC:AL109663] [PN:hypothetical protein] [GN:SC4A10.10c] [OR:Streptomyces coelicolor A3(2)] [DB:genpept-bct1] [DE:Streptomyces coelicolor cosmid 4A10.] [NT:SC4A10.10c, hypothetical protein, len: 398 aa;] [LE:10587] [RE:11783] [DI:complement]

| ORF_Name | NT_ID | AA_ID | NT LN | AA LN | Score | P-value |
|---|---|---|---|---|---|---|
| 2235216_f1_324 | 2862 | 10033 | 609 | 202 | 798 | 2.3e-79 |

Description gp:[GI:g5069462] [LN:AF026270] [AC:AF026270:L31414] [PN:PduT] [GN:pduT] [OR:Salmonella enterica serovar Typhimurium] [DB:genpept-bct2] [DE:Salmonella enterica serovar Typhimurium PocR (pocR) gene, partialcds; PduF (pudF) gene, complete cds and pdu operon, completesequence.] [NT:related to the major shell proteins of] [LE:15695] [RE:16249] [DI:direct]

| ORF_Name | NT_ID | AA_ID | NT LN | AA LN | Score | P-value |
|---|---|---|---|---|---|---|
| 22460087_c2_1752 | 2863 | 10034 | 942 | 313 | 382 | 2.8e-35 |

Description sp:[LN:PHEC_PSEAE] [AC:Q01269] [GN:PHEC] [OR:Pseudomonas aeruginosa] [EC:4.2.1.51:4.-.-.-] [DE:DEHYDRATASE,; AROGENATE DEHYDRATASE,]] [SP:Q01269] [DB:swissprot] >sp:[LN:B42325] [AC:B42325] [PN:cyclohexadienyl dehydratase] [OR:Pseudomonas aeruginosa] [DB:pir2] >gp:[GI:g2997758] [LN:AF054868] [AC:AF054868:M74132] [PN:cyclohexadienyl dehydratase] [GN:pheC] [OR:Pseudomonas aeruginosa] [DB:genpept-bct2] [DE:Pseudomonas aeruginosa autoinducer synthetase (rhlI) gene, partialcds; cyclohexadienyl dehydratase (pheC), hypothetical 0299 protein(yigM), chloramphenicol-sensitive protein (rarD), and hypotheticalprotein (yafL) genes, complete cds; and malic enzyme (sfcA) gene,partial cds.] [LE:253] [RE:1059] [DI:direct]

| ORF Name | NT ID | AA ID | NT LN | AA LN | Score | P-value |
|---|---|---|---|---|---|---|
| 22541_f2_720 | 2864 | 10035 | 726 | 241 | 1013 | 3.8e-102 |

Description sp:[LN:MUTH_ECOLI] [AC:P06722] [GN:MUTH:MUTR:PRV] [OR:Escherichia coli] [DE:DNA MISMATCH REPAIR PROTEIN MUTH] [SP:P06722] [DB:swissprot]

| ORF Name | NT ID | AA ID | NT LN | AA LN | Score | P-value |
|---|---|---|---|---|---|---|
| 22700_f1_49 | 2865 | 10036 | 564 | 187 | 617 | 3.5e-60 |

Description sp:[LN:G65046] [AC:G65046] [PN:hypothetical protein b2670] [OR:Escherichia coli] [DB:pir2] >gp:[GI:g1789025] [LN:AE000352] [AC:AE000352:U00096] [PN:orf, hypothetical protein] [GN:b2670] [FN:orf; Unknown] [OR:Escherichia coli] [DB:genpept-bct2] [DE:Escherichia coli K-12 MG1655 section 242 of 400 of the completegenome.] [NT:o149; This 149 aa ORF is 28 pct identical (16 gaps)] [LE:365] [RE:814] [DI:direct]

| ORF Name | NT ID | AA ID | NT LN | AA LN | Score | P-value |
|---|---|---|---|---|---|---|
| 22734653_c3_1904 | 2866 | 10037 | 552 | 183 | 348 | 1.1e-31 |

Description sp:[LN:YQCC_ECOLI] [AC:Q46919] [GN:YQCC] [OR:Escherichia coli] [DE:HYPOTHETICAL 12.8 KD PROTEIN IN BARA-SYD INTERGENIC REGION] [SP:Q46919] [DB:swissprot] >sp:[LN:D65061] [AC:D65061] [PN:hypothetical protein b2792] [CL:hypothetical protein HI1436] [OR:Escherichia coli] [DB:pir2] >gp:[GI:g882687] [LN:ECU29581] [AC:U29581] [OR:Escherichia coli] [DB:genpept-bct1] [DE:Escherichia coli K-12 genome; approximately 63 to 64 minutes.] [NT:corresponds to hypothetical protein from E.] [LE:5339] [RE:5668] [DI:complement] >gp:[GI:g1789156] [LN:AE000363] [AC:AE000363:U00096] [PN:orf, hypothetical protein] [GN:b2792] [FN:orf; Unknown] [OR:Escherichia coli] [DB:genpept-bct2] [DE:Escherichia coli K-12 MG1655 section 253 of 400 of the completegenome.] [NT:f109; similar to GenBank Accession] [LE:1497] [RE:1826] [DI:complement]

| ORF Name | NT ID | AA ID | NT LN | AA LN | Score | P-value |
|---|---|---|---|---|---|---|
| 22742711_c1_1320 | 2867 | 10038 | 279 | 92 | 104 | 7.9e-06 |

Description gp:[GI:e285321:g1743348] [LN:MSRECAGEN] [AC:X99208] [PN:unknown protein] [OR:Mycobacterium smegmatis] [DB:genpept-bct1] [DE:M.smegmatis recA, partial hypB & recX genes.] [LE:798] [RE:1211] [DI:direct]

| ORF Name | NT ID | AA ID | NT/LN | AA/LN | Score | P-value |
|---|---|---|---|---|---|---|
| 22775302_c1_1198 | 2868 | 10039 | 1176 | 391 | 1400 | 3.7e-143 |

Description gp:[GI:g2582422] [LN:AF026067] [AC:AF026067] [PN:FMNH2-dependent methanesulfonate sulfonatase] [GN:msuD] [OR:Pseudomonas aeruginosa] [DB:genpept-bct2] [DE:Pseudomonas aeruginosa NADH-dependent FMN reductase (msuE),FMNH2-dependent methanesulfonate sulfonatase (msuD), and putativeFMNH2-dependent monooxygenase (msuC) genes, complete cds.] [LE:1727] [RE:2872] [DI:direct]

| ORF Name | NT ID | AA ID | NT/LN | AA/LN | Score | P-value |
|---|---|---|---|---|---|---|
| 22845288_f1_11 | 2869 | 10040 | 1551 | 516 | 783 | 8.9e-78 |

Description gp:[GI:g5257497] [LN:AF151698] [AC:AF151698] [PN:GlnP/GlnQ homolog] [OR:Agrobacterium tumefaciens] [DB:genpept-bct2] [DE:Agrobacterium tumefaciens cryptic plasmid pAtC58 transcriptionalrepressor, GlnH homolog, GlnP/GlnQ homolog, putativeoxidoreductase, and AgaE homolog genes, complete cds.] [NT:Orf3] [LE:2453] [RE:3961] [DI:direct]

| ORF Name | NT ID | AA ID | NT/LN | AA/LN | Score | P-value |
|---|---|---|---|---|---|---|
| 22859543_c3_1838 | 2870 | 10041 | 1569 | 522 | 1734 | 1.5e-178 |

Description sp:[LN:CBID_SALTY] [AC:Q05628] [GN:CBID] [OR:Salmonella typhimurium] [DE:CBID PROTEIN] [SP:Q05628] [DB:swissprot] >gp:[GI:g154423] [LN:STYVB12AA] [AC:L12006] [GN:cbiD] [OR:Salmonella typhimurium] [SR:Salmonella typhimurium (strain LT2) DNA] [DB:genpept-bct1] [DE:Salmonella typhimurium vitamin B12/cobalamin biosynthetic (cob)operon 5' end including: (cbiA, cbiB, cbiC, cbiD, cbiE, cbiT, cbiF,cbiG, cbiH, cbiJ, cbiK, cbiL, cbiM, cbiN, cbiQ, cbiO, cbiP, cobU,cobS, cobT) genes and regulatory protein (PocR).] [NT:putative] [LE:4266] [RE:5405] [DI:direct]

| ORF Name | NT ID | AA ID | NT/LN | AA/LN | Score | P-value |
|---|---|---|---|---|---|---|
| 23455382_f1_202 | 2871 | 10042 | 1212 | 403 | 204 | 1.8e-12 |

Description gp:[GI:g1171129] [LN:MXU24657] [AC:U24657] [PN:saframycin Mx1 synthetase A] [GN:safA] [OR:Myxococcus xanthus] [DB:genpept-bct2] [DE:Myxococcus xanthus saframycin Mx1 synthetase B (safB), saframycinMx1 synthetase A (safA), and safC genes, complete cds.] [NT:contains two putative amino acid activating] [LE:5491] [RE:13308] [DI:direct]

| ORF Name | NT ID | AA ID | NT LN | AA LN | Score | P-value |
|---|---|---|---|---|---|---|
| 23456502_f3_749 | 2872 | 10043 | 1068 | 355 | 129 | 1.7e-05 |

Description sp:[LN:YQII_ECOLI] [AC:P76656] [GN:YQII] [OR:Escherichia coli] [DE:HYPOTHETICAL 38.6 KD PROTEIN IN RIBB-GLGS INTERGENIC REGION PRECURSOR] [SP:P76656] [DB:swissprot] >sp:[LN:F65092] [AC:F65092] [PN:hypothetical protein b3048] [CL:ybgO protein] [OR:Escherichia coli] [DB:pir2] >gp:[GI:g1789427] [LN:AE000386] [AC:AE000386;U00096] [PN:orf, hypothetical protein] [GN:yqiI] [FN:orf; Unknown] [OR:Escherichia coli] [DB:genpept-bct2] [DE:Escherichia coli K-12 MG1655 section 276 of 400 of the completegenome.] [NT:o354; phage > ecoli] [LE:8170] [RE:9234] [DI:direct]

| ORF Name | NT ID | AA ID | NT LN | AA LN | Score | P-value |
|---|---|---|---|---|---|---|
| 23534701_f1_5 | 2873 | 10044 | 3180 | 1059 | 3181 | 0.0 |

Description gp:[GI:e256815:g1707645] [LN:PAMEXEFOP] [AC:X99514] [GN:mexF] [FN:cytoplasmic membrane component of multidrug] [OR:Pseudomonas aeruginosa] [DB:genpept-bct1] [DE:P.aeruginosa mexE, mexF & oprN genes.] [LE:1439] [RE:4627] [DI:direct]

| ORF Name | NT ID | AA ID | NT LN | AA LN | Score | P-value |
|---|---|---|---|---|---|---|
| 23548533_f1_157 | 2874 | 10045 | 2397 | 798 | 243 | 1.2e-49 |

Description gp:[GI:g3044098] [LN:AF055999] [AC:AF055999] [PN:outer membrane hemin receptor] [GN:phuR] [OR:Pseudomonas aeruginosa] [DB:genpept-bct2] [DE:Pseudomonas aeruginosa hemin uptake locus, hypothetical proteinPhuW (phuW), ATPase component (phuV), ABC-type permease (phuU),periplasmic binding protein (phuT), hemin degrading factor (phuS),and outer membrane hemin receptor (phuR) genes, complete cds.] [NT:PhuR] [LE:5383] [RE:7677] [DI:direct]

| ORF Name | NT ID | AA ID | NT LN | AA LN | Score | P-value |
|---|---|---|---|---|---|---|
| 23601500_c2_1612 | 2875 | 10046 | 639 | 212 | 891 | 3.2e-89 |

Description gp:[GI:e1455617:g4887557] [LN:ECAJ6210] [AC:AJ006210] [PN:phenylacrylic acid decarboxylase-like protein] [GN:pad1] [OR:Escherichia coli] [DB:genpept-bct1] [DE:Escherichia coli O157:H7 mutS, o218, yclC, pad1, slyA, rpoS genes.] [LE:5041] [RE:5634] [DI:complement]

| ORF_Name | NT ID | AA ID | NT/LN | AA/LN | Score | P-value |
|---|---|---|---|---|---|---|
| 23647188_c3_1880 | 2876 | 10047 | 186 | 61 | 119 | 3.2e-06 |

Description gp:[GI:e199082:g1107839] [LN:PAALGYGEN] [AC:Z54213] [PN:alginate lyase] [GN:algY]
[OR:Pseudomonas aeruginosa] [DB:genpept-bct1] [DE:P.aeruginosa algY gene.]
[LE:1820] [RE:3874] [DI:direct]

| ORF_Name | NT ID | AA ID | NT/LN | AA/LN | Score | P-value |
|---|---|---|---|---|---|---|
| 23719057_c3_1941 | 2877 | 10048 | 447 | 148 | 384 | 1.7e-35 |

Description sp:[LN:YGBE_ECOLI] [AC:P46141:Q46895] [GN:YGBE] [OR:Escherichia coli]
[DE:HYPOTHETICAL 12.0 KD PROTEIN IN SURE-CYSC INTERGENIC REGION]
[SP:P46141:Q46895] [DB:swissprot] >sp:[LN:A65056] [AC:A65056] [PN:hypothetical
protein in surE-cysC intergenic region] [GN:ygbE] [OR:Escherichia coli] [DB:pir2]
>gp:[GI:g882642] [LN:ECU29579] [AC:U29579] [OR:Escherichia coli]
[DB:genpept-bct1] [DE:Escherichia coli K-12 genome; approximately 61 to 62
minutes.] [NT:ORF_f107] [LE:45317] [RE:45640] [DI:complement] >gp:[GI:g1789106]
[LN:AE000358] [AC:AE000358:U00096] [PN:putative cytochrome oxidase subunit]
[GN:ygbE] [FN:putative enzyme; Not classified] [OR:Escherichia coli]
[DB:genpept-bct2] [DE:Escherichia coli K-12 MG1655 section 248 of 400 of the
completegenome.] [NT:f107; 100 pct identical to 66 aa of YGBE_ECOLI] [LE:7988]
[RE:8311] [DI:complement]

| ORF_Name | NT ID | AA ID | NT/LN | AA/LN | Score | P-value |
|---|---|---|---|---|---|---|
| 24337833_f1_82 | 2878 | 10049 | 303 | 100 | | |

Description

NO-HIT

| ORF_Name | NT ID | AA ID | NT/LN | AA/LN | Score | P-value |
|---|---|---|---|---|---|---|
| 24413156_f2_673 | 2879 | 10050 | 312 | 103 | 346 | 1.8e-31 |

Description gp:[GI:g5069454] [LN:AF026270] [AC:AF026270:L31414] [PN:PduK] [GN:pduK]
[OR:Salmonella enterica serovar Typhimurium] [DB:genpept-bct2] [DE:Salmonella
enterica serovar Typhimurium PocR (pocR) gene, partialcds; PduF (pudF) gene,
complete cds and pdu operon, completesequence.] [NT:related to the major shell
proteins of] [LE:8921] [RE:9403] [DI:direct]

| ORF Name | NT ID | AA ID | NT/LN | AA/LN | Score | P-value |
|---|---|---|---|---|---|---|
| 24415927_c2_1739 | 2880 | 10051 | 585 | 194 | 237 | 6.4e-20 |

Description gp:[GI:e259415:g1504105] [LN:PMATFGC] [AC:Z78535] [PN:major subunit of type 1 fimbria] [GN:atfA] [OR:Proteus mirabilis] [DB:genpept-bct1] [DE:P.mirabilis atf gene cluster.] [LE:301] [RE:861] [DI:direct]

| ORF Name | NT ID | AA ID | NT/LN | AA/LN | Score | P-value |
|---|---|---|---|---|---|---|
| 24417891_c3_1990 | 2881 | 10052 | 1353 | 450 | 369 | 6.6e-34 |

Description sp:[LN:SCRY_SALTY] [AC:P22340] [GN:SCRY] [OR:Salmonella typhimurium] [DE:SUCROSE PORIN PRECURSOR] [SP:P22340] [DB:swissprot] >sp:[LN:A39127] [AC:A39127:S70069] [PN:sucrose porin scrY precursor] [GN:scrY] [OR:Escherichia coli] [DB:pir2] >sp:[LN:S15193] [AC:S15193] [PN:sucrose porin scrY] [GN:scrY] [OR:Salmonella typhimurium] [DB:pir2] >gp:[GI:g48830] [LN:STSCRY] [AC:X57400:S44132] [PN:sucrose porin] [GN:scrY] [OR:Salmonella typhimurium] [DB:genpept-bct1] [DE:S.typhimurium plasmid pUR400 scrY gene for sucrose porin.] [SP:P22340] [LE:133] [RE:1650] [DI:direct] >gp:[GI:g155143] [LN:UR4SCRYA] [AC:M38416] [PN:sucrose porin] [GN:scrY] [OR:Plasmid pUR400] [SR:Plasmid pUR400 (clone: pCH186.) DNA] [DB:genpept-bct1] [DE:Plasmid pUR400 (from S.typhimurium) sucrose porin (scrY) gene,complete cds, and scrA gene, 5' end.] [LE:151] [RE:1668] [DI:direct]

| ORF Name | NT ID | AA ID | NT/LN | AA/LN | Score | P-value |
|---|---|---|---|---|---|---|
| 24641457_f2_454 | 2882 | 10053 | 780 | 259 | 1178 | 1.2e-119 |

Description sp:[LN:SRLR_ECOLI] [AC:P15082:P77030] [GN:SRLR:GUTR] [OR:Escherichia coli] [DE:GLUCITOL OPERON REPRESSOR] [SP:P15082:P77030] [DB:swissprot] >sp:[LN:S01832] [AC:S01832:G65050] [PN:regulatory protein gutR:glucitol operon protein R:srlR protein] [GN:srlR:gutR] [CL:regulatory protein gutR] [OR:Escherichia coli] [DB:pir1] >gp:[GI:g41630] [LN:ECGUTMR] [AC:X13463] [OR:Escherichia coli] [DB:genpept-bct1] [DE:Escherichia coli gutM gene and gutR gene for activator andrepressor proteins.] [NT:gut R protein (AA 1-257)] [SP:P15082] [LE:779] [RE:1552] [DI:direct] >gp:[GI:g882599] [LN:ECU29579] [AC:U29579] [GN:gutR] [FN:glucitol operon repressor] [OR:Escherichia coli] [DB:genpept-bct1] [DE:Escherichia coli K-12 genome; approximately 61 to 62 minutes.] [NT:CG Site No. 152; alternate gene name srlR] [LE:1350] [RE:2123] [DI:direct] >gp:[GI:g1789059] [LN:AE000354] [AC:AE000354:U00096] [PN:regulator for gut (srl), glucitol operon] [GN:srlR] [FN:regulator; Degradation of small molecules:] [OR:Escherichia coli] [DB:genpept-bct2] [DE:Escherichia coli K-12 MG1655 section 244 of 400 of the completegenome.] [NT:o257; 100 pct identical to SRLR_ECOLI SW: P15082;] [LE:7003] [RE:7776] [DI:direct] >gp:[GI:g146282] [LN:ECOGUT] [AC:J02708:M36721] [OR:Escherichia coli] [DB:genpept-bct2] [DE:E.coli glucitol (gut) operon: glucitol-specific enzyme II (gutA),and III (gutB), glucitol-6-phosphate dehydrogenase (gutD),activator (gutM) and repressor (gutR) genes, complete cds.] [NT:gut operon repressor (gutR)] [LE:3748] [RE:4521] [DI:direct]

| ORF_Name | NT ID | AA ID | NT/LN | AA/LN | Score | P-value |
|---|---|---|---|---|---|---|
| 24644663_c1_1173 | 2883 | 10054 | 1104 | 367 | 1816 | 3.0e-187 |

Description gp:[GI:g882708] [LN:ECU29581] [AC:U29581] [OR:Escherichia coli] [DB:genpept-bct1] [DE:Escherichia coli K-12 genome; approximately 63 to 64 minutes.] [NT:ORF_f432] [LE:27636] [RE:28934] [DI:complement]

| ORF_Name | NT ID | AA ID | NT/LN | AA/LN | Score | P-value |
|---|---|---|---|---|---|---|
| 24644693_c3_1791 | 2884 | 10055 | 801 | 266 | 1380 | 4.8e-141 |

Description sp:[LN:TYSY_ECOLI] [AC:P00470] [GN:THYA] [OR:Escherichia coli] [EC:2.1.1.45] [DE:THYMIDYLATE SYNTHASE, (TS)] [SP:P00470] [DB:swissprot] >sp:[LN:SYECT] [AC:A00549:B24137:D65065] [PN:thymidylate synthase,] [GN:thyA] [CL:thymidylate synthase:thymidylate synthase homology] [OR:Escherichia coli] [EC:2.1.1.45] [DB:pir1] [MP:61 min] >gp:[GI:g147987] [LN:ECOTHYA] [AC:J01710] [GN:thyA] [OR:Escherichia coli] [SR:Escherichia coli DNA] [DB:genpept-bct1] [DE:E.coli thyA gene coding for thymidylate synthase.] [NT:thymidylate synthase] [LE:215] [RE:1009] [DI:direct] >gp:[GI:g1789191] [LN:AE000366] [AC:AE000366:U00096] [PN:thymidylate synthetase] [GN:thyA] [FN:enzyme; 2'-Deoxyribonucleotide metabolism] [OR:Escherichia coli] [DB:genpept-bct2] [EC:2.1.1.45] [DE:Escherichia coli K-12 MG1655 section 256 of 400 of the completegenome.] [NT:f264; 99 pct identical to TYSY_ECOLI SW: P00470; CG] [LE:5419] [RE:6213] [DI:complement]

| ORF_Name | NT ID | AA ID | NT/LN | AA/LN | Score | P-value |
|---|---|---|---|---|---|---|
| 24650278_c1_1403 | 2885 | 10056 | 666 | 221 | 409 | 3.8e-38 |

Description sp:[LN:YRAI_ECOLI] [AC:P42914] [GN:YRAI] [OR:Escherichia coli] [DE:PRECURSOR] [SP:P42914] [DB:swissprot] >sp:[LN:C65104] [AC:C65104] [PN:hypothetical 25.7 kD fimbrial chaperone in agai- mtr intergeni] [GN:yraI] [CL:chaperone protein papD] [OR:Escherichia coli] [DB:pir1] >gp:[GI:g1789532] [LN:AE000395] [AC:AE000395:U00096] [PN:putative chaperone] [GN:yraI] [FN:putative factor; Not classified] [OR:Escherichia coli] [DB:genpept-bct2] [DE:Escherichia coli K-12 MG1655 section 285 of 400 of the completegenome.] [NT:o231; 100 pct identical amino acid sequence and] [LE:6325] [RE:7020] [DI:direct] >gp:[GI:g606083] [LN:ECOUW67] [AC:U18997] [OR:Escherichia coli] [DB:genpept-bct2] [DE:Escherichia coli K-12 chromosomal region from 67.4 to 76.0 minutes.] [NT:ORF_o231] [LE:68842] [RE:69537] [DI:direct]

| ORF Name | NT ID | AA ID | NT/LN | AA/LN | Score | P-value |
|---|---|---|---|---|---|---|
| 24650655_c3_1840 | 2886 | 10057 | 576 | 191 | 747 | 5.8e-74 |

Description sp:[LN:CBIT_SALTY] [AC:Q05632] [GN:CBIT] [OR:Salmonella typhimurium] [EC:1.-.-.-]
[DE:PRECORRIN-8W DECARBOXYLASE,] [SP:Q05632] [DB:swissprot] >gp:[GI:g154425]
[LN:STYVB12AA] [AC:L12006] [PN:precorrin decarbocylase] [GN:cbiT] [OR:Salmonella
typhimurium] [SR:Salmonella typhimurium (strain LT2) DNA] [DB:genpept-bct1]
[DE:Salmonella typhimurium vitamin B12/cobalamin biosynthetic (cob)operon 5' end
including: (cbiA, cbiB, cbiC, cbiD, cbiE, cbiT, cbiF,cbiG, cbiH, cbiJ, cbiK,
cbiL, cbiM, cbiN, cbiQ, cbiO, cbiP, cobU,cobS, cobT) genes and regulatory protein
(PocR).] [NT:putative] [LE:5994] [RE:6572] [DI:direct]

| ORF Name | NT ID | AA ID | NT/LN | AA/LN | Score | P-value |
|---|---|---|---|---|---|---|
| 24719191_c2_1527 | 2887 | 10058 | 270 | 89 | 318 | 1.7e-28 |

Description sp:[LN:YGDI_ECOLI] [AC:Q46924] [GN:YGDI] [OR:Escherichia coli] [DE:HYPOTHETICAL
LIPOPROTEIN YGDI PRECURSOR] [SP:Q46924] [DB:swissprot]

| ORF Name | NT ID | AA ID | NT/LN | AA/LN | Score | P-value |
|---|---|---|---|---|---|---|
| 24736711_c3_1931 | 2888 | 10059 | 1842 | 613 | 2836 | 2.5e-295 |

Description gp:[GI:g145680] [LN:ECOCYSJIHA] [AC:M23008:J05025:J05057:M27144]
[PN:NADPH-sulfite reductase flavoprotein component] [GN:cysJ] [OR:Escherichia
coli] [SR:E.coli (strain B, ATCC 11303) DNA, clone pJYW2] [DB:genpept-bct1]
[EC:1.8.1.2] [DE:E.coli NADPH-sulfite reductase flavoprotein component
(cysJ),NADPH-sulfite reductase hemoprotein component (cysI), and
3'phosphoadenosine 5'-phosphosulfate sulfotransferase (cysH) genes,complete cds.]
[LE:285] [RE:2084] [DI:direct]

| ORF Name | NT ID | AA ID | NT/LN | AA/LN | Score | P-value |
|---|---|---|---|---|---|---|
| 24816066_f3_921 | 2889 | 10060 | 1485 | 494 | 63 | 0.029 |

Description sp:[LN:YPE4_NPVLD] [AC:P36868:Q90117] [OR:Lymantria dispar multicapsid nuclear
polyhedrosis virus] [SR:,LdMNPV] [DE:HYPOTHETICAL 9.7 KD PROTEIN IN PE 3'REGION
(ORF 4)] [SP:P36868:Q90117] [DB:swissprot] >gp:[GI:d1007742:g468452]
[LN:LPVPECP2] [AC:D37947:D10836] [OR:Lymantria dispar nucleopolyhedrovirus]
[SR:Lymantria dispar nuclear polyhedrosis virus DNA] [DB:genpept-vrl]
[DE:Lymantria dispar nuclear polyhedrosis virus genes for polyhedronenvelope
protein, Lef-2 homolog and PDV E66 polyhedron derivedvirion envelope protein
homolog.] [NT:ORF4] [LE:4281] [RE:4547] [DI:direct]

| ORF Name | NT ID | AA ID | NT/LN | AA/LN | Score | P-value |
|---|---|---|---|---|---|---|
| 25401687_c1_1237 | 2890 | 10061 | 1380 | 459 | 2114 | 8.0e-219 |

Description sp:[LN:NOEC] [AC:G65059:B25608] [PN:phosphopyruvate hydratase,:2-phosphoglycerate dehydratase:enolase] [GN:eno] [CL:enolase] [OR:Escherichia coli] [EC:4.2.1.11] [DB:pir1] [MP:60 min] >gp:[GI:g1789141] [LN:AE000361] [AC:AE000361:U00096] [PN:enolase] [GN:eno] [FN:enzyme; Energy metabolism, carbon: Glycolysis] [OR:Escherichia coli] [DB:genpept-bct2] [EC:4.2.1.11] [DE:Escherichia coli K-12 MG1655 section 251 of 400 of the completegenome.] [NT:f432; 99 pct identical to 419 aa of ENO_ECOLI] [LE:7220] [RE:8518] [DI:complement] >gp:[GI:g882673] [LN:ECU29580] [AC:U29580] [PN:enolase] [GN:eno] [OR:Escherichia coli] [DB:genpept-bct2] [EC:4.2.1.11] [DE:Escherichia coli K-12 genome; approximately 62 minute region.] [NT:CG Site No. 823] [LE:4508] [RE:5806] [DI:complement]

| ORF Name | NT ID | AA ID | NT/LN | AA/LN | Score | P-value |
|---|---|---|---|---|---|---|
| 25472550_c2_1638 | 2891 | 10062 | 1644 | 547 | 142 | 1.8e-06 |

Description gp:[GI:g2623371] [LN:MMU70653] [AC:U70653] [PN:sex determining protein] [GN:Sry] [OR:Mus musculus musculus] [SR:eastern European house mouse] [DB:genpept-rod] [DE:Mus musculus musculus sex determining protein (Sry) gene, completecds.] [NT:HMG box transcription factor] [LE:57] [RE:1307] [DI:direct] >gp:[GI:g2623373] [LN:MMU70654] [AC:U70654] [PN:sex determining protein] [GN:Sry] [OR:Mus musculus musculus] [SR:eastern European house mouse] [DB:genpept-rod] [DE:Mus musculus musculus sex determining protein (Sry) gene, completecds.] [NT:HMG box transcription factor] [LE:57] [RE:1307] [DI:direct]

| ORF Name | NT ID | AA ID | NT/LN | AA/LN | Score | P-value |
|---|---|---|---|---|---|---|
| 25494642_f1_9 | 2892 | 10063 | 885 | 294 | | |

Description

NO-HIT

| ORF Name | NT ID | AA ID | NT/LN | AA/LN | Score | P-value |
|---|---|---|---|---|---|---|
| 25495342_f1_273 | 2893 | 10064 | 435 | 144 | 656 | 2.5e-64 |

Description sp:[LN:FUCU_ECOLI] [AC:P11555:Q46923] [GN:FUCU] [OR:Escherichia coli] [DE:FUCOSE OPERON FUCU PROTEIN] [SP:P11555:Q46923] [DB:swissprot] >sp:[LN:Q4ECKR] [AC:H65062:JS0187] [PN:fucose operon U protein] [GN:fucU] [CL:fucose operon U protein] [OR:Escherichia coli] [DB:pir1] [MP:60 min] >gp:[GI:g882699] [LN:ECU29581] [AC:U29581] [GN:fucU] [OR:Escherichia coli] [DB:genpept-bct1] [DE:Escherichia coli K-12 genome; approximately 63 to 64 minutes.] [LE:20443] [RE:20865] [DI:direct] >gp:[GI:g1789169] [LN:AE000364] [AC:AE000364:U00096] [PN:protein of fucose operon] [GN:fucU] [FN:phenotype; Degradation of small molecules:] [OR:Escherichia coli] [DB:genpept-bct2] [DE:Escherichia coli K-12 MG1655 section 254 of 400 of the completegenome.] [NT:o140; 100 pct identical to FUCU_ECOLI SW: P11555] [LE:4957] [RE:5379] [DI:direct]

| ORF Name | NT ID | AA ID | NT/LN | AA/LN | Score | P-value |
|---|---|---|---|---|---|---|
| 25507327_f1_12 | 2894 | 10065 | 729 | 242 | 412 | 5.6e-38 |

Description gp:[GI:g559044] [LN:HUMALAD13] [AC:L29296] [PN:alpha-adducin] [OR:Homo sapiens]
[SR:Homo sapiens DNA] [DB:genpept-pri2] [DE:Human (clone: SS20B/E6.0)
alpha-adducin gene, exons 14, 15, 16.] [LE:L29293.1:190:L29286.1:209]
[RE:384:371] [DI:directJoin]

| ORF Name | NT ID | AA ID | NT/LN | AA/LN | Score | P-value |
|---|---|---|---|---|---|---|
| 25516682_f1_160 | 2895 | 10066 | 1095 | 364 | 1028 | 9.7e-104 |

Description sp:[LN:S54438] [AC:S54438] [PN:hemin permease] [CL:vitamin B12 transport protein
btuC] [OR:Yersinia enterocolitica] [DB:pir2]

| ORF Name | NT ID | AA ID | NT/LN | AA/LN | Score | P-value |
|---|---|---|---|---|---|---|
| 25517813_c1_1400 | 2896 | 10067 | 381 | 126 | 110 | 1.8e-06 |

Description gp:[GI:g180869] [LN:HUMCOLAA05] [AC:M25730:J03065] [PN:alpha-1 type II collagen]
[GN:COL2A1] [OR:Homo sapiens] [SR:Homo sapiens DNA] [DB:genpept-pri2] [DE:Human
alpha 1 collagen type II gene, exons 8 and 9.] [NT:precursor]
[LE:M32168.1:157:M25655.1:3:M25656.1:10] [RE:241:19:42] [DI:directJoin]

| ORF Name | NT ID | AA ID | NT/LN | AA/LN | Score | P-value |
|---|---|---|---|---|---|---|
| 25525277_f1_59 | 2897 | 10068 | 768 | 255 | 260 | 2.3e-22 |

Description sp:[LN:PROW_ECOLI] [AC:P14176] [GN:PROW] [OR:Escherichia coli] [DE:GLYCINE
BETAINE/L-PROLINE TRANSPORT SYSTEM PERMEASE PROTEIN PROW] [SP:P14176]
[DB:swissprot] >sp:[LN:MMECPW] [AC:JS0129:G65047] [PN:glycine betaine/L-proline
transport system permease protein P] [GN:proW] [CL:glycine
betaine/carnitine/choline ABC transporter] [OR:Escherichia coli] [DB:pir1]
>gp:[GI:d1017275:g1800066] [LN:D90891] [AC:D90891:AB001340] [PN:glycine
betaine/proline transport system protein] [GN:proW] [OR:Escherichia coli]
[SR:Escherichia coli (strain:K12) DNA, clone_lib:Kohara lambda minise]
[DB:genpept-bct1] [DE:E.coli genomic DNA, Kohara clone #445(60.2-60.6 min.).]
[NT:similar to [PIR Accession Number JS0129]] [LE:9482] [RE:10546] [DI:direct]
>gp:[GI:g147374] [LN:ECOPROU] [AC:M24856] [OR:Escherichia coli] [SR:E.coli (K12)
DNA] [DB:genpept-bct1] [DE:E.coli proV, proW and proX genes (proU operon),
complete cds.] [NT:proW peptide] [LE:1883] [RE:2947] [DI:direct]
>gp:[GI:g1789033] [LN:AE000352] [AC:AE000352:U00096] [PN:high-affinity transport
system for glycine] [GN:proW] [FN:transport; Transport of small molecules: Amino]
[OR:Escherichia coli] [DB:genpept-bct2] [DE:Escherichia coli K-12 MG1655 section
242 of 400 of the completegenome.] [NT:o354; CG Site No. 18019; 100 pct
identical] [LE:7211] [RE:8275] [DI:direct]

| ORF Name | NT ID | AA ID | NT/LN | AA/LN | Score | P-value |
|---|---|---|---|---|---|---|
| 25567885_c2_1779 | 2898 | 10069 | 525 | 174 | 904 | 1.3e-90 |

Description gp:[GI:d1042584:g5103173] [LN:AP000342] [AC:AP000342] [PN:IS1 transposition protein] [GN:insB] [OR:Plasmid R100] [SR:Plasmid R100 (specific_host:Shigella flexneri 2b strain 222] [DB:genpept-bct1] [DE:Plasmid R100 genomic DNA.] [NT:100% identical to gp:ECAE000134_5[IS1 protein] [LE:21474] [RE:21977] [DI:direct] >gp:[GI:d1042676:g5103265] [LN:AP000342] [AC:AP000342] [PN:IS1 transposition protein] [GN:insB] [OR:Plasmid R100] [SR:Plasmid R100 (specific_host:Shigella flexneri 2b strain 222] [DB:genpept-bct1] [DE:Plasmid R100 genomic DNA.] [NT:100% identical to gp:ECAE000134_5[IS1 protein] [LE:93763] [RE:94266] [DI:direct] >gp:[GI:g673426] [LN:ISIS1X] [AC:V00609] [GN:insB] [OR:Escherichia coli] [DB:genpept-bct1] [DE:E.coli insertion sequence 1.] [SP:P03830] [LE:250] [RE:753] [DI:direct] >gp:[GI:g755079] [LN:SYNISR] [AC:M27083] [GN:insB] [FN:transposition of insertion sequence IS/R] [OR:synthetic construct] [SR:Artificial gene DNA] [DB:genpept-syn] [DE:Synthetic insertion sequence IS/R encoding insA and insB genes bothessential for transposition.] [LE:259] [RE:762] [DI:direct]

| ORF Name | NT ID | AA ID | NT/LN | AA/LN | Score | P-value |
|---|---|---|---|---|---|---|
| 25652308_c1_1159 | 2899 | 10070 | 762 | 253 | 1160 | 9.9e-118 |

Description sp:[LN:CBIH_SALTY] [AC:Q05590] [GN:CBIH] [OR:Salmonella typhimurium] [EC:2.1.1.131] [DE:METHYLTRANSFERASE) (PRECORRIN-3 METHYLASE)] [SP:Q05590] [DB:swissprot] >gp:[GI:g154428] [LN:STYVB12AA] [AC:L12006] [PN:precorrin methylase] [GN:cbiH] [OR:Salmonella typhimurium] [SR:Salmonella typhimurium (strain LT2) DNA] [DB:genpept-bct1] [DE:Salmonella typhimurium vitamin B12/cobalamin biosynthetic (cob)operon 5' end including: (cbiA, cbiB, cbiC, cbiD, cbiE, cbiT, cbiF,cbiG, cbiH, cbiJ, cbiK, cbiL, cbiM, cbiN, cbiQ, cbiO, cbiP, cobU,cobS, cobT) genes and regulatory protein (PocR).] [NT:putative] [LE:8365] [RE:9090] [DI:direct]

| ORF Name | NT ID | AA ID | NT/LN | AA/LN | Score | P-value |
|---|---|---|---|---|---|---|
| 25881876_c3_2000 | 2900 | 10071 | 630 | 209 | 947 | 3.7e-95 |

Description sp:[LN:HYCB_ECOLI] [AC:P16428:Q46883] [GN:HYCB:HEVB] [OR:Escherichia coli] [DE:COMPONENT B)] [SP:P16428:Q46883] [DB:swissprot] >sp:[LN:H65052] [AC:H65052:S08620] [PN:hydrogenase, 3 chain 2:formate hydrogenlyase chain 2:hydrogenase-3 protein B] [GN:hycB] [CL:nrfC protein:ferredoxin 2[4Fe-4S] homology] [OR:Escherichia coli] [EC:1.18.99.1] [DB:pir2] [MP:58 min] >gp:[GI:g882617] [LN:ECU29579] [AC:U29579] [PN:formate hydrogenlyase subunit 2] [GN:hycB] [OR:Escherichia coli] [DB:genpept-bct1] [DE:Escherichia coli K-12 genome; approximately 61 to 62 minutes.] [NT:GTG start; CG Site no. 33169; alternate gene name] [LE:21542] [RE:22153] [DI:complement] >gp:[GI:g1789079] [LN:AE000356] [AC:AE000356:U00096] [PN:probable small subunit of hydrogenase-3,] [GN:hycB] [FN:putative enzyme; Energy metabolism, carbon:] [OR:Escherichia coli] [DB:genpept-bct2] [DE:Escherichia coli K-12 MG1655 section 246 of 400 of the completegenome.] [NT:f203; 99 pct identical to HYCB_ECOLI SW: P16428;] [LE:6775] [RE:7386] [DI:complement]

| ORF_Name | NT_ID | AA_ID | NT/LN | AA/LN | Score | P-value |
|---|---|---|---|---|---|---|
| 2594131_f3_1041 | 2901 | 10072 | 1248 | 415 | 1650 | 1.2e-169 |

Description gp:[GI:g5069465] [LN:AF026270] [AC:AF026270:L31414] [PN:PduW] [GN:pduW]
[OR:Salmonella enterica serovar Typhimurium] [DB:genpept-bct2] [DE:Salmonella
enterica serovar Typhimurium PocR (pocR) gene, partialcds; PduF (pudF) gene,
complete cds and pdu operon, completesequence.] [NT:probable propionate kinase;
related to Ack (acetate] [LE:17056] [RE:18255] [DI:direct]

| ORF_Name | NT_ID | AA_ID | NT/LN | AA/LN | Score | P-value |
|---|---|---|---|---|---|---|
| 26042083_c3_2030 | 2902 | 10073 | 951 | 316 | 354 | 2.6e-32 |

Description sp:[LN:C69992] [AC:C69992] [PN:ABC transporter (ATP-binding protein) homolog
ytgB] [GN:ytgB] [CL:ATP-binding cassette homology] [OR:Bacillus subtilis]
[DB:pir2] >gp:[GI:e1185949:g2635560] [LN:BSUB0016] [AC:Z99119:AL009126] [GN:ytgB]
[FN:unknown] [OR:Bacillus subtilis] [DB:genpept-bct1] [DE:Bacillus subtilis
complete genome (section 16 of 21): from 2997771to 3213410.] [NT:similar to ABC
transporter (ATP-binding protein)] [LE:145577] [RE:146329] [DI:complement]
>gp:[GI:g2293152] [LN:AF008220] [AC:AF008220] [PN:putative transporter] [GN:ytgB]
[OR:Bacillus subtilis] [DB:genpept-bct2] [DE:Bacillus subtilis rrnB-dnaB genomic
region.] [NT:similar to iron (III) dicitrate transporter of E.] [LE:34098]
[RE:34850] [DI:direct]

| ORF_Name | NT_ID | AA_ID | NT/LN | AA/LN | Score | P-value |
|---|---|---|---|---|---|---|
| 26063391_f1_101 | 2903 | 10074 | 1155 | 384 | 1464 | 6.1e-150 |

Description sp:[LN:C65051] [AC:C65051] [PN:rubredoxin--NAD+ reductase,:hypothetical protein
hydA 3'-region] [GN:ygbD] [CL:rubredoxin--NAD+ reductase rubB] [OR:Escherichia
coli] [EC:1.18.1.1] [DB:pir2] >gp:[GI:g882604] [LN:ECU29579] [AC:U29579]
[OR:Escherichia coli] [DB:genpept-bct1] [DE:Escherichia coli K-12 genome;
approximately 61 to 62 minutes.] [NT:ORF_o377] [LE:6216] [RE:7349] [DI:direct]
>gp:[GI:g1789065] [LN:AE000355] [AC:AE000355:U00096] [PN:putative oxidoreductase]
[GN:ygbD] [FN:putative enzyme; Not classified] [OR:Escherichia coli]
[DB:genpept-bct2] [DE:Escherichia coli K-12 MG1655 section 245 of 400 of the
completegenome.] [NT:o377; 99 pct identical to 235 aa fragment] [LE:1522]
[RE:2655] [DI:direct]

| ORF_Name | NT_ID | AA_ID | NT/LN | AA/LN | Score | P-value |
|---|---|---|---|---|---|---|
| 26071952_f2_394 | 2904 | 10075 | 363 | 120 | 208 | 7.6e-17 |

Description gp:[GI:g642965] [LN:ABCARRA] [AC:X70360] [GN:carR] [OR:Azospirillum brasilense]
[DB:genpept-bct1] [DE:A.brasilense carR gene.] [NT:ORF2] [LE:59] [RE:580]
[DI:direct]

| ORF Name | NT ID | AA ID | NT LN | AA LN | Score | P-value |
|---|---|---|---|---|---|---|
| 26303906_c3_1792 | 2905 | 10076 | 735 | 244 | 446 | 4.6e-42 |

Description sp:[LN:C65065] [AC:C65065] [PN:prepilin peptidase dependent protein A precursor]
[GN:ppdA] [OR:Escherichia coli] [DB:pir2] >gp:[GI:g882718] [LN:ECU29581]
[AC:U29581] [PN:prepilin peptidase dependent protein A] [GN:ppdA] [OR:Escherichia
coli] [DB:genpept-bct1] [DE:Escherichia coli K-12 genome; approximately 63 to 64
minutes.] [LE:45262] [RE:45732] [DI:complement] >gp:[GI:g1789190] [LN:AE000366]
[AC:AE000366:U00096] [PN:prepilin peptidase dependent protein A]
[FN:putative enzyme; Not classified] [OR:Escherichia coli] [DB:genpept-bct2]
[DE:Escherichia coli K-12 MG1655 section 256 of 400 of the completegenome.]
[NT:f156; 99 pct identical to PPDA_ECOLI SW: P33554] [LE:4765] [RE:5235]
[DI:complement]

| ORF Name | NT ID | AA ID | NT LN | AA LN | Score | P-value |
|---|---|---|---|---|---|---|
| 26367163_f2_403 | 2906 | 10077 | 660 | 219 | 451 | 1.3e-42 |

Description sp:[LN:G64892] [AC:G64892:S55810:S55808] [PN:[acyl-carrier-protein]
phosphodiesterase, acpD] [GN:acpD] [CL:acyl carrier protein phosphodiesterase]
[OR:Escherichia coli] [EC:3.1.4.14] [DB:pir2] >gp:[GI:d1015742:g1742298]
[LN:D90779] [AC:D90779:D90761:AB001340] [PN:Acyl carrier protein
phosphodiesterase (ACP) [OR:Escherichia coli] [SR:Escherichia coli (strain:K12)
DNA, clone_lib:Kohara lambda minise] [DB:genpept-bct1] [DE:E.coli genomic DNA,
Kohara clone #268(31.6-32.0 min.).] [NT:ORF_ID:o268#8; similar to [SwissProt
Accession] [LE:14964] [RE:15569] [DI:complement] >gp:[GI:d1015746:g1742303]
[LN:D90780] [AC:D90780:AB001340] [PN:Acyl carrier protein phosphodiesterase (ACP)
[OR:Escherichia coli] [SR:Escherichia coli (strain:K12) DNA, clone_lib:Kohara
lambda minise] [DB:genpept-bct1] [DE:E.coli genomic DNA, Kohara clone
269(31.8-32.1 min.).] [NT:ORF_ID:o268#8; similar to [SwissProt Accession]
[LE:5107] [RE:5712] [DI:complement] >gp:[GI:g1787680] [LN:AE000238]
[AC:AE000238:U00096] [PN:acyl carrier protein phosphodiesterase] [GN:acpD]
[FN:enzyme; Fatty acid and phosphatidic acid] [OR:Escherichia coli]
[DB:genpept-bct2] [DE:Escherichia coli K-12 MG1655 section 128 of 400 of the
completegenome.] [NT:f201; 90 pct identical to ACPD_ECOLI SW: P41407 but]
[LE:8168] [RE:8773] [DI:complement]

| ORF_Name | NT_ID | AA_ID | NT/LN | AA/LN | Score | P-value |
|---|---|---|---|---|---|---|
| 26433540_c1_1357 | 2907 | 10078 | 1233 | 410 | 1652 | 7.3e-170 |

Description sp:[LN:MLTB_ECOLI] [AC:P41052] [GN:MLTB] [OR:Escherichia coli] [EC:3.2.1.-]
[DE:(MUREIN HYDROLASE B) (35 KD SOLUBLE LYTIC TRANSGLYCOSYLASE) (SLT35)]
[SP:P41052] [DB:swissprot] >sp:[LN:A65050] [AC:A65050:S65868:S77642]
[PN:membrane-bound lytic transglycosylase, B precursor:mltB protein] [GN:mltB]
[OR:Escherichia coli] [EC:3.2.1.-] [DB:pir2] >gp:[GI:d1017295:g1800087]
[LN:D90892] [AC:D90892:AB001340] [PN:MEMBRANE-BOUND LYTIC MUREIN TRANSGLYCOSYLASE
B] [GN:mltB] [OR:Escherichia coli] [SR:Escherichia coli (strain:K12) DNA,
clone_lib:Kohara lambda minise] [DB:genpept-bct1] [DE:E.coli genomic DNA, Kohara
clone #446(60.5-60.9 min.).] [NT:similar to [SwissProt Accession Number P41052]]
[LE:13397] [RE:14482] [DI:complement] >gp:[GI:g1789053] [LN:AE000354]
[AC:AE000354:U00096] [PN:membrane-bound lytic murein transglycosylase B]
[GN:mltB] [FN:enzyme; Murein sacculus, peptidoglycan] [OR:Escherichia coli]
[DB:genpept-bct2] [EC:3.2.1.-] [DE:Escherichia coli K-12 MG1655 section 244 of
400 of the completegenome.] [NT:f361; 100 pct identical to MLTB_ECOLI SW:
P41052;] [LE:2447] [RE:3532] [DI:complement] >gp:[GI:g642538] [LN:ECU18785]
[AC:U18785] [PN:membrane-bound lytic transglycosylase precursor] [GN:mltB]
[OR:Escherichia coli] [DB:genpept-bct2] [DE:Escherichia coli membrane-bound lytic
transglycosylase (mltB) gene,and YgaD (ygaD) gene, complete cds.] [LE:151]
[RE:1236] [DI:direct]

| ORF_Name | NT_ID | AA_ID | NT/LN | AA/LN | Score | P-value |
|---|---|---|---|---|---|---|
| 26448587_f1_96 | 2908 | 10079 | 792 | 263 | 1209 | 6.4e-123 |

Description sp:[LN:SRLD_ECOLI] [AC:P05707] [GN:SRLD:GUTD] [OR:Escherichia coli]
[EC:1.1.1.140] [DE:PHOSPHATE DEHYDROGENASE) (KETOSEPHOSPHATE REDUCTASE)]
[SP:P05707] [DB:swissprot] >sp:[LN:DEECSP] [AC:E65050:C26725:S11015]
[PN:sorbitol-6-phosphate 2-dehydrogenase,:glucitol-6-phosphate dehydrogenase]
[GN:srlD:gutD] [CL:ribitol dehydrogenase:short-chain alcohol dehydrogenase
homology] [OR:Escherichia coli] [EC:1.1.1.140] [DB:pir1] [MP:58 min]
>gp:[GI:d1017299:g1800091] [LN:D90892] [AC:D90892:AB001340]
[PN:SORBITOL-6-PHOSPHATE 2-DEHYDROGENASE (EC] [GN:gutD] [OR:Escherichia coli]
[SR:Escherichia coli (strain:K12) DNA, clone_lib:Kohara lambda minise]
[DB:genpept-bct1] [DE:E.coli genomic DNA, Kohara clone #446(60.5-60.9 min.).]
[NT:similar to [SwissProt Accession Number P05707]] [LE:16643] [RE:17422]
[DI:direct] >gp:[GI:g882597] [LN:ECU29579] [AC:U29579] [PN:glucitol-6-phosphate
dehydrogenase (sorbitol-6-] [GN:gutD] [OR:Escherichia coli] [DB:genpept-bct1]
[EC:1.1.1.140] [DE:Escherichia coli K-12 genome; approximately 61 to 62 minutes.]
[NT:CG Site No. 153; alternate gene name srlD] [LE:39] [RE:818] [DI:direct]
>gp:[GI:g1789057] [LN:AE000354] [AC:AE000354:U00096] [PN:glucitol
(sorbitol)-6-phosphate dehydrogenase] [GN:srlD] [FN:enzyme; Degradation of small
molecules: Carbon] [OR:Escherichia coli] [DB:genpept-bct2] [EC:1.1.1.140]
[DE:Escherichia coli K-12 MG1655 section 244 of 400 of the completegenome.]
[NT:o259; 99 pct identical to SRLD_ECOLI SW: P05707; CG] [LE:5693] [RE:6472]
[DI:direct]

| ORF Name | NT ID | AA ID | NT LN | AA LN | Score | P-value |
|---|---|---|---|---|---|---|
| 26460280_f2_672 | 2909 | 10080 | 294 | 97 | 426 | 6.0e-40 |

Description gp:[GI:g5069453] [LN:AF026270] [AC:AF026270:L31414] [PN:PduJ] [GN:pduJ] [OR:Salmonella enterica serovar Typhimurium] [DB:genpept-bct2] [DE:Salmonella enterica serovar Typhimurium PocR (pocR) gene, partialcds; PduF (pudF) gene, complete cds and pdu operon, completesequence.] [NT:related to the major shell proteins of] [LE:8642] [RE:8917] [DI:direct]

| ORF Name | NT ID | AA ID | NT LN | AA LN | Score | P-value |
|---|---|---|---|---|---|---|
| 26460827_c2_1697 | 2910 | 10081 | 333 | 110 | 159 | 1.2e-11 |

Description sp:[LN:OSMY_ECOLI] [AC:P27291] [GN:OSMY] [OR:Escherichia coli] [DE:OSMOTICALLY INDUCIBLE PROTEIN Y PRECURSOR] [SP:P27291] [DB:swissprot] >sp:[LN:A41899] [AC:A41899:S56600:A49909:G65252] [PN:hyperosmotically inducible periplasmic protein osmY:csi-5] [GN:osmY] [OR:Escherichia coli] [DB:pir2] >gp:[GI:g147148] [LN:ECOPERPLAS] [AC:M89635] [PN:periplasmic protein] [OR:Escherichia coli] [SR:Escherichia coli (strain K-12) DNA] [DB:genpept-bct1] [DE:Escherichia coli K-12 periplasmic protein gene, complete cds.] [NT:Hyperosmotically induced periplasmic protein with] [LE:366] [RE:971] [DI:direct] >gp:[GI:g537216] [LN:ECOUW93] [AC:U14003] [PN:periplasmic protein] [GN:osmY] [OR:Escherichia coli] [DB:genpept-bct1] [DE:Escherichia coli K-12 chromosomal region from 92.8 to 00.1 minutes.] [LE:302227] [RE:302832] [DI:direct] >gp:[GI:g1790836] [LN:AE000508] [AC:AE000508:U00096] [PN:hyperosmotically inducible periplasmic protein] [GN:osmY] [FN:phenotype; Osmotic adaptation] [OR:Escherichia coli] [DB:genpept-bct2] [DE:Escherichia coli K-12 MG1655 section 398 of 400 of the completegenome.] [NT:o201; 100 pct identical amino acid sequence and] [LE:2044] [RE:2649] [DI:direct]

| ORF Name | NT ID | AA ID | NT LN | AA LN | Score | P-value |
|---|---|---|---|---|---|---|
| 26578541_c3_1901 | 2911 | 10082 | 1416 | 471 | | |

Description

NO-HIT

| ORF Name | NT ID | AA ID | NT LN | AA LN | Score | P-value |
|---|---|---|---|---|---|---|
| 26580056_c2_1620 | 2912 | 10083 | 324 | 107 | 104 | 7.9e-06 |

Description sp:[LN:G72704] [AC:G72704] [PN:hypothetical protein APE1054] [GN:APE1054] [OR:Aeropyrum pernix] [DB:pir2] >gp:[GI:d1043825;g5104724] [LN:AP000060] [AC:AP000060] [PN:109aa long hypothetical protein] [GN:APE1054] [OR:Aeropyrum pernix] [SR:Aeropyrum pernix (strain:K1) DNA] [DB:genpept-bct1] [DE:Aeropyrum pernix genomic DNA, section 3/7.] [LE:309099] [RE:309428] [DI:complement]

| ORF Name | NT ID | AA ID | NT LN | AA LN | Score | P-value |
|---|---|---|---|---|---|---|
| 26588508_f3_769 | 2913 | 10084 | 480 | 159 | 601 | 1.7e-58 |

Description gp:[GI:d1017270:g1800061] [LN:D90891] [AC:D90891:AB001340] [GN:MG230]
[OR:Escherichia coli] [SR:Escherichia coli (strain:K12) DNA, clone_lib:Kohara
lambda minise] [DB:genpept-bct1] [DE:E.coli genomic DNA, Kohara clone
445(60.2-60.6 min.).] [NT:similar to [SwissProt Accession Number P47472]]
[LE:4193] [RE:4846] [DI:direct]

| ORF Name | NT ID | AA ID | NT LN | AA LN | Score | P-value |
|---|---|---|---|---|---|---|
| 26600416_f2_674 | 2914 | 10085 | 639 | 212 | 861 | 4.8e-86 |

Description gp:[GI:g5069455] [LN:AF026270] [AC:AF026270:L31414] [PN:PduL] [GN:pduL]
[OR:Salmonella enterica serovar Typhimurium] [DB:genpept-bct2] [DE:Salmonella
enterica serovar Typhimurium PocR (pocR) gene, partialcds; PduF (pudF) gene,
complete cds and pdu operon, completesequence.] [NT:related to phycocyanobilin
lyase CpcE; required for] [LE:9403] [RE:10035] [DI:direct]

| ORF Name | NT ID | AA ID | NT LN | AA LN | Score | P-value |
|---|---|---|---|---|---|---|
| 26661533_f1_4 | 2915 | 10086 | 1212 | 403 | 793 | 7.7e-79 |

Description gp:[GI:e256814:g1707644] [LN:PAMEXEFOP] [AC:X99514] [GN:mexE] [FN:periplasmic
link protein of multidrug efflux] [OR:Pseudomonas aeruginosa] [DB:genpept-bct1]
[DE:P.aeruginosa mexE, mexF & oprN genes.] [LE:173] [RE:1417] [DI:direct]

| ORF Name | NT ID | AA ID | NT LN | AA LN | Score | P-value |
|---|---|---|---|---|---|---|
| 26737512_c3_1925 | 2916 | 10087 | 810 | 269 | 1195 | 1.9e-121 |

Description sp:[LN:MAZG_ECOLI] [AC:P33646] [GN:MAZG] [OR:Escherichia coli] [DE:MAZG PROTEIN]
[SP:P33646] [DB:swissprot] >sp:[LN:A65060] [AC:A65060] [PN:mazG protein]
[GN:mazG] [CL:beta-lactamase regulatory protein:beta-lactamase regulatory protein
homology] [OR:Escherichia coli] [DB:pir2] >gp:[GI:g1789144] [LN:AE000362]
[AC:AE000362:U00096] [PN:orf, hypothetical protein] [GN:mazG] [FN:orf; Unknown]
[OR:Escherichia coli] [DB:genpept-bct2] [DE:Escherichia coli K-12 MG1655 section
252 of 400 of the completegenome.] [NT:f263; 99 pct identical (1 gap) to
MAZG_ECOLI] [LE:144] [RE:935] [DI:complement] >gp:[GI:g882675] [LN:ECU29580]
[AC:U29580] [GN:mazG] [OR:Escherichia coli] [DB:genpept-bct2] [DE:Escherichia
coli K-12 genome; approximately 62 minute region.] [NT:CG Site No. 33299]
[LE:7759] [RE:8550] [DI:complement]

981

| ORF_Name | NT ID | AA ID | NT/LN | AA/LN | Score | P-value |
|---|---|---|---|---|---|---|
| 26737650_f1_235 | 2917 | 10088 | 1308 | 435 | 2021 | 5.7e-209 |

Description sp:[LN:SDAC_ECOLI] [AC:P36559] [GN:SDAC] [OR:Escherichia coli] [DE:SERINE
TRANSPORTER] [SP:P36559] [DB:swissprot] >sp:[LN:S45633] [AC:S45633:H65061]
[PN:serine transport protein sdaC] [GN:sdaC] [CL:threonine-serine permease]
[OR:Escherichia coli] [DB:pir2] >gp:[GI:g402256] [LN:ECU01233] [AC:U01233]
[PN:putative serine transporter] [GN:sdaC] [OR:Escherichia coli]
[DB:genpept-bct1] [DE:Escherichia coli K-12 putative serine transporter (sdaC)
gene,complete cds.] [LE:803] [RE:2092] [DI:direct] >gp:[GI:g882691] [LN:ECU29581]
[AC:U29581] [PN:putative serine transporter] [GN:sdaC] [OR:Escherichia coli]
[DB:genpept-bct1] [DE:Escherichia coli K-12 genome; approximately 63 to 64
minutes.] [NT:CG Site no. 33329; ORF_o429] [LE:9784] [RE:11073] [DI:direct]
>gp:[GI:g1789160] [LN:AE000363] [AC:AE000363:U00096] [PN:probable serine
transporter] [GN:sdaC] [FN:putative transport; Transport of small]
[OR:Escherichia coli] [DB:genpept-bct2] [DE:Escherichia coli K-12 MG1655 section
253 of 400 of the completegenome.] [NT:o429; 100 pct identical to SDAC_ECOLI SW:
P36559;] [LE:5942] [RE:7231] [DI:direct]

| ORF_Name | NT ID | AA ID | NT/LN | AA/LN | Score | P-value |
|---|---|---|---|---|---|---|
| 26752340_c3_2031 | 2918 | 10089 | 894 | 297 | 423 | 1.2e-39 |

Description sp:[LN:ADHS_STRGC] [AC:P42364] [GN:SCAA] [OR:Streptococcus gordonii challis]
[DE:COAGGREGATION-MEDIATING ADHESIN PRECURSOR] [SP:P42364] [DB:swissprot]
>sp:[LN:T11551] [AC:T11551] [PN:adhesin] [GN:scaA] [CL:adhesin B]
[OR:Streptococcus gordonii] [DB:pir2] >gp:[GI:g310633] [LN:STRSCAA] [AC:L11577]
[PN:adhesin] [GN:scaA] [FN:coaggregation mediating adhesin] [OR:Streptococcus
gordonii] [SR:Streptococcus gordonii (strain PK488) DNA] [DB:genpept-bct1]
[DE:Streptococcus gordonii coaggregation mediating adhesin (scaA), ATPbinding
protein, hydrophobic membrane protein, complete cds, andzinc metalloprotease
gene, partial cds.] [LE:3418] [RE:4350] [DI:direct]

| ORF Name | NT ID | AA ID | NT/LN | AA/LN | Score | P-value |
|---|---|---|---|---|---|---|
| 26753130_c3_2036 | 2919 | 10090 | 204 | 67 | 298 | 2.2e-26 |

Description sp:[LN:CSRA_ECOLI] [AC:P31803] [GN:CSRA:ZFIA] [OR:Escherichia coli] [DE:CARBON
STORAGE REGULATOR] [SP:P31803] [DB:swissprot] >sp:[LN:B40608] [AC:B40608:D65049]
[PN:glycogen biosynthesis inhibitor csrA:carbon storage regulator (csrA)]
[GN:csrA] [CL:glycogen biosynthesis inhibitor] [OR:Escherichia coli] [DB:pir1]
>gp:[GI:d1017290:g1800082] [LN:D90892] [AC:D90892:AB001340] [PN:CARBON STORAGE
REGULATOR.] [GN:csrA] [OR:Escherichia coli] [SR:Escherichia coli (strain:K12)
DNA, clone_lib:Kohara lambda minise] [DB:genpept-bct1] [DE:E.coli genomic DNA,
Kohara clone #446(60.5-60.9 min.).] [NT:similar to [SwissProt Accession Number
P31803]] [LE:7867] [RE:8052] [DI:complement] >gp:[GI:d1022405:g2281030]
[LN:ECOALAS3] [AC:D44453] [PN:ZfiA protein] [GN:zfiA] [FN:modulator of
interaction between LetD protein] [OR:Escherichia coli] [SR:Escherichia coli
(isolate:KP4714) DNA, clone_lib:Kohar] [DB:genpept-bct1] [DE:Escherichia coli DNA
for ZfiA protein and alanyl t-RNA synthetase,complete cds,tRNA-Arg and tRNA-Ser.]
[LE:473] [RE:658] [DI:direct] >gp:[GI:g304882] [LN:ECOCSRASER] [AC:L07596]
[PN:carbon storage regulator] [GN:csrA] [OR:Escherichia coli] [SR:Escherichia
coli (strain K-12) DNA] [DB:genpept-bct1] [DE:Escherichia coli carbon storage
regulator (csrA) gene, completecds, alaS gene, 3' end, and serV promoter region.]
[LE:271] [RE:456] [DI:direct] >gp:[GI:g1789047] [LN:AE000353]
[AC:AE000353:U00096] [PN:carbon storage regulator; controls glycogen] [GN:csrA]
[FN:regulator; Global regulatory functions] [OR:Escherichia coli]
[DB:genpept-bct2] [DE:Escherichia coli K-12 MG1655 section 243 of 400 of the
completegenome.] [NT:f61; 100 pct identical to CSRA_ECOLI SW: P31803] [LE:9437]
[RE:9622] [DI:complement]

| ORF Name | NT ID | AA ID | NT/LN | AA/LN | Score | P-value |
|---|---|---|---|---|---|---|
| 26767257_f2_625 | 2920 | 10091 | 1326 | 441 | 2050 | 4.9e-212 |

Description sp:[LN:FUCP_ECOLI] [AC:P11551] [GN:FUCP] [OR:Escherichia coli] [DE:L-FUCOSE
PERMEASE] [SP:P11551] [DB:swissprot] >sp:[LN:WQECFP]
[AC:JS0184:C33495:S49565:E65062] [PN:L-fucose permease] [GN:fucP] [CL:fucose
permease] [OR:Escherichia coli] [DB:pir1] [MP:60 min] >gp:[GI:g41504]
[LN:ECFUCOSE] [AC:X15025] [OR:Escherichia coli] [DB:genpept-bct1] [DE:Escherichia
coli fucose operon.] [NT:fucP ORF (AA 1-438)] [SP:P11551] [LE:2608] [RE:3924]
[DI:direct] >gp:[GI:g882696] [LN:ECU29581] [AC:U29581] [PN:L-fucose permease]
[GN:fucP] [OR:Escherichia coli] [DB:genpept-bct1] [DE:Escherichia coli K-12
genome; approximately 63 to 64 minutes.] [NT:CG Site no. 10875; ORF_o438]
[LE:15790] [RE:17106] [DI:direct] >gp:[GI:g1789166] [LN:AE000364]
[AC:AE000364:U00096] [PN:fucose permease] [GN:fucP] [FN:transport; Transport of
small molecules:] [OR:Escherichia coli] [DB:genpept-bct2] [DE:Escherichia coli
K-12 MG1655 section 254 of 400 of the completegenome.] [NT:o438; 100 pct
identical to FUCP_ECOLI SW: P11551;] [LE:304] [RE:1620] [DI:direct]

| ORF_Name | NT_ID | AA_ID | NT/LN | AA/LN | Score | P-value |
|---|---|---|---|---|---|---|
| 26814203_c1_1312 | 2921 | 10092 | 1386 | 461 | 105 | 0.0063 |

Description gp:[GI:g2160524] [LN:AHU56832] [AC:U56832] [OR:Aeromonas hydrophila]
[DB:genpept-bct2] [DE:Aeromonas hydrophila FK506 binding protein (fkpA) gene,
completecds in 3.9 kb fragment.] [NT:ORF5; no significant similarity with known]
[LE:2969] [RE:3721] [DI:complement]

| ORF_Name | NT_ID | AA_ID | NT/LN | AA/LN | Score | P-value |
|---|---|---|---|---|---|---|
| 2851553_f2_386 | 2922 | 10093 | 744 | 247 | 116 | 5.6e-05 |

Description gp:[GI:g2655264] [LN:AF031161] [AC:AF031161] [PN:transcriptional activator]
[GN:stdR] [FN:activates transcription from std promoter] [OR:Pseudomonas sp.
VLB120] [DB:genpept-bct2] [DE:Pseudomonas sp. VLB120 styrene degradation genes
includinghistidine kinase (stdSc) gene, partial cds; and transcriptionalactivator
(stdR), styrene monooxygenase large component (stdA),styrene monooxygenase small
component (stdB), styrene oxideisomerase (stdC), and phenylacetaldehyde
dehydrogenase (stdD)genes, complete cds.] [NT:StdR; response regulator] [LE:842]
[RE:1465] [DI:direct]

| ORF_Name | NT_ID | AA_ID | NT/LN | AA/LN | Score | P-value |
|---|---|---|---|---|---|---|
| 2911290_c1_1435 | 2923 | 10094 | 234 | 77 | 367 | 1.1e-33 |

Description sp:[LN:IEECC7] [AC:A93826:A93117:S40546:A04452] [PN:hypothetical protein, 8K]
[CL:Escherichia coli insertion sequence IS1 hypothetical 7.6K protein]
[OR:Escherichia coli] [DB:pir1] >gp:[GI:d1001773:g285762] [LN:ECO110K]
[AC:D10483:J01597:J01683:J01706:K01298:K01990:M10420:M10611:M12544]
[OR:Escherichia coli] [SR:Escherichia coli (strain:K-12) DNA] [DB:genpept-bct1]
[DE:E.coli K12 genome, 0-2.4min. region.] [NT:IS1 hypothetical protein
C-70(PIR:A04452)] [LE:19988] [RE:20200] [DI:complement]

| ORF_Name | NT_ID | AA_ID | NT/LN | AA/LN | Score | P-value |
|---|---|---|---|---|---|---|
| 2914700_c1_1229 | 2924 | 10095 | 1323 | 440 | 1772 | 1.4e-182 |

Description sp:[LN:YGCA_ECOLI] [AC:P55135] [GN:YGCA] [OR:Escherichia coli] [EC:2.1.1.-]
[DE:(EC 2.1.1.-)] [SP:P55135] [DB:swissprot] >sp:[LN:E65060] [AC:E65060] [PN:ygcA
protein] [GN:ygcA] [CL:hypothetical protein HI0333] [OR:Escherichia coli]
[DB:pir2] >gp:[GI:g1789148] [LN:AE000362] [AC:AE000362:U00096] [PN:putative
enzyme] [GN:ygcA] [FN:putative enzyme; Not classified] [OR:Escherichia coli]
[DB:genpept-bct2] [DE:Escherichia coli K-12 MG1655 section 252 of 400 of the
completegenome.] [NT:f433; This 433 aa ORF is 26 pct identical (48 gaps)]
[LE:3949] [RE:5250] [DI:complement] >gp:[GI:g882679] [LN:ECU29580] [AC:U29580]
[OR:Escherichia coli] [DB:genpept-bct2] [DE:Escherichia coli K-12 genome;
approximately 62 minute region.] [NT:alternate gene name ygcA; ORF_f433]
[LE:11564] [RE:12865] [DI:complement]

| ORF_Name | NT_ID | AA_ID | NT LN | AA LN | Score | P-value |
|---|---|---|---|---|---|---|
| 292826_c2_1500 | 2925 | 10096 | 927 | 308 | 1407 | 6.7e-144 |

Description sp:[LN:POCR_SALTY] [AC:Q05587] [GN:POCR] [OR:Salmonella typhimurium] [DE:REGULATORY PROTEIN POCR] [SP:Q05587] [DB:swissprot] >gp:[GI:g2587036] [LN:AF026270] [AC:AF026270:L31414] [PN:PocR] [GN:pocR] [OR:Salmonella enterica serovar Typhimurium] [DB:genpept-bct2] [DE:Salmonella enterica serovar Typhimurium PocR (pocR) gene, partialcds; PduF (pudF) gene, complete cds and pdu operon, completesequence.] [NT:Transcriptional regulator; related to the AraC] [LE:<1] [RE:909] [DI:complement]

| ORF_Name | NT_ID | AA_ID | NT LN | AA LN | Score | P-value |
|---|---|---|---|---|---|---|
| 29303126_c1_1154 | 2926 | 10097 | 948 | 315 | 1220 | 4.4e-124 |

Description sp:[LN:CBIF_SALTY] [AC:Q05630] [GN:CBIF] [OR:Salmonella typhimurium] [EC:2.1.1.133] [DE:METHYLASE)] [SP:Q05630] [DB:swissprot] >gp:[GI:g154426] [LN:STYVB12AA] [AC:L12006] [PN:precorrin methylase] [GN:cbiF] [OR:Salmonella typhimurium] [SR:Salmonella typhimurium (strain LT2) DNA] [DB:genpept-bct1] [DE:Salmonella typhimurium vitamin B12/cobalamin biosynthetic (cob)operon 5' end including: (cbiA, cbiB, cbiC, cbiD, cbiE, cbiT, cbiF,cbiG, cbiH, cbiJ, cbiK, cbiL, cbiM, cbiN, cbiQ, cbiO, cbiP, cobU,cobS, cobT) genes and regulatory protein (PocR).] [NT:putative] [LE:6556] [RE:7329] [DI:direct]

| ORF_Name | NT_ID | AA_ID | NT LN | AA LN | Score | P-value |
|---|---|---|---|---|---|---|
| 29376262_f1_127 | 2927 | 10098 | 342 | 113 | 409 | 3.8e-38 |

Description sp:[LN:HYPC_ECOLI] [AC:P24191] [GN:HYPC] [OR:Escherichia coli] [DE:HYDROGENASE ISOENZYMES FORMATION PROTEIN HYPC] [SP:P24191] [DB:swissprot] >sp:[LN:S15199] [AC:S15199:D65053] [PN:hydrogenase expression/formation protein hypC] [GN:hypC] [CL:hydrogenase expression/formation protein hypC] [OR:Escherichia coli] [DB:pir2] >gp:[GI:g41777] [LN:ECHYP] [AC:X54543] [PN:hydrogenase isoenzyme hypC] [GN:hypC] [OR:Escherichia coli] [DB:genpept-bct1] [DE:E. coli hyp operon encoding hydrogenase isoenzymes.] [SP:P24191] [LE:1319] [RE:1591] [DI:direct] >gp:[GI:g882621] [LN:ECU29579] [AC:U29579] [GN:hypC] [FN:required for formation of all 3 hydrogenase] [OR:Escherichia coli] [DB:genpept-bct1] [DE:Escherichia coli K-12 genome; approximately 61 to 62 minutes.] [NT:CG Site no. 33113; ORF_o90] [LE:24168] [RE:24440] [DI:direct] >gp:[GI:g1789083] [LN:AE000356] [AC:AE000356:U00096] [PN:pleiotropic effects on 3 hydrogenase isozymes] [GN:hypC] [FN:phenotype; Energy metabolism, carbon: Anaerobic] [OR:Escherichia coli] [DB:genpept-bct2] [DE:Escherichia coli K-12 MG1655 section 246 of 400 of the completegenome.] [NT:o90; 100 pct identical to HYPC_ECOLI SW: P24191; CG] [LE:9401] [RE:9673] [DI:direct]

| ORF_Name | NT_ID | AA_ID | NT/LN | AA/LN | Score | P-value |
|---|---|---|---|---|---|---|
| 29398910_c2_1658 | 2928 | 10099 | 1878 | 625 | 2232 | 2.5e-231 |

Description sp:[LN:HYCC_ECOLI] [AC:P16429;Q46882] [GN:HYCC:HEVC] [OR:Escherichia coli]
[DE:COMPONENT C)] [SP:P16429;Q46882] [DB:swissprot] >sp:[LN:G65052]
[AC:G65052:S08621] [PN:hydrogenase, 3 chain 3:formate hydrogenlyase chain
3:hydrogenase-3 protein C] [GN:hycC] [CL:formate hydrogenlyase chain 3]
[OR:Escherichia coli] [EC:1.18.99.1] [DB:pir2] [MP:58 min] >gp:[GI:g2367154]
[LN:AE000356] [AC:AE000356:U00096] [PN:membrane-spanning protein of hydrogenase 3
(part] [GN:hycC] [FN:enzyme; Energy metabolism, carbon:] [OR:Escherichia coli]
[DB:genpept-bct2] [DE:Escherichia coli K-12 MG1655 section 246 of 400 of the
completegenome.] [NT:f608; 99 pct identical to HYCC_ECOLI SW: P16429; CG]
[LE:4952] [RE:6778] [DI:complement]

| ORF_Name | NT_ID | AA_ID | NT/LN | AA/LN | Score | P-value |
|---|---|---|---|---|---|---|
| 29507830_c1_1148 | 2929 | 10100 | 1539 | 512 | 1884 | 1.9e-194 |

Description sp:[LN:CBIA_SALTY] [AC:P29946] [GN:CBIA] [OR:Salmonella typhimurium]
[DE:COBYRINIC ACID A,C-DIAMIDE SYNTHASE] [SP:P29946] [DB:swissprot]
>gp:[GI:g154420] [LN:STYVB12AA] [AC:L12006] [PN:precorrin amidase] [GN:cbiA]
[OR:Salmonella typhimurium] [SR:Salmonella typhimurium (strain LT2) DNA]
[DB:genpept-bct1] [DE:Salmonella typhimurium vitamin B12/cobalamin biosynthetic
(cob)operon 5' end including: (cbiA, cbiB, cbiC, cbiD, cbiE, cbiT, cbiF,cbiG,
cbiH, cbiJ, cbiK, cbiL, cbiM, cbiN, cbiQ, cbiO, cbiP, cobU,cobS, cobT) genes and
regulatory protein (PocR).] [NT:putative] [LE:1288] [RE:2667] [DI:direct]

| ORF_Name | NT_ID | AA_ID | NT/LN | AA/LN | Score | P-value |
|---|---|---|---|---|---|---|
| 29533463_c2_1593 | 2930 | 10101 | 1431 | 476 | 1315 | 3.7e-134 |

Description gp:[GI:e288126;g1752671] [LN:NMCYSG] [AC:Y10177] [PN:sirohaem synthase] [GN:cysG]
[OR:Neisseria meningitidis] [DB:genpept-bct1] [EC:2.1.1.107] [DE:N.meningitidis
cysG gene.] [LE:247] [RE:1674] [DI:direct]

| ORF_Name | NT_ID | AA_ID | NT/LN | AA/LN | Score | P-value |
|---|---|---|---|---|---|---|
| 29860150_f1_309 | 2931 | 10102 | 318 | 105 | 438 | 3.2e-41 |

Description gp:[GI:g5069450] [LN:AF026270] [AC:AF026270:L31414] [PN:PduA] [GN:pduA]
[OR:Salmonella enterica serovar Typhimurium] [DB:genpept-bct2] [DE:Salmonella
enterica serovar Typhimurium PocR (pocR) gene, partialcds; PduF (pudF) gene,
complete cds and pdu operon, completesequence.] [NT:related to the major shell
proteins of] [LE:2446] [RE:2730] [DI:direct]

| ORF Name | NT ID | AA ID | NT LN | AA LN | Score | P-value |
|---|---|---|---|---|---|---|
| 29884456_c2_1604 | 2932 | 10103 | 843 | 280 | 1231 | 3.0e-125 |

Description sp:[LN:SURE_ECOLI] [AC:P36664] [GN:SURE] [OR:Escherichia coli] [DE:SURVIVAL PROTEIN SURE] [SP:P36664] [DB:swissprot] >sp:[LN:I69732] [AC:I69732:D65055] [PN:stationary-phase survival protein SurE] [GN:surE] [CL:stationary-phase survival protein SurE] [OR:Escherichia coli] [DB:pir2] >gp:[GI:g1036739] [LN:ECOPCMORFS] [AC:L07942] [GN:surE] [OR:Escherichia coli] [SR:Escherichia coli (strain MP180) DNA] [DB:genpept-bct1] [DE:Escherichia coli surE gene, complete cds and L-isoaspartylproteinmethyltransferase (pcm) gene, partial cds.] [NT:ORF2] [LE:1826] [RE:2587] [DI:direct] >gp:[GI:g1789101] [LN:AE000358] [AC:AE000358:U00096] [PN:survival protein] [GN:surE] [FN:phenotype; Not classified] [OR:Escherichia coli] [DB:genpept-bct2] [DE:Escherichia coli K-12 MG1655 section 248 of 400 of the completegenome.] [NT:f253; 100 pct identical to PIR: I69732; alternate] [LE:4487] [RE:5248] [DI:complement]

| ORF Name | NT ID | AA ID | NT LN | AA LN | Score | P-value |
|---|---|---|---|---|---|---|
| 29928331_c2_1614 | 2933 | 10104 | 273 | 90 | 251 | 2.1e-21 |

Description gp:[GI:g4741970] [LN:AF134589] [AC:AF134589] [PN:VdcD] [GN:vdcD] [OR:Streptomyces sp. D7] [DB:genpept-bct2] [DE:Streptomyces sp. D7 vanillic acid decarboxylation gene cluster,complete sequence.] [LE:2151] [RE:2390] [DI:direct]

| ORF Name | NT ID | AA ID | NT LN | AA LN | Score | P-value |
|---|---|---|---|---|---|---|
| 29969791_c1_1162 | 2934 | 10105 | 828 | 275 | 1176 | 2.0e-119 |

Description sp:[LN:CBIK_SALTY] [AC:Q05592] [GN:CBIK] [OR:Salmonella typhimurium] [DE:CBIK PROTEIN] [SP:Q05592] [DB:swissprot] >gp:[GI:g154430] [LN:STYVB12AA] [AC:L12006] [GN:cbiK] [OR:Salmonella typhimurium] [SR:Salmonella typhimurium (strain LT2) DNA] [DB:genpept-bct1] [DE:Salmonella typhimurium vitamin B12/cobalamin biosynthetic (cob)operon 5' end including: (cbiA, cbiB, cbiC, cbiD, cbiE, cbiT, cbiF,cbiG, cbiH, cbiJ, cbiK, cbiL, cbiM, cbiN, cbiQ, cbiO, cbiP, cobU,cobS, cobT) genes and regulatory protein (PocR).] [NT:putative] [LE:9881] [RE:10675] [DI:direct]

| ORF_Name | NT ID | AA ID | NT/LN | AA/LN | Score | P-value |
|---|---|---|---|---|---|---|
| 30109836_c2_1463 | 2935 | 10106 | 1335 | 444 | 1968 | 2.4e-203 |

Description sp:[LN:B65064] [AC:B65064] [PN:hypothetical protein b2817] [OR:Escherichia coli] [DB:pir2] >gp:[GI:g882709] [LN:ECU29581] [AC:U29581] [OR:Escherichia coli] [DB:genpept-bct1] [DE:Escherichia coli K-12 genome; approximately 63 to 64 minutes.] [NT:ORF_f447] [LE:29312] [RE:30655] [DI:complement] >gp:[GI:g1789180] [LN:AE000365] [AC:AE000365:U00096] [PN:putative amidase] [GN:b2817] [FN:putative enzyme; Not classified] [OR:Escherichia coli] [DB:genpept-bct2] [DE:Escherichia coli K-12 MG1655 section 255 of 400 of the completegenome.] [NT:f447; This 447 aa ORF is 47 pct identical (4 gaps)] [LE:1826] [RE:3169] [DI:complement]

| ORF_Name | NT ID | AA ID | NT/LN | AA/LN | Score | P-value |
|---|---|---|---|---|---|---|
| 30333260_f3_1039 | 2936 | 10107 | 477 | 158 | 524 | 2.5e-50 |

Description gp:[GI:g5069463] [LN:AF026270] [AC:AF026270:L31414] [PN:PduU] [GN:pduU] [OR:Salmonella enterica serovar Typhimurium] [DB:genpept-bct2] [DE:Salmonella enterica serovar Typhimurium PocR (pocR) gene, partialcds; PduF (pudF) gene, complete cds and pdu operon, completesequence.] [NT:related to EutS.] [LE:16249] [RE:16599] [DI:direct]

| ORF_Name | NT ID | AA ID | NT/LN | AA/LN | Score | P-value |
|---|---|---|---|---|---|---|
| 30713557_c1_1243 | 2937 | 10108 | 192 | 63 | 49 | 0.0063 |

Description gp:[GI:g1816543] [LN:IDU82586] [AC:U82586] [PN:cytochrome oxidase I] [GN:COI] [OR:Mitochondrion Ips duplicatus] [SR:Ips duplicatus] [DB:genpept-invl] [DE:Ips duplicatus cytochrome oxidase I (COI) gene, mitochondrial geneencoding mitochondrial protein, partial cds.] [LE:<1] [RE:>565] [DI:direct]

| ORF_Name | NT ID | AA ID | NT/LN | AA/LN | Score | P-value |
|---|---|---|---|---|---|---|
| 30714782_f2_428 | 2938 | 10109 | 765 | 254 | 432 | 1.4e-40 |

Description gp:[GI:e1420532:g4539550] [LN:RME132004] [AC:AJ132004] [PN:2-isopropylmalate synthase] [GN:leuA] [FN:leucine biosynthesis] [OR:Sinorhizobium meliloti] [DB:genpept-bct1] [DE:Rhizobium meliloti clpP and leuA genes, ORF83 and ORF142.] [LE:1194] [RE:2903] [DI:direct]

| ORF Name | NT ID | AA ID | NT/LN | AA/LN | Score | P-value |
|---|---|---|---|---|---|---|
| 31272042_c1_1122 | 2939 | 10110 | 1137 | 378 | 1377 | 1.0e-140 |

Description gp:[GI:g1895094] [LN:STU90625] [AC:U90625] [PN:CobD] [GN:cobD] [OR:Salmonella typhimurium] [DB:genpept-bct2] [DE:Salmonella typhimurium alpha-ribazole-5'-phosphate phospatase CobC(cobC) gene, partial cds and putative aminotransferase CobD (cobD)gene, complete cds.] [NT:putative aminotransferase involved in the] [LE:95] [RE:1189] [DI:direct]

| ORF Name | NT ID | AA ID | NT/LN | AA/LN | Score | P-value |
|---|---|---|---|---|---|---|
| 31272808_f2_606 | 2940 | 10111 | 363 | 120 | 120 | 1.8e-06 |

Description gp:[GI:e282242:g1679831] [LN:MAMAMIRM] [AC:X79027] [PN:unknown] [OR:Microbacterium ammoniaphilum] [DB:genpept-bct1] [DE:M.ammoniaphilum genes mamIR and mamIM.] [LE:3382] [RE:>4972] [DI:complement]

| ORF Name | NT ID | AA ID | NT/LN | AA/LN | Score | P-value |
|---|---|---|---|---|---|---|
| 31330131_f1_307 | 2941 | 10112 | 333 | 110 | | |

Description

NO-HIT

| ORF Name | NT ID | AA ID | NT/LN | AA/LN | Score | P-value |
|---|---|---|---|---|---|---|
| 31385155_f2_532 | 2942 | 10113 | 939 | 312 | 737 | 6.6e-73 |

Description sp:[LN:S54440] [AC:S54440] [PN:hemV protein] [CL:unassigned ATP-binding cassette proteins:ATP-binding cassette homology] [OR:Yersinia enterocolitica] [DB:pir2] >gp:[GI:e274427:g1619625] [LN:YEHEMSTUV] [AC:X77867] [PN:ATPase component] [GN:hemV] [OR:Yersinia enterocolitica] [DB:genpept-bct1] [DE:Y.enterocolitica hemS, hemT, hemU and hemV genes.] [LE:3008] [RE:3808] [DI:direct]

| ORF Name | NT ID | AA ID | NT/LN | AA/LN | Score | P-value |
|---|---|---|---|---|---|---|
| 31426882_f3_993 | 2943 | 10114 | 342 | 113 | | |

Description

NO-HIT

| ORF_Name | NT_ID | AA_ID | NT LN | AA LN | Score | P-value |
|---|---|---|---|---|---|---|
| 31432337_f2_488 | 2944 | 10115 | 372 | 123 | 478 | 1.9e-45 |

Description sp:[LN:HYPA_ECOLI] [AC:P24189] [GN:HYPA] [OR:Escherichia coli] [DE:HYPA PROTEIN] [SP:P24189] [DB:swissprot] >sp:[LN:S15197] [AC:S15197:B65053] [PN:hypA protein] [GN:hypA] [CL:hydrogenase accessory protein] [OR:Escherichia coli] [DB:pir1] >gp:[GI:g41775] [LN:ECHYP] [AC:X54543] [PN:hypA product] [GN:hypA] [OR:Escherichia coli] [DB:genpept-bct1] [DE:E. coli hyp operon encoding hydrogenase isoenzymes.] [SP:P24189] [LE:102] [RE:452] [DI:direct] >gp:[GI:g882619] [LN:ECU29579] [AC:U29579] [GN:hypA] [OR:Escherichia coli] [DB:genpept-bct1] [DE:Escherichia coli K-12 genome; approximately 61 to 62 minutes.] [NT:CG Site no. 33104; ORF_o116] [LE:22951] [RE:23301] [DI:direct] >gp:[GI:g1789081] [LN:AE000356] [AC:AE000356:U00096] [PN:pleiotrophic effects on 3 hydrogenase isozymes] [GN:hypA] [FN:phenotype; Energy metabolism, carbon: Anaerobic] [OR:Escherichia coli] [DB:genpept-bct2] [DE:Escherichia coli K-12 MG1655 section 246 of 400 of the completegenome.] [NT:o116; 100 pct identical to HYPA_ECOLI SW: P24189;] [LE:8184] [RE:8534] [DI:direct]

| ORF_Name | NT_ID | AA_ID | NT LN | AA LN | Score | P-value |
|---|---|---|---|---|---|---|
| 31541706_f1_328 | 2945 | 10116 | 924 | 307 | 1099 | 2.9e-111 |

Description gp:[GI:g5069466] [LN:AF026270] [AC:AF026270:L31414] [PN:PduX] [GN:pduX] [OR:Salmonella enterica serovar Typhimurium] [DB:genpept-bct2] [DE:Salmonella enterica serovar Typhimurium PocR (pocR) gene, partialcds; PduF (pudF) gene, complete cds and pdu operon, completesequence.] [LE:18313] [RE:19215] [DI:direct]

| ORF_Name | NT_ID | AA_ID | NT LN | AA LN | Score | P-value |
|---|---|---|---|---|---|---|
| 31656966_c2_1566 | 2946 | 10117 | 1551 | 516 | 2223 | 2.3e-230 |

Description sp:[LN:GUD2_ECOLI] [AC:Q46915] [GN:YGCY] [OR:Escherichia coli] [EC:4.2.1.40] [DE:PROBABLE GLUCARATE DEHYDRATASE 2, (GDH)] [SP:Q46915] [DB:swissprot] >sp:[LN:H65060] [AC:H65060] [PN:glucarate dehydratase homolog] [CL:glucarate dehydratase] [OR:Escherichia coli] [DB:pir2] >gp:[GI:g882683] [LN:ECU29581] [AC:U29581] [OR:Escherichia coli] [DB:genpept-bct1] [DE:Escherichia coli K-12 genome; approximately 63 to 64 minutes.] [NT:ORF_f446] [LE:961] [RE:2301] [DI:complement] >gp:[GI:g1789151] [LN:AE000362] [AC:AE000362:U00096] [PN:putative glucarate dehydratase] [GN:ygcY] [FN:putative enzyme; Not classified] [OR:Escherichia coli] [DB:genpept-bct2] [DE:Escherichia coli K-12 MG1655 section 252 of 400 of the completegenome.] [NT:f446; This 446 aa ORF is 66 pct identical (5 gaps)] [LE:9656] [RE:10996] [DI:complement]

| ORF Name | NT ID | AA ID | NT LN | AA LN | Score | P-value |
|---|---|---|---|---|---|---|
| 31681631_c1_1094 | 2947 | 10118 | 411 | 136 | 293 | 7.4e-26 |

Description sp:[LN:YGDB_ECOLI] [AC:P08370] [GN:YGDB] [OR:Escherichia coli] [DE:HYPOTHETICAL
13.5 KD PROTEIN IN PPDC-PPDB INTERGENIC REGION] [SP:P08370] [DB:swissprot]
>sp:[LN:QQEC13] [AC:D24137:A65065] [PN:hypothetical 13.5K protein (ppdC-ppdB
intergenic region)] [GN:ygdB] [CL:Escherichia coli hypothetical 13.5K protein
(ppdC-ppdB intergenic region)] [OR:Escherichia coli] [DB:pir1] [MP:61 min]
>gp:[GI:g42687] [LN:ECRECC] [AC:X03966] [OR:Escherichia coli] [DB:genpept-bct1]
[DE:E. coli recC gene and thyA-recC intergenic region including URF1-3.] [NT:URF2
(aa 1-121)] [SP:P08370] [LE:1856] [RE:2221] [DI:direct] >gp:[GI:g882716]
[LN:ECU29581] [AC:U29581] [OR:Escherichia coli] [DB:genpept-bct1] [DE:Escherichia
coli K-12 genome; approximately 63 to 64 minutes.] [NT:alternate name ygdB, URF2;
orf of X03966; 2nd] [LE:44304] [RE:44669] [DI:complement] >gp:[GI:g1789188]
[LN:AE000366] [AC:AE000366:U00096] [PN:orf, hypothetical protein] [GN:ygdB]
[FN:orf; Unknown] [OR:Escherichia coli] [DB:genpept-bct2] [DE:Escherichia coli
K-12 MG1655 section 256 of 400 of the completegenome.] [NT:f121; 100 pct
identical to YGDB_ECOLI SW: P08370;] [LE:3807] [RE:4172] [DI:complement]

| ORF Name | NT ID | AA ID | NT LN | AA LN | Score | P-value |
|---|---|---|---|---|---|---|
| 31697682_c2_1546 | 2948 | 10119 | 1512 | 503 | 108 | 0.0026 |

Description sp:[LN:S18586] [AC:S18586] [PN:probable mercury(II) reductase,:Hg(II)
reductase:merA protein:mercuric reductase] [CL:mercury(II)
reductase:dihydrolipoamide dehydrogenase homology:heavy-metal-associated
homology] [OR:Thiobacillus ferrooxidans] [EC:1.16.1.1] [DB:pir1] >gp:[GI:g48153]
[LN:TFMERRCG] [AC:X57326:S79623] [OR:Thiobacillus ferrooxidans] [DB:genpept-bct1]
[DE:T.ferrooxidans merR and merC genes.] [NT:ORF-1] [LE:1571] [RE:2992]
[DI:direct]

| ORF Name | NT ID | AA ID | NT LN | AA LN | Score | P-value |
|---|---|---|---|---|---|---|
| 31772967_f2_530 | 2949 | 10120 | 831 | 276 | 750 | 2.8e-74 |

Description sp:[LN:T12071] [AC:T12071] [PN:periplasmic binding protein] [GN:hmuT]
[OR:Yersinia pestis] [DB:pir2] >gp:[GI:g3776554] [LN:YPU60647] [AC:U60647]
[PN:periplasmic binding protein] [GN:hmuT] [OR:Yersinia pestis] [DB:genpept-bct2]
[DE:Yersinia pestis HmuP (hmuP), TonB-dependent outer membrane receptor(hmuR),
HmuS (hmuS), periplasmic binding protein (hmuT), ABC-typepermease (hmuU), and
ATP-binding protein (hmuV) genes, completecds; and unknown genes.] [NT:HmuT]
[LE:4771] [RE:5610] [DI:direct]

| ORF_Name | NT_ID | AA_ID | NT LN | AA LN | Score | P-value |
|---|---|---|---|---|---|---|
| 31896911_f1_56 | 2950 | 10121 | 1176 | 391 | 1416 | 7.4e-145 |

Description sp:[LN:RIR4_SALTY] [AC:P17424] [GN:NRDF] [OR:Salmonella typhimurium]
[EC:1.17.4.1] [DE:(RIBONUCLEOTIDE REDUCTASE 2) (R2F PROTEIN)] [SP:P17424]
[DB:swissprot] >sp:[LN:S34272] [AC:S34272:A45917] [PN:ribonucleoside-diphosphate
reductase,] [CL:ribonucleoside-diphosphate reductase beta] [OR:Salmonella
typhimurium] [EC:1.17.4.1] [DB:pir2] >gp:[GI:g311979] [LN:STNRD] [AC:X73226]
[PN:ribonucleoside-diphosphate reductase] [GN:nrdF] [OR:Salmonella typhimurium]
[DB:genpept-bct1] [EC:1.17.4.1] [DE:S.typhimurium nrdEF operon.] [SP:P17424]
[LE:2991] [RE:3950] [DI:direct]

| ORF_Name | NT_ID | AA_ID | NT LN | AA LN | Score | P-value |
|---|---|---|---|---|---|---|
| 31906668_f2_453 | 2951 | 10122 | 462 | 153 | 459 | 1.9e-43 |

Description sp:[LN:GUTM_ECOLI] [AC:P15081] [GN:GUTM:SRLM] [OR:Escherichia coli] [DE:GLUCITOL
OPERON ACTIVATOR PROTEIN] [SP:P15081] [DB:swissprot] >sp:[LN:S01831]
[AC:S01831:F65050] [PN:regulatory protein gutM:glucitol operon protein M]
[GN:gutM] [OR:Escherichia coli] [DB:pir2] >gp:[GI:d1017300:g1800092] [LN:D90892]
[AC:D90892:AB001340] [PN:GLUCITOL OPERON ACTIVATOR PROTEIN.] [GN:gutM]
[OR:Escherichia coli] [SR:Escherichia coli (strain:K12) DNA, clone_lib:Kohara
lambda minise] [DB:genpept-bct1] [DE:E.coli genomic DNA, Kohara clone
446(60.5-60.9 min.).] [NT:similar to [SwissProt Accession Number P15081]]
[LE:17527] [RE:17886] [DI:direct] >gp:[GI:g41629] [LN:ECGUTMR] [AC:X13463]
[OR:Escherichia coli] [DB:genpept-bct1] [DE:Escherichia coli gutM gene and gutR
gene for activator andrepressor proteins.] [NT:gut M protein (AA 1-119)]
[SP:P15081] [LE:353] [RE:712] [DI:direct] >gp:[GI:g882598] [LN:ECU29579]
[AC:U29579] [GN:gutM] [FN:glucitol operon activator] [OR:Escherichia coli]
[DB:genpept-bct1] [DE:Escherichia coli K-12 genome; approximately 61 to 62
minutes.] [NT:CG Site No. 33198; alternate gene name srlM] [LE:924] [RE:1283]
[DI:direct] >gp:[GI:g1789058] [LN:AE000354] [AC:AE000354:U00096] [PN:glucitol
operon activator] [GN:gutM] [FN:regulator; Degradation of small molecules:]
[OR:Escherichia coli] [DB:genpept-bct2] [DE:Escherichia coli K-12 MG1655 section
244 of 400 of the completegenome.] [NT:o119; 100 pct identical to GUTM_ECOLI SW:
P15081;] [LE:6577] [RE:6936] [DI:direct] >gp:[GI:g146281] [LN:ECOGUT]
[AC:J02708:M36721] [OR:Escherichia coli] [DB:genpept-bct2] [DE:E.coli glucitol
(gut) operon: glucitol-specific enzyme II (gutA),and III (gutB),
glucitol-6-phosphate dehydrogenase (gutD),activator (gutM) and repressor (gutR)
genes, complete cds.] [NT:gut operon activator (gutM)] [LE:3322] [RE:3681]
[DI:direct]

| ORF_Name | NT_ID | AA_ID | NT LN | AA LN | Score | P-value |
|---|---|---|---|---|---|---|
| 31932711_c1_1431 | 2952 | 10123 | 1419 | 472 | 110 | 0.00037 |

Description gp:[GI:g1245105] [LN:MMU46463] [AC:U46463] [PN:glutamine repeat protein-1]
[OR:Mus musculus] [SR:house mouse] [DB:genpept-rod] [DE:Mus musculus glutamine
repeat protein-1 mRNA, complete cds.] [NT:GRP-1] [LE:181] [RE:696] [DI:direct]

| ORF Name | NT ID | AA ID | NT/LN | AA/LN | Score | P-value |
|---|---|---|---|---|---|---|
| 32070452_f1_53 | 2953 | 10124 | 261 | 86 | 334 | 3.4e-30 |

Description sp:[LN:NRDH_ECOLI] [AC:Q47414] [GN:NRDH] [OR:Escherichia coli]
[DE:GLUTAREDOXIN-LIKE PROTEIN NRDH] [SP:Q47414] [DB:swissprot] >sp:[LN:S70891]
[AC:S70891:B65047] [PN:hypothetical 9.1K protein b2673] [OR:Escherichia coli]
[DB:pir2] >gp:[GI:g1050470] [LN:ECNRDE] [AC:X79787] [PN:9.1 kD protein]
[OR:Escherichia coli] [DB:genpept-bct1] [DE:E.coli nrdEF operon (partial).]
[NT:ORFB] [SP:Q47414] [LE:595] [RE:840] [DI:direct] >gp:[GI:g1789028]
[LN:AE000352] [AC:AE000352:U00096] [PN:glutaredoxin-like protein; hydrogen donor]
[GN:nrdH] [FN:enzyme; Biosynthesis of cofactors, carriers:] [OR:Escherichia coli]
[DB:genpept-bct2] [DE:Escherichia coli K-12 MG1655 section 242 of 400 of the
completegenome.] [NT:o81; This 81 aa ORF is 28 pct identical (2 gaps) to]
[LE:1924] [RE:2169] [DI:direct]

| ORF Name | NT ID | AA ID | NT/LN | AA/LN | Score | P-value |
|---|---|---|---|---|---|---|
| 32282090_c2_1520 | 2954 | 10125 | 447 | 148 | 119 | 8.1e-06 |

Description sp:[LN:D70807] [AC:D70807] [PN:hypothetical glycine-rich protein Rv3514]
[GN:Rv3514] [OR:Mycobacterium tuberculosis] [DB:pir2] >gp:[GI:e1254642:g2924451]
[LN:MTV023] [AC:AL022022:AL123456] [PN:PE_PGRS] [GN:PE_PGRS] [OR:Mycobacterium
tuberculosis] [DB:genpept-bct1] [DE:Mycobacterium tuberculosis H37Rv complete
genome; segment 148/162.] [NT:Rv3514, (MTV023.21), len: 1489. Member of]
[LE:34120] [RE:38589] [DI:direct]

| ORF Name | NT ID | AA ID | NT/LN | AA/LN | Score | P-value |
|---|---|---|---|---|---|---|
| 32428905_c3_1841 | 2955 | 10126 | 699 | 232 | 126 | 2.2e-06 |

Description sp:[LN:JQ0321] [AC:JQ0321] [PN:hypothetical 19.8K protein] [OR:Xanthomonas
campestris pv. vesicatoria] [DB:pir2]

| ORF Name | NT ID | AA ID | NT/LN | AA/LN | Score | P-value |
|---|---|---|---|---|---|---|
| 32439042_f1_7 | 2956 | 10127 | 273 | 90 | | |

Description

NO-HIT

| ORF Name | NT ID | AA ID | NT/LN | AA/LN | Score | P-value |
|---|---|---|---|---|---|---|
| 32515751_f3_806 | 2957 | 10128 | 1080 | 359 | 1489 | 1.4e-152 |

Description sp:[LN:WQEC2S] [AC:A26725:I41071:B65050:C65050] [PN:phosphotransferase system enzyme II, sorbitol-specific, factor II:phosphotransferase system enzyme II, glucitol-specific, factor II:protein-N(pi)-phosphohistidine-glucitol phosphotransferase, factor II] [GN:gutA:srlA:srlA_1:srlA_2:sbl] [CL:phosphotransferase system sorbitol-specific enzyme II, factor II] [OR:Escherichia coli] [EC:2.7.1.69] [DB:pir1] [MP:58 min]

| ORF Name | NT ID | AA ID | NT/LN | AA/LN | Score | P-value |
|---|---|---|---|---|---|---|
| 32526888_f1_167 | 2958 | 10129 | 399 | 132 | 102 | 2.0e-05 |

Description gp:[GI:e1370577:g4158178] [LN:SC1A6] [AC:AL023496] [PN:hypothetical protein] [OR:Streptomyces coelicolor] [DB:genpept-bct1] [DE:Streptomyces coelicolor cosmid 1A6.] [NT:Protein sequence is in conflict with the conceptual] [LE:<1] [RE:574] [DI:direct]

| ORF Name | NT ID | AA ID | NT/LN | AA/LN | Score | P-value |
|---|---|---|---|---|---|---|
| 32595291_c3_1958 | 2959 | 10130 | 1257 | 418 | | |

Description

NO-HIT

| ORF Name | NT ID | AA ID | NT/LN | AA/LN | Score | P-value |
|---|---|---|---|---|---|---|
| 32595967_f2_412 | 2960 | 10131 | 2127 | 708 | 2871 | 4.9e-299 |

Description sp:[LN:D65047] [AC:D65047:S70893] [PN:ribonucleoside-diphosphate reductase, 2 alpha chain] [GN:nrdE] [CL:Salmonella typhimurium ribonucleoside-diphosphate reductase] [OR:Escherichia coli] [EC:1.17.4.1] [DB:pir2] >gp:[GI:g1789030] [LN:AE000352] [AC:AE000352:U00096] [PN:ribonucleoside-diphosphate reductase 2, alpha] [GN:nrdE] [FN:enzyme; Central intermediary metabolism:] [OR:Escherichia coli] [DB:genpept-bct2] [EC:1.17.4.1] [DE:Escherichia coli K-12 MG1655 section 242 of 400 of the completegenome.] [NT:o714; 100 pct identical to 310 bp fragment nrdE] [LE:2549] [RE:4693] [DI:direct]

| ORF_Name | NT ID | AA ID | $\frac{NT}{LN}$ | $\frac{AA}{LN}$ | Score | P-value |
|---|---|---|---|---|---|---|
| 32667890_c1_1151 | 2961 | 10132 | 717 | 238 | 860 | 6.1e-86 |

Description sp:[LN:CBIC_SALTY] [AC:Q05601] [GN:CBIC] [OR:Salmonella typhimurium] [EC:5.4.1.2]
[DE:PRECORRIN-8X METHYLMUTASE, (PRECORRIN ISOMERASE)] [SP:Q05601] [DB:swissprot]
>gp:[GI:g154422] [LN:STYVB12AA] [AC:L12006] [PN:precorrin isomerase] [GN:cbiC]
[FN:involved in methyl migration] [OR:Salmonella typhimurium] [SR:Salmonella
typhimurium (strain LT2) DNA] [DB:genpept-bct1] [DE:Salmonella typhimurium
vitamin B12/cobalamin biosynthetic (cob)operon 5' end including: (cbiA, cbiB,
cbiC, cbiD, cbiE, cbiT, cbiF,cbiG, cbiH, cbiJ, cbiK, cbiL, cbiM, cbiN, cbiQ,
cbiO, cbiP, cobU,cobS, cobT) genes and regulatory protein (PocR).] [NT:putative]
[LE:3634] [RE:4266] [DI:direct]

| ORF_Name | NT ID | AA ID | $\frac{NT}{LN}$ | $\frac{AA}{LN}$ | Score | P-value |
|---|---|---|---|---|---|---|
| 32675880_c2_1550 | 2962 | 10133 | 1467 | 488 | 297 | 1.0e-24 |

Description sp:[LN:SOXC_RHOSO] [AC:P54998] [GN:SOXC:DSZC] [OR:Rhodococcus sp] [SR:,strain
IGTS8] [DE:DIBENZOTHIOPHENE DESULFURIZATION ENZYME C (DBT SULFUR DIOXYGENASE)]
[SP:P54998] [DB:swissprot] >gp:[GI:g595293] [LN:RSU08850] [AC:U08850]
[PN:dibenzothiophene desulfurization enzyme] [GN:soxC] [FN:metabolizes
dibenzothiophene to DBT] [OR:Rhodococcus sp.] [SR:Rhodococcus sp]
[DB:genpept-bct1] [DE:Rhodococcus sp. IGTS8 sox dibenzothiophene desulfurization
operon(soxA, soxB, and soxC) genes, complete cds, and IS1166 transposasegenes,
complete cds.] [NT:The entire operon removes organically bound sulfur] [LE:4011]
[RE:5264] [DI:direct]

| ORF_Name | NT ID | AA ID | $\frac{NT}{LN}$ | $\frac{AA}{LN}$ | Score | P-value |
|---|---|---|---|---|---|---|
| 3296953_f2_502 | 2963 | 10134 | 186 | 61 | | |

Description

NO-HIT

| ORF Name | NT ID | AA ID | NT/LN | AA/LN | Score | P-value |
|---|---|---|---|---|---|---|
| 33228437_c2_1657 | 2964 | 10135 | 492 | 163 | 582 | 1.8e-56 |

Description sp:[LN:HYCA_ECOLI] [AC:P16427] [GN:HYCA:HEVA] [OR:Escherichia coli] [DE:FORMATE HYDROGENLYASE REGULATORY PROTEIN HYCA] [SP:P16427] [DB:swissprot] >sp:[LN:S08619] [AC:S08619:A65053] [PN:formate hydrogenlyase regulatory protein:hydrogenase-3 protein A] [GN:hycA] [OR:Escherichia coli] [DB:pir2] [MP:58-59 min] >gp:[GI:g41680] [LN:ECHYC] [AC:X17506] [GN:hycA] [OR:Escherichia coli] [DB:genpept-bct1] [DE:E.coli hyc operon hycA,B,C,D,E,F,G,H,I genes.] [SP:P16427] [LE:212] [RE:673] [DI:direct] >gp:[GI:g882618] [LN:ECU29579] [AC:U29579] [PN:formate hydrogenlyase regulatory protein] [GN:hycA] [OR:Escherichia coli] [DB:genpept-bct1] [DE:Escherichia coli K-12 genome; approximately 61 to 62 minutes.] [NT:CG Site no. 33143; alternate gene name hevA;] [LE:22278] [RE:22739] [DI:complement] >gp:[GI:g1789080] [LN:AE000356] [AC:AE000356:U00096] [PN:transcriptional repression of hyc and hyp] [GN:hycA] [FN:regulator; Energy metabolism, carbon:] [OR:Escherichia coli] [DB:genpept-bct2] [DE:Escherichia coli K-12 MG1655 section 246 of 400 of the completegenome.] [NT:f153; 100 pct identical to HYCA_ECOLI SW: P16427;] [LE:7511] [RE:7972] [DI:complement]

| ORF Name | NT ID | AA ID | NT/LN | AA/LN | Score | P-value |
|---|---|---|---|---|---|---|
| 33400336_c3_1790 | 2965 | 10136 | 879 | 292 | 1401 | 2.9e-143 |

Description sp:[LN:LGT_SALTY] [AC:Q07293] [GN:LGT] [OR:Salmonella typhimurium] [EC:2.4.99.-] [DE:PROLIPOPROTEIN DIACYLGLYCERYL TRANSFERASE,] [SP:Q07293] [DB:swissprot] >sp:[LN:A47354] [AC:A47354] [PN:probable prolipoprotein glyceryl transferase] [GN:lgt] [CL:prolipoprotein diacylglyceryl transferase] [OR:Salmonella typhimurium] [DB:pir2] >gp:[GI:g295202] [LN:STYLGTX] [AC:L13259] [PN:prolipoprotein diacylglyceryl transferase] [GN:lgt] [OR:Salmonella typhimurium] [DB:genpept-bct1] [DE:Salmonella typhimurium (ygdF) gene, partial cds and prolipoproteindiacylglyceryl transferase (lgt) gene, complete cds.] [LE:475] [RE:1350] [DI:direct]

996

| ORF_Name | NT ID | AA ID | NT/LN | AA/LN | Score | P-value |
|---|---|---|---|---|---|---|
| 33595376_c3_2035 | 2966 | 10137 | 2646 | 881 | 4176 | 0.0 |

Description sp:[LN:SYA_ECOLI] [AC:P00957:P78279] [GN:ALAS:LOVB] [OR:Escherichia coli]
[EC:6.1.1.7] [DE:ALANYL-TRNA SYNTHETASE, (ALANINE--TRNA LIGASE) (ALARS)]
[SP:P00957:P78279] [DB:swissprot] >sp:[LN:SYECAT]
[AC:E65049:A01185:A94258:A40608:I40988:A54217] [PN:alanine--tRNA
ligase,:alanyl-tRNA synthetase] [GN:alaS] [CL:alanine--tRNA ligase]
[OR:Escherichia coli] [EC:6.1.1.7] [DB:pir1] [MP:58 min]
>gp:[GI:d1017291:g1800083] [LN:D90892] [AC:D90892:AB001340] [PN:ALANYL-TRNA
SYNTHETASE (EC 6.1.1.7)] [GN:alaS] [OR:Escherichia coli] [SR:Escherichia coli
(strain:K12) DNA, clone_lib:Kohara lambda minise] [DB:genpept-bct1] [DE:E.coli
genomic DNA, Kohara clone #446(60.5-60.9 min.).] [NT:similar to [SwissProt
Accession Number P00957]] [LE:8287] [RE:10917] [DI:complement] >gp:[GI:g1789048]
[LN:AE000353] [AC:AE000353:U00096] [PN:alanyl-tRNA synthetase] [GN:alaS]
[FN:enzyme; Aminoacyl tRNA synthetases, tRNA] [OR:Escherichia coli]
[DB:genpept-bct2] [EC:6.1.1.7] [DE:Escherichia coli K-12 MG1655 section 243 of
400 of the completegenome.] [NT:f876; 98 pct identical to SYA_ECOLI SW: P00957;
CG] [LE:9857] [RE:12487] [DI:complement]

| ORF_Name | NT ID | AA ID | NT/LN | AA/LN | Score | P-value |
|---|---|---|---|---|---|---|
| 33597827_c2_1760 | 2967 | 10138 | 225 | 74 | 113 | 8.8e-07 |

Description sp:[LN:F72598] [AC:F72598] [PN:hypothetical protein APE1254] [GN:APE1254]
[OR:Aeropyrum pernix] [DB:pir2] >gp:[GI:d1044030:g5104930] [LN:AP000061]
[AC:AP000061] [PN:109aa long hypothetical protein] [GN:APE1254] [OR:Aeropyrum
pernix] [SR:Aeropyrum pernix (strain:K1) DNA] [DB:genpept-bct1] [DE:Aeropyrum
pernix genomic DNA, section 4/7.] [LE:79002] [RE:79331] [DI:complement]

| ORF_Name | NT ID | AA ID | NT/LN | AA/LN | Score | P-value |
|---|---|---|---|---|---|---|
| 33633566_c3_2063 | 2968 | 10139 | 375 | 124 | 551 | 3.4e-53 |

Description gp:[GI:d1017268:g1800059] [LN:D90891] [AC:D90891:AB001340] [GN:ygaC]
[OR:Escherichia coli] [SR:Escherichia coli (strain:K12) DNA, clone_lib:Kohara
lambda minise] [DB:genpept-bct1] [DE:E.coli genomic DNA, Kohara clone
445(60.2-60.6 min.).] [NT:similar to [SwissProt Accession Number P36931];]
[LE:3120] [RE:>3476] [DI:complement]

| ORF Name | NT ID | AA ID | NT/LN | AA/LN | Score | P-value |
|---|---|---|---|---|---|---|
| 3367157_f3_758 | 2969 | 10140 | 1839 | 612 | 603 | 1.5e-80 |

Description sp:[LN:ACOR_ALCEU] [AC:P28614] [GN:ACOR] [OR:Alcaligenes eutrophus] [DE:ACETOIN CATABOLISM REGULATORY PROTEIN] [SP:P28614] [DB:swissprot] >sp:[LN:A42890] [AC:A42890] [PN:transcription factor acoR] [CL:RNA polymerase sigma factor interaction domain homology] [OR:Alcaligenes eutrophus] [DB:pir2] >gp:[GI:g141888] [LN:AFAACOR] [AC:M90471] [GN:acoR] [OR:Ralstonia eutropha] [SR:Alcaligenes eutrophus (strain H16) DNA] [DB:genpept-bct1] [DE:Alcaligenes eutrophus (strain H16) AcoR (acoR) gene, complete cds.] [LE:451] [RE:2457] [DI:direct]

| ORF Name | NT ID | AA ID | NT/LN | AA/LN | Score | P-value |
|---|---|---|---|---|---|---|
| 33728830_f2_393 | 2970 | 10141 | 204 | 67 | | |

Description

NO-HIT

| ORF Name | NT ID | AA ID | NT/LN | AA/LN | Score | P-value |
|---|---|---|---|---|---|---|
| 33847702_c3_1795 | 2971 | 10142 | 2463 | 820 | 3467 | 0.0 |

Description sp:[LN:PTR_ECOLI] [AC:P05458:P78106] [GN:PTR] [OR:Escherichia coli] [EC:3.4.24.55] [DE:PROTEASE III PRECURSOR, (PITRILYSIN) (PROTEASE PI)] [SP:P05458:P78106] [DB:swissprot] >sp:[LN:SNECPI] [AC:F65064:A29093:A25765:B25532] [PN:pitrilysin, precursor:endopeptidase Pi:proteinase III] [GN:ptr] [CL:insulinase] [OR:Escherichia coli] [EC:3.4.99.44] [DB:pir1] [MP:61] >gp:[GI:g42561] [LN:ECPTR] [AC:X06227] [PN:preprotease III (AA -23 to 939)] [OR:Escherichia coli] [DB:genpept-bct1] [DE:E. coli ptr gene for protease III.] [SP:P05458] [LE:206] [RE:3094] [DI:direct] >gp:[GI:g2367164] [LN:AE000365] [AC:AE000365:U00096] [PN:protease III] [GN:ptr] [FN:enzyme; Degradation of proteins, peptides,] [OR:Escherichia coli] [DB:genpept-bct2] [EC:3.4.24.55] [DE:Escherichia coli K-12 MG1655 section 255 of 400 of the completegenome.] [NT:f962; 99 pct identical to PTR_ECOLI SW: P05458; CG] [LE:10065] [RE:12953] [DI:complement]

| ORF Name | NT ID | AA ID | NT/LN | AA/LN | Score | P-value |
|---|---|---|---|---|---|---|
| 3385325_c1_1190 | 2972 | 10143 | 294 | 97 | 74 | 0.041 |

Description sp:[LN:T13049] [AC:T13049] [PN:eyelid] [GN:eld] [OR:Drosophila melanogaster] [DB:pir2] >gp:[GI:g2981221] [LN:AF053091] [AC:AF053091] [PN:eyelid] [GN:eld] [OR:Drosophila melanogaster] [SR:fruit fly] [DB:genpept-inv1] [DE:Drosophila melanogaster eyelid (eld) mRNA, complete cds.] [NT:Bright family member] [LE:454] [RE:8601] [DI:direct]

998

| ORF Name | NT ID | AA ID | NT LN | AA LN | Score | P-value |
|---|---|---|---|---|---|---|
| 33864782_c1_1105 | 2973 | 10144 | 669 | 222 | 713 | 2.3e-70 |

Description sp:[LN:PTR_ECOLI] [AC:P05458:P78106] [GN:PTR] [OR:Escherichia coli]
[EC:3.4.24.55] [DE:PROTEASE III PRECURSOR, (PITRILYSIN) (PROTEASE PI)]
[SP:P05458:P78106] [DB:swissprot] >sp:[LN:SNECPI]
[AC:F65064:A29093:A25765:B25532] [PN:pitrilysin, precursor:endopeptidase
Pi:proteinase III] [GN:ptr] [CL:insulinase] [OR:Escherichia coli] [EC:3.4.99.44]
[DB:pir1] [MP:61] >gp:[GI:g42561] [LN:ECPTR] [AC:X06227] [PN:preprotease III (AA
-23 to 939)] [OR:Escherichia coli] [DB:genpept-bct1] [DE:E. coli ptr gene for
protease III.] [SP:P05458] [LE:206] [RE:3094] [DI:direct] >gp:[GI:g2367164]
[LN:AE000365] [AC:AE000365:U00096] [PN:protease III] [GN:ptr] [FN:enzyme;
Degradation of proteins, peptides,] [OR:Escherichia coli] [DB:genpept-bct2]
[EC:3.4.24.55] [DE:Escherichia coli K-12 MG1655 section 255 of 400 of the
completegenome.] [NT:f962; 99 pct identical to PTR_ECOLI SW: P05458; CG]
[LE:10065] [RE:12953] [DI:complement]

| ORF Name | NT ID | AA ID | NT LN | AA LN | Score | P-value |
|---|---|---|---|---|---|---|
| 33869056_f3_1024 | 2974 | 10145 | 816 | 271 | 1123 | 8.3e-114 |

Description sp:[LN:PDUB_SALTY] [AC:P37449] [GN:PDUB] [OR:Salmonella typhimurium] [DE:PDUB
PROTEIN] [SP:P37449] [DB:swissprot] >gp:[GI:g2587033] [LN:AF026270]
[AC:AF026270:L31414] [PN:PduB] [GN:pduB] [OR:Salmonella enterica serovar
Typhimurium] [DB:genpept-bct2] [DE:Salmonella enterica serovar Typhimurium PocR
(pocR) gene, partialcds; PduF (pudF) gene, complete cds and pdu operon,
completesequence.] [NT:related to the proteins involved in carboxysome] [LE:2837]
[RE:3538] [DI:direct]

| ORF Name | NT ID | AA ID | NT LN | AA LN | Score | P-value |
|---|---|---|---|---|---|---|
| 3409776_f2_639 | 2975 | 10146 | 273 | 90 | | |

Description

NO-HIT

| ORF Name | NT ID | AA ID | NT LN | AA LN | Score | P-value |
|---|---|---|---|---|---|---|
| 34114416_f1_317 | 2976 | 10147 | 528 | 175 | 453 | 8.3e-43 |

Description gp:[GI:g5069456] [LN:AF026270] [AC:AF026270:L31414] [PN:PduM] [GN:pduM]
[OR:Salmonella enterica serovar Typhimurium] [DB:genpept-bct2] [DE:Salmonella
enterica serovar Typhimurium PocR (pocR) gene, partialcds; PduF (pudF) gene,
complete cds and pdu operon, completesequence.] [LE:10032] [RE:10523] [DI:direct]

| ORF_Name | NT_ID | AA_ID | NT/LN | AA/LN | Score | P-value |
|---|---|---|---|---|---|---|
| 34165781_c1_1401 | 2977 | 10148 | 1605 | 534 | 2076 | 8.5e-215 |

Description gp:[GI:g3928680] [LN:AF068264] [AC:AF068264] [PN:NAD+ dependent acetaldehyde dehydrogenase] [GN:exaC] [OR:Pseudomonas aeruginosa] [DB:genpept-bct2] [DE:Pseudomonas aeruginosa quinoprotein ethanol dehydrogenase (exaA)gene, partial cds; cytochrome c550 precursor (exaB), NAD+ dependentacetaldehyde dehydrogenase (exaC), and pyrroloquinoline quinonesynthesis A (pqqA) genes, complete cds; and pyrroloquinolinequinone synthesis B (pqqB) gene, partial cds.] [LE:994] [RE:2514] [DI:direct]

| ORF_Name | NT_ID | AA_ID | NT/LN | AA/LN | Score | P-value |
|---|---|---|---|---|---|---|
| 34181517_f2_493 | 2978 | 10149 | 1014 | 337 | 1382 | 3.0e-141 |

Description sp:[LN:HYPE_ECOLI] [AC:P24193:Q46886] [GN:HYPE] [OR:Escherichia coli] [DE:HYDROGENASE ISOENZYMES FORMATION PROTEIN HYPE] [SP:P24193:Q46886] [DB:swissprot] >sp:[LN:S15201] [AC:S15201:F65053] [PN:hydrogenase isoenzymes formation protein hypE] [GN:hypE] [CL:hydrogenase expression/formation protein hypE] [OR:Escherichia coli] [DB:pir2] >gp:[GI:g41779] [LN:ECHYP] [AC:X54543] [PN:hypE product] [GN:hypE] [OR:Escherichia coli] [DB:genpept-bct1] [DE:E. coli hyp operon encoding hydrogenase isoenzymes.] [SP:P24193] [LE:2751] [RE:3719] [DI:direct] >gp:[GI:g1789085] [LN:AE000356] [AC:AE000356:U00096] [PN:plays structural role in maturation of all 3] [GN:hypE] [FN:factor; Energy metabolism, carbon: Anaerobic] [OR:Escherichia coli] [DB:genpept-bct2] [DE:Escherichia coli K-12 MG1655 section 246 of 400 of the completegenome.] [NT:o322; 99 pct identical to HYPE_ECOLI SW: P24193; CG] [LE:10833] [RE:11801] [DI:direct]

| ORF_Name | NT_ID | AA_ID | NT/LN | AA/LN | Score | P-value |
|---|---|---|---|---|---|---|
| 34377213_c2_1660 | 2979 | 10150 | 1722 | 573 | 2964 | 0.0 |

Description sp:[LN:HYCE_ECOLI] [AC:P16431] [GN:HYCE:HEVE] [OR:Escherichia coli] [DE:(HYDROGENASE-3 COMPONENT E)] [SP:P16431] [DB:swissprot] >sp:[LN:S08623] [AC:S08623:S42355:E65052] [PN:hydrogenase, 3 chain 5 precursor:formate hydrogenlyase chain 5:hydrogenase-3 protein E] [GN:hycE] [OR:Escherichia coli] [EC:1.18.99.1] [DB:pir2] [MP:58-59 min] >gp:[GI:g41684] [LN:ECHYC] [AC:X17506] [GN:hycE] [OR:Escherichia coli] [DB:genpept-bct1] [DE:E.coli hyc operon hycA,B,C,D,E,F,G,H,I genes.] [SP:P16431] [LE:4176] [RE:5885] [DI:direct] >gp:[GI:g882614] [LN:ECU29579] [AC:U29579] [PN:formate hydrogenlyase subunit 5] [GN:hycE] [OR:Escherichia coli] [DB:genpept-bct1] [DE:Escherichia coli K-12 genome; approximately 61 to 62 minutes.] [NT:CG Site no. 33159; alternate gene name hevE;] [LE:17066] [RE:18775] [DI:complement] >gp:[GI:g1789076] [LN:AE000356] [AC:AE000356:U00096] [PN:large subunit of hydrogenase 3 (part of FHL] [GN:hycE] [FN:enzyme; Energy metabolism, carbon:] [OR:Escherichia coli] [DB:genpept-bct2] [DE:Escherichia coli K-12 MG1655 section 246 of 400 of the completegenome.] [NT:f569; 100 pct identical amino acid sequence and] [LE:2299] [RE:4008] [DI:complement]

SEQUENCE LISTING (14342 sequences)

SEQ ID NO: 1 - DNA, 741 bp, Klebsiella pneumoniae
ttgaagagttcctcgatggcgaagaaggctagctttattgtgatggtcgacggcgagcacgtcctgccgatggccaccagccaggatcacaagcgcgtcggcaacggcgataccggcccgaacaccggcgggatgggggcgtactccccggcgccggtggttactgacgaagtccaccagcgcaccatggagcggattatctggccaaccgtgaaaggcatggccgctgaaggcaacacctataccggtttcctctacgccggtctgatgatcgacaagcagggcaacccgaaggtgattgagttcaactgccgctttggcgacccggaaacccaaccgatcatgctgcgcatgaagtccgacctggtcgagctgtgcctcgccgcctgcgcgggcaagctggacgagaaaacctccgagtgggatgaccgcgcgtcgctgggcgtggtggttgccgccggcggctatccgggcagctacaatacgggcgatgagatctacggcctgccgcagcaggaagtcgcagacggtaaggtcttccacgccggcaccaaactgtctgacgaccagcgcgtggtcaccaacggcgggcgcgtgctgtgcgtcaccgcgctgggtgactccgtggcgcaggcgcagcagcgcgcctaccagctgctgaccgacattcgctgggacggtagctttagccgtagcgatatcggctggcgcgccatcgaacgtgaaaaggctaacggctaa

SEQ ID NO: 2 - DNA, 684 bp, Klebsiella pneumoniae
cttccgcgcccgcggcggcgaaatctacctgaaacaggaggaagcctgatgtatcaacctgattttccacccgtcccgtttcgtctcggactctacccggtggtggacagcgtggcgtggattgagcgcctgctcgaagctggggtacgtacccttcagttacgcatcaaagaccggcgcgacagcgaagtggaggatgacgtgatcgccgccatcgcccttggtcgccgctatcacgcccgactgttcattaacgattactggcaactggcgattaagcaccaggcctatggcgtgcatctcggacaagaagatctggaaaccaccgatctgagcgctatccgccaggccgggctgcgtcttggcgtctctactcacgatgatatggaaattgatgtcgcccttgcggcacgcccctcttacatcgcgctaggtcacgtcttcccgacgcaaaccaaacagatgccttccgcgccgcagggcctcgagcagcttgccagacatattcaacgcctggcggattaccccaccgtggcgatcggcggaataagcctggaaaaggcgccgggggtactggcgaccggcgtcggcagcatcgcggtggtcagcgccatcacccaggcggcggactggcgggcagcgaccgaccaactgctgacgctggcgggagcgggcgatgaatga

SEQ ID NO: 3 - DNA, 492 bp, Klebsiella pneumoniae
cgaacctggcctgctttcgcgtttttaaccgcttcagcaacgttcggagttacggtacctactttcgggttcggcatcaggccacgcggacccagaacctgccccagctggccaacaacgcgcattgcatccggggaagcaataacaacgtcaaagttcatttcgccttttttgatctgctcagccagatcttccatacctaccagctcagcgcctgcagctttagcagcttcagcgtttgcgccctgggtaaatacggctacgcgaacggaacggccagtaccgtgcggcagtacagttgcgccacggacgttctggtcagatttacgagcgtcgatgccgaggttaacggcaacgtctacgctttcggtaaatttagcggtggccagctctttcagcagagcaatggcttcgttgatgtcgtactgtttagttgcatcaactttctcacggatcacgcgcatgcgcttggtcagtttagccatttcttag

SEQ ID NO: 4 - DNA, 459 bp, Klebsiella pneumoniae
agcgttaatacccattttgaggatttaagaatggctaagaaagtccaagcctacgtcaagctgcaggttgcagctggtatggcgaacccgagcccgccggtcggcccagcactgggtcagcagggcgtgaacatcatggaattctgcaaagcgttcaacgccaaaactgattccctggagaaaggtctgccgatcccggttgttatcaccgtttacgctgaccgttcctttacctttgttaccaagactccgccggctgctgttctgctgaagaaagctgcaggcatcaagtctggttccggtaagccgaacaaagataaagtgggtaaaatctcccgcgctcagctgcaggaaatcgcgcagaccaaagctgccgacatgactggtgccgacattgaagcgatgactcgctccatcgaaggtactgcacgttccatgggcctggtagtggaggactaa

SEQ ID NO: 5 - DNA, 366 bp, Klebsiella pneumoniae
atgtctatcactaaagatcaaatcattgaagcagtatccgctatgtccgtaatggacgttgttgagctgatctctgcaatggaagaaaaattcggtgtttccgctgctgctgctgtagctgtagctgctggcccggttgaagctgctgaagaaaaaactgaattcgacgtaattctgaaagctgctggcgctaacaaagttgctgttatcaaagcagtacgtggcgcaactggcctgggtctgaaagaagctaaagacctggtagaatctgctccggctgcactgaaagaaggcatcagcaaagacgacgctgaagctctgaaaaaatctctggaagaagctggcgctgaagttgaagttaaataa

SEQ ID NO: 6 - DNA, 1908 bp, Klebsiella pneumoniae
ctggaatgcgctatgtctactaccaaactaacccgtcgggaacaacgcgagcacgcgcagcgattcattgatacgctggcgggtaccgcttttcctaattcacgccgcatctatgttcacggctcacaagcggatatccgcgtcccgatgcgtgaaattcagctcagcccaactctcgtcggcggcgataaagataacccccggtacgaaaccaacgaaccgatcccggtgtatgacacctccgggccgtatggcgacccggatattagcattgatgtccgccaggggttggcaaagctgcgccagccgtggatcgacgcgcgtaacgactgcgcgccgctcagcgaacgcagctcggcctataccaaagcgcggctggccgacgacggtctcgatgagctgcgcttcagcggcctgctgacgcccaaacgcgccgtcgctggcaaatgcgttacccagctgcattacgcccgccaggggatagtcaccccggagatggagttcatcgccattcgcgaaaacatgggtcgcgaacgtatccgcagcgaggttctgcgccagcagcacgcaggtgaaggcttcggcgcccaccttccggaaaacatcacccccgagtttgttcgcgatgaagtggccgccggacgcgccatcatccccgccaacatcaaccacccggagtctgaaccgatgattatcggccgcaacttcctggtgaaagtgaatgccaatatcggcaactcggcggtgacctcttccatcgaagaagaggtcgagaaactggtctggtcaacccgctggggcgccgacacagtgatggacctctccaccggccgctatatccacgaaacccgcgagtggatcctgcgcaacagcccggtgccgattggtaccgtgccgatttaccaggcgctggagaaggtcaacggcatcgccgagaatctcacctggcaagtcttccgcgataccctgctggaacaggccgagcaaggcgtcgactacttcacgattcacgccggcgtactgttgcgctacgtcccgatgacggcgaagcgcctgaccggtatcgtctcgcgcggcggctcaatcatggctaagtggtgcctgtcgcatcatcaggaaaacttcctctaccagcatttccgcgaaatctgcgaaatctgcgccgcctatgacgtgtcgctgtcgctgggcgatggcctgcgccccggctccattcaggatgccaacgacgaggcgcagttttccgagctgcgcaccctcggcgaactgacgaaaatcgcctgggaatatgacgtgcaggtgatgattgaaggccctggccacgtgccgatgcagatgatccgccgcaatatgaccgaacagctggagcactgccacgaagcgccattctacaccctggggccgctcaccactgacatcgcgccgggctacgaccatttcacctccggtatcggcgcggcaatgatcggctggttcggctgcgccatgctgtgctatgtcacgccgaaagagcatctcggcctgcccaacaaagaggatgtcaaacaggggctgattacctacaaaatcgccgcccacgccgccgacctcgcgaaaggccaccccggggcgcagatccgcgacaacgcgatgtcaaaagcgcgttttgaattccgctgggaagaccagttcaacctcgcgctcgacccgttcaccgcgcgggcctatcacgatgaaaccctgccgcaggagtccggcaaagtcgcccacttctgctccatgtgcgggccgaaattctgttcgatgaaaatcactcaggaggtccgcgactacgccgcgaagcaaagtatcgaagccggcatggccgatatgtcgaataacttccgcgcccgcggcggcgaaatctacctgaaacaggaggaagcctga

SEQ ID NO: 7 - DNA, 4266 bp, Klebsiella pneumoniae
cgcccggcagcggaatgtgctaactccgacgggagcaaatccgtgaaagacttattaaagtttctgaaagcgcaaactaaaaccgaagagtttgatgcgatcaaaattgctctggcttcgccagacatgatccgttcatggtctttcggtgaagttaaaaagccggaaaccattaactaccgtacgttcaaacctgagcgtgacggccttttctgcgcccgtatctttgggccggtaaaagattatgagtgcctgtgcggtaagtacaagcgcctgaaacaccgcggtgtgatctgtgagaagtgcggcgttgaagtgacccagactaaagtgcgtcgtgagcgcatgggccacatcgagctggcatgtccgactgcgcacatctggttcctgaaatccctgccgtcccgtatcggtctgctgctggatatgccgctgcgcgatatcgaacgtgtactgtactttgaatcctatgtggttatcgaaggtggcatgaccaacctcgaacgcaaccagattctgacggaagaacagtacctggacgcgctggaagagttcggtgacgaattcgacgcgaaaatgggcgcggaagcgatccaggcgctgctgcgcaatatggatctggagcaggaatgcgagcagctgcgtgaagagctgaacgaaaccaactccgaaaccaagcgtaaaaagctgaccaagcgcattaagctgctggaagctttcgttcagtctggcaacaagccggagtggatgatcctgaccgttctgccggtactgccgccagatctgcgtccgctggttccgctggacggtggtcgtttcgcgacgtctgacctcaacgatctgtatcgtcgcgtgatcaaccgtaacaaccgtctgaaacgtctgctggatctggctgcgccggatatcatcgtacgcaacgaaaaacgtatgctgcaggaagcggttgacgccctgctggataacggtcgtcgcggtcgtgcgatcaccggttctaacaaacgtcctctgaaatctttggccgatatgatcaaaggtaaacagggtcgtttccgccagaacctgctcggtaaacgcgttgactactccggtcgttctgttatcaccgtaggtccatacctgcgtctgcatcagtgcggtctgccgaagaaaatggcgctggagctgttcaaaccgttcatctacggcaagctggaactgcgtggcctggccaccaccatcaaagccgctaagaagatggttgagcgcgaagaagctgtcgtttgggatatcctggacgaagttatccgcgaacatccggtcctgctgaaccgtgcgccaaccctgcaccgtctgggtattcaggcattcgaaccggttctgatcgaaggtaaagccatccagctgcacccgctggtttgtgcggcatacaacgccgacttcgatggtgaccagatggctgttcacgtaccgctgacgctggaagcccagctggaagcgcgtgcgctgatgatgtctaccaacaacatcctgtccccggcgaacggcgaaccaatcatcgttccgtctcaggacgttgtactgggtctgtactacatgacccgtgacagtgttaacgccaaaggcgaaggcatggtgctgactggcccgaaagaagctgagcgtatttatcgcgccggcctggcctctctgcatgcgcgcgttaaagtgcgtatcactgaatacgaaaaagacgacaatggtgagtttgtcgcgaaaaccagcctgaaagacacgaccgttggccgtgccattctgtggatgatcgtaccgaaaggtctgccgttctctatcgtgaaccaggcgcttggtaagaaagcgatctccaagatgctgaacacctgttaccgtattctgggtctgaaaccgaccgttatttttgcggaccagacgatgtacaccggctttgcttacgcagcgcgttcaggtgcatccgttggtatcgatgacatggtcatcccggagaaaaaatacgaaatcatcagcgaagcggaagcggaagttgctgagattcaggaacagttccagtccggtctggtgaccgcgggcgaacgctacaacaaagttatcgatatctgggctgcggcgaacgatcgtgtatccaaagcgatgatggataacctgcaaaccgaaaccgtgattaaccgtgacggtcaggaagagcagcaggtttccttcaacagcatctacatgatggccgactccggtgcgcgtggttctgcggcacagattcgtcagctggctggtatgcgtggtctgatggcgaagccggatggctccatcatcgaaacgccgatcaccgcgaacttccgtgaaggtctgaacgtactccagtacttcatctctacccacggtgctcgtaaaggtctggcggataccgcactgaaaacagcgaactccggttacctgactcgccgtctggttgacgttgcacaggacctggtcgtcactgaagacgactgcggcaccctggaaggcatcaccatgacgccggttatcgaaggtggcgacgttaaagagccgctgcgcgatcgcgtactgggtcgtgtgactgcggaagatgttctgaagccgggtaccgcggatattctggttccacgcaacacgctgctgcatgagcactggtgtgacctgctggaagcgaactccgttgactccgtcaaagtgcgttccgttgtatcctgtgacaccgactttggcgtctgcgcgcactgctatggtcgtgacctggcgcgtggccacctcatcaacaaaggtgaggctatcggcgttatcgcggcacagtccatcggtgagccgggtacacagctgacgatgcgtacgttccacatcggtggtgcggcatctcgtgcggctgctgaatccagcatccaggtgaaaaacaaaggtagcatcaagctcagcaacgcgaagtcggttgtgaactccagtggtaagctggttatcacttcccgtaataccgagctgaagctgatcgacgaattcggtcgtaccaaagagagctataaagtaccttacggtgcggttatggcgaaaggcgacggtgagcaggttgccggcggtgaaaccgtcgcaaactgggatccgcacaccatgccggttatcaccgaagttagcggtttcatccgtttcactgacatgatcgacggccagaccattactcgtcagactgacgagctgaccggtctgtcttcgctggtggttctggactctgcagaacgtaccgcaggtggtaaagatctgcgtccagcactgaaaatcgttgatgctcagggcaacgacgttctgatcccaggcactgatatgcctgctcagtacttcctgccgggtaaagcgattgttcagctggaagatggcgtacagatcagctctggtgacaccctggcgcgtattccgcaggaatccggcggtaccaaggatatcaccggtggtctgccgcgcgttgcggacctgttcgaagcacgtcgtccgaaagagccggctatcctggctgaaatcagcggtatcatttccttcggtaaagaaaccaaagggaaacgtcgcctggttatcaccccggtagacggtagcgagccgtacgaagagatgatcccgaaatggcgtcagctcaacgtgttcgaaggtgaacgtgtggaacgtggtgatgtggtttccgacggtccggaagcaccgcacgacattctgcgtctgcgtggcgtacatgctgtgacccgttacattgttaacgaagtccaggacgtataccgtctgcagggcgttaagattaacgataagcacatcgaagttatcgttcgtcagatgctgcgtaaagccaccatcgaaagcgcaggcagctccgacttcctcgaaggcgagcaggtggaatactcccgcgtcaagatcgcgaaccgcgaactggaagcgaacggcaaagtgggcgcaacgttctcccgcgatctgctgggtatcaccaaagcgtctctggccaccgagtccttcatctccgcggcatcgttccaggagaccactcgcgtgctgaccgaagcagccgttgcgggcaaacgcgacgaactgcgcggtctgaaagagaacgtcatcgtgggtcgtctgatcccggccggtaccggttatgcgtatcaccaggatcgtatgcgccgtcgcgctgctggcgagctgccggcggcaccgcaggtgagcgtggaagaagcgtctgccaacctggcagagctgctgaacgcaggtctgggcggttctgacaacgattaa

SEQ ID NO: 8 - DNA, 1539 bp, Klebsiella pneumoniae
cgattcatggctctacacaacagaaagctctcttttacgacgccgatcgtcgtggggtttgccggtattttgctcagttttatgctgatcgctatttttgtgactctggcgcaacagaaagattttctcgaagattatcacgatattaaccgcaattttacccataacctggcgatcaactatacggaaaccctgctgcgggaaaatgattttatcctcgggcgcgcagccgccttctttgcccgcaatgacgaactgaatcgcgcagtcaatgtggagccggagaaagggttaaccacgctgatgcagttacagaacatgatgccaagcgtctcatccatctcgctggcggataccgagggccactatctgcgcgccccggaggtgctggaaaacgaagacagccgggctttcgatcccagaacgcggccctggtttatcaaacaggcggaagccagcaccttcagccactacaccagtccgtatatggattatttcacccaccatccgacgattaccattttcaaacccatcattaccccggaagggaaactcaagggcagcctggcctttcatctcgatctcacctccatggggttcgcgctgcgccagatggtggcgcccgtacagggggaattttttgtggtgcaacgggatggcaaagtggtcctgcactccgacccgggcgcgctgtttaaacccttcgtcagggacgagctgatggataaaatgaccagcggagaggggcagctttacgatcccgggagcgacacctggtattactattactcctttaccaatcccgactggtttgtgattttccgtgtcgataacgccaccctggtcaatctgacacgtcatgagaccaatttagtgatcggcggtttcactctcgcagcgatcattattatcctgttcggtctttatctgcgtcatgcttcccgtaccgtgctgatgaatatcatcaatgcgattaaaaccggtgacgtcaaacgcgccccgcgccttgaggcgatgctgagtaaagcgattgaaactaataaacagcgcgaactgtcctacgtccgccaggcgaccatcgacgctctcaccggctgcaaaaaccgccgcgccttcgacagcgatattgccgccctgatgaacgatcaccagccgttcgccctcgcgctggtcgatatcgataactttaaatcgatcaacgacacctggggccatctcaatggcgatatcgtcctgcgtaacgtcgctcgcgaagggctacaggtcctccagccgctggagatatccctctatcgctacggcggcgaagagttcgcggtggtctttcctgccgaacatatcgataacgcccgcacgctgctggaaacatggcggataaacgtcgaacgacgcacctggcgcgaagatggcctgacggtcaccttcagcgccggacttggggaatggaatatggagccactggataagctggtggtgagcgtcgatgaagcgctgtacaaagccaaacagcagggtaaaaaccgtatcctgcgcacgtaa

SEQ ID NO: 9 - DNA, 708 bp, Klebsiella pneumoniae
gaccgcgtggcagtgaacagttttatcgaaggggctattaagccccttttgtctgtctggcgccggcctctggcgctggcgggcatcctgttgctgactgcctgcagccacgacacgtcgctaccgccgtttaccgccagcggatatgcggacaatcagggagcgatgcgcatctggcgtaaagattctggcgatgaagtccatcttctcgccgccttcagcccgtggcgtcacggggacacttcgaccagcgaatatcgctggcagggcgatcaactggcgcttatcgaactcaatgtctatggcaaaccgccggaacatattcgcgcccgtttcgacgcgcagggcgatctgagctttatgcaacgggaagtggacgggcagaagcagcagctctccagcgaccaggtcgcgctatatcgttatcgcgccgaacagatccgccagaccagcgacgccctccgccaggggcgggtcgtcctgcgccaggggcgctggaacgctgccgcgcataccgtgctgacctgcgaagggcagacggttacgcccgacctcgatagccgggccctggcgcacattgaacgccgccagagccacgcttccgccgcagtgagcattgcctggctggaggcgccggaaggctctcaactgctgctggtcgccaatgaaaacttctgcacctggcagccgacggaaaaaagcttctaa

SEQ ID NO: 10 - DNA, 552 bp, Klebsiella pneumoniae
cattatatttacattttggtgagcagatttaaatcaaaactagcggagtcaatcatgctaaaccagctggaaaatctgacggagcgcgttggcggtagtaatgaactggtcgatcgctggctacaagtgcgtaagcatctgctcgtggcttactacaacctggttggcctgaaaccgggcaaagagtcgtttatgcggctaaacgaaaaggcgctggatgacttttgccaaagtctggtggattacctctcatccggtcattttagtatttatgaacgcattattggcgaaatggaaggcgatacccctcttttagccgccacccggctttacccgcagctggaagccaatacccagcagatgatggactactacgatacctgcctcgaaaacgccatcgatcacgataactatcttgaatttcagcaggcgctgtcggatatcggcgagtcgctggaggcgcgtttcgcgctggaagataaactgatcgccctggctgtcgcccataacctgagcaatgacgtgcgtgataatattgcgccgaccgcttga

SEQ ID NO: 11 - DNA, 306 bp, Klebsiella pneumoniae
cgcgtaatttacgtacattatccctctgcggagggatttcatcttgtcggagtgcctattttccatgcgcaggctaacgtggaaaaggctgagaccgttaattcgggatccgcggaacctgatcaggctaatacctgcgaagggaacaagagtaaactgctgttcgcgtcagtccgtcagggccgatcgcatctgttactccatccgtcgtctgacaagccatgtccttttttaactggaatgcgctatgtctactaccaaactaacccgtcgggaacaacgcgagcacgcgcagcgattcattga

SEQ ID NO: 12 - DNA, 1656 bp, Klebsiella pneumoniae
tactttcatctgctgctccatgaattaatggcggaagtggcgcatgtcggtgaagatcatggcgatgccgtgttcgtcagcggcggcaatcacttcgtcgtcacggatagagccgcccggctgaataacgcaggtgatgcctaccgcggctgcggcatcgatgccgtcgcggaacgggaagaaagcgtcagaggccatggcggaacctttcacttccagaccttcatcaccggctttaattccggcgattttcgccgagtagacgcggctcatctgaccggcgcctataccgatggtcatattatctttggcataaacgatggcgttggatttgacgaatttcgctactttccagcagaacagcgcatcgcgcagctcttgctcgctcggctgacgtttgctgaccacgcgcagttcgcccgcggtgaccataccgagatcgcggtcctgaaccagcagaccaccgttaacgcgtttgaaatcgaggccggcaacgcgagtatcccactggccgcaggtcagtacgcggacgttctgcttcgcggcggtgattttcagcgcttcttcgctggcggacggcgcgatgatcacttcgacgaactggcgagagatgatcgcctgcgcggtttcagcatccagctcgcggttaaaggcaatgatgccgccgaacgcggaggtcgggtcggttttgtaagcgcgatcgtaggcgtcaagaatcgagtcgctgacggcaacgccgcacgggttggcatgcttgacgataacgcaggccggctcgttgaactctttcacgcactccagcgccgcatcggtatcggcaatgttgttataggagagcgctttgccctgcagctgagtggcggtcgccacggaggcctcttttacattctcttctatatagaaagccgcctgctggtggctgttttcgccgtagcgcatatcctgcttcttaatgaagttcagattcagggtacgcgggaagcggccagcggcttctttgctttcgccgtgataggccggaaccatgctgccgaagtagttggcgatcatgctgtcgtaagcggcggtgtgttcgaaggctttaatggcgaggtcgaagcgggtggccagcgtgagggaaccttcgttggcgtccatctcattaatgatggcgtcgtagtcgctgctcttaactacgatggcgacatctttatggttcttcgccgcggagcgcaccatggtcgggccgccgatatcgatgttttccaccgcgtcttccagcgagcatccttcacgagcgacggtctgggcgaacgggtaaaggttaacgacaaccatatcgataggcgcgataccgtgttgctgcatgataccgtcatcctgaccgcgacgaccgaggatgccgccgtgtactttcggatgcagggtcttcacgcgtccatccatcatttccgggaaaccggtgtagtcagagacttcggtaaccggcaggcctttatctgccagcaggcgagcggtgccgccggtggacagcagctcgacaccacgagcggaaagcgcctgcgcgaattcgacgataccggccttgtcagaaacactgagcagagcgcggcggactggacgacgttgttgcatggtattaaatccccaggatttgaacattacagagagcgttag

SEQ ID NO: 13 - DNA, 1644 bp, Klebsiella pneumoniae
gcaaaaactcacctaacgctctctgtaatgttcaaatcctggggatttaataccatgcaacaacgtcgtccagtccgccgcgctctgctcagtgtttctgacaaggccggtatcgtcgaattcgcgcaggcgctttccgctcgtggtgtcgagctgctgtccaccggcggcaccgctcgcctgctggcagataaaggcctgccggttaccgaagtctctgactacaccggtttcccggaaatgatggatggacgcgtgaagaccctgcatccgaaagtacacggcggcatcctcggtcgtcgcggtcaggatgacggtatcatgcagcaacacggtatcgcgcctatcgatatggttgtcgttaacctttacccgttcgcccagaccgtcgctcgtgaaggatgctcgctggaagacgcggtggaaaacatcgatatcggcggcccgaccatggtgcgctccgcggcgaagaaccataaagatgtcgccatcgtagttaagagcagcgactacgacgccatcattaatgagatggacgccaacgaaggttccctcacgctggccacccgcttcgacctcgccattaaagccttcgaacacaccgccgcttacgacagcatgatcgccaactacttcggcagcatggttccggcctatcacggcgaaagcaaagaagccgctggccgcttcccgcgtaccctgaatctgaacttcattaagaagcaggatatgcgctacggcgaaaacagccaccagcaggcggctttctatatagaagagaatgtaaaagaggcctccgtggcgaccgccactcagctgcagggcaaagcgctctcctataacaacattgccgataccgatgcggcgctggagtgcgtgaaagagttcaacgagccggcctgcgttatcgtcaagcatgccaacccgtgcggcgttgccgtcagcgactcgattcttgacgcctacgatcgcgcttacaaaaccgacccgacctccgcgttcggcggcatcattgcctttaaccgcgagctggatgctgaaaccgcgcaggcgatcatctctcgccagttcgtcgaagtgatcatcgcgccgtccgccagcgaagaagcgctgaaaatcaccgccgcgaagcagaacgtccgcgtactgacctgcggccagtgggatactcgcgttgccggcctcgatttcaaacgcgttaacggtggtctgctggttcaggaccgcgatctcggtatggtcaccgcgggcgaactgcgcgtggtcagcaaacgtcagccgagcgagcaagagctgcgcgatgcgctgttctgctggaaagtagcgaaattcgtcaaatccaacgccatcgtttatgccaaagataatatgaccatcggtataggcgccggtcagatgagccgcgtctactcggcgaaaatcgccggaattaaagccggtgatgaaggtctggaagtgaaaggttccgccatggcctctgacgctttcttcccgttccgcgacggcatcgatgccgcagccgcggtaggcatcacctgcgttattcagccgggcggctctatccgtgacgacgaagtgattgccgccgctgacgaacacggcatcgccatgatcttcaccgacatgcgccacttccgccattaa

SEQ ID NO: 14 - DNA, 546 bp, Klebsiella pneumoniae
agtgagttccagagcataggctctggcaaacatccaggagcaaagctaatggctttaaatcttcaagacaaacaagcgattgttgctgaagtcagcgaagtagccaaaggcgcgctgtctgcagtagttgcggattcccgtggcgtaactgtagataaaatgactgaactgcgtaaagcaggtcgtgaagctggcgtatacatgcgtgttgttcgtaacaccctgctgcgccgcgtcgttgaaggtactcagttcgagtgcctgaaagacacgtttgttggtccgaccctgattgcatactctatggaacacccgggcgctgctgctcgtctgttcaaagagttcgcgaaagcgaatgcaaaatttgaggtcaaagccgctgcctttgaaggtgagctgatcccggcgtcgcagatcgaccgcctggcaactctgccgacctacgaagaagcaattgcacgcctgatggcaaccatgaaagaagcttcggctggcaaactggttcgtactctggctgctgtacgcgatgcgaaagaagctgcttaa

SEQ ID NO: 15 - DNA, 603 bp, Klebsiella pneumoniae
ttcatggagcagcagatgaaagtattagtaatcggcaacggcgggcgtgagcacgcgctggcctggaaagcggctcagtcgccgctggttgataccgtctacgtcgcgccgggcaacgccggtaccgccctggagccgtcgctgcaaaacgtcgccatcggcgtcaccgatattccggcgctgcttcgcttcgcgcaggatgagaacatcgatctgaccatcgttggcccggaagcgccgttggtcattggcgtggtcgacgcgttccgtgccgccgggctgaacattttcgggccaaccgaaggcgccgcgcagctggaaggctcaaaagccttcaccaaagattttctcgcccgtcatcatattccgacggcggaataccagaacttcaccgaagtggagcctgcgctggcttatctgcgcgagaaaggcgcgccgatcgtcatcaaagccgacggtctggcggcgggtaaaggcgttatcgtggcgatgaccctcgaggaagccgaagcggcggtcaaagatatgctggccggcaacgcctttggcgacgcaggccaccgcatcgtgattgaagagttcctcgatggcgaagaaggctag

SEQ ID NO: 16 - DNA, 708 bp, Klebsiella pneumoniae
gaaatggctaaactgaccaagcgcatgcgcgtgatccgtgagaaagttgatgcaactaaacagtacgacatcaacgaagccattgctctgctgaaagagctggccaccgctaaatttaccgaaagcgtagacgttgccgttaacctcggcatcgacgctcgtaaatctgaccagaacgtccgtggcgcaactgtactgccgcacggtactggccgttccgttcgcgtagccgtatttacccagggcgcaaacgctgaagctgctaaagctgcaggcgctgagctggtaggtatggaagatctggctgagcagatcaaaaaaggcgaaatgaactttgacgttgttattgcttccccggatgcaatgcgcgttgttggccagctggggcaggttctgggtccgcgtggcctgatgccgaacccgaaagtaggtaccgtaactccgaacgttgctgaagcggttaaaaacgcgaaagcaggccaggttcgttaccgtaacgacaaaaacggcatcatccacaccaccatcggtaaagtggactttgacgctgacaaactgaaagaaaacctggaagctctgctggttgcgctgaaaaaagcaaaaccgactcaggcgaaaggcgtgtacatcaagaaagttagcatctccaccactatgggtgcaggtgttgcagtagatcaggctggcctgaacgcttctgcaaactaa

SEQ ID NO: 17 - DNA, 276 bp, Klebsiella pneumoniae
cttatgaacaagactcaactgattgatgtaattgcggacaaagctgacctgtccaaagcacaggctaaagctgccctggaatctaccctggctgcaattactgagtctctgaaagaaggtgatgctgttcaactggttggtttcggtaccttcaaagtgaaccaccgcgctgagcgtactggccgcaacccgcagaccggtaaagagatcaaaatcgctgcagctaacgtgccggcatttgtttctggcaaagcactgaaagacgcagttaagtaa

SEQ ID NO: 18 - DNA, 1077 bp, Klebsiella pneumoniae
aggaatgtaaaaatgaccgaactgaagaacgatcgttacctgcgcgcgctgctgcgtcagccggttgatgtcaccccggtgtggatgatgcgccaggcgggccgctatttaccggagtacaaagccacccgtgcgcaagcgggcgactttatgtcgctgtgtaaaaatgccgagctggcctgcgaagtgacgctccagccgctgcgccgttacccgctggacgcggcgatcctcttttcggacatcctgaccatcccggacgccatggggctggggctgtactttgaagctggcgaaggtccgcgcttcacctcgccggtaaaaagtaaagccgacgtcgacaagctgccgatcccggatccggagcaggagctgggctatgtaatgaacgccgtgcgcaccattcgccgcgaactgaaaggcgaagtgccgctgatcggtttttccggtagtccatggacgctggctacgtacatggtggagggcggcagcagcaaggctttcaccgtgattaaaaagatgatgtacgccgagccgcaggcgctgcatgcgctgctggataagctggcgaagagcgttaccctgtatctcaacgcgcagatcaaagccggcgcgcagtcggtgatgatttttgacacctggggcggggtgctgaccggccgcgactatcagcagttctccctctactacatgcataagatcgtcgatggcctgctgcgggaaaacgaaggccgtcgcgtgccggtgaccttgttcaccaaaggcggtggtcagtggctggaagcgatggcggagaccggctgcgatgcgttgggtctcgactggaccaccgatattgccgatgcccgccgtcgcgtgggtaacaaagtagcgctgcagggcaatatggatccgtcgatgctctatgcgtccgccccgcgtattgaagaagaagtggcgaccattcttgccggctttggccagggggaaggccacgtctttaaccttggacacggtattcatcaggacgttgaccccgagcatgcgggcgtctttgttgaggctgtgcaccgtctgtccgcaccctatcaccagtag

SEQ ID NO: 19 - DNA, 588 bp, Klebsiella pneumoniae
gcgagtaaaaatgactcgcctgaccctggcggaacgggtcatttttactcgctctcctcggcaaaggcttcggcaggcccacacagacgggctttttcagactggcatggaagatgcaataccgagggaaaccacacaggagaaaatgccatgaaacggaaccgtaccttacctctcgccctcgttacctttgccgcgctgaccttcgccagcaacgcggcctgggccaaccaccactggggcaacaataacgggatgggcaaccagggctacagtcagctgacccaggagcagcaggctaccgtgcaaaagctgcataacgattactatgcgcaaaccagcgccctgcgccagcagctgcagtccaaacgctatgagtacaatgcgctgctcacggcgcaaaagccggacagcgggaagattgaagctgtcgctcaggagatggaaggcttacgccagaagctggatcagcagcgggtgaagtttgatatcgccctggctgaggcaggcgttccccgcggcgcaggaatgggatatggcggctgtcgcggtagcgccgacggtcatatgggcatgcaccactggtaa

SEQ ID NO: 20 - DNA, 2403 bp, Klebsiella pneumoniae
gggccgggaaagcggcggaaaatagacaataaaaaaagccggtcaggaaacctgaccggctttttagcagtgcatcaacgattaatcgttgtcagaaccgcccagacctgcgttcagcagctctgccaggttggcagacgcttcttccacgctcacctgcggtgccgccggcagctcgccagcagcgcgacggcgcatacgatcctggtgatacgcataaccggtaccggccgggatcagacgacccacgatgacgttctctttcagaccgcgcagttcgtcgcgtttgcccgcaacggctgcttcggtcagcacgcgagtggtctcctggaacgatgccgcggagatgaaggactcggtggccagagacgctttggtgatacccagcagatcgcgggagaacgttgcgcccactttgccgttcgcttccagttcgcggttcgcgatcttgacgcgggagtattccacctgctcgccttcgaggaagtcggagctgcctgcgctttcgatggtggctttacgcagcatctgacgaacgataacttcgatgtgcttatcgttaatcttaacgccctgcagacggtatacgtcctggacttcgttaacaatgtaacgggtcacagcatgtacgccacgcagacgcagaatgtcgtgcggtgcttccggaccgtcggaaaccacatcaccacgttccacacgttcaccttcgaacacgttgagctgacgccatttcgggatcatctcttcgtacggctcgctaccgtctaccggggtgataaccaggcgacgtttccctttggtttctttaccgaaggaaatgataccgctgatttcagccaggatagccggctctttcggacgacgtgcttcgaacaggtccgcaacgcgcggcagaccaccggtgatatccttggtaccgccggattcctgcggaatacgcgccagggtgtcaccagagctgatctgtacgccatcttccagctgaacaatcgctttacccggcaggaagtactgagcaggcatatcagtgcctgggatcagaacgtcgttgccctgagcatcaacgattttcagtgctggacgcagatctttaccacctgcggtacgttctgcagagtccagaaccaccagcgaagacagaccggtcagctcgtcagtctgacgagtaatggtctggccgtcgatcatgtcagtgaaacggatgaaaccgctaacttcggtgataaccggcatggtgtgcggatcccagtttgcgacggtttcaccgccggcaacctgctcaccgtcgcctttcgccataaccgcaccgtaaggtactttatagctctctttggtacgaccgaattcgtcgatcagcttcagctcggtattacgggaagtgataaccagcttaccactggagttcacaaccgacttcgcgttgctgagcttgatgctacctttgtttttcacctggatgctggattcagcagccgcacgagatgccgcaccaccgatgtggaacgtacgcatcgtcagctgtgtacccggctcaccgatggactgtgccgcgataacgccgatagcctcacctttgttgatgaggtggccacgcgccaggtcacgaccatagcagtgcgcgcagacgccaaagtcggtgtcacaggatacaacggaacgcactttgacggagtcaacggagttcgcttccagcaggtcacaccagtgctcatgcagcagcgtgttgcgtggaaccagaatatccgcggtacccggcttcagaacatcttccgcagtcacacgacccagtacgcgatcgcgcagcggctctttaacgtcgccaccttcgataaccggcgtcatggtgatgccttccagggtgccgcagtcgtcttcagtgacgaccaggtcctgtgcaacgtcaaccagacggcgagtcaggtaaccggagttcgctgttttcagtgcggtatccgccagacctttacgagcaccgtgggtagagatgaagtactggagtacgttcagaccttcacggaagttcgcggtgatcggcgtttcgatgatggagccatccggcttcgccatcagaccacgcataccagccagctgacgaatctgtgccgcagaaccacgcgcaccggagtcggccatcatgtagatgctgttgaaggaaacctgctgctcttcctgaccgtcacggttaatcacggtttcggtttgcaggttatccatcatcgctttggatacacgatcgttcgccgcagcccagatatcgataactttgttgtagcgttcgcccgcggtcaccagaccggactggaactgttcctgaatctcagcaacttccgcttccgcttcgctgatgatttcgtattttttctccgggatgaccatgtcatcgataccaacggatgcacctga

SEQ ID NO: 21 - DNA, 906 bp, Klebsiella pneumoniae
cccagctcgaacagcagcagccgggcgttgcgctggcgctcaatcaacacatcctgccgcgcgaccggtgggaagatcatctcttgcaggaaggcgatcgggtcctgctttttcaggttatcgctggaggctgacatgttacgtattgcagacaaaacgtttgaatcccatcttttcaccggtaccggcaaattcgccgccccggaggtgatggtcgaggcgattcgcgcctcgggcagccagctggtaaccctggcgatgaagcgcgtcgatttacgccagcgcaatgacgccatcctcgccccgctgctggcggcgggggttaacctgctgccgaatacctcaggcgccaagacggcggaagaggcggtgtttgccgcccgcctggcgcgggaagccctgggtacccactggctgaagctggagatccacccggacgcccgctggctgctgcccgacccgattgaaaccctgaaagcggcggagctgctggtccgcgaagggttcgtggtgctgccctactgcggcgccgatccggtgctgtgtaaacgactggaagaggtaggctgcgcggcggtgatgccgctgggtgcgccgatcggctccaatcaggggctggaaaccaaagccatgctggagattattatcgagcaggcgacggtcccggtggtggtcgacgccgggatcggcgtcccgagccatgcggcgcaggcgctggagatgggcgcggacgcggtgctggtcaataccgccattgccgtcgccgacgaccccgtggccatggcccgcgccttccgtatggcgatcgatgccggattactggcgcgtcaggccggaccgggggcacgcagtacgcaggcgcaggccaccagcccgctcaccggattcctggaggcgctggcatga

SEQ ID NO: 22 - DNA, 4083 bp, Klebsiella pneumoniae
aaaactgccctctgcgggcagatgggtcgacttgtcagcgagctgaggaaccctatggtttactcctataccgagaaaaaacgtattcgtaaggattttggtaaacgtccacaagttctggatgtgccatatctcctttctatccagcttgactcgttccagaagtttatcgagcaagatcctgaagggcagtatggtctggaagctgctttccgttccgtattcccgattcagagctacagcggtaattccgagctgcaatacgtcagctaccgtctgggcgaaccggtttttgacgttaaagaatgtcagatccgtggcgtgacttattctgcaccgctgcgcgtaaaactgcgtctggtgatctacgagcgcgaagcgccagaaggcaccgtcaaagacattaaagaacaagaagtctacatgggcgaaattccgctcatgaccgacaacggtacctttgttatcaacggtaccgagcgtgttatcgtttctcagctgcaccgtagcccgggcgtcttctttgacagtgacaaaggtaagacccactcctccggtaaggttctgtataacgcacgtatcatcccttaccgcggttcctggctggacttcgaattcgacccgaaagacaacctgttcgttcgtatcgaccgtcgtcgtaagctgccggctaccatcatcctgcgcgcgctgaattacaccactgagcagatccttgacctgttcttcgaaaaagtggtctttgaaattcgcgacaacaagctgcagatggagctgattccggagcgtctgcgcggtgaaactgcctccttcgatatcgaagccaacggcaaagtgtacgttgagaaaggccgtcgcatcacggctcgtcatatccgtcagctggaaaaagacgatatcaagcatatcgaagtgccggttgaatatatcgcgggcaaagtggcggctaaagactatatcgatgaagcgactggcgaactgatctgcccggcgaacatggagctgagcctggatctgctggctaagctgagccagtctggccacaagcgtatcgaaacgctgttcaccaacgatctggaccacggcccgtacatctctgaaacggtacgcgtcgacccgactaacgatcgtctgagcgcgctggtagaaatctaccgcatgatgcgccctggcgagccgccgactcgtgaagccgctgaaagtctgtttgagaacctgttcttctctgaagaccgctacgatctgtccgcggttggtcgtatgaagttcaaccgttctctgctgcgcgacgaaatcgaaggttccggtatcctgagcaaagacgacatcatcgaagtgatgaagaagctcatcgatatccgtaacggtaaaggcgaagtggacgatatcgaccacctcggcaaccgtcgtatccgttccgttggcgaaatggcggaaaaccagttccgcgttggcctggtacgtgtagagcgtgcggtgaaagagcgtctgtctcttggcgatctggataccctgatgcctcaggatatgatcaacgccaagccgatttccgcagcagtgaaagagttctttggttccagccagctgtctcagtttatggaccagaacaacccgctgtctgagattacgcacaaacgtcgtatctccgcactcggcccaggcggtctgacccgtgagcgcgcaggcttcgaagttcgagacgtacacccgacccactacggtcgcgtatgtccgatcgaaacgcctgaaggtccgaacatcggtctgattaactccctgtccgtgtacgcgcagaccaacgaatatggcttccttgagacgccgtatcgtaaagtgaccaacggtgtggttactgacgaaattcactacctgtctgctatcgaagaaggcaactacgttatcgctcaggcgaactccaacctggatgaaaacggccacttcgtagaagatctggttacctgccgtagcaaaggcgaatccagcttgttcagccgcgaccaggttgactacatggacgtatccacccagcaggtggtatccgtcggtgcgtccctgatcccgttcctggaacacgatgacgccaaccgtgcattgatgggtgcgaacatgcaacgtcaggcggttccgactctgcgcgctgataagccgctggttggtaccggtatggaacgtgctgttgccgttgactccggtgttactgccgtggctaaacgtggcggtaccgttcagtacgtggatgcttcccgtatcgttatcaaagttaacgaagacgagatgtacccgggcgaagcaggtatcgacatttataacctgaccaagtacacccgttctaaccagaacacctgcatcaaccagatgccttgcgtgtccctgggcgaacctattgagcgcggcgacgtgctggcagacggcccgtccaccgacctcggtgagctggcgctgggtcagaacatgcgtgtagcgttcatgccgtggaacggttacaacttcgaagactccatcctcgtttccgagcgtgttgtccaggaagaccgtttcaccactatccacattcaggaactggcgtgcgtgtcccgtgacaccaagctggggccggaagagatcaccgctgacatcccgaacgtgggtgaagctgcgctctccaaactggatgaatccggtatcgtttatatcggtgcggaagtgaccggcggcgacattctggttggtaaggtaacgccgaaaggtgaaacccagctgacgccggaagagaaactgctgcgcgcgatcttcggtgagaaagcgtctgacgttaaagactcttctctgcgcgtaccgaacggtgtctctggtaccgttatcgacgttcaggtctttacccgtgacggcgtagaaaaagacaaacgtgctctggaaatcgaagagatgcagctgaagcaggccaaaaaagacctgtctgaagaactgcagatcctcgaagccggtctgttcagtcgtatctacgcggtgctggtctccggtggcgttgaagctgagaagctcgacaagctgcctcgcgatcgctggctggaactgggcctgaccgacgaagagaaacaaaatcagctggaacagctggctgagcagtatgacgaactgaaacacgagttcgagaaaaaactcgaagcgaaacgccgtaaaatcacccaaggcgacgatctggcaccgggcgtgctgaagattgttaaggtatatctggccgttaaacgccgtatccagcctggtgataagatggcgggtcgtcacggtaacaagggtgttatctctaagatcaacccgatcgaagatatgccgcacgatgctaacggtacgccggtagatatcgtactgaacccgctgggcgtaccgtctcgtatgaacatcggtcagatccttgaaactcacctgggtatggctgcaaaaggcatcggcgataagatcaacgccatgctgaaacagcagcaggaagtcgcgaaactgcgcgaattcatccagcgtgcttacgatctgggcgctgacgttcgccagaaagttgacctgaataccttcagcgatgaagaagttctgcgtctggctgaaaacctgcgtaaaggcatgccgatcgcaacgccggtattcgacggtgcgaaagaagctgaaatcaaagagctgctgcagctgggcgacctgccgacttccggtcagatcaccctgtttgatggccgcaccggtgaacagttcgaacgtccggtaaccgtgggttacatgtacatgctgaaactgaaccacctggtcgacgacaaaatgcacgctcgttccaccggttcttacagcctggttactcagcagccgctgggtggtaaggcacagttcggtggtcagcgcttcggtgagatggaagtgtgggcgctggaagcatacggcgcggcctacaccctgcaggaaatgctcaccgttaagtctgatgacgtgaacggtcgtaccaagatgtataaaaacatcgtggacggcaatcaccagatggaaccgggcatgccggaatccttcaacgtactgttgaaagaaattcgctcgctgggcatcaacatcgaactggaagacgagtaa

SEQ ID NO: 23 - DNA, 1419 bp, Klebsiella pneumoniae
aaaagagatgacaaggactcgccgatgaagatcaaatctctctcccgggacgccgccgctggcgcgctgagctggctgctgaccggcacggttgtgctgctggtcatgctgttctccgcgatgatcgtccgcgactacggtcgcgagacgaccgctgcccgacaaaccattgaagagaaagggagcgtgctgatccgcgcgctggagtccggcacgcgcgtcgggatggggatgcgtatgcatcatgcgcagctgcaggccctgctggaagagatggcctggcaaccgggcgtcctgtggttcgcggtgaccgatgaaaacggtaaaattatcgcccatagcgatccgcagcaggtgggtaaaacgctgtatagcccggcgcagatgcgtgcgttagcggttggcgaacaggcccgctggcgccggcttagcgaaccgcagccggcgctggagatctatcgccattttcgcccgcttaatccggcccgcggccaccatatgggaatgatgaaccgcggcaatagcgccctggctcaggccaccgtcccgcaggtgatttttatcgcctttgatagccgcgagctggatgccgcgcaggcccgcgggcagcggaatatggccatcatgctgggtgccgccgcgctggtgatagcggcgacgatcctcgctcagttctggttccgccgctatcgtcgctcgcggaaacagctgctggaggcgatggcccgcaaggaaaagctggtggcgcttggccatctggcggcgggggtcgcgcacgagatccgcaacccgctctcgtcgattaaagggctggcgaaatattttgccgaacgcacgccgcctggcggcgagtcgcatcagttagcccaggtgatggccaaagaggctgatcgcctgaaccgggtggtcagcgagctgctggagctggtccggcccgcccatctaaactaccagacagtcgatatcaacgcgcttatccgccactcattgcagttggtaagccaggatgcgcagagccgcgggatcgcgctgcaatttactccgcgacctgagttaaccacgatcagcgccgaccccgatcgcctgaatcaggtgctgttgaatctgtacctgaatgcaatgcaggcgattggccgtgacggcgtcattcgcgtaacagcaagcgaagccgatcgtcagcgggtgaaaatcgtcgtcacggatagcggtaaggggatgagcgatgaagagttacaggctatcttcacgccgtatttcaccaccaaggcggacggcaccgggctggggctggccgtagtgcagaatattatcgaacaacatggcgggacgatccgcgccgaaagtcagccgggagctggagcgatatttacgctttggttaccggtggatgctcaacggagggaagatgagcagcgataa

SEQ ID NO: 24 - DNA, 321 bp, Klebsiella pneumoniae
tcgatggaagatttagaaacgatcatcatggagctgctggttaacgcgggttccgcacgtagcgcggcgctgacggcgctacagctggcgcgcaaaggcgattttgtcgccgcggagcaggccatggctgaatcccatgagttcgtcaaacatgcgcataaaattcagacccagcttatcggcatggatgaaggcagcggtaaattgccggtcaacctgatcaccgtgcattcccaggaccatctgatgaacgctatggtcattcaggatctggcgaccgacatgattgaactctatcgtcgtctgcccctcgcgcaataa

SEQ ID NO: 25 - DNA, 774 bp, Klebsiella pneumoniae
cgctggcgggagcgggcgatgaatgatcacgactttatgcgctatagccgccagctgctgctggaggatattgccatcgaagggcagcagaagctgttagccagtcgagtgctgattatcggccttggcgggctgggctccccggcggcgctctatctggccggggctggcgtcgggacgctgaccctggccgatgacgacgcggtgcatctcagcaacctgcaacggcagatcttgttcaccagcgcggatatcgatcggccaaaagccgcagcggcacagactcggctcagccagctaaacccgcagatcaaactggtagcgctccagcagcgcttaagcggcgaggcgctccgcgccgaagtggcgaaagcggacgtggtgctggactgtaccgataatatggtcacccgccaggcgatcaatgccgcctgtgtggccctcgataccccgttagtgaccgccagcgccgtgggcttcggcggtcagctgatggtgctcaccccgccctggacgcagggctgctatcgctgcctgtggccggaaagcgatgaaccgcagcgcaactgccgcaccgcggggatcgtcggcccggtggtcggcatgatgggcaccctgcaggcgctggagacgattaagctgctcagcggcatggcgacgccgcgcaacaccctgcggctgttcgacgcccgcaccagcaactggcgcgcccttgcgctacagcgctcccggagctgcccggtgtgcggagggcggcatgcagatctggtttaa

SEQ ID NO: 26 - DNA, 225 bp, Klebsiella pneumoniae
ctttgctcctggatgtttgccagagcctatgctctggaactcacttcactcaattcaacgaaaagagcgtctaaatacggtgagcagaaacaagccagaatatccaaaaataatcttagcgttctgtcaccgtctacgcaggggattaagtttcttgcgaaacacctgcggtcttcgacggaggcctggataggccaggctccaacgaacaaattcttcctatga

SEQ ID NO: 27 - DNA, 351 bp, Klebsiella pneumoniae
tgggcaccctgcaggcgctggagacgattaagctgctcagcggcatggcgacgccgcgcaacaccctgcggctgttcgacgcccgcaccagcaactggcgcgcccttgcgctacagcgctcccggagctgcccggtgtgcggagggcggcatgcagatctggtttaacgacgagccgctggcgtgcgccgacaatctcagcgtcagcgccctgctgacccagctcgaacagcagcagccgggcgttgcgctggcgctcaatcaacacatcctgccgcgcgaccggtgggaagatcatctcttgcaggaaggcgatcgggtcctgctttttcaggttatcgctggaggctga

SEQ ID NO: 28 - DNA, 468 bp, Klebsiella pneumoniae
ctgatgcgactcgccgccaggcggcgtgcgttcggcaaaatatttcgccagccctttaatcgacgagagcgggttgcggatctcgtgcgcgacccccgccgccagatggccaagcgccaccagcttttccttgcgggccatcgcctccagcagctgtttccgcgagcgacgatagcggcggaaccagaactgagcgaggatcgtcgccgctatcaccagcgcggcggcacccagcatgatggccatattccgctgcccgcgggcctgcgcggcatccagctcgcggctatcaaaggcgataaaaatcacctgcgggacggtggcctgagccagggcgctattgccgcggttcatcattcccatatggtggccgcgggccggattaagcgggcgaaaatggcgatagatctccagcgccggctgcggttcgctaagccggcgccagcgggcctgttcgccaaccgctaa

SEQ ID NO: 29 - DNA, 372 bp, Klebsiella pneumoniae
agcggttgtcgcatcgccagggccgcgataaagataagacatcacggaacacaagggccactgactatgaagaatatcgttttgtgctgtgccgccggtatgtctaccagcatgctggttcagcgtatgcaagatgccgcgcagaagaagggtgttgaggtctctatcaaggccgtaccggtcgctgagtttaaagataatctggccgccgccgacattattttgctcggcccgcaggtgaaatatgagcaggcgaagctgcaggcgctggccgacccgttcggcaagaaggtcgccgtgatcgatatgatggactacggcatgatgaaaggtgatgccgttctggataaagcccttaagatgctggagtaa

SEQ ID NO: 30 - DNA, 4206 bp, Klebsiella pneumoniae
cacattccgctgccgggcgttaacccggcagcagtgaacttgtttgagcgagaattactcgtcttccagttcgatgttgatgcccagcgagcgaatttctttcaacagtacgttgaaggattccggcatgcccggttccatctggtgattgccgtccacgatgtttttatacatcttggtacgaccgttcacgtcatcagacttaacggtgagcatttcctgcagggtgtaggccgcgccgtatgcttccagcgcccacacttccatctcaccgaagcgctgaccaccgaactgtgccttaccacccagcggctgctgagtaaccaggctgtaagaaccggtggaacgagcgtgcattttgtcgtcgaccaggtggttcagtttcagcatgtacatgtaacccacggttaccggacgttcgaactgttcaccggtgcggccatcaaacagggtgatctgaccggaagtcggcaggtcgcccagctgcagcagctctttgatttcagcttctttcgcaccgtcgaataccggcgttgcgatcggcatgcctttacgcaggttttcagccagacgcagaacttcttcatcgctgaaggtattcaggtcaactttctggcgaacgtcagcgcccagatcgtaagcacgctggatgaattcgcgcagtttcgcgacttcctgctgctgtttcagcatggcgttgatcttatcgccgatgccttttgcagccatacccaggtgagtttcaaggatctgaccgatgttcatacgagacggtacgcccagcgggttcagtacgatatctaccggcgtaccgttagcatcgtgcggcatatcttcgatcgggttgatcttagagataacacccttgttaccgtgacgacccgccatcttatcaccaggctggatacggcgtttaacggccagatataccttaacaatcttcagcacgcccggtgccagatcgtcgccttgggtgattttacggcgtttcgcttcgagttttttctcgaactcgtgtttcagttcgtcatactgctcagccagctgttccagctgattttgtttctcttcgtcggtcaggcccagttccagccagcgatcgcgaggcagcttgtcgagcttctcagcttcaacgccaccggagaccagcaccgcgtagatacgactgaacagaccggcttcgaggatctgcagttcttcagacaggtcttttttggcctgcttcagctgcatctcttcgatttccagagcacgtttgtctttttctacgccgtcacgggtaaagacctgaacgtcgataacggtaccagagacaccgttcggtacgcgcagagaagagtctttaacgtcagacgctttctcaccgaagatcgcgcgcagcagtttctcttccggcgtcagctgggtttcacctttcggcgttaccttaccaaccagaatgtcgccgccggtcacttccgcaccgatataaacgataccggattcatccagtttggagagcgcagcttcacccacgttcgggatgtcagcggtgatctcttccggccccagcttggtgtcacgggacacgcacgccagttcctgaatgtggatagtggtgaaacggtcttcctggacaacacgctcggaaacgaggatggagtcttcgaagttgtaaccgttccacggcatgaacgctacacgcatgttctgacccagcgccagctcaccgaggtcggtggacgggccgtctgccagcacgtcgccgcgctcaataggttcgcccagggacacgcaaggcatctggttgatgcaggtgttctggttagaacgggtgtacttggtcaggttataaatgtcgatacctgcttcgcccgggtacatctcgtcttcgttaactttgataacgatacgggaagcatccacgtactgaacggtaccgccacgtttagccacggcagtaacaccggagtcaacggcaacagcacgttccataccggtaccaaccagcggcttatcagcgcgcagagtcggaaccgcctgacgttgcatgttcgcacccatcaatgcacggttggcgtcatcgtgttccaggaacgggatcagggacgcaccgacggataccacctgctgggtggatacgtccatgtagtcaacctggtcgcggctgaacaagctggattcgcctttgctacggcaggtaaccagatcttctacgaagtggccgttttcatccaggttggagttcgcctgagcgataacgtagttgccttcttcgatagcagacaggtagtgaatttcgtcagtaaccacaccgttggtcactttacgatacggcgtctcaaggaagccatattcgttggtctgcgcgtacacggacagggagttaatcagaccgatgttcggaccttcaggcgtttcgatcggacatacgcgaccgtagtgggtcgggtgtacgtctcgaacttcgaagcctgcgcgctcacgggtcagaccgcctgggccgagtgcggagatacgacgtttgtgcgtaatctcagacagcgggttgttctggtccataaactgagacagctggctggaaccaaagaactctttcactgctgcggaaatcggcttggcgttgatcatatcctgaggcatcagggtatccagatcgccaagagacagacgctctttcaccgcacgctctacacgtaccaggccaacgcggaactggttttccgccatttcgccaacggaacggatacgacggttgccgaggtggtcgatatcgtccacttcgcctttaccgttacggatatcgatgagcttcttcatcacttcgatgatgtcgtctttgctcaggataccggaaccttcgatttcgtcgcgcagcagagaacggttgaacttcatacgaccaaccgcggacagatcgtagcggtcttcagagaagaacaggttctcaaacagactttcagcggcttcacgagtcggcggctcgccagggcgcatcatgcggtagatttctaccagcgcgctcagacgatcgttagtcgggtcgacgcgtaccgtttcagagatgtacgggccgtggtccagatcgttggtgaacagcgtttcgatacgcttgtggccagactggctcagcttagccagcagatccaggctcagctccatgttcgccgggcagatcagttcgccagtcgcttcatcgatatagtctttagccgccactttgcccgcgatatattcaaccggcacttcgatatgcttgatatcgtctttttccagctgacggatatgacgagccgtgatgcgacggcctttctcaacgtacactttgccgttggcttcgatatcgaaggaggcagtttcaccgcgcagacgctccggaatcagctccatctgcagcttgttgtcgcgaatttcaaagaccactttttcgaagaacaggtcaaggatctgctcagtggtgtaattcagcgcgcgcaggatgatggtagccggcagcttacgacgacggtcgatacgaacgaacaggttgtctttcgggtcgaattcgaagtccagccaggaaccgcggtaagggatgatacgtgcgttatacagaaccttaccggaggagtgggtcttacctttgtcactgtcaaagaagacgcccgggctacggtgcagctgagaaacgataacacgctcggtaccgttgataacaaaggtaccgttgtcggtcatgagcggaatttcgcccatgtagacttcttgttctttaatgtctttgacggtgccttctggcgcttcgcgctcgtagatcaccagacgcagttttacgcgcagcggtgcagaataagtcacgccacggatctgacattctttaacgtcaaaaaccggttcgcccagacggtagctgacgtattgcagctcggaattaccgctgtagctctgaatcgggaatacggaacggaaagcagcttccagaccatactgcccttcaggatcttgctcgataaacttctggaacgagtcaagctggatagaaaggagatatggcacatccagaacttgtggacgtttaccaaaatccttacgaatacgttttttctcggtataggagtaaaccatagggttcctcagctcgctgacaagtcgacccatctgcccgcagagggcagttttttatgcaacactattttgttgaccggaaaatggaacactttccgcaatgcctgttgctatcacgcttaa

SEQ ID NO: 31 - DNA, 795 bp, Klebsiella pneumoniae
agcaaaggtagtgcaatagatatggatcgtattattgaaaaattagatcgcggctggtgggttgtcagtcacgaacaaaaattatggttgcctggtggagaattaccacatggcgaagcggttaatttcgatcttgtcggccagcatgcgctgcatattggcgagtggcagggcgagtccgtgtggatggtgcgccaggatcgtcgccatgacatgggatcgttgcgccaggtgctggatcaggatccgggactcttccagctggctgggcgggggatccagctcgccgaattttatcgctcgcataaattttgcggttactgcggccacccgatgcatgccagcaaaagcgaatgggcgatgctgtgcagccactgccgtgaacgttactacccgcaaattgccccctgcattatcgtggcaatccgtcgcgacgatgcgatcctgctggcgcaacatacgcgccatcgcaacggcgtgcacaccgtgctggccggctttgtcgaggtcggcgaaacccttgagcaggcggtggctcgcgaggtgatggaggagagcggtattcgggtaaaaaacctgcgttacgtgacctctcagccatggccgttcccgcagtcgctgatgaccgcctttatggcggattacgcagatggcgagatcgtggtcgacaaaaaagagttactgaccgcggactggtatcgctatgacgacctgccgcttctgccgccgccggggacagtggcgcggcggcttatcgaagataccgtcgcgatgtgtcgggcagagttcgagtga

SEQ ID NO: 32 - DNA, 1488 bp, Klebsiella pneumoniae
acgactggaagaggtaggctgcgcggcggtgatgccgctgggtgcgccgatcggctccaatcaggggctggaaaccaaagccatgctggagattattatcgagcaggcgacggtcccggtggtggtcgacgccgggatcggcgtcccgagccatgcggcgcaggcgctggagatgggcgcggacgcggtgctggtcaataccgccattgccgtcgccgacgaccccgtggccatggcccgcgccttccgtatggcgatcgatgccggattactggcgcgtcaggccggaccgggggcacgcagtacgcaggcgcaggccaccagcccgctcaccggattcctggaggcgctggcatgaaaacctttagcgatcgctggcggcagctggagtgggacgatatccgcctgcgcatcaacagcaaaaccgccgccgacgtcgaacgggcgctggcggccaaacagctcacccgcgacgatatgatggccctgctctcgcctgccgcggccaattaccttgaaccgctggcccagcgcgcgcagcgcctcacccgccagcgcttcggcaataccgtcagcttctacgtgccgctgtatctctccaacatgtgcgctaacgactgcacctactgcggcttctcgatgagcaaccgcattaagcgcaagacgctggatgccgccgagattgcccgcgagtgcgccgcgatccgcaacctgggctttgagcatctgctgctggtgaccggcgaacatcagggtaaggtgggaatggattatttccgtcggcacctaccggctatccgcagccagtttgcctcgctgcatatggaggtgcagccgctggcgactgaagagtatgccgagctgaaaaccctggggctcgacggggtgatggtctatcaggagacctatcatgaaagcatgtacgcccaacaccatctgaaaggaaaaaagcaggatttcttctggcggctggatacgccggatcgcttaggcgcggcggggatcgataagatcggccttggcgcgctcatcggcctttccgacagctggcgagtggactgctttatagtcgctgagcacctgctgtggctgcagcagcgctactggcgcagccgctattcggtctccttcccgcgcctgcgtccctgcgccggcggtattgaaccggcttcgctgatggatgagcgccagctggtgcaaactatctgcgccttccgcctgctggcgccagaggttgagctgtcgctatccacccgcgaatcaccctggttccgcgaccgggtgatcccgctggcgatcaataacgtcagcgccttctctaaaacccagcccggcggctacgccgacgatcatccggagctcgagcaatttgccccgcacgacgatcgccgccctgaagaggtcgccagcgcgctggccgcccgcggcctgcagccggtatggaaagactgggatagctggctgggacgcgcttcgcaaacctcatga

SEQ ID NO: 33 - DNA, 474 bp, Klebsiella pneumoniae
aacgctactggcgccttacagcgcaaaaaggctggtgaccaaaaagtcaccagcctcagcctgatttctcaggctgcaaccggaagggttggcttatttaacttcaacttcagcgccagcttcttccagagattttttcagagcttcagcgtcgtctttgctgatgccttctttcagtgcagccggagcagattctaccaggtctttagcttctttcagacccaggccagttgcgccacgtactgctttgataacagcaactttgttagcgccagcagctttcagaattacgtcgaattcagttttttcttcagcagcttcaaccgggccagcagctacagctacagcagcagcagcggaaacaccgaatttttcttccattgcagagatcagctcaacaacgtccattacggacatagcggatactgcttcaatgatttgatctttagtgatagacatttaaattgttcctga

SEQ ID NO: 34 - DNA, 1437 bp, Klebsiella pneumoniae
ccgcatctcatgcttctcccggtcaggcgcagaaataatcccgacaggcaggtagggatcatttttagatctgagtggacaggctctgggggctgcatggaattcgcgatacaactcattattatattaatttgtctgttttatggtgcccgaaaagggggtattgcgctggggctgctgggcggcatcggtttggtgatcctcgtctttgtttttcatctccagccgggcaaaccgccggttgatgtgatgctggtgatcattgcagtggtagccgcctctgcgaccctgcaggcgtccggcgggttagacgtgatgctgcagattgccgagaagctgctgcggcgtaacccgaaatatgtttctatcgtggcgcctttcgtcacctgcacgctgaccatcctctgcggtaccggccacgtggtgtataccatcctgccgattatctacgatgtggcgattaagaataacattcgtccggagcgtccgatggccgccagctccattggcgctcagatggggatcatcgccagcccggtctcggtggcggtggtatcgctggtggcgatgctgggaaattttacctttaacgggaaacacctggagtttctcgatctgctggcgataaccattccgtccacgctgctgggtattttagccatcggtatcttcagctggttccgcggcaaagacctggatcaggacgaagccttccaggcgtttattgcgctaccggagaaccgccattacgtctatggcgatacggcgaccctgctggacaaaaagctgccgaccagcaactggatagcaatgtggatttttctggcctctatcgccgtggtggcgctgcttggcgctttttctgaactgcgcccggcctttgacggtaaaccactgtcgatggtgctggttatccagatgtttatgctgctctccggagcgctgatcatcatcattacaaaaactaacccggcatcgatttccaaaaatgaggtctttcgttcgggaatgatcgctatcgtcgcggtgtacggcatcgcgtggatggcggagaccatgtttggcgcgcacatgaccgagattaaaggcgtgcttggtgaaatggtaaaagagtatccgtgggcttatgccatcgtgctgctactggtttcgaaatttgtgaactcccaggcggcagcgctggcggcgattgtgccagtagccctggccatcggcgtcgacccggcctatatcgtggcttctgcgccggcctgctatggctactatattctgccgacctacccaagcgatctggcggcgatccagtttgatcgctcagggaccacccatatcggccgctttgtgattaaccacagctttatcctgcccgggctcatcggcgtcggcgtctcctgcgtgtttggctgggtattcgcggcgatgtacggctttctgtaa

SEQ ID NO: 35 - DNA, 225 bp, Klebsiella pneumoniae
tcgtcccggatgtataaaccatgggtccgaacgcaggttgcgtctgggacgcctgccgatcgaatcagttcactattgctcaattataactctgaggccttcatgtatcgtgatttatattcggcgataatgtgcaggcctctgctcagcgcggagaggcagggcgaaaatgaggaagaaaaggttcgccctggtcagcgtccgctgctgaccagggcagaatag

SEQ ID NO: 36 - DNA, 1809 bp, Klebsiella pneumoniae
acgcgctgcgtaagcaaagccggtgtacatcgtctggtccgcaaaaataacggtcggtttcagacccagaatacggtaacaggtgttcagcatcttggagatcgctttcttaccaagcgcctggttcacgatagagaacggcagacctttcggtacgatcatccacagaatggcacggccaacggtcgtgtctttcaggctggttttcgcgacaaactcaccattgtcgtctttttcgtattcagtgatacgcactttaacgcgcgcatgcagagaggccaggccggcgcgataaatacgctcagcttctttcgggccagtcagcaccatgccttcgcctttggcgttaacactgtcacgggtcatgtagtacagacccagtacaacgtcctgagacggaacgatgattggttcgccgttcgccggggacaggatgttgttggtagacatcatcagcgcacgcgcttccagctgggcttccagcgtcagcggtacgtgaacagccatctggtcaccatcgaagtcggcgttgtatgccgcacaaaccagcgggtgcagctggatggctttaccttcgatcagaaccggttcgaatgcctgaatacccagacggtgcagggttggcgcacggttcagcaggaccggatgttcgcggataacttcgtccaggatatcccaaacgacagcttcttcgcgctcaaccatcttcttagcggctttgatggtggtggccaggccacgcagttccagcttgccgtagatgaacggtttgaacagctccagcgccattttcttcggcagaccgcactgatgcagacgcaggtatggacctacggtgataacagaacgaccggagtagtcaacgcgtttaccgagcaggttctggcggaaacgaccctgtttacctttgatcatatcggccaaagatttcagaggacgtttgttagaaccggtgatcgcacgaccgcgacgaccgttatccagcagggcgtcaaccgcttcctgcagcatacgtttttcgttgcgtacgatgatatccggcgcagccagatccagcagacgtttcagacggttgttacggttgatcacgcgacgatacagatcgttgaggtcagacgtcgcgaaacgaccaccgtccagcggaaccagcggacgcagatctggcggcagtaccggcagaacggtcaggatcatccactccggcttgttgccagactgaacgaaagcttccagcagcttaatgcgcttggtcagctttttacgcttggtttcggagttggtttcgttcagctcttcacgcagctgctcgcattcctgctccagatccatattgcgcagcagcgcctggatcgcttccgcgcccattttcgcgtcgaattcgtcaccgaactcttccagcgcgtccaggtactgttcttccgtcagaatctggttgcgttcgaggttggtcatgccaccttcgataaccacataggattcaaagtacagtacacgttcgatatcgcgcagcggcatatccagcagcagaccgatacgggacggcagggatttcaggaaccagatgtgcgcagtcggacatgccagctcgatgtggcccatgcgctcacgacgcactttagtctgggtcacttcaacgccgcacttctcacagatcacaccgcggtgtttcaggcgcttgtacttaccgcacaggcactcataatcttttaccggcccaaagatacgggcgcagaaaaggccgtcacgctcaggtttgaacgtacggtagttaatggtttccggctttttaacttcaccgaaagaccatga

SEQ ID NO: 37 - DNA, 1440 bp, Klebsiella pneumoniae
tgcagaatattatcgaacaacatggcgggacgatccgcgccgaaagtcagccgggagctggagcgatatttacgctttggttaccggtggatgctcaacggagggaagatgagcagcgataaggtacagattctggtcgttgatgatgacgtcagccactgcacgatcctgcaggcgctgctgcgcggctggggctatcaggtggggttggctcacaacggcctgcaggcgctggagcagatccatcagcaggtcttcgacctggtgctgtgcgatatccgtatggcggagatggacggtatcgcaacgttaaaagagattaaggcctataacccggcgataccggtgctgatcatgacggcgttttccagcgtcggtacggcggtagaagctattaagtccggggcgctggattatctggttaaaccgctggattttgacaccctgcagcagacgctggttcaggcattggcgcacacccggcagagcgagagcgaccccagcgttgcgacggattcacggtggggcatgattggcgacagcccggcgatgcaggcgcttcttaacgatattacgctggtggcgccctcggacgcgacggtgctgatctgcggcgaatcgggaaccggtaaagaactggtagcgcgcgccattcacgcctgcagcgagcgtcgtgacaagccgttggttacgctcaactgcgcggcgctgaatgagtcactgctggagtcggaactcttcggccatgaaaaaggggcgtttaccggggcggatcggcgacgggaaggacgctttgtcgaggcggatggtggcacgctgttccttgatgaaattggcgatatctcgccgctgatgcaggtgcgtctgctgcgggcgattcaggaacgcgaagtgcagcgcgtgggcagtaatcagacgctttctgtcgatgtgcggctaatcgccgccacccatcgcaaccttgcggaagaggtgagcgccgggcgctttcgccaggatctctattaccgactcaacgtcgtgaccatcgagataccgccgctgcgccggcgacgggaagatattccgcagctggcgcagcattttctcaaacgctataccgaacgcaatcgtaagacggtaaaggggttcacgccacaggcgatggacctgctgatccactacccctggccgggcaatattcgcgagctggaaaacgcggtggagcgggcggtggtgctactgaccggaaactatatctctgagcgagaactgccgctggcgatcgccggtacgccgctgccatcagtcgggagcgaggaggggggaattcagccgttagtggaagtggagaaagaggtgattctggcggcgctggaaaaaacgggcggcaacaaaaccgaagccgcccgtcagttaggcattacgcgcaaaacgctgctggcgaaacttagccgttag

SEQ ID NO: 38 - DNA, 210 bp, Klebsiella pneumoniae
aagcctttttctaaaacctttctttatgtatgggtaaaacttctactcatatcaaaaaataatcaattcaaagggtatatattcaaaatacctgatgaatcatgggattacttctgttgctgtatcttcggcgcgacggcgctggagagggatagccgcatctcatgcttctcccggtcaggcgcagaaataatcccgacaggcaggtag

SEQ ID NO: 39 - DNA, 606 bp, Klebsiella pneumoniae
cttcgagaattcatcatgttacaaaacccgattcacctgcgcctggagaagctggaaagctggcagcatgtcacttttatggcctgcctgtgcgaacgtatgtatcccaactacgcgatgttctgcaagcaaaccgagtttggcgacggcctgctttatcgtcgtatcctggacctgatctgggaaacgctgacggttaaagatgcgaaggtgaatttcgacagccagctggagaagctggaagaagcgatcccggcggcagatgatttcgacatgtacggtgtctatccggccatagacgcttgcgtggcgttgagtgaactgattcattctcgtctgagcggcgaaacgctcgagcacgcgatcgaggtgagcaagacctccatcaccaccgtggcgatgctggaaatgacccaggaaggtcgcgaaatgaccgacgaagagttgaaagcgaatccggcggtagagcaggaatgggatattcagtgggaaattttccgcctgctggccgactgtgaagagcgtgatcttgagctgataaaaggcctgcgcgcggacctgcgcgaggctggcgagagcaatattggtataaattttcagcagtga

SEQ ID NO: 40 - DNA, 828 bp, Klebsiella pneumoniae
agaatttcctccactccagaggcctggacagcacacaccagtatcattttcagcagaatttacagtgaaaatatcatacccatccgctccttctcaaactggccaatggagaaagttaaaatgcagcgtagagattttattaatgcaggtagcgcaatgctgggcgcaatagctttaggtatgtccgcaactgcaaacgcagataacgaaataaaagaatctaataatcccggattatcaggaagcagcaaaatggataacaggttcagcgttgaaaaagatgatgccgtttttatctttgctgatttacatcccggcctggtaagtacatgtaatacgatatctcccgagtctttgactgcaaatgtaggggggcttgcaaaatgtgcaaaagttgtttccgccccttcttactttctgacggttactcaaaatggtaaaccgggcgagctggtaccttcgctcagggagtatgccgatacgcacaacaccatttttcgtaaaatagccgatccattccaggtttctgagattactgacgccattaaacgttctggccgaaaaacccttatagtggctggctacactgctgaagtggctgtcttacttacaaccctgggtggaattcaggctggttacaatgtattcattccagtagactgcatcggtagccgctcttcgagaacagaagacgcagcgctcaggcaggctgagcaggctggaggtgtgattacttctttaagcactcttgcagcgcagtttgctccagatttttctcaggagcccggtaagactattctctctgtgattgcatcaattaaagcctga

SEQ ID NO: 41 - DNA, 936 bp, Klebsiella pneumoniae
catttcatatcattttgtcatgctaatttcgtttttacatttacaggaggggttatgcacagcaggctgaagggtaatgaagtatttttacttgcgagaacgctggctcctgaactaggtaaaaaagagagagctatcgcccgctttatagatgataaccctcagtccctggcacgtatgtcaatcacagaaattgctaattatttgaaggttagcgtatcgagcataaccaaagtctccaaaaaactgggatttaccgggtttcatgatttgaagttaagcgtctctaataacatgaacgccgttgaaaacactgttgacattccggttattcccgattcggaaaagtatgttgaaagtgttcttgaaagtacttttcttaattctgttcttgccctgcaagaatcgttaaatgtcattgattgtgccgtcatcaaatcggttgcatatctattcattaataagcctgaagaagccagaatatttattgctggctgtggcggttcaagtgcaatctgtgatgatttcaatcataagctactaaaaattggtatcttctcatcagtatttagtgatagtcataaacagctgatgactgcatcgctgatgcggcaaggtgatattcttctggccgtgtcccactccggacaaacgtcggatattatccagatggtaaatatggcaaatgagagcggcgcagaaacgatttgtttaactaattatccgaacagtccgcttagccttattgcccgacattcaattatttcggcagtaaaaaataacccgatcacgggcgagaatgctaccacccgaatagtacatctgaatattcttgacgctatttttaccattattgccagtaaaaccagtgacaaaagtaaaaatagcttactcagcaccagaaatgcggtagcgtccaagcgtaccgccagttaa

SEQ ID NO: 42 - DNA, 1218 bp, Klebsiella pneumoniae
gcatgcatatcaggccaccttctcttcagcgtgggcggtatccccggttgcgagggtcattttttccgccagagcggtcagctgcgcgccgagggtttgcgggatggcgagagcggcgacaaagcggtccggtctgaccacggcgatggcggtgttatgctgagcaaaccagctcttcaggcgattttgcctgtcgcccacccgcagcgtgccgggggcgttatcctgctcgcgatggatctgcacctcgggcaccacctggataaagcgcacgccaatcgcgcgccagcgggcgatctgcccggcgtcgagcccccactgcgggttgcagccccagccgataatggcgaaattcgcgccgatgacgtcgtcgagcagcacgctctcgccgctctccagcgtcacctgcggttgaataaacattttgcccaccggcgaggtcttgccggcgcagtccgtcagcagcgccccctcgcggtactgcggcatcggcttaaagcgcatttcgaggaagtagcgtttcaccggcggcaggtaattcagcagccaggagagaccgtcgcgcacggccccctgccagcgcttcggcggcgccagcacgtagccggcggtgaccgacagatcaatcatcgctttcgcgtggtcgcggcgctcctgctggtagctgtcgagcagcgcctctcccgctttaccgttgaccaccagcgccagcttccacgccaggttgaaggcgtcgcgcatgccgctgttgtacccctggccctgccagaccggcatgatgtgcgccgcatcgccggccagcagcacgcggtcgatgcgaaagcgctcggcaaggcgggcgttatgcgtatagacccgctggcggatcagctcgacgcggtccgggtccggcagcactttgctcagcagacggcgcatattgtgcggctcgctgagctgggcttcggtttctccgggcatcaccataaattcaaagcggcgcacgccgtggggcagcgcggcggaaacgtagggtcgcaccgggtcgcagcacaggtaaacatgcggggtggccagcgggtcgttagcgatatcgatgacgatccactgattcggcgcggtcttaccttcgaaggggatgttcagcgtacgacgaataaagctggcgccgccgtcgcaagccaccagccagtccgcgcgcaccgtctcctgttcgccgtccggtcctttaagatttaa

SEQ ID NO: 43 - DNA, 732 bp, Klebsiella pneumoniae
tcgaaatcgtcgcatagtcagcagaacgccagtattcaggaggcatccatggcacattaccggattatcgacaccgcatcctggccccgccgggaccatttcactttttaccgccaattcgccaaccccagctttaatctctgcgtgccgatagcggcgcagcgcctgtacgaatgtgcgaaggaccgtcgggtctcgttttttcagctcgcgctctatgccctgctgcgcgcggccaacggggtaccgcagctacgccagcgcgtgcggaacgatgaggtgattgaatatgacagtctggcagtaatgacgccggtgatgaccgtcggagagggattccgtcaggtgtggtgcgacaacgcccccgagttcaccgccttcagcgccgcggccacgccgaagattgtcgcggcaagagagacatccccggcgccgctcatcgtcgatggcgagcattttatctgcgccagctgtctgccatggctccacttcacctcgatgacccatgcggaatatgccgtcggcgcggcggtccccgcgctcacctggggaaaattgcagaatggcgttatcccggtggccgggcggtttaaccatgccttcgtcgatggtctccacgccagccgcttttatgcccttgtcgaagagggatttaatgaccccgagcggctctggttgccgctaaccgaaaccgcaccctccctgcttcccccagcggcgaaggagcgttaa

SEQ ID NO: 44 - DNA, 1071 bp, Klebsiella pneumoniae
cgcgatgcgtcacgacgcgctggcggccgtccgtaccctccaacagcgcgccgctgtttaactgataacaggataatgacgatgacctcaaccacccagaatcaacgctacgccttacaggaactggaaaaagaggcgctgatgggcgccgagggcgaagagaccttcgcccgcgaagtgcgctgtatcgacctgtcgaactttgccgcaagaaaaaatgacattgccgaacaactgtgggaggcggcggtggagattggcttcttccaggtcagccatcacggtattccgctggcggatatccgccaggcgttcagcatgaccgaggcgtttttcgacctgcccgacgaggtgaagcgccagtatccgctggccggcaacgccggctgggaaagcaaagcgcaggttcggccgtcgacccgcaccccggatcaaaaagagtcgtatcagataacccggcctctgatggccgggcgctggcccagcgatcgggagttgccagcattccagcagacaatgctcgggtttgagtcgcagtgctggcagctggggatgaagatcctctcctgctttgctttaaagctcggttttccggaatcgttttttaccaccgcgcacgatccgcagcgtgacacctatcagagcaccttgcgcatgctgcattactatgcaaccgagcagtcgcagcaggggatgtggcgggccggcgcgcacaccgattttgactgcctgacgctgctgttccagcgccccggccagggcggcctgcaggtttgtcccggtaaagaccgcgaaagccagcagtggaccagcattgagccgcgggaggaggtgatcacctgcaatatcggcgatatgctgatgcgctggagcgacgaccagctgccgtctaacttccatcgggtgagaaatccgctgccccatgaatatcaggggcagcgctacagcctggcgtttttttgccaggccaataaagatgtcgagatcctcgggccgcagaggaagtacccgcccatcagcgccgaggattatctgcagcagcggatccaggccaattttgccaaagggtaa

SEQ ID NO: 45 - DNA, 3147 bp, Klebsiella pneumoniae
cggcgggcgtcagaagcctgcgtgacggtgagcacgtggctggcatacaggaggaccaggatgaagcagggctttaatctttcggcctgggcgctgaaacaacagcagctgatggcctttctgatgctgctcattatggccaccggcattatcagttacgaacagctttcccgcaatgaagatccggcgtttaccatcaaaacggctgtggtttctgcgcagtggccgggcgcgaaccttagcgacacggtaaatctggttactgacacgctggagaaaaagcttcaggaaatcccgtggcttgactatgtccagagtgagacgcacgccgggcgctgcgttatttttattaatcttcgcgatagcacgcctcctgatcaggtcgcagacgtctggtaccaggtacggaagaagatgcaggacactgctccttcattacctcagggcgtacaggggcctgtggtcaacgacgaatttgaagacacttttggtacgatttacgggtttactgccgacggatttactatgcgggaactgcgggatcgggtggacagcatccgccgggatctgatgagtctgccggacgttggaaaaattcagctgttgggagagcaggaagagcagctggtagtcgccttctccccacgccagctgtccgccatgggtctggatttacaacaggtcgccgatgcgttgcgcgcgcagaatgtggtcgaacctgcgggtaccgcccgcacggccggtgacaatgttgccctgcgcgtcagcggagctttcagtagcgaagagagtctgcgtgcggtgacgcttcgggtcaacaaccgttatataccgcttacagacattgccagcattgtacgccgatctgcagagccaccggctccgctttttcgcgtcaatggccagcctgcaattggccttgccatctcgatggcgccaaccggaaatatgcttgaattcgggcaggcgctgcggtcgcgcatgaacagcgaagcagcacagctgccgcacggtattgaaatgaccaaaattgccgatcagtctgcggtggttgaggaggctgtcagcgggtttgtgcacgtactcggggaggcggtaataatcgtactggctgtctcttttgtttcactgggtctgcgtgcagggcttgtggtggccgccgcgatacctctggtgctcgccatgacgtttatctgtatgtatcttgccggcatcggcttgcagcggatctccctgggcgcgctgattattgcgctgggtctgctggttgatgacgcgatgataacggtggaaaccatggtagcccgactcgaagctggcgattcccttgccagcgcagcgacatatgccttcacttccacggcattcccgatgttgactggcacactggtgatgattgcaggatttattccggtcggctttgcagcctcaagcgccggggaatactgttacaccctttttgctgtggtacttattgcactgatcagctcatggattgtggctgtactgttttccccattaaccggcagctggctgttacctggcacgctgcagaaacaccacactggcaccggacgcctgggcagattttaccagcgcctgcttaccagagttttacaacacaggctactgacgcttggtatagcgttgctggctctgttgctggctggtcttggaacgacttatatgcagggtgagttctttccggcctcagatcgccctgagcttctggtgagtctgtctctcccggcgaatgcatctcaggaagcgactctccgtcagacagcgcgtctggagcaagcagtatcagccagccacgatgttgaccactactcctcttatgttggaaccggtgcgatacgtttttacctgcctatggatgttctgcttgatgatgaaaataccgctcagctggtcgtggtagccaaaagcctggcggcccgcgaaaggcttcgacattatctcgataaggtgctcgccagggatttcagcgacatcacaacacgagtttctccacttgagcttggtccccccgtcggctggcccattcgctatcgcgttagcgggcctgattacaggcgcgtccagatgctggcagagcagctttcggctgcactgggcgcatcctccctgacacgagaggtgaaccagacagcaggagaacccgagcgcgttatcacgttaaaggtaaaccagacggcagcaagggcagcggggctctcatctgatcagatagctcgttatctgaacacggtctggtcaggcacgcttattactactgttcgcgacaggaaccggttgatagatgtagtactgcagggcaacacagatgaaaggcgtaatcttgacagtctctccgggctgctactgacgtcgtcgacgggcgcaaaaatccccatggcgcaggtggccacaccagaatgggggcttgaggatccggttatctggcggcgccagcgtctgccctttattacagtacagacggatctggcccccggtttgcgcgctgaaactgtatcaaatggtctcaagccgctcattaatcatctgagagcggggttgcctgagggttacagcatcagtgaggatggtgctgttgccgagtctgacaaaggtaacagttcggtatttgccattttaccggtcactctgctctgcatgctgctgttgctgatgattcagttaaagcgagtttcacgcatgtttcttgccctgctgatggcaccctttggtttacccgggattgttctcgccatgctgccaaccggaactccaatgggctttgtggctttgctgggcattattgcccttgccggcatgatcatccgcaacgccgtcattctcatcattgaagcagacaataaccggaagtcagggatgcactttaatgaggcgataggtgctgccgccattcaccgggcacgacctatactactcacggcaagtgcagccattctgggtatgatccctatttcccgacagattttctgggggccgatggcttttgcgattatcggtggacttcttgtagccaccctggtgacgctaacggttttaccggcagccatgagtctggttatgcagatggaggatcgttcagctacaggtaaatcagccaatgctgcgagcgtaacagaggggcagtaa

SEQ ID NO: 46 - DNA, 810 bp, Klebsiella pneumoniae
atgatgactttttctcttgacgcgctggcccggcagctccgcgacgcggaacagagcggccaggcgatcgccccgctgcgcgatattctcggcgtcgacaatgccgacgccgcctatgccatccagcgtctgaacgtccagcaccacgtggcccatggccggcgggtggtgggccgcaaggtgggcctgacccatcccaaagtgcagcagcagctgggcgtcaatcagccggacttcggcaccctgtttgccgacatgtgctatggcgacaacgccgaggtgccgtttggccgcgtgctgcagcccaaggtggaggccgagatcgccctggtgctgaagcaggatctgccgcatgccgataccacttttgatgaactgtataacgccatcgaatgggtattgccggcgcttgaggtggtgggcagccgcattcgcgactggtcaatcggctttgtcgacaccgtcgccgataacgcctcatgcggcctgtacgtcattggcggcccggcgcagcgcccggcgggactggatctgaagcagtgcgccatgcacatgacccgcaaccaggagctggtctccagcggccgcggcagcgagtgtctggggcatccgctgaacgccgcagtctggctggcgcgcaagctggcgagtctcggcgaaccgctgcgggccggggatatcgtgctgaccggggcgttaggaccgatggtgacgattaacgagggggacagctttgtcgcccatatcgaaggtattggctcagtcgcggcacgcttcgtcgccgccggagaaggagatcgtgatgcgtaa

SEQ ID NO: 47 - DNA, 1263 bp, Klebsiella pneumoniae
cttcctgatccgcggcttcgatccgctgaacgacgcggccgactacggccgggcgctgctgccgatcgcccgggaaaaagccgcgcggcgtgcggtggcggagcgcgcatcgtgatccatcctgagcgcgacgactgggcccggcagctgacggcgcttcgccagcagatggcggagcaggcggctagccttgacgccagcggcgagtttccctggcgtaatatcgaccatctgcgtgcggggggctggttaagcctcgccgtgccgccatcctgcggcggcgcgggcgccagtctggcccagctgcagcaggtcatcgccgccatcgcctggggagagccggcgacagcgctgattgtctgcatgcagtatctccaccatttgcggctggcggaaaacgacgcctggcacgcgccgctgcgccagcaggtttttcacgatgctgtcgaacacggtggcctcatcaacagcctgcgcgtcgagccggagctgggctccccggcgcggggcggcctgccggacaccgtggcgacccgtcgcgcggagggctgggacatcagcggccataaaatttataccaccggcattgaagggctgcgctggctggcggtgtgggccagaagcgatgataacccgccgctggtgggtacctggctggtgcctggcgacagcccgggtatcacggtggtgaagagctgggatcacgccgggatgcgggccaccggcagccatgaagttatttttaaccacgttcgggtggcggcagagcacgcggtggatgtctggccggccgatgcgccacccgccgcggaggccgaaccgtttcgcctgttcgccaaccggcagacagcgctgctggcggcgatctatgacagcattgcccacgccgctcacgactggctggtgaggtggctggcggggcgggtgcccgccggtctcggccatccgctctctcgtctgccacgggtgcaggagaaagtcgggcagatcgccgggctgctgctggtcaaccgcagcctgctggagcaggccgccgcgctgcgcttttccgccatcgaggccaatctggcgaaagtcaccatcaccgacaacgccattcaggcggtgaatatcgcgctcgagctgaccggcaatcatggtctcagccgacaaaacccgctggaacgccactaccgcaatgtgctctgcggacgggtacataccccacagagcgacagcgcctggctggcagctggcaacttcgtctttcaatcacaaggataa

SEQ ID NO: 48 - DNA, 1041 bp, Klebsiella pneumoniae
gataaattcccggccaatatagtttccgtttatcaaccagaagcattgctattttacaagggctcgattagcattttaataacgtatagtctaaaaaactttatctggagtctaatggatcccttttctgatgttttgaatctgctgtctgcccgcagctatgccactgcaggtctttccgccggcaatcactgggctatgtcttttcccggatataacggactcaagttcatttttataaaaaaagggatgttctggttcagactggaagcggaacctgaatggacccagctgagtgaggggcaaggcctcgtgctgacccgatatgcccgctttttaatggcgacggacgttaacatcccgccagctgagtcctctgagaaaaaaaggcctcgcgttaacgagaccgtcaactatggaggtgacgaaaacctgttactggctggaaagatggaaattgatcttacttcttcagatattctgcttaacggcctgccgcttgttcttcattttaatacgcagaccgatgacagttctgcgctgtgcacgcttatgtcgctgttctttagggaaaaggtagctaataagccaggctctgttcaggcctgtgactaccttatgcacctgatcatgattgaagtgctgagaagtggatacgaaaagtcatctgaaggctgcgtagtcatcgacaaatttagcgatgcccgtataaacaaggtacttagcgcaattcatcaggaaccagaaaacaactggagtttgcttgagctggcaacaatatctggtatgtcacgagctggcttttcaaaaaaattcagggaggtaacgggactcacgcctcttctgtatctgacaaactggcgtatgcggcttgcgagtaaatccctgagatatacccgtgagtctgtaaagctgatttgttttaagctgggctacagttcagaaagtaccttcagtagtgccttcaagcgcgtttatggcgtcgcccccagaatttatcgtgatcaacactttcaggcaggcttaaaaaaagacgattaa

SEQ ID NO: 49 - DNA, 1359 bp, Klebsiella pneumoniae
cagcattgcccacgccgctcacgactggctggtgaggtggctggcggggcgggtgcccgccggtctcggccatccgctctctcgtctgccacgggtgcaggagaaagtcgggcagatcgccgggctgctgctggtcaaccgcagcctgctggagcaggccgccgcgctgcgcttttccgccatcgaggccaatctggcgaaagtcaccatcaccgacaacgccattcaggcggtgaatatcgcgctcgagctgaccggcaatcatggtctcagccgacaaaacccgctggaacgccactaccgcaatgtgctctgcggacgggtacataccccacagagcgacagcgcctggctggcagctggcaacttcgtctttcaatcacaaggataatcacgatgcgtctatcattttcaggccgggtggcggccgcgctgatgctgctggcgctgggcggctacgcgacagcgcaggagcggcttaccctgcgtatcgccgatcaaaaaggcggcatgcgttcgcagctggaggcggccaacgccctgcaaaatctcccttacgacattaagtgggccgagttcccggccgccgcgccgctggcggaagccctcaacgcgggcgccgtggacgcggggatcatcggcgatgcgccgttgctcttcgccctggccaacggtgcgccggtcaaagctattgccgtggataaaagcaacccggcggggaccgcggtgctggtatcccccggcagcacgttaaaaagcggcgctgatttaaaaggcaaacgcatcgccaccggtaaagggtcgattggtcatttcgtggcgctgaaagcgctggagcaggcggggatttcaccgaaggaggtgcagtgggtgttcctcggcccggtggacgccaaagtggcgttgctaaacggctcggtggacgcctgggcgacctgggagccctacaccacccaaatggtgaagaccaacgaggggcagatcctggtgagcggcaaagggctgctgccggggaataccttcctcgcggcaacggattccgcgcttaacgatccgcaaaaacgcgccgcgctgcaggattatctccagcgcctggccggcgccgagcgctgggcctacgccaatctcgacagctacggcaaaacgttgggggagatcatccgcttcccggcggagatcgcccgcgcgcagtttgccaaccgccagtcgcagtggcagccgctggccgaggaaacagtggcccagcagcaggcaacggcggacttttatctcgccaacggcctgatccgcacccggctggacgtgaagccgacctttgaccgccgttttagcgtgcccgccgccgaggtgacgccatga

SEQ ID NO: 50 - DNA, 243 bp, Klebsiella pneumoniae
aggagccgcccgatgagccccgccttttcgtctttcgccgccttcctgaatatgggcggctatgccgtgtacgtctggctggcggtggccgtggccgtcgccgcttttggcctgctgacggtgcataccctgtgggcgcggcgggcgctgttccatgaggtacgacgccagcaggcgcgcgagcggcggatcgctgccgcccgcgaacatgacaaggaggccgcggatgcaagcgcgtcgtaa

SEQ ID NO: 51 - DNA, 567 bp, Klebsiella pneumoniae
cggtgcataccctgtgggcgcggcgggcgctgttccatgaggtacgacgccagcaggcgcgcgagcggcggatcgctgccgcccgcgaacatgacaaggaggccgcggatgcaagcgcgtcgtaaaacccggctgtatatcgtgctggcggtgctcgccggcctcgggctaaccgtcagcctgacgctgtacgccctgagcagcaatatcgatctgttctacaccccgggggaaattatctacggtaaaacggaaacccgggcgctaccccataccgggcagcggctgcgggtggggggctacgttcagccgggctccctgcagcgcgacccgcaaaccctcgatgtgcgctttaagctgtatgacgcccgcggggtggtggacgtcagctataagggcattctgccggacctgtttcgtgaagggcagggcgtggtggcccagggcgtactggatggcgagcggcatattaccgcccagcaggtgctggccaaacatgatgaaaattacacgccgccggaggtgaaaaacgccatgacgccggagaaaacgggggcgcagccatga

SEQ ID NO: 52 - DNA, 1299 bp, Klebsiella pneumoniae
ttaaaacaacccgaaccttacctcgtatccgcgaccagtcagtgtctgacactggagggaaatatgtttgaaaagataggtttacccaggaatttattatggggatatatcggcctgaccatctttatgattggcgatggtgttgagcaggcgtggatctcaatctggcttgtagagaaggggctgtctgttgcacaggcatcctacctgatcaccgcgtatggtgttactgttacgctggcagcctgggttactggcgttctggttcagacgctaggcccgcgtaaagtcatgttttacggtctggtaacctttatcattggcagtatcggttttatcagtgttggccttaaacacatggaaatggcgtggatgcttcctttctacgcattacgcgggattggatatcctctgttcgcttactcattcctgatatggattaactacagcacgcctgttgcgcgcagggcgactgcagttggctggttctggtttacgttctcattagggctgagtgtgattgggcccttcttctcttcgatggcgttaccggtgctgggtgagatccacgtgctctgggtcggcttactgtttgtcctggtcgggtctgttctcgggatctgggtcaaccgtgatgttgttcctgcttcagaaattcacccattcagcgcgggtgaattactgaaagggatcaccattctgcagcggccggtcatcgcgatgggcctggtggtgaaatccgtaaacggtatcgcgcagtacgggctggccaccttcctgcctctgtacctgatcagttatggctacagtaaaacagagtggctgcatatgtggtctgcagtattcctggtggctatttttgccaatctgttctttgggttctttggtgacaaatttggctggcggaaaaccattatgtgggtcgggggatttggttatgccgctgttctcattctggtgtgggcggtcccccaggtactgggtcataatttctatgtgatggcatttgtactttgcctttgcggcgtgaccatggcgggctatgttcctttgtcagcgttatttccgatgcttgccccggacagtaaaggagccgctatgtcagtactgaaccttggtgcaggcctgggagccttcatcgctcccgctattacagcattgttctattcatctcttggcgcaggtggtgttctaggcatctatgccggtttatatatcctcagtggcgtgcttacacctttcctcaaaacgccggaggagcttaatcagcaggctgaactgaaagataaggtcgcataa

SEQ ID NO: 53 - DNA, 993 bp, Klebsiella pneumoniae
ccctcgcaaccggggataccgcccacgctgaagagaaggtggcctgatatgcatgcctatttgcactgtctctcccacaccccgctggtgggattcgtggacccggagcaggcggtccttgatgaagtgaacggggtgattgccgacgcccggcggcggatcgctgaattcgatcccgagctggtagtgctcttcgctcccgatcactacaacggttttttctatgacgtgatgccgccgttctgcctcggggtcggcgccaccgcgattggcgacttcgccagcgccgccggcgacctgccggtgcccgccgagctggcggaagcctgcgcccacgccgtgatcaacagtggtatcgacctggcggtgtcgtacaacatgcaggtggaccatggcttcgcccagccgctggagtttctgctgggtggcctggaccgcgtgccggtgctgccggtgtttattaacggcgtcgccgcgccgctgccgggttttcaacgcacccggctgctgggcgaggcgatgggccgcttcctcaacaccctcaataagcgggtgctgatcctcggctcgggcggactctcgcaccagccgcctgtgccggagctggcgaaggccgacgcccatctgcgcgatcgcctgctcggcggcggaaaacagctgccgccggacgaacgcgaacggcgccaacagcgggtgatcaatgccgcccgacggtttaccgaagacccgcactcgctccatcccctcaacccggtctgggacaaccgctttatgagcctgctggagcaggggcggctgagcgaactggacgcgatcggcaatgacgagctgtcggcgatggccggcaaatcgacgcacgaaattaagacctgggtggccgcttttgccgcgctatccgcttttggccgctggcgcagtgaaggcctctattaccggccgatccccgagtggatcgccggattcggctcgctgagcgccaccaccgagatttga

SEQ ID NO: 54 - DNA, 903 bp, Klebsiella pneumoniae
atgatatcgcctctggcgatgttttatccgacttgccgggccgggccagacgctaagcggtttaaaagcgcaatggtatcggttccagcacgacattcactggttttgtcagcgacaaaaacagtaattttcaatgacaggaatgtgatgatgtcgagcgagaaaaccaacaattccaggcgtgatttcctggtgaaatcgatggcgctgatcccgacggtggtgatcggcggcgcgggagcaggggctattggcgtggccaccagcgcgaccgcgcaggcggcccccacttcagagccagcctccgggaacaccgcggcggccagcgactggaagccgcagttcttcaacgatcgtgagtgggcgtttatcaacgccgccgtcgctcgcttaatcccggcggatgaactcggtcccggcgccaaagaggccggcgtgccggagtttatcgaccgccagctcaataccccttacgccaccggctccatctggtatatgcaggggcccttcaatcccgacgtgccgaaagagatgggttatcagctgccgctggtgcccaaacagatctataacctcgggatcgccgacgccgaggcgtggtgtcaggacaaatatcataaaaccttcgctgaactgagcagcgagcagcaggacgaggcgctcggcctgtgggaatcgggtaaagccgagttcaaacagctgccggcctcgctgttcttcacctatctgctgcaaaacacccgcgaagggttcttcagcgacccgatccatggcggcaataaaggcatggtcggctggacgctgattaattttcccggcgcgcgcgccgactttatggactgggttgaacggggcgaacgctaccccttcccgccggtatcaattaatggggagagggcgtaa

SEQ ID NO: 55 - DNA, 927 bp, Klebsiella pneumoniae
ccatcgtcgcctgctgcccaccgccttctggctcggcgccgccctgatgctggtggtggacgatctggcgcgcacgctgacccaggcggagatcccgatcgggatcgtcactgccctgctcggggcgccgctgtttacctttttactggtgcaatcccggcgccggagtacggcccgatgaacagctcattatcgctgcaagcgctacgctacggccaccgtcagccgctcttcgccccgctcacgctggcctgccgtcccggtgagatctgggcggtgctgggcgccaatggccggggaaaaagcaccctgctggataccctgaccggcgtgctgccgccgctgggcggcgaggtgcagtgcgagggcggcgtggccctggtcccgcagtcgtttcgtcccgctttccgctggcgcgtgagcgatgtggtgctgatgggccgggcccgtcacgtggatctctttgcccagccggacgaggaggatgcccggcgggttgagcaggcgctggcgcagctggggattgccgccctggccgaagatgacttcggcgccctctccggcggccagcagcagctggtgctgattgcccgcgcgctggtcagcgccagccagaatatcctgctggatgagccctgctcggcgctggacctcggtaaccagcaggtggtgctgcagctgatcggcgacctcgcccaccgccaggcgcgcaccgtcctgttcaccacccatgatcccaaccacgccctacaggtggccagccatacgctgcttctgctgccggagggccggtggctggcgggtgagaccgccgacgtgctgagcgaaacgcatctccggcaagcgtacggcctgccggtacgcctgatccgccatgccgcctccgcgttccctctgctggcgccggggtttacgctgcgtcgctga

SEQ ID NO: 56 - DNA, 312 bp, Klebsiella pneumoniae
agccatccgccagcgccgccattttggttttccgctcgtgcatatcctcgaccacatgcagctccgtcaagccgcggtgggcaatttcccgctccaccaggccgcgcggcatcacgccgatcaccacgccaccggcctccagcgccgcatcggcgaccgcccccatcagaccaactttgccgccgccatagacaagcgccaacccctgctgcgccagcgtacgtccaaccagacgggcggtttcgaggtacagcggatgttcgccagctgaagaaccgcagaaaataccaatcgatttcatcttcgttatga

SEQ ID NO: 57 - DNA, 318 bp, Klebsiella pneumoniae
caatccccgccgggatctgcagcggggcaaacgccagccggccaagggtatcggtcgccaacaccagcaaggcgccaatcagcgcgctgccgcacagcagcgatacctggccgccgcgcagcacgaaacgcgccatatgcggcgccatcaggcccacaaaacccaggctgccgacgcaggagacgctggccgaggtcagcagcaccggcgcaaaaaagcgcagcaccgtcagctgctgcagacgtacgccgaggccgatggcggtccggtcgcccagcagcgccacgtccgccgcccgggcggtacagaacaggatga

SEQ ID NO: 58 - DNA, 240 bp, Klebsiella pneumoniae
cccagaccgccgctcgcgacctcgcgccgctgggcatcacggtcaacggctactgcccggggattgtcaaaacgccgatgtgggccgaaattgaccgccaggtgtccgaagccgccggtaaaccgctgggctacggtaccgccgagttcgccaaacgcatcaccctcggccgcctgtccgagccggaagatgtcgccgcctgcgtctcctatcttgccagcccggattctgattatatga

SEQ ID NO: 59 - DNA, 684 bp, Klebsiella pneumoniae
gcagtagcgccttcagcgcggcgcgcccaccgcaggccaccggcccaatggccatatcgtgcaggccgaagtagcgcggatcgtccagccggtaaatggcaaggtccgcctgcatgccgacctgcagggtgccgctctgcgctaagccgaggatctgcgcccctccggcgctgccccagcgcactacatcctccaccgtggccgcatcggccccaccctcaaaggtgcccccggcgtagcgcggctgcgccagcatccccttgcgcgcgcgctgcagcagccatgcggcatgggcttcgctttgcatatccgccgcttcattcgaggcggcgccgtccacccccagcgagaccgggaccccggcctgctctaacgccagcagatcggcgatgccgctgcccagccggccgttgctttgcgggcagtgggcgatgccggttccggtacggcccagcagggcaatctcctccggcagcagcttcaccagatgggcaaaccacacgtcatttcccagccagtcgtgttccgcgcagaactgcaccggcgtcatggcgaatttctgccgcgcggcgtcgagataatcgacggtttccgataaatggctgtgcaaccggatccccagctggcgggccagcttcgccatctcccgcagctgggcgcccggcgcggagtgcaggacggtag

SEQ ID NO: 60 - DNA, 1020 bp, Klebsiella pneumoniae
gatgcagcgccggggcgccagcaaagggctggccaccctgtgcgtcggcggcggccagggcatcgccatgacccttcaacgttaacaggagccactatgtttacaccacgcctggcggtactcggcgcgggactgatgggcgtcggtatcgcctgccatttcgcccgtcacggtcacgccgtccgcctgtatgacaccgatccgcagcgtctcgccgaggttccggcagtggccagcgccatcctgtgcgagctggaggctagcggtcaacaggatcccgccgaccgcgacgcggtgctggcccgtctgacccccaccccgacgctgaatgccctggccgatgccacgctgctgattgaagcgatccccgagcggctggcgctgaagcacgccctgtacgccgagctggaaacgctgatcgccgacgagacgattatcgccagcaacaccagcggcctgccgccggatcggctggcgcagggcatgcgccaccctgaacggttgctgatcgcccatttctggcatccgccgcacctgatcccgctggtggaagtggtgcccgggagcgccacgctgcctcatctggcacgccaggtgagcgacttttgcgccgcctgcgcgctggaggcggtggtgctcaaccgcgccgcgccgggctttgtcggcaaccggctgcagttcgccctgctgcgcgaagcactgcatatcgtccacagcggcatcgcttccccggaggtggtggaccaggtgatgcgcgcctcgctgggccgccgctatgcgatggtcggcccgctggaggctgcggacatgaccggcctggcgacagtccaggatatctgccagcacctgctgccggagctggccagcggcacggagatgatgtcgctggtggcggagaaagtggcgcgaggcgacaccggcgcccgcagcgggcaaggcttttaccgctgggacgaggcccggcaccagcgcatccagtcgcgccgggaacaccagctgcgcttcgccctgaaaccctag

SEQ ID NO: 61 - DNA, 669 bp, Klebsiella pneumoniae
cggccctggccggactgtcgacgcagaaaattcagtacctgctggcccatcgtcccggttttgtttccccaacccttgccgcgcgcaaattcgctacccttgagcacctgctggggggccgcttggcggtgcatatcatcagcggcggcaacgatgccgagcagcgccgggatggcgactatctcgaccacgaccagcgctacgcccgcaccgacgccttcctcgacaccgtgcgccaggtgtggaccagcgagcagccggtggatattcacaacgatttctatcaggccgagcaggcctggtccgccattcgcccgctgcaaaaaccgcatcttcccatctacttcggcggctcgtcggaagcggctatcgccgtcgccggcaaacatgccgacgtcttcgcactgtggggtgagtcgctggcgcaaaccggcgagaccatccagcgggtgcgcgccgaagcggcgaaacaccagcgtgatattggcttcagcgtctcgttccggccgattatcgccgacagcgaagccgaagcctgggagaaagccgagcatatcctgcacgtcgccaccgagcaggcggcgcagcgcggaggcgggttcaaagccaaaccggacagcatcggcgcccagcggctgcgggccaccgcggcgcagggcagagtggtag

SEQ ID NO: 62 - DNA, 429 bp, Klebsiella pneumoniae
aggtttaggcctttttgcccgcaacaggagaacactatgttttcatacattatgctgggaacgaacgatctgccacgcgccatcaagttctatgacccgttaatggcgctgctgggacacgtcaaagccggccgtaacgaacagggggcgtcctggggcaccttcaacggcaatcacacctgcgggctgtgcgtgggtgttccttttgaccagcagcctgccggggtgggtaatggaacgatggtggcgcttaacgcccgctccgtcgtacatattgcggaactgcatgccctcgccctgcaactcggcggacgtgacgaaggcggtcccggtcaccggccgcagtatggcgacggttttcacagcgcctacgtccgcgatcccgacggcaataagctggcgtttgtttactatgcgtctgcagattga

SEQ ID NO: 63 - DNA, 714 bp, Klebsiella pneumoniae
caactatttacgttaaatagggaaataaacatgaaaagagccgaattagacgttgtggttttaagtgaggatttgccgaatgaagggctggtaaaaggaacgcttggtactattgttatggtttttaattcgccaacaactggctatctggtcgagttttgcgacgagaaaggaaaaacaatcgcaatgccagttttattccccgcccagctaaagcgctatttcacgattcgtaacctgaagtcgctgatggttgaaggtaattatcccgtagccgaccctgtagacccagacgtcatggcagatttaatgcacaaagtcgcgcctgttgaatgggaggacaagaaaagaagggtctatgaggatattcaacgactattgattagtcggccggactacgctgatatgttcaatattatggatgggggtgagtacaatggcatgacattgtacagcctggtgcaggcagagaacggtgaacctgcatggtcgaatatctttgttcgaaactttgatacgcgtattaacgaaatctatgtcgatccgaacctcattggcaaagtagtcattggtgaagagggcatgtccgtgattgtctacagcttcacagatgaccgtttcgaaatccgcgataaagtctcctcggattatgtcattgagtcacatacccacttcaacggactgttgtccgccctcattgagccggtcagctga

SEQ ID NO: 64 - DNA, 1635 bp, Klebsiella pneumoniae
ccgccatttacccaatatctgggattcctcccgcgaacatcaaggataaccactatgtccacctacgcttatcgccaggccgccgggatccgccaggcgctgctcgaccgtcgtgaactggcgctgatcgacgtccgtgaagaggccgatttcgccaccgctcatccgctgtttgccgtcaatctgccgctcagcaaactggagctcgaggtccgccggcggataccgcgcttcaccaccccgctcaccgtctacgacaacggcgagggtctggcggagatcgccgtcgaacggctgcggtcctggggctatcaggatgtggccctgctggccgagggtctcgccggctggcgccgcagcggcggcgagctgtttcaggacgtcaactccgccagtaaagcctttggcgagctggtggaaagcgtgcgtcacacaccgtcgctcagcgcccaggaggttcaggcgctcatcgacagccggcaggaggtggtgatcgtcgacgcccggcgcttcgatgagtaccagaccatgagcatccccggcagcatcagcgtgcccggcggcgagctggccctgcgggtagagagcctgacgccctccccgcagacgccggttatcgtcaactgcgccggacgcacccgcagcatcatcggcacccagtcgctgatcaacgccggcgtgccaaacccggtccatgccctacgcaatggcactatcggctggacgctggccggccagacgctggcgcaccagcagcagcggcaatacgatccctccgcccgcgcctccggcgcccgggccgctgaggtggcgcatcttgccgaacgggccggggtggcggtcatcgatgaggccacgctgcaacgctggctgcagcagagcgaccgcaccaccttcctgtttgatgtccgcagccccgaagagtacgcggcgggtcactatcccggcagcctgagcgcgccaggcggccagctggtgcaggagaccgaccacttcgccagcgtacgaggggcgcgcattgtgctgctggatgacgatggcatccgggcagcaataaccggctcgtggctggcgcagatgggctgggagacggcgcggctgagcgcgctgtcgaccagtcagttgagcgaacgcggggtgccagccgccgaggtgccgcccggcccgcaggcggaggagataagcccggcgcagctggcgcaacagctggaagaacccggtacggtggtgctcgattttaccaccagcgccaactttgtcgctcgccatatccccggcgcgtggtggctaacgcgctcgcagctgcgccaggccctggaggtgatccctcccgcccaacgttacgtggtgacctgcggcagcagtctgctggcccgctacgcggtgccggaggtggcggccttgaccggtaaaccggtgcagttgcttaccggcgggacgctggcgtggatcgccgccggtctgccgctggcgcatggcgacagcggcctcgccgtcgagcgccgtgaccgctatcgtcgtccgtacgaaggaaccgataattccgccgaggccatgcaggcctatctggagtgggagtatggcctggtggatcagctggcccgcgacggcacccacggttttcgggtgctctag

SEQ ID NO: 65 - DNA, 642 bp, Klebsiella pneumoniae
atcaaggagtttgccttcatgctgcatgcagagcgactgacctgcatcgttgacgatcgaccgctgtttgcggcgctgacgctgtccctcgctgccggcgagctgctgcaggtcgccggtgataacggcgcggggaaaacctcgctgctgcggatcctctgcggcctggcgcgcccggaaagcggggtggtgagctggcagggccagccgctggcgaaggtccgggagtcatttcaccgtcagctgctgtggctgggccataaacccggcgttaacgcggcgctgaccgccgatgaaaacctgcgtttcttctttccggccagccgccttcagcagcgggaaagcgccctcgctgccgtcggcctggcgggctatgaagatctccccttgagccagctctccgccgggcagcagcgtcgggtggcgctcacccgcctgtggttaaccgacgcgccgctgtggatcctcgatgagccgttcaccgccctcgacgccacggcgatggaaaccctgacccgtcgcctggagcagcacgcccggcaggggggatgcgccatcctcaccacccaccagccgctgcggccgctgggctgtccgttgcgcaccctgcgcctcggcggcgacgctggaggcgggcaatga

SEQ ID NO: 66 - DNA, 1101 bp, Klebsiella pneumoniae
cgcaaggagttgttcatgagcattcagtttctcggcatgattggccaccgcctctcttccgaaacgattgccccggtggggccgatctttgaccgcgactatatcgttcgctttgcgcaaacccatgaagccgccgggtttgatcgtctgctggtcggccactggtccgatcaacccgacggctttctggtgacggccctggccggactgtcgacgcagaaaattcagtacctgctggcccatcgtcccggttttgtttccccaacccttgccgcgcgcaaattcgctacccttgagcacctgctggggggccgcttggcggtgcatatcatcagcggcggcaacgatgccgagcagcgccgggatggcgactatctcgaccacgaccagcgctacgcccgcaccgacgccttcctcgacaccgtgcgccaggtgtggaccagcgagcagccggtggatattcacaacgatttctatcaggccgagcaggcctggtccgccattcgcccgctgcaaaaaccgcatcttcccatctacttcggcggctcgtcggaagcggctatcgccgtcgccggcaaacatgccgacgtcttcgcactgtggggtgagtcgctggcgcaaaccggcgagaccatccagcgggtgcgcgccgaagcggcgaaacaccagcgtgatattggcttcagcgtctcgttccggccgattatcgccgacagcgaagccgaagcctgggagaaagccgagcatatcctgcacgtcgccaccgagcaggcggcgcagcgcggaggcgggttcaaagccaaaccggacagcatcggcgcccagcggctgcgggccaccgcggcgcagggcagagtggtagacaaacgcctgtggaccggcatcgcccagctggtgggcggcggacataactccaccgcgctggtgggcaccccggagcaggtggcggatgcgctgctcgactactacgacctcggcgtgcgtaacttcctgatccgcggcttcgatccgctgaacgacgcggccgactacggccgggcgctgctgccgatcgcccgggaaaaagccgcgcggcgtgcggtggcggagcgcgcatcgtga

SEQ ID NO: 67 - DNA, 903 bp, Klebsiella pneumoniae
aggagtaatacaatgaacttacacggtaaaacggcgctggtcaccggctccaccagcggcatcggtttagggatcgccaaagtgctggcgcaggcaggcgcccagctggtgctcaatggcttcggcgacagcagccacgcccgggctgaagtcgccgcgctgggcaagatccccggctatcacgacgccgacctgcgcgacgtcgggcagatcgaggcgatgatgcgctatgccgaaagcaccttcggcggcgtcgatatcgtgatcaataacgccggcatccagcacgtggccccggtggagcagttcccggtggacaaatggaacgatattctcgccatcaatctctccagcgtcttccacaccacccgcctggcgctgccgggtatgcgccagcgcaactgggggcgcatcatcaatattgcctcagtgcatggcctggtggcgtcgaaagagaaatcggcctacgtcgccgccaagcacgcggtggtcgggctgaccaaaaccgtggcccctggaaaccgcgcgcagcggcatcacctgcaacgccatctgccctggctgggtgctaaccccgctggtgcagcagcagatcgacaaacgcatcaccgagggggtcgacccggagcaggccagcgcccagctgctggcggaaaaacagccctccggggagtttgtcaccccgcagcagctgggcgaaatggcgctgtttctgtgcagcgatgccgccgcccaggtgcgcggcgccgcatggaacatggatggcggctgggtggcgcagtaagccgctggcgccgcgaagatcagaacatcgccagaaagcgtttcaccgtacgcgagcgctcgaagcgccgccaggcgatggcgatatcggtcttcagcggcgccccgctaagcgggtga

SEQ ID NO: 68 - DNA, 468 bp, Klebsiella pneumoniae
caccttgccacatttcatgggctgaaccgccagcacacattcttctgcacgcttcagggttgtcacctatccttagggcgtggcttagcaactttcgtaatacaggtttggctccccggcagtgcgcccgcggagcgagaattccatatccttcacaacttaaagactaaaactgtcatgaaaaagaccaaaattgtttgcaccatcggtccgaaaaccgaatctgaagagatgctgaccaaaatgctggaagccggcatgaatgtgatgcgtctgaacttctcccacggtgactatgcggaacacggtcagcgcatccagaacctgcgcaatgtgatgagcaaaaccggtaagaaagccgctattctgctggacaccaaagggccggaaatcccgtaccatcaagctggaaggcggcaacgacgtctccctgaaagcaggccagaccttcaccttcactaccgataa

SEQ ID NO: 69 - DNA, 1155 bp, Klebsiella pneumoniae
attaacgccactcacacgtcaggcgggcagcagggggctgctgcccgcctgacgatatcctttcttcactggcgcgtttccagccagatttcatcctatcccagggcttttgtggccggtcgaaaatggcgaggccgcgcgtccggcaagcagtgccaggaatacattcctcaggtttcggcatgggtaccggctttgacgatctgtagcgcgctggggctcgccacgctgccgctggcggtgacgaaccctggatggacagtctcgccgctggcgctgtccaccaatgcaataggcggcgcgctatgcagcacgtgctggtggccccattccatcagggcgaacagcaccagcgccgggatactgctgtggctggtgccgatggccgccctggcgctaatgctgggctgggcgcatccgctgacccagatgagcgggttctttaccaaagccgcgctgatgactttcggcggggcgtatgccgtcctgccttacgtttaccagggggcggtgacccactatggctggctgaccgcagggcagatgatggacggcctcgccctgggggaatcgacccccggaccgttgatcatggtggtgacctttgtcgggtttgtcggcgattacaccaaagcggtattgggcgttgatgaagtgctgctggggggcatcgcggcggcgtgcctggtgacatggtttaccttttgccctcgtttatctttattctcgccggcgggtcgtttattgaaaccacccataataaagtgggatttaccgcgccgttggccgccgccgcggtgggctttatcgtccatatggcgggactgtccggcgcaggatgaggttgggcggcaacgggccagcgacccgttagcgcccaaccggaccggggaccatcaggtcgtggggctttcgcgggtggcccgcgccagcgggttgccgtccagttccagctggtcgcgcagcgcccagccgcgcagcttgccggggttaagcaatcccgccgggtcgagagactgtttcaccgccacgacgtcgggacgaatcacgccctgtttgccgtcctcaacctgcagcacgtgggggttgttaatcttgacgtcgttgtcgcgaaatatctgcatgatggcgttaagacgttcgggcgtggtatag

SEQ ID NO: 70 - DNA, 2670 bp, Klebsiella pneumoniae
gtttcccggtttttagtattaataaagggcacatgttttttaaggaaaaattccatgaggcgcttgatcagggtttcgctacaaaatcaacatgccatcgcggcgataagttttgaaaactgtccagcgaaaacccggatgttgagtgatggtcgcgtggtgcagggacgctcggtattgagccattgtcagattgtcggggagattgctcgggcgcttatggcgttgtatcccgaaccgatgcgaagtcgactcttcccagcgggaagtgaaatggcagcggctggccacgatatcggaaaggtcagtccgacttttgccgccaaaatttttgcggcatgtgacgttaatgatcaccgtcttgctgggttatcggcggtgaaccccggactcgaaacactctggggaggacatgcaggcgtcagtcaggcgacagcggaaagtttacatgctccgcgctatgttcctgagatcctcggtcagcatcatggttttaatccagggctcaacggcaggcgtggcgacgctgaagtattcggcgggccgctctggtttgatgagcgtaaaaaactcgtggataagctgaaagcggaattctccgcagattggccgacatttgattcagccgctcaggctcgcgtggtcgccgggttgacctcggtagctgactggattggatccggtgagttttttgaaaatcctgagcaagcgtggcagcctgtcataaccgcagcccttaataacgccggctttattaaacccgttatccgtcagggactatcctttgcggacgtcttttttcctgacgatccatcgaagaaaccacgcgaagcgcaatcgcgctttattgaccaggttgtggggcctggtctctatattctcgaagcgcaaatgggaatggggaaaaccgaagccgcgttatacgcggcttatcaaatgttggtccaggaaaaagcaaccggcatttattttgcgctacccacccagctaacctcgaacaaaatatacgatcgctttaatgcgtttttgcatcagattgtcagtactgaaaccccgcaacattccttacttttgcattccggcgcctggttgatggataccgagatgggggaggaaggaagccctggtggtgcgtggtttaaccaccgtaaacgcggcttattagcgccgtttgccgtcggtaccatcgatcaggcgttgatggcggtgatgaatgttaagcatggttttgtcagagcgtatgggctcgcaggcaaggttgtgatccttgatgaagttcatacttacgatttatacactggcacgattcttaatgcgttagtcgaattcctccgtcaaatcgactgtacagtgattattcttagcgccacgctgagtcagacgcgtcgcgacgcattactgcagcaaagcacaaccagtgaggcatacccgctgattaccgcggcgccatcagcggaacgggagcgcggtctggtcgagattggcgttcccgtcaccgagaataccaccgtcatcctccattcttgtcgtaaagatgagcccgcgcgggaagaggcgctgcggcgcgcagagctcgggcagcaggttttatggattgagaacaccattgccgaagctcaacaaacgtatctggacttggccagccgggcggtcgaggcgggatgtgaaacaggactcttacattcccgttttacgccccagcaccgcaaccggcatgagcaacgctgggtcgcgctttacggccgggcgggttggccccaacgtaaacagtgcggacgcattttagtcgggacccaggttctggaacaatccctcgatatagatgctgatttcctcgtcagccgttttgcgccaaccgatatgttgctgcaacgtcttggtcggctgtggcgacataccgatacgccccgccatgccagcgcgaaggcggaatgctggctattgtccccctcgctggagagtgctttagccaacccgggttctgcattcggcatgagcgcgatggtctattcgccctatgtgttatgccgcagtctggaggtctggcaagcgatcccgtccctctcattgccaggggatattcgccccctgatcgatcaaacctataccgagcgcgctgaagaggggacatgggccaccctattgcatgagctgaaaaatggcagccgctttcgttcaggagaacaggcgctgcagtcgctggcgaagctcacgttatctaccggcgggaaaacgctgcctgagcataaagcggagactcgctatagcgatcgtgacacccatgacctgttgctgctgcgtggtctgcgtacgcaagacggcatcacgtatatgcgcctgctagatggtgctgaattaacccttccgcatgggcgccatcgtttaagccgggcgcagtggcgacagctggcggtggtgcttaatcagcagctggtgcgagttagcccggctttttgtccgcccacaatagctaaaagtgagctggaaaaattacacctgcaggaggtgttctatcttggtcgccccgaagatgacgaggcgttactgcgggttgcgattgtcagcccggcgggtgagttgaagacactggatggccggcccgcaggcgataaatacactctcgaatatagtgaatatcttggcttccgggccatttccaaaaaggaataa

SEQ ID NO: 71 - DNA, 351 bp, Klebsiella pneumoniae
cccgcaggcacctccgcccaggcggcacaggcgaaaacggccgtcagtgaaaccactaaaccacttattttcttatacatgataccaacctttaatcatcaattaataaacacaaatttaacatatagtggtatcagctccccttgcaacgacggggatggcttttttctggcttttgtgacactggcagaatttaaaaatgtggtgtttatggcgttaattaaaacgcgatcccggcccggttttttatcgtctgtcgtatgcgcaggcgctggcgcagcggcatgtcgccgggagacgccgcccttgaccttctgcgccgggcggcgcagcataaaacggcaaacataa

SEQ ID NO: 72 - DNA, 897 bp, Klebsiella pneumoniae
ctccgaggcaccgcgatgattaacggttacattcctgccgcgcgctttcttccttttctgagctggacggacgtggccgccctgccggataaaagcaatacggttatcgtcctccccaccggggcgatcgaacagcacggcccgcatctgccctgctcggtggacagcgtgatatcttccggcgtggcgggccatgccctcgccaggctgccggcgacgatcccggcctacgccattccgccgatcgtctacggtaagtccgaggagcatctgcattttcccggcaccctgacccttagcggcgatacgctgctgcataccctgctggagatcgccgaatctctctatcgggccggttttcgcaagctgctgatgatcaacggccacggcggccagccgcagatcctgcagatcgcctgccgggaaatgcgcctgcgccacggggatttcatcgccatcccccacgacgtgttcaacgtgcccaactgcgaaaaacagtttctcagcccgcatgaacagcggatggcgatgcacgccgggcatagcgaaacggcgctgatgctggcgctggcgccggagtgcgtccatatggaacgggccgtcgctaatttccccccggaattcccctgcccaaccctgtcgaaaggccgtccggcggcggcgtgggcgtcgtatgactttggccccagcggggtgattggcgacccgaccccggcgacgcgggagcaaggcgaaaggcttctcgactccctcgccgccagctgggcgcaggcgatcatcgagatccaccgcatggcctgggtcgaacgtcgcgaaccgacctggggcaaacagcactggcacggctttgtgcagtccctaccaccttctttcgctgctgaatccagggagccctga

SEQ ID NO: 73 - DNA, 483 bp, Klebsiella pneumoniae
tcgagcataacacaatccttaaatgatcaaaaccgagcagtagcaagcatgatcgtctgccctgctctggttgtcaacgttcctgcccggaggtttaccatgaaaattgcccatttcgccctgtggacccaacagctagacgtccaggcccgcttctgggtggacttctttgccgccagcatcaatgaaaaataccttagccagaccaaccccggctttgcctcctattttgttactatcgacgacgaggtggtgatcgagctgatgaccaagcctggcctgcagcaggccagcgcggttaataaccataccggctgggcgcatctggccctctcggtgggcggggcggaacaggtcgatgccatcgcccaacgcgccggggccgccggaatactgatttcgccgccgcgcaccaccggcgacggctattatgaggcggtgatcgccgatcccgatggcaacctgatcgaaatcgtcgcatag

SEQ ID NO: 74 - DNA, 654 bp, Klebsiella pneumoniae
gtgctggtgactggaatatggctggtctccagcaaatggcgcagcgccttgctgttttccggctggctggccatcaggccgagcaggaagatcgggttcttcgcctgggcgataagtttcgccacctggtcgatggcatcatccggcgcggcgcccatctgcggggccccgctggccggcagcactttgccgctgaccgggccatcgaccacatcctgcggcaggctaacgaacgcgctgcccggccggccctgctcggcggcgcggaaggcgttggagaccacttccgccagcgcatccggcgccgtcacctcgacggcgtatttggtgaccgggctgaacatcgccaccgtatccatactctggtggacctgcttcgctttatcggcgcgttttaccgcgccgcccagggccaccaccgggtcgccttcgctgttcgcggtggccatgccggtgatcaggttggaacagcccggaccggaggtgaccagcgccacgcccgctttgccggtaatgcgtccgacggcggcggccataaatgcggcgttggcttcatggcgtaccggaataatgcgaatggaggaatccagcagtgaatcgaagaccttgtcaattttggcgccggggatgccgaacacctggcgtactccctga

SEQ ID NO: 75 - DNA, 351 bp, Klebsiella pneumoniae
cccctgacgacgcaggctggcagccacggttttcacattgaaccggtaaccctgggcacgaagctcatccgtcaggcgtggcgctccatagcgttgttttgcgtcactgaatgcttcccggacgacgttatcacagacaaggcggaactgctgacgccggtttacctgataacgacgctgatgccagatgtaccagccactacgggtaacctgaagtacacggcacatggctttgatactgaactcagcctgatgtttttcgatgaagacatacttcatttcaggcgcttcgcgaagtatgtcgcggccttttggagaatggccagttcctcatcccgttctgccagttga

SEQ ID NO: 76 - DNA, 996 bp, Klebsiella pneumoniae
cgccgcaggacgcagcagcagatgacgggaggcgaaagccagcggccgaaaaccggcccggtgaacggcgcgcgtcatttaaaaaacctcgcggcgataaagataaacaacggcgcgcccaccagggcggtcatcgctccggtggccagctcctgcggcgcgaccagcgtccgggcggcgatatccgccagcaccagcgccagcgctcccaccggcgcggccaggggcagcgccaggcggatgtcttccgtcaccagacggcgcaccatgtgcggcaccaccagcccgacgaagccgatcggcccggccaccgccaccgccgcgccgcacagcagcgcaatcgccagcaggcccagcagccgggtctggacgagattaacgccaaggcccagcgccaccttatcccccagcgccagcacgttgaggcgtggggcaatgagcagcgcgacgccaaggccgatcagcgctggaaccagcgccgtctgcagcgtgctccagttcagtccggccaggtcgccggccagccaggtgcgcatcgccagcagcgtctgttcatcgagaattaatatcgccgccgtcaccgccgacgcaaaccctgacagcgccactccgcacaacgtgatgcgcagcggcgtcgccccgccgcgcccggcagaggccagcgccatcacgccaccgaacagcagccccgcgccgcaggcggcggtcagcgggcgcccggcggggaaagcgccgaaggacaggcccagcgccgaggtcgccaccaccgccagcgaggcgccggcgttaagcccgagaatatgcggctcgccaagcgggttacggatcaccgtctgcagcagcagcccggcgacgccgagcgccgcgccggtcagcagcgcccgccgccagccgcaccagacgcagatcgacgataatccgctgctcaaagttacgcggatcgtactccagcagcgctcgcagcaccgtctgcggggcgatccagcgggcgcctaa

SEQ ID NO: 77 - DNA, 189 bp, Klebsiella pneumoniae
gggacaactgcaggaggtgttgcccggctgttgcgtcaaggatgggcatttctcggtcctgtggcccgccagccgctacctgtcaccaagaatacgctgttttatcgattttatagctgcggcagagatacccttgtcacccgcatcggcgacccctgccccttgtgtctaacaatttgtggtgattag

SEQ ID NO: 78 - DNA, 1035 bp, Klebsiella pneumoniae
gccacattcgctcgctccccctcccggcgtaaagaggagagggatatgaaaacaggcgcacgccttccccggggcatacgctggctgggcctgatggctctcggcggtgtctcgctggccgttcaggccgaggagaaaatcgttctgctgacctcctggtacgcccaggcggagcagggggggtattatcaggctcaggccaccgggctgtacaaaaaatacggtctcgacgtcgagatccgctccggcggaccgcaggtcaacggcatgcagttgctgttgtcgaagcgggccgatgtgatcatcggttacgacctgcagctgctggaaggcattcagcgcggcttccaggcaaaggccattgccgcgccctttcagtacgatccccaggggctgctgacccatgccgatgtcacctctctgcaggggctgaaagacaaaaccctgctggtttccagctccggtcaggcgacgtggtggccgtggctgaaggcgcaataccagctgagcgacgcgcaggttcgcccctataccttcaatattcaaccctttgtcgtcgatgacgctgtcgcccagcaggcctatgtcagctccgaggtgttccaggtgcagaaggccggagtgaaggcgaacttcttcctcttttccgaacacggctatcccccctacggcggcatccttatcgcccgcccggacaccatcgccgagcgtaaagcggcgatggcgaagtttgtccgcgcctcaatggagggctgggtgagctatctcaaggatccggagccgggcaatgcgttgattaagcaggacaacccgaaaatgaccgacgatctgctcgcctggggcgtgacccagatccgtgagcatcacctgatcgacggcggggatgccgccagccagggctgggggacgatgaccgacgcgcgctggcagaagacccgcgactttatggtcagcgccggtctgctggcggcggccaccgactggaaacaggcctacaccaccgaatttgttcaggccatgcaggttaaaccctga

SEQ ID NO: 79 - DNA, 1227 bp, Klebsiella pneumoniae
cgcgagcccgcctcaggcttcgcgcatgatccacgaatactgaaagctcttcggcgccggaaaatgggtccggcgccggtaggagcccagcgactgcggggtgcagtaggtacaactccccagccattcaacgctcgccggcgccacccccgcctctgcgaagatcgcttcggcaaaggcccgcagatcaaaccacagattatcgctgccgcgtgcggcggctttgagcggatcgctgaccgggcccgaacgggagtggaacagccgctggcgatggcgggccacccggtcaccgccgggctggtccagcagttgctgatagaatccggcggagacttcgtaacagcaggggtgaatatgcggccccacggcgatgaccagatcggccaatgccaccccctgctggcgaaaacaggccagactgttgtcgacaataccgctgaccagcccctgccagccggcatgcacgctgcagacgtagcgaccgtcgcgcgaggcgatcagcagcggcagacagtcggcggtcaccacccccaccttttgcccggctaccgcggtaaacaccgcgtcggcgtgcgggcgcgtcggcagcggctgctgataatgatgaacctcattaccatgcaccagcttcaccggagccagctcggcatagggaaaggcggcggtttcatggacatcgagaaaagcgtggcggatgccagggatcgcattgagcaaacgggaggtgtaagccatagggacgataagcgtcagggaatgatgtcttaccttaggccaggggacgcggacaggcaaggcggcggcccggcatttttttaccagaccgccggatgcatatcagaccatggccgcgcgctgctggcgatgcatcagccagaacaccgccacgccggccagcacaatgcccggcgccgaggccgccatcaccccgacggtgccggtgccgagggccagcatcttgccggccagcagcgggccgctcatcgccccaagacgccccaccgccacggcggtgcccaccccggtggcgcggatggccgcgggataaaaaagcggcgccagagcgtaaagcacactttgtccgccggtggcgaacagcccggcgacaaaccccgccagcagcatgccagtcagcgacgacgcgctgcccagcgccaacagcgacgccagaatgccgctgtagatcaggagcgacatccgcagcggggtgagcttatccattag

SEQ ID NO: 80 - DNA, 2013 bp, Klebsiella pneumoniae
aaattacacgccgccggaggtgaaaaacgccatgacgccggagaaaacgggggcgcagccatgatgccggagctgggccactttttattgtgtctggcggcgggactggcgctgctcctgagcgtttatcccctgtggggcgcggcgcggcaggaccggcggctgatggccctggcgcggccgctggcctgtgggctattcgcctgtatcggcggcgccttcctgctgctggtgcacgcctttgtggtcaatgactttaccgtccgctacgtggcggaaaactccaacagcgcgctgccggtgtggtatcgggtggcggcaacctggggggcgcacgagggctcgctgctgctgtgggttctgctgctcagcgtctggaccttcgccgtcgccatcttcagccgccggatgccgctcgacgccgtcgcccgggtgctggcggtgatggggatgatcgcctttggtttcctgctgtttatcctcttcacctccaatccgttcagccgcggcctgccgcagtaccccattgatggccgcgacctcaatccgctgctgcaggatatcggcatgattttccatccgccgatcctctatatgggttatgtcggcttctcggtggctttcgccttcgccatcgcctcgctgctggcgggccggctggatactgcctgggcgcgctggtcgcgtccctggacccaggcggcatggatgttcctcactctcggcatcgtgctgggctcggcgtgggcatactacgaactgggctggggcggctggtggttctgggacccggtggaaaacgcctcgtttatgccgtggctggtgggaaccgcgctgctgcactccctggctgtgaccgaaaagcggggcagcttccgcgcctggacggtgctgctggccatcgccgccttctccctgtgcctgctgggcaccttcctggtgcgctccggggtgctggtttcggtgcatgccttcgcctcggatccgtcgcgcgggctgtttattctggtactgctgattgtcgccatcggcggatcgctgctgctgtacgccctgaagggcggccgggtgcgggcgcgggtggaacatacgctgtggtcgcgcgagtcgttcctgcttggcaacaatatcttgctgatggccgcgatgctggtggtgctcctcggaacgctgctgccgctggtgcataaagagctgggcctcggcagcatctccatcggcgagccgttcttcaataccatgttcaccgccctgatggcgccgtttgcgctgctgctggggctgggaccgctgatccgctggcggcgcgatgacgtcgccaggcagattaagcgcctgattatcgctctgctggtgacgttgtcactttctctggcgctgccgtggctgctgcaggaccgtatcaccgccatggcggtcataggcctgatgatggccctgtgggtgctgatcttcgccctgatggaggttcacgaacgggccacccatcgccacggcttctggcgcggcctgcgcactctgacccgcagccagtgggggatggtgctcggtcacgtcggcgtggcggtgaccgttatcggcatcaccttcagccagaactacagcgtggagcgcgatgtacggatgcgccccggcgacagcatcgatatccacctctatcactttgtgtttaacggcgtgcgcaatatcgtcggccccaactggaccggcggcgaaggcattatcgccgtgacccgcaacggccgcccggaagcgacgctgtatgccgagaaacgcttttacaccgccagccggatgatgatgaccgaggcggcgatcagcggcgggctgacccgcgatctgtacgccgcgctaggggaagagctgagcgacggcagctgggcggtgcgtctgtactataaaccgttcgttcgctggatctggtacggcggggtgctgatggccctcggcggtctgtgctgcatgctcgacccgcgctaccggatgcgtaagaagctgcaggaggcctcatga

SEQ ID NO: 81 - DNA, 513 bp, Klebsiella pneumoniae
cccaccgacgcgtgtggcaggaggagatggcacatgagtcttgaagcaggcgccggggcgccgctggcgcggtatgccgcctggcgcagagccggcgattttatctttctctccggcattattccggtcaatcccctgaccggcgccatcgtcaacggctttcaggatgtgcctgagccggtgcgggagctgctgggggcgaccggcgaattttcaaccgatgcgaaacagggcccgatcctcgcccagagctggtacgtcctggagagcatccgccgcaccgtggcgtccgcgggagggcagatgagcgacgttatcaaactggtgcagtactttcgtaaccttgaccattttccctattacagccgggtcaggaagctgttttaccccgaccagccgcccgtttccaccgtggtgcaggtcagcgaaatgctgcccgacgccacggtactgattgaagtcgaagcgaccgtctggttacccccgtcatttaactccgaggcaccgcgatga

SEQ ID NO: 82 - DNA, 1182 bp, Klebsiella pneumoniae
aggaactgcgccatgcctgatgaacatcacgtcctgcttaaagaggacgtcaggaacctgccggatacccggtatcttctctcactgatgcctctgctgggctgtttagttctgatgaccattatgctggccggctgcgatggcaaaaaacaacccacttctttacctctgcgtccggtcaggttcgtgactgtcggtccgcgtgagtctcccggggtacagacgctgaccggcgaaatcagggcgcatgatgagacgtccctgagtttcaggctggacggacgcatactgacgcgcagcgctgacctaggcagccggtttcggcagggtgatgcgcttgctgttctggacagtccaacagcgcaaaatcagttaaccagcgctcaggcagacgtcagcagcagccgggccgcggaaaaagtggcggcgcttaatctgcatcgcatgcgtcttctgatgccgtccggggccattgcgcgggcgcagctggacaccgccgcagccgactggcaggccgcactttcacgccttcagagcagtgaagcggcgctgaaaaatgcgcaggagaacgtgcgctggacgaccctaacggcgccggtaaacggcttggtcacgggcgtcagcgcgtctgcggggcaggtggtcagcgccggacaaaccgtgtttaccgtggcctccagtaatgcccgggacgtcgtatttgacgtggccagtcccggaatcgtatcccgtcagcctggtgccacttttcatgtggcattgcttcaggatgcttccgttattgcacaggcgcatctgcgtgacatcagcccgcaggccgacccgcaaacgcgcagctggcgggtgcgcatcacgcttgataatccgccgcctgacatggtgatgggagccagcgtctctgtaacgcttcccatcgcggactcagcgggtgaaaaggtgataacgcttccggcctcttctcttacgcgcctgtcagaagctcctgctgttttcattctggatccggctaataataaggtctaccggcgagccgtacatattgcaggttactctgcggacgctgtttttatccgggctggagtatcacccggagatcgtgtggtaacggcgggcgtcagaagcctgcgtgacggtgagcacgtggctggcatacaggaggaccaggatgaagcagggctttaa

SEQ ID NO: 83 - DNA, 1053 bp, Klebsiella pneumoniae
atgacgcgcgccgttcaccgggccggttttcggccgctggctttcgcctcccgtcatctgctgctgcgtcctgcggcgttaaaaattgccgccagcatagtgctgacgctgctggcgctggggctgtacagccttagccgcggcagctatccgctgcccgcgtcgacgctggcgcgagccctgctggcgccccaggagatgggcgagcagccgcgctttattctgtttgatatccgcctgccgcggatcctgatggcgctgctgtgcggggccatgctggggctggccggcgcggcgatgcagagcatcacccgtaacgggctggccgacccggggctgatcggcgtcaaagagggggcaagcatcgtggttctggcgctggtgctgtttttcccggcggtaggcctggtctggcggccgctggcggggatggtcggcggcatagcggtggccctgctggtcctgacgctggcccgcgactgttcgcggccgcgctttattttaattggcatcggcgtctcctggagcctggcggccgcggtcggcatctttatgaccaccgccgacgtacgcgacgtgcagacggcgatgatctggctggcgggcagcctgcaggccgccacctggccgctgctggcggtggctttttgctgggcgctgcccggggccatcatcctgttctgtaccgcccgggcggcggacgtggcgctgctgggcgaccggaccgccatcggcctcggcgtacgtctgcagcagctgacggtgctgcgcttttttgcgccggtgctgctgacctcggccagcgtctcctgcgtcggcagcctgggttttgtgggcctgatggcgccgcatatggcgcgtttcgtgctgcgcggcggccaggtatcgctgctgtgcggcagcgcgctgattggcgccttgctggtgttggcgaccgatacccttggccggctggcgtttgccccgctgcagatcccggcggggattgtcattgccctggtgggctgcccgttcttcgttgtcttgctctggcgtcgccgtgatgccctttaa

SEQ ID NO: 84 - DNA, 363 bp, Klebsiella pneumoniae
tcttacccagcaatagtggacacgcgactaagtggagtaaactctcaaccagaggtgactcacatgacaaaaccaacatcaaccaccaaaaagccacgcaagcagcacactcctgaatttcgtcaggaagccctgaaactggctgaacgcattggggtggcagctgccgcccgcgaacttaacctgtatgaatcacagctctacaactggcgaagcaaacagcaaaatcagttctcttcttctgaacgcgagcaggacatgtccgctgagatcgcccgtctgaaacgtcaactggcagaacgggatgaggaactggccattctccaaaaggccgcgacatacttcgcgaagcgcctgaaatga

SEQ ID NO: 85 - DNA, 297 bp, Klebsiella pneumoniae
aggcctgcagcccgatgcggtcaatcaacgcgtctgccttcgcctccagcccctttttcccctgcgcctgcgggcccagcagcacgttctgccgcaccgtcagccacggatagagcgtcggatcctgaaacaccagaattcgctccggccccggggcgccgagcgccgcgccgtcgatctgcatctgtccgctctgcggcgcttccagccccgccagcagccgcagcagggttgatttaccgcagccggaagggcccagcagcgccacgctttcccccgggcgcagctgcaggctaa

SEQ ID NO: 86 - DNA, 201 bp, Klebsiella pneumoniae
gtttccgcagccgcctgtccggcagccgtcagcgcggctatcatgcaacacgctttgagcaaattcttgaccatgagatttcctttttatgcatttattttgcataaaaatacacacactcacttttatatgcaaccggaaaccttcccgctggtgaattatcttctcaatggccccgtttaccgccggatttaccgatag

SEQ ID NO: 87 - DNA, 414 bp, Klebsiella pneumoniae
cggggaaaagccagcggcagcgcaaactcggcgataatccgccctggacgcggcgacatcaccagcacccgctcgcacagcagcagcgcctcttcgatatcgtgggtcaccagcaggctggtatacccctgctgctgccagagggcgatcagctcccgctgcatactgatgcgggtcagcgaatcgagtttgcccaacggctcgtcgagcagcagcagacgcggttcgttcaacaaggcgcgcgccagcgccgcacgctgtgccatccctccggacagctgccgcggccacgcctcgctgaaggcctgcagcccgatgcggtcaatcaacgcgtctgccttcgcctccagcccctttttcccctgcgcctgcgggcccagcagcacgttctgccgcaccgtcagccacggatag

SEQ ID NO: 88 - DNA, 1623 bp, Klebsiella pneumoniae
acagccggagcggcagttctcccggttcggtttccggggacctccaccagcttttgggcggcggcaccggcagcgtcgacatcaccggccccatcggaaggcacaaatctggcgtaccgactgatcggcgaatatcagaatgaggattactggcgcaatttcggtaaaaacaaaagcagctttatcgccccttccctgacctggtttggcgagcgggcaacggtgaccgcgtcctattcgcaccgcgactacagcgccccctttgatcgcggcactatcttcgatctgaataccggccatgcggttaacgtcgatcgcaaaacccgcttcgatgaagcgtttaatattaccgatggctattccgatctcgctcagctcaacgccgagtatcgccttaacgacgcctggaccgcgcgcttcgactacagctacagccaggatcattacaacgataaccaggcgcgggtgatggcctatgattcggcgaccggcaacctcacccgccgggtcgatggtacccacggttcaacgcagaagatgcactccacccgcgccgacctgcagggcaacgtggtagtgggcggcttttataacgagctgctgaccggcgtcgcctatgagaattacgatctgctgcgcaccgatatgctgcgctgtaagaacgttaaaggctttaacatctatcatccggtctacggcactctcgacacctgtaataccgtctccgcctccgacagcgaccagcgcattcagcaggagagctatgccgcatacgtacaggacgcgctgtacctgaccgacaactggatcgccgtcgccggcgtgcgctaccagtactacacccagtacgccggtaaaggccgaccgtttaacgtcaataccgacagccgcgatgagaaatggacgccgaaagccggcctggtctacaaggtcacgccgaacgtctctctgttcgccaacgtcgcccagtcgtttatgccgcagtcgtcgatcgccagctatatcggcgagctgccgccggaagagtccacctcttacgaagtgggcgccaaatttgacctgttaaacggcattaccgccaatatcgcgctgtttgatattcataagcgtaacgtgctgtacaccgagagcattggcgatgagacggtggccaaaacggcgggcaaagtgcgttcccagggcgtggaagtggatctggccgggtccatcaccgataacctcagcgtgatcgccagctacggctacaccgacgccaaagtgctggaagatccggattacgccgggaaaccgctgccaaacgtaccgaaacataccggttcgctgttcctgacctatgacattcataacgtctacaacagcaataccctgaccgtcggcggcggcggccacgcggtcagcaagcgctccggcaccaacggcgcggattattatctgcaggggtatgcggtggcggatgtgttcgccgcctataagatgaagctgcagtatccggtgacgctgcaggtgaatgtgaagaacctgtttgataagacctattacacttcctcgatcggcaccaataacctcggtaaccagattggcgacccgcgcgaagtgcagttcacggtgaagatggatttttaa

SEQ ID NO: 89 - DNA, 939 bp, Klebsiella pneumoniae
cctcagggagcgcagcgcgctccctctgtcgctgccggtgggttacgccgccggcagctgtttctccaccagccccacccacatggcgacgccggggccgatcagcgcatcgttaaagtcatagcttgcgttatgcagcggcttcgacggggtttcgccgtcggtgcctatccagaaataggcccccggacaggcctccagcatgcaggcaaaatcttcggaggccatcgacggcgcctgattccagcgcaccgcttgcgcgccgagagtggcgacggccacctcgcgcacctgctgcgcctgcagcgcatggtttttggtcaccggataacccgggaaccagctaatctcgccctgcacatcggacacctgcggctgggtcgccacatagctttcgatgagctcccgcacgcgggcgcgaacgcgattgctcaggcagcggaaggtaccgcgcagcaccacggtgtccggcaggacgttgatcgcctcgccgccgtttatctgggtgatgctgaccaccgcggaatcctgcggcgacaagcggcgggaaggaatggtctgcagcgccattatcagctgcgccgccgcgacgatcggatcggccccgctctccggcatcgccgcatgacagctctttccgcgcagggtgatctcgaaggcgtccagcgaggccatcatcgcgccatcgctgagcgccacttcgccaagagggatccccggccagttatgcagcgcgtagatggcgtccatcgggaagcgctcaaacaacccctcctccaccattttgcgcgcgccgccgaggttctcttccgccggctgaaagacaaagtggacggtgccgctgaaatggcgggtctgcgccagatgggcggcggccgccagcagcatcgcggtatggccatcgtggccgcaggcgtgcatcaccccggcgcggcgtga

SEQ ID NO: 90 - DNA, 999 bp, Klebsiella pneumoniae
atccagggagccctgatgaataccagattgacgcccgtttttaccctgctgaccgtggccgccctcgcgacctcagcctcctgcttcgcggcggagaagtttacctttctcaccaactggtatgcccaggccgagcacggcgggttttaccaggcccaggccaccgggctgtatcaccacgccggtctcgatgtcgaaattaaaatgggcggcccgcagatcaacgtcatgcagctgatggcggccggtcaggcggactgcacccttggcgacaacggccaggcgctggagacctggcaggccggggtgcacgcggtgaccgtcgccaccgtgttccagcactcgccgacggtgtttatcacccatgacaaagtggagaacccggcggaacttaaagacaaaaccttcctgctcgccaccgaggcctatacctccttctggccgtgggcgaaaagcgagctgggtctggctggcagcaaagtgcgcccctatacctttaacgttcagccgttcctcgccgataaaaatctggtgcagcagggctacgtgacctcggagccgttctccgtcgccaaaggcggacagccgttctatgtctatccgctcagcgactggggatatccgccctacggcaactcgattatctgtatggccgacaccatccgcaaacgtccggcggcggtggcggccttcgtcaaagcctccatggaaggctggaaaagctacctgcaggatcccgcccccggcaacagcctgatcggtaaagcgaatccgcagatgggcgccgagcagatcgcctttggcattgcccagatgaagcagtaccagctggtgaccggcggcgacgccaggaccggcggcatcggcatcatcaccgagccgcggctgaagaaaacctgggagatgctggtgaaaaacaaactgatcgacgccagcaaggtgccgtttgagcagacttacaccctggagatggtcaaagacgccggagtgatgccatga

SEQ ID NO: 91 - DNA, 312 bp, Klebsiella pneumoniae
ggcagcgtggcgctcccgggcaccacttccaccagcgggatcaggtgcggcggatgccagaaatgggcgatcagcaaccgttcagggtggcgcatgccctgcgccagccgatccggcggcaggccgctggtgttgctggcgataatcgtctcgtcggcgatcagcgtttccagctcggcgtacagggcgtgcttcagcgccagccgctcggggatcgcttcaatcagcagcgtggcatcggccagggcattcagcgtcggggtgggggtcagacgggccagcaccgcgtcgcggtcggcgggatcctgttga

SEQ ID NO: 92 - DNA, 213 bp, Klebsiella pneumoniae
catttcccggcaggtccatgcggcattcgccggatcccggacaatactgactctcagcacaaaaagagcctgatagcaataaatacccgattggctggattatctgcggcttgtcggcgtaaagcggagaggtctgtcgccgcgaatcagtcggaggccttccgctgtctgcaaagcggcgcccgttttggcaaaatttgcgtggcgtggtga

SEQ ID NO: 93 - DNA, 321 bp, Klebsiella pneumoniae
ggcaggacggcatacgccccgccgaaagtcatcagcgcggctttggtaaagaacccgctcatctgggtcagcggatgcgcccagcccagcattagcgccagggcggccatcggcaccagccacagcagtatcccggcgctggtgctgttcgccctgatggaatggggccaccagcacgtgctgcatagcgcgccgcctattgcattggtggacagcgccagcggcgagactgtccatccagggttcgtcaccgccagcggcagcgtggcgagccccagcgcgctacagatcgtcaaagccggtacccatgccgaaacctga

SEQ ID NO: 94 - DNA, 651 bp, Klebsiella pneumoniae
tccctacaggctgagcctctacgacggcaacggcatgcttggcctggatctcggggtctatggcgcgccggagacgtttctcatcgacggtcagggcattatccgctggcggcacgccggcgacctgaacgaacgggtgtggcgcgaggagctccagccgctgtgggatcaatacaaccggagggcgggctgatgagacgtgtaatagtcatcctgctggcgctgatgctgaccggccagacgtgggccgccatcgatacctggcagtttaaggatgaggcccaggagcaggccttccgcgagatcacctcccaactgcgctgccctaaatgccagaacaacagcatcgccgactcaaacgcgatgattgccgctgatatgcggcagaaggtgtacgagctgatgcagcagggtaaaacgaaagggcagatcgttgactatatggtggcccgctacggtcattttgtcagctatgagccgccgctgaccgcgggcacggtgctgctgtggctaggaccggggttgttcgtgctggcgggcgcgggagtaattatcgcccgcgcccgccgtcgcgacattcctgacgcggcgctcagcgccgaagagcgccagcggctggcggcattattgaaagaaggaaaagaacgatga

SEQ ID NO: 95 - DNA, 594 bp, Klebsiella pneumoniae
cgccgccgggcaaggacagcgggcacggagccgattttgtgccgggtggcggctgcgccttacccggcctacaaaactcttctggtggcatgcccctggcccgcgcctgcgcagcgccgccggacagtcactgcgcctgctgctgcgcctgcgccagctggcggacgatcgcctcgcgccgcgcatccccttccggtagccgggccagcaacgcctgcagggccgccacggcctcggggtaatcttcattacgcaccgcgctcagggccagcatctccagcaccggcaggctgttcggctgccgctgatgcaggtcacgcagcagcagctcgcccatccgaacctgaccgctatcccccgcccgcaccagcgcgctggcgtaatcgaaagccgccgccgggtcgtccgccgccagagcatgcgcccggccaaaggcgccgatcgccgtctcgccatcgtttaacaacaggcccagccgcccaagcagctgccagccggcgaggtcgttcggcgtatcctgcaggtggctgcgcaggccaagccgcagctccgccagctcatccattcgcagcggcgccgccgtcgggtccttaa

SEQ ID NO: 96 - DNA, 192 bp, Klebsiella pneumoniae
cgccgccgggcaagggcagcgggtgcggagccgcttttgtgccgggtggcggctgcgacttacccggcctacggtccgtgcgacttgtcgttaatttattcaccattgttgctgaaactgccggtgctggcggcctcaaaatcgctgagacgttcccggaaggccggggcagcccgcatggatgcgggctga

SEQ ID NO: 97 - DNA, 834 bp, Klebsiella pneumoniae
tgttattactattgtttcataggtaattatatggtgtatgcatgcaggtatttttacaaggagaagtttatgtcacggtttatctgtaacactcttctgcttacaaacgatgacggctttgatgcgccaggcttgaagatactggagaaagtgtgtcaacgcctggcaaaagaagtctgggtggtagcgccagcttgcgacagaagcggaacctcacagtctctttctttacacactcctttaaggttccgtcaaaagggcgttcatcgctatgttgtcgagggaacgcctgcagactgtgttgcaatggcggtgcgacatctcatgattgattcaccccctgattttattctttcaggtattaataggggggcgaatattggtaacgaaacgatcttttcgggcaccgtgggggcagcgatgacaggtgtgcttcttggttttcgtgctatcgccttgagccagtattttaacaacaggcataatattcactgggacactgcagaacatgcgtcggaaatcgtactgaagtacctgattcagggccggtgggactacggaacctgctttaatgtcaaccttcctgacgtagaacccgacagcataaaagatattgccatcacacgtcagggggaaggcaatctgaataacatcggcgttatagtgcgtgaggatcttcgagctattccttacgcatggctgaatctggaaagaagtgaaaatgctgaaccatcagacagtgaaggttctgcagtgagggcggggcatatcagtgtcacacctctgcatttcgacagaacgcattacagagacagattaatacattcacattga

SEQ ID NO: 98 - DNA, 1356 bp, Klebsiella pneumoniae
caacaccctctgtacccgagacaggaaccgactatgagctcatatagccctaacccgacggctgccgcccagccagccgttaccgtgcgccgttcccggcggcgtatcggcattcttgcgctgttggccattggcaccatgatcaactatctcgatcgcaccgtactggggatcgccgccccaaagctcaccgctgagctggggatcgacccggcgatcatgggaatcctcttctccgccttcgcctggacctatgctctggcgcagatccccggcggactgtttctcgaccgctttggcaacaaagtgacctactttttgtcactgaccctgtggtcgctgtttaccctgttccacggcatggcggtggggctgaagacgctgctgctgtgccgcttcgggctcggcattagcgaagcgccgtgctttccggtcaacagccgggtggtcagcgcctggttcccacagcaggagcgggcgaaggccacggcggtgtacaccgtgggggagtatctcgggctggcctgttttgcgccgctgctgttctggatcatggacggtttcggctggcgggtgctgttcgtcagcgttggcgccgtcggcattctgtttgccctggtgtggtggcgctgctaccgcgaaccgcatgaagatccgcgccttagccagcaggagcgcgagcatatcgaaaacggcggcggcctcagcgccccgaccgaccagcaggtggcgttcagctggccgctggtccgccagctgctgagcaaacggcagatcatcggcgccagtatcggccagtttgccggcaataccgtgctggtgttctttctcacctggttccccacctggctggccaccgagcggcatatgccctggctgaaggtcggcttcttctccatcctgccgtttgtcgccgccgccggcggggtgatgtttggcggctggctctccgacaagttgctgaaagctaccgggtcagccaacctcggtcgtaagctgccgatcgttgccggcctgctgatggccagctgcatcatcaccgccaactggctggagagcgacctggcggtgatcctggtgatgtcgtttgccttttttggccaggggatggtggggctcggctggacgctgatctccgatatcgccccgaaggggctgggcggcctgaccggcggcctgtttaacttctgcgccaacctcgcggggatcctcaccccgctggtgatcggctttatcgttgccgggttcggcaatttcttctacgccttgatctacatcggcggcgccgcgctgctgggcgtggtggcctatctgtttatcctcggcgacgtcaaacgtatcgagttatcgcagtaa

SEQ ID NO: 99 - DNA, 981 bp, Klebsiella pneumoniae
atgctacggtattgtgataaaactgttgcgtccagagctttgattcgcacaacccgttgcaaaaaagagagcacccaaaccatgtttgccttctcccgatttctgctctatttcaccgaagtggcccgtcagggatcgtttcgtaaagcgtcagaggcgctgcatgtgtcggcgtcttccatcgaccgtcagattttgcgcgtggaacaggagctggcgatgccgctcttcgagcgccatcccaccgggctgaggctgaccgccgccggggagctgctcctgcacgcggccaataactggaaaaaggactttacccgggtctgcgagcagctggacgatctgcgcgggttgcggcgggggcatgtgcgcatcgccaccatcgatgccattaaccggcatttcttttcgacgatgctcaaagaggtgcataaacattatcccaacatctcttttacattgaccaccatcaacaatatccacatccagcaggcgctgatctccggcgaggcggatttcggcatcatgctcaatccgcagacctcccgtgaactgcaggtgcgggcgtttgccgaaatgaatatggggatcgtggtgccgaccggccatccgctggccagccgcagcgcggtgcgctttagtcagtgcctcgactacccgtttatcctgccgtccgccccattgatgatcagcgagccggtggaggcgctggtgaacatcagcggcaacgaggtgaaggaggtggcggtatcgaataacattcacatgatccgcaccctgatcaaagagcagatgggcatcggcatcctgtgccggctggatattctcgatgagattgagtccggccagctggcgtttgtgccgctaaccgatccgcagcttaagcctttcacgctggcgctgtgcgtctcgcccgcccgccagctttcccttgccgcctcgatgatgctgaaccagctggagatgctcttcagccagctgtga

SEQ ID NO: 100 - DNA, 780 bp, Klebsiella pneumoniae
aaaggaaatctcatggtcaagaatttgctcaaagcgtgttgcatgatagccgcgctgacggctgccggacaggcggctgcggaaacctataccgtcggctccggcggcacctaccggccgtttgaatttgaaaacagccagaaacagctggaaggtttcgacatcgacatcatcaaagccatcgccaaagccgaaggctttgacgttaagctggtcaataccccatgggaaggcatcttcgccacgctgaacaccggcgaccgcgacatcatcatctccgggatcaccatcaccgataaacgcaaacagatggtcgatttctccgcgccgtacttcccggccgaacagtctatcgtcgtcgctcaggactcgcaggtggattcgctggcggccctgaaaaacgagaaggtcggggtggtgaactccagcaccggcgatatcgtggtttctgaggtgctgggtaaaaacagcaccgcgatcaagcgcttcgacaataccccgctgatgctccaggagctgtttgaggacggcgtcagcgccgcggttggcgacgtcggggtggtgaagtactacatcaaacagcacccggagaagcagttcaagctggtgccggatgccaaatttgagcgtcagtatttcggtattgcggtggcgaaaggcaacagtgaactgctgggcaaaatcaacgccgggctgcaaaagatcgttgctgacgggacttacgccaaaatctataaaacctggttcgacgacaacgtgccgacgctgccagcgcaataa

SEQ ID NO: 101 - DNA, 906 bp, Klebsiella pneumoniae
cgcggcgctcagcgccgaagagcgccagcggctggcggcattattgaaagaaggaaaagaacgatgagcctgttggtggttatcgtcgcgctgctgctggctggcgcgctggggctgctgtacttcccgtggtcgggcaaaggggcggtagaccgcgatgccctcaaccgcgccctgtaccagtcgcgcctgcaggagctggcgcaggagcgcggcgaggacaacccggcgctggtcgtcgagcttcagcgcacgctgctgaccgatatcccgccgcagccgctgcctggcgaacggccgctaaaccgctgggcgctgcttccgggcgcgctgctgctggtggtcctgagtctgggcctgtatctgaaaaccagcgatattggtcaggtgctgctctggcagcaggctgaacgacattatcctgcactgttgcagcaggttaaggacccgacggcggcgccgctgcgaatggatgagctggcggagctgcggcttggcctgcgcagccacctgcaggatacgccgaacgacctcgccggctggcagctgcttgggcggctgggcctgttgttaaacgatggcgagacggcgatcggcgcctttggccgggcgcatgctctggcggcggacgacccggcggcggctttcgattacgccagcgcgctggtgcgggcgggggatagcggtcaggttcggatgggcgagctgctgctgcgtgacctgcatcagcggcagccgaacagcctgccggtgctggagatgctggccctgagcgcggtgcgtaatgaagattaccccgaggccgtggcggccctgcaggcgttgctggcccggctaccggaaggggatgcgcggcgcgaggcgatcgtccgccagctggcgcaggcgcagcagcaggcgcagtga

SEQ ID NO: 102 - DNA, 546 bp, Klebsiella pneumoniae
gtgacggctcaccggcataaccagtatgataacggttcaaccaacccgggaccgactatggacaaagacacagtagtaacgctgttgaaatacaagcgctggattgaccttgccaccttacaggcgatccgcgcgattgacggaacggtacatggcgaaaagcgtcacctgaccatcaggctgatgaaccatatccatgtcgttgatatgattttccgggcgaatctgcgcggcaggccgcacggctacaccgcgctgaatacccctgagacgccaaccgttgatgagctggaaacggccatgaccgcctgtacggacgaatacattcagtacgtcagcgccatgacccccgccgatttccacgaacgtatcgccttcaaatttgtcgacggcggcgacggcaatatgaccgcgatggagatgctgaaccacatgctctttcacggcgcctatcaccgcggcgcggtgggctggatgattggcgaatgcggcggcgtgccgccgaaagaggtgctgaccgttttcctgcgcgaccatcattcctga

SEQ ID NO: 103 - DNA, 585 bp, Klebsiella pneumoniae
accgtagatcaggagattactttgcaaccagatcgctcaagactttatcttcgccgcgtaaacgcatcagatatagatgatctcttcaggatttatggcgaccctgcaacaaatacgttcaatccagcaggcccgtatcccgatattagtcacgcacgtaatgtaatggcccgctggcttaaccactgggagaattataggttcggaaactgggctatctcactgaaagagaatcccgatagaattatcggttttggagggcttagcattatcagttatgacgatacaccgataatgaacctggggtatcgtttctctacagaatcatgggggaaaggtctggcgacagagttcgctaaatatgcggtcgggtacgggtttgatgttttaaaactggctgagatttctgcggtagtaagaccaaaccatctggcatcccaaaagatcctgacgaaagcaggtctccggttttcacgaaatattcatgacgtgaaaaatgagcccgcaagcatgctttttactgtgactctggatgagtggaacaacgcgctaagtaggggaactaccccacccattgatcattag

SEQ ID NO: 104 - DNA, 270 bp, Klebsiella pneumoniae
ctgcatgaccacggtgatcctgcgcccggacgcgttcgatgccccggacagccaggcgcagacggaggcctttatcgcatggttaagcagtcgccgcacgatgccgatgccccggtgctggcgcccggcgaatgggaggccgccaaccgcgaagcgcggctggcgcaggggatcccgctggatgccggcagctggcaggctatctgcgccgccgcgcgcgacgtcggcctgagcgaatcgcacttcgaccgctgccgccctctcgcctag

SEQ ID NO: 105 - DNA, 489 bp, Klebsiella pneumoniae
ttggtgcgtctgaatggactcgaaccatcgacccccaccatgtcaaggtggtgctctaaccaactgagctacagacgcattatggtgcgtttaattggactcgaaccaacgacccccaccatgtcaaggtggtgctctaaccaactgagctataaacgcattatggtgcgttcgattggactcgaaccaacgacccccaccatgtcaaggtggtgctctaaccaactgagctacgaacgcaatgttgtggtgacaacggggacgcatattatcggcagggaggggatgtggcaagaggtaaacgtcacttttcttgcacattgcatgcgattgcggaatttttactcattccggatatattttactgaaccacaaggatatttcttcgccagcgagcatcacggctctcatttttcaggcagtccaaacctgcgcggaagggttgccgatgtgttaaattatcggccaccagaagagaaggagtcataa

SEQ ID NO: 106 - DNA, 1020 bp, Klebsiella pneumoniae
cgtggacgccagatgcccgctaaccatcatccctggctggtgcagggtagcctggcgctggtgaccctggggatcgcggtcgcctcgctctgtttcggccagtacccgttaagcctgagcgccgttggccacaccctggtccatctgccgccaggtgaaggggtgatcgggcagatcgtctggtcggttcgcctgccgcgcgtggtgatggccctgctggccgggggcgcgctggggctgtgcggcgccaccttgcagggcgtgttccagaacccgctggtggacccacacatcatcggggtgaccgccggctccgccttcggcggcacgctggcgatcctgttgggcgtcggcagtctgctgatgatggcctcgacctttttcttcggcctcgtcgcgctggggctgatttacgccctcgccgccctgcaggggcgggacagcacgctggggctgattctgtccgggatcattctcagcggcttcttcgcggcgctggtcagcctgatgcagtacctcgccgacagcgaagagacgttaccgaacatcgttttctggctgctcggcagcttcgcgaccgccagctggcataaggtactgcttatgtccctgcccctggcggtggctgccggggcgctgtggaagctgcgctggcgtatcaacctgctggccctggaggaacgcgatgcccgcagtcttggcgttccggtggccgcgctgcgtcgcggcgtgctggtttgctgcgcggtgctggtggcagcccaggtggctgtcagcggcagcatcgcctggatgggtctggtggtcccgcacctcgcccgtctgctggtaggggctgaccatcgtcgcctgctgcccaccgccttctggctcggcgccgccctgatgctggtggtggacgatctggcgcgcacgctgacccaggcggagatcccgatcgggatcgtcactgccctgctcggggcgccgctgtttacctttttactggtgcaatcccggcgccggagtacggcccgatga

SEQ ID NO: 107 - DNA, 918 bp, Klebsiella pneumoniae
ggaactggccattctccaaaaggccgcgacatacttcgcgaagcgcctgaaatgaagtatgtcttcatcgaaaaacatcaggctgagttcagtatcaaagccatgtgccgtgtacttcaggttacccgtagtggctggtacatctggcatcagcgtcgttatcaggtaaaccggcgtcagcagttccgccttgtctgtgataacgtcgtccgggaagcattcagtgacgcaaaacaacgctatggagcgccacgcctgacggatgagcttcgtgcccagggttaccggttcaatgtgaaaaccgtggctgccagcctgcgtcgtcaggggctacgggcgaaagctccacgaaagttcagtccggtccgttaccgcgaacatggtctgccagtctcagagaatctgctgaagcaggacttttacgccagcggcccgaatcaaaaatgggtgggtgacatcacgtttcttcgcactggtgaaagctgggcttatctggccgtggttatcgatctgtggtcgcggtcagtcattggctggtcgatgtcctcacggatgacagcacagcttgcctgcgatgcgttacagatggcgctgtggcggcgtaaacgtccggaaaacgtcatcgtgcatacagacagaggcggtcagtactgttcaacggattaccagagcttgctgaaacgccataatctgcgggggagtatgagcgccagaggttgttgttacgacaatgcctgtgcggaaagcttcttccatacgctgaaggtggaatgtatccacggagaggactttgtcagccgggaaatcatgcggacagcagtgtttaattatattgagtgtgattacgatcggtggcgtcgtcacagtgcctgtggcggtcttagtccggaacaatttgaaaaccagaacctcgcttag

SEQ ID NO: 108 - DNA, 417 bp, Klebsiella pneumoniae
attatcggccaccagaagagaaggagtcataacgaagatgaaatcgattggtattttctgcggttcttcagctggcgaacatccgctgtacctcgaaaccgcccgtctggttggacgtacgctggcgcagcaggggttggcgcttgtctatggcggcggcaaagttggtctgatgggggcggtcgccgatgcggcgctggaggccggtggcgtggtgatcggcgtgatgccgcgcggcctggtggagcgggaaattgcccaccgcggcttgacggagctgcatgtggtcgaggatatgcacgagcggaaaaccaaaatggcggcgctggcggatggctttattgccctgccgggcggggcggggacgctcgaggagattttcgaacaatggacctgggcgcagctggggatccatga

SEQ ID NO: 109 - DNA, 1770 bp, Klebsiella pneumoniae
ccagtaggccagcgcggccaccgtgccggttgggttgtagcccagcccctgcgggaacgcggaggcgccgatgacgaagacgttatgcacgtcccagctttgcagataacggttaacggcgctggttttcggatcttcccccatcaccgccccaccgttcatatgggtggtctggtaggtggtggtatcaaagtggctgttggcgttttttgggctgccgaggatatatttcggcttcatcgctttagcgatcggcgccatcttatcgaacataaactgcgccatcttgatgtcgttttcctgccagtcgaaggtcatgcggagcagcggctggccgaagacgtttttgtagttcggatcaagatcgaggtagttctgccgataggactggtgcgcgccgtgggcatccatcgacaggtgatgggtgtaggtatcggccaccgccgctttccacttgctgccccacgccggggtgcccggcggtaccgggaaaccggagatgggcttggtcccggcctggttgacccagaacggcgaaccgccgacaaagcccgccgcaccgtggtcgaagttgtcggcgttgaagtcgtcgacgccgacgccgttgccgcccgcgccgataaacggattggtataggtgtctttgtcgaaaatggccttgatggtggtcatgttctggtaggcgaagttacgccctaccaccccttcgccggtctccggattgtacggtttgccgatcccggagagcagcatcaggtgcacgttgtggaactggaaggcgccgataatcaccaggtccgccggctgttccatttcgcgcccctggccgtcgacgtaggtcacgccggtggcgcgggatttgtcgtcggtcaggttgaccttcagcacgttggcgttagtccgcagctcaaagcgtttttcctggcgcagcgccggcagaatgttcacgttcggcgaggctttagagtacatgtagcaggcgtagccgctgcagaaaccgcagaagttgcacgggcccatctgcgcgccgtaggggttggtataggagtcggaggtgttggccgacggcaggttataggggtgataccccacttccagcgccgctttttcaaacagctgcgccgaccaggtgtttttctgcgccggcagcgggaagtcgtccgagcggtccggggcgaaggcgttgccgccgcggcctttgccgacgaccttgcctttgatcgaccaggcggtcccggaagtaccgaatactttttccgctttatcgaagaacggttccagctcgtcgtaggtgacgccgaaatcctggatgatcatatcctgggggatgaagtttttgccgtagcgttcttcatagtggctgcgcatccgcagctcaatgggatcgacgcggaaatggacgccggaccagtgcagcccggcgccgcccacgccggtacccggcaggaaggccgccagctggcgatagggcaccgcctgctggctggtgttatgccggatggtgacggtgcttttcgacagatcctggaacagcttgcggcggatgttgtaggtcagctcatcaatcacctgcggataggcgccgtccggccaggtgtcgcgcatcgggccgcgctccagcgcgacgacgttgagccccgcttcggtcagctctttggccatgatcgccccaacccagccgaagccgacgatcgcgacatcggtttttttcaatacggtggccatgattacgccctctccccattaattgataccggcgggaaggggtag

SEQ ID NO: 110 - DNA, 876 bp, Klebsiella pneumoniae
gcagacttacaccctggagatggtcaaagacgccggagtgatgccatgaataccgccccgaaactgaccgtgatgagcgatacccgctttatgcctgccgctgccaccccggccatcgaggtgctgtcggcggagaaaatctacagcaacggcacccgggcgctgctgcccgtcaacctgaccatcaatcagggggagtttattaccctgctcggcccgtccggctgcggtaaaagcaccctgctgaagatggtcgccggcctggtggagcccagcgacggcaagctgatgctgtggcggcgcgacagtcgggaaaaggcccagcatccgctgtcgttcgtcttccaggaagccaccctgatgccgtggagcagcgtgcgcaataacgtcaggctgccgctggatctggccggcgtgccgcgggcggagggaaatacccgggtgagtgaagtccttgagctggtgggcctcggcaagttcgccgacgtcctgccgcgcgaactctccggcggcatgcaaatgcgcgtctccatcgcccgcggcctggtcacccgaccaaagctgctgctgatggatgagcccttcggcgcgctggatgaaattacgcgtaacaaactcgacagcgacctgttgcgtctctggcaggagcaaaacctgacggtagtgttcgtcacccactcgatccacgaagcggtgtttctctcccagcgggtgatcatgatggcggcccgtcccggacgggtggtcgaagatatccccatccgcgagccgttcccgcgcagcgaggcgttccgcgtcagcccggccttttccctgtatgcccgtcagctgcaggacagtctgttgcaggccagccagtccggtatggagccataa

SEQ ID NO: 111 - DNA, 2280 bp, Klebsiella pneumoniae
attctggcacaagacctgcatagcgcaacaggcctgcgtctgcatcaccaccaggcgataccgcgatcgttgcccgtcgggcccggcgcgacagcgatcctcagttcactgttaacaggtctgttactgatgaaaaaaatcacgagcgtgtgcccctactgcggggcgggttgcaaacttaaactggttgtcgacaacaataaaatcattcgcgcggaagccgccgacggcgtcaccaaccagaaccagctgtgcctgaaaggctactacggctgggattttcttaacgatacgcagctcctgacgccccgtcttaaacaaccgatgatccgctaccagaaaggcggcgccttcacgccggtcagctggcaggaggcgattcgctataccgccagcaagctcagggagatcaaagagaagcatggcccgcgcgccatcatgaccaccggctcctcgcgcggcaccggcaacgaaaccaactatgtgatgcaaaagttcgcccgcgcggtgctgaacaccaataacgtcgactgctgcgcccgcgtctgccacggcccctccgtcgccgggctacagcaggcgctgggcaacggggcgatgagcaactcgattagcgacatcgaaaactcgaagtgcctgctggtttttggctacaactgcgccgactcccatcccatcgtcgcccgccgggtaatcaaggcccgggacaacggcgccaaaatcatcgtctgcgatccgcggcgcattgaaaccgcgcgcattgccgatcgtcatctgcagctcaacaacggcagcaacatggcgctggtaaatgccttcggctatgtgctgctggaggaggagctgtacaacaaaacctatgtcgaacgctataccgaagggctggatgcttaccgcgaggcggtgaaggattacgccccggaagcggtggaagggattgtcggggtcagcgcgcgggaaatccgggaggcgatgcgcatgttcgccgccgccccatccgccaccattatgtggggcatgggggtcacccagtttggccaggcggtggacgtggtgcgcggcctggcaagcctggcgctgctcaccggcaacctgggacggcccaacgtcggcgtggggccggtccgcgggcaaaacaacgtacagggcgcctgcgatatgggcgtgctgccgaacctgttccccggctatcaggaggtcaccgacccggacgtgcgggcgaaattcgccgccgcctggggcatcgacccggcgctgatggacgaccaggtcggcacccgcatcaccgaggtgccgcataaagcgctggccggcgagatcaaagcctattacatcatgggcgaagatccgctgcagaccgaagccgacctcggcctggtgcgcaaaggcatcgaggcgctggacttcgtggtcgtgcaggacatcttcatgaccaaaacagcggaaatggccgatgtcctgctgccggccacctcctggggcgagcacggcggcgtcttcacctgcgccgaccgcgggttccagcggtttgaacaggcgatccctccggcgggaaatgtgaagcgcgactgggagatcattagcctgctggccagcgaattgggctatccgatgcactatgagaacaaccagcaaatctgggacgagatgcgcgagctctgcccgctgttctacggcgtgacctgggagaaaatgggcgatatgggccatgtccagtggccgtgcccgaccctcgatcatcccggcacgccgtggctgtataaagacaaccgcttcgacaccccctcgggtaaagggcagctgttcgccaccgcctggcgcgcgccggcggagcgcccggatgacgagtggccgctggtgctctgcaccgtgcgggaagtcgggcattattcctgccgctcgatgaccggcaactgcgccgcgctgcagtcgctggccgacgagccgggacgggtgcagatgaatcccgcggatgcgcaacgactggggatcgccgacaaacagctggtgtgggtcagctcccggcgcgggaaggtgatctcccgcgccgacctcagcgatcgcatcaatccgggggcggtctatatgacctatcagtggtgggtgggcgcctgcaatgagctgacccaggataacctcgatccgatctccaaaacgccggaaaccaaatactgtgcggtgaaagtggaagcgattgccgaccagcaatgggcggagcgctatgcctggacggcctacagcgacatgaaagcgcgactgaaagccgctgccgacgtctga

SEQ ID NO: 112 - DNA, 1086 bp, Klebsiella pneumoniae
aacggcaaacataacaaaataacaacagactacaggagagaatcagtgcctacaggacaccgctttctggcgacggatctgcatcagtttgtcgtctcactgtttacccatctcggcagtaccccaggggaagccaccctcgtcgcggaccatctgatcgccgccaatcttgccgggcatgactcccacggcgtcgggatgatccccagctacgtcaaatcccacgccggtggttttctgcagctcaaccgccacgccacggtgaccaaagacgccggcgccgtggtcaccctcgacggcaacgccggcttcggccaggtggtcgcccacgaagcgatgcagttaggcattgaaaaggcgaagcagcatggtatggcggctatcgccctgcgcaatgcgcatcacgtcggacgcatcggctactgggccgaacagtgcgccgccgccgggctgatctccattcacttcgtcagcgtcatcggcgacccgatggtcgccccgttccgcgggaaggacagccgcttcggcaccaacccgctgtgcgtggtgtttccccgcgcaggccatccgccgctgctgctggactacgccaccagcgccatcgcctttggtaaaacccgcgtcgcctggcataaaggcgaagccgtggcccccggctgcctgattgacgccgagggtcgacccaccaccgacccggcggtgatgcagacctcgccgctgggcgccctgctcaccttcgcccagcacaaaggctatgccctggcgacgctgtgcgaagtgctcggcggcgcgctctccggcgggcaaaccacccatcaggagagcctgcagaccagcgtcgacgccatctttaactgcatgaccacggtgatcctgcgcccggacgcgttcgatgccccggacagccaggcgcagacggaggcctttatcgcatggttaagcagtcgccgcacgatgccgatgccccggtgctggcgcccggcgaatgggaggccgccaaccgcgaagcgcggctggcgcaggggatcccgctggatgccggcagctggcaggctatctgcgccgccgcgcgcgacgtcggcctga

SEQ ID NO: 113 - DNA, 912 bp, Klebsiella pneumoniae
tcaatggaacatactgttgcaggcgccatcaaagaatggcgtaaacataataaagtgatcggtcaggtcaaaataagctataaaaaaattttacgaaaatgcagagagctctcgctcgcaggaggtaaatacagagaatatcaaggactttgtgcgaaatatcagtgcgcgcggttgaccgcggtgaccaaaggactggtgccttttgaggataaaccgtttaaagcgtatctcaataaacggctgtcaaaacgacgcaaactggatattgcccatggttcactgaatttcatcgagaaaacgtttcaccctgatgtcctgccgcagctctacaatgtcgcggattttggccgagagatgttttctattcccttgaaaaatggcgataagcttgacgttaagctgctggcctcgccgtttcaggaggaaggggagctgatgctgcagctgtttcttggcgaccggcgcgtctatagcgtctgtttttcctgcaccgacgatggccgcgcttatatcggcggcatccagggcgggaaagatatcaccaatgacgaagtgaaggtgctgactaaagagctgcatggcgcgcggccgaaaaatatcatcatgagcgtgctgtatggtttgctgcgatatttcaacatctccacggtctacgccatcgattctgattaccacgtgaaaagcgatctggtgaaagccagttattcatcgctgtggctggaaatgggcggtgagaaacaggctcgcggctggtataaactgccggcgcaagagatcaaaaagagtattgaagaggtgaaaagtaagcaccggagccagtttattaagcgcgaaggtcttaaagagctgattcagattaatatggcgaatgccctgcagcaaattaccttgtctgcgcgggtgaattaa

SEQ ID NO: 114 - DNA, 198 bp, Klebsiella pneumoniae
tggcgcctgcaacagtatgttccattgattaagatccatagattcatccataatcgcggccatattaacataaaagcgtttcgtcaacgcttaattactccttcgttgtcctttcatttaatatttaggcaggaaattatcctgtcgacgttatttgtcgctaaacttattctgtcaacgatgaattatggtaggtaa

SEQ ID NO: 115 - DNA, 615 bp, Klebsiella pneumoniae
caggaaccgcacatgactgcaccacgactggaaaaattacgccatttcattcatgaggtagaccgcctgcaccgcgaacaccaccagaccgccccgctgcttgacgccgtggcgcagcggctggcggcgctggtgcgttacgacgactggctgccggaagagtacaccctgccgcatccgcaccattaccagcagtatctgctgcatgccgactccggggagcgcttctcgattgtcagcttcgtctggggaccggggcaggcgacgccgatccatgaccaccgggtgtggggggccattgggatgctgcgcggcgcggaggaaaaccagcgctaccagctggatgccgatggcataccgcgcgcgctcggcgccgccacgcttctggaagcaggccaggtggagaaagtctccgctgacgatggcgatattcatcgcgtcagcaatgcgctggcggatcgcgtctctatcagcattcatgtctacggcggcaatatcggcgcggtgaagcgcgccgtgtataccccggaagggcagcagaaaccgtttatctccggctactctaaccgccatttacccaatatctgggattcctcccgcgaacatcaaggataa

SEQ ID NO: 116 - DNA, 1308 bp, Klebsiella pneumoniae
cgacagccgcaagggatccacatcaaccaggccccgataccagggaaaccgtcaccgaccagggagtcttcgcgtatgaaattagcgttgggaccgtacatccgttttagcagaatcttgttatttccgctggcgatggttatctatgatttttctgcttatctgactaccgatctcattcagccgggtattatccacatcatccgggaatttgaggctgatgttgcgttagccccggcctctgtcagcctctatttagccggggggctggcattacagtggctgctggggccgctctccgaccgcattggtcgccgccccgtactactgaccggagccatcatctttgctttggcctgcttcagcatgatctttgtcacgtcgattgatcaatatcttatcgcccgttttatccagggaaccagtatctgcttcatttcgacagtcggttatgtctccatccaggaggcttttgatgaaaaagagtctatccgcattatggcggcgctgacatccatcgttttgctggcgccggtaatcgggcccctggcgggcgctggcctgatgaatttcctgcactggaagttattgtttgcgatcatcggcgccatgagcttgctggcctgggcgttactgatttttaacatgccagaaacggtcacctctcagggccgggggtttcgtccgggagaggtattttccgagtttgtccgcgcctttaaacagccggtggtgctcacgggcgcgctggtgttgtcattcagtaacctgccgataatcacctgggtagcactctctccggtgatcctgatcgatgacggcggaatgtcgcgcggcgcctatgcctggacccaggtgcctgtctttggcggcgttattattgccagcatcatcgtggcccgttttatcaaggatccgacctctccccgctttatctggcgcactatcccgatacagctgaccgggttgttggtattactggcgggaaatattgcatggccccatacctggtggtggtccgtttcaggaacaagtctctatgccctcggaacaggcctgttgttccccgtattattccgttttgcgcttttttcccactccctgccgaaagggacggtttcagccaccatcaacattgtggcgctcagttttatggcggcctcggtggaagtagcgcgctgggtttacttccaggctggcggcagaattgcttttcactgcctggcgctgatagcaggaatcgtcgtcatcatgctggtctcgcgcttgttaaaactccgtcagcaacatctccttcagccagcctga

SEQ ID NO: 117 - DNA, 1737 bp, Klebsiella pneumoniae
ataaccacgcaatcatttgatgaggtagcacttttgtccagattacaacaaggattaaaaaccagacaaacccgcttcgccctagcgctaaaagtggccctgctcggcggcgtggtagcattttcttctgctgtctttgctgagggtctcctgaaagaaggtatcaccccggccactgacgccagccagatcccggccagcgccaaactgcggaaagacacggtggtggccgggatctccgagccgcaggggatctttaacccctactttttcgtcaacggctgggatgagaacgtgactaacgtcattttttcacgcctgatcgactgggacagccagggcaagctggtcccgggactggcggagagctggacggtcagcccggataacaaagtctataccatcaaattgcgccctggcctcaccttcagcgacggctcaccgctgacggcggaagatgtcgcctttaccctgacggtcctgctcgaccccagctatgatggcgataccgacatcaccctggccaatatcgccggcggggcggactacaaagccggcaaggctgacagcgtcagcggcctgaaggtcatcgacccgctcaccctgcaggtgaccaccacgcagccaggcgccaccacgctggccaaaattggcgggcctgtactgtcgaaagcctggtacggcaaagggtatcagcggggaaatctcgactatctgcgctcactgcacggcaagccgctgggcaacggcccttacgtgtacgacaaatatattcccggtcaggaaatacgcttccatgccaatagccatttttaccgtgggacgccgccaacgccgcgctttatctatcgcgtgaccaatccgtccaccaacttccagctgttccagaccggggagaccgactacgacgcctttacctcgcgccccgacgatattgagcaactgaagatgctcggcttcgccaatattaatctttacggctccagcgactacagccaggtggaattcaacgtgcatcgcccggcgctacaggataagcgggtgcgccaggcgctgatttacggcctggataggcagaagctgatcgacgtggtctatcagggatacggcaaagtcgccatcgaaccgatcgcgccgatctcctgggcctttaacgctgaaggcgtcaacccttacccttacgatccggcacaggccaaaaagctgctggatgaggccggctggaaagctggcgccgacggtatccgcgccaaagacggccagcgcctggagctgaccctgctggtgagcaagaaggtgctcaacgatgcgctgatccccatcgccaaggagaactggcggcagattggcgtgctgctgaagccgcaggtggtggatttcaacgccctgatggcgcagcgcaaagccggaaattacgatttggcctcgttcagcaccagcaccctcaacgacccgcacgacggggtatgggatttctacagcagcgaagctaaagagtccggctaccataacgcggaagtcgataagctgattaacgccggcaacgcggtgctcgacatcgaacagcgcaagccgatctaccaccagctgtataaagtgctggccgacgatccgccggtgatcctgctcggctatcgcgagatcctttccgccagcagcgcccgcgtcagcggctttaagccggatatctacaacggcctgaccggcagcctgccggatgtaaaaatcgtcaaataa

SEQ ID NO: 118 - DNA, 552 bp, Klebsiella pneumoniae
aaccgcgcgcattgccgatcgtcatctgcagctcaacaacggcagcaacatggcgctggtaaatgccttcggctatgtgctgctggaggaggagctgtacaacaaaacctatgtcgaacgctataccgaagggctggatgcttaccgcgaggcggtgaaggattacgccccggaagcggtggaagggattgtcggggtcagcgcgcgggaaatccgggaggcgatgcgcatgttcgccgccgccccatccgccaccattatgtggggcatgggggtcacccagtttggccaggcggtggacgtggtgcgcggcctggcaagcctggcgctgctcaccggcaacctgggacggcccaacgtcggcgtggggccggtccgcgggcaaaacaacgtacagggcgcctgcgatatgggcgtgctgccgaacctgttccccggctatcaggaggtcaccgacccggacgtgcgggcgaaattcgccgccgcctggggcatcgacccggcgctgatggacgaccaggtcggcacccgcatcaccgaggtgccgcataa

SEQ ID NO: 119 - DNA, 987 bp, Klebsiella pneumoniae
cttactcagcaccagaaatgcggtagcgtccaagcgtaccgccagttaaaggttgaaaagatgaaaagtgatgtagtcgttattggtagtctgaactatgacattctagtccagcaggatcggcttccggaactgggcgaaacatttactggcaatgagttaatgctcatgccaggtgggaagggggctaatcaggcggtgcagtgttctagacttggactgaacgtcagcatggttgggtgtgtcggaaatgacatttatggtagcgagctgatcaactctttacgtgagaataatgtatcggtagagaatgtaaacaagcggggtaccaccacaggtatcggtatcgtccagatccttgaatcaggtgactactgcagcaccattatcaaaggcgctaattaccttatcagtgaagatgacatcactgagtcactcttcgaaggacagccactggttattcttcagtcagaaattccggcccccgttgttgagtatattatcggcgttgccagcacccaccattgccgcattatccttaataacgccccggcacgggatgtctccgcccacgccctgagtctggtggactacctggttgttaatgagacagaagccgccttcatgagcggtgccgatgtatcttcgattgatgacgctcattcttgtgcaaccggactgcataaacgagtgaagggacaggtaatcattaccctcggtgaaaaaggggcggtattgtcccaggaacatggcactcgacatttcccggctgtattctgtccggatgttgttgataccaccggtgccggcgattcatttattggaggtattgcctactgcattgttaatggtttttcgctgacggacgcgatcccctttgctgctgaaattagctcttgttcaatacagaaatatggcgggcaaaactcttttcccatgctaccggacgtttctcatgcccttaaaaactccagcttgttagattaa

SEQ ID NO: 120 - DNA, 852 bp, Klebsiella pneumoniae
gcaaaggagcaaggcatggtgattagtgggaatacgcggctgatagcgcaccttggctatccgaccgccagttttaaggcgccgatgatctacaacccgtggttcgttgaccagcaggtggacgtgaaggtggtgccgatgggggtcaggccggaggactacgccgcgtttattccgccgctgtttacgatgaccaacatcatcggcgcgctggtgacgatgccgcataaaatcgccacctgcgatctggtgcagcgcctgagcccgacggcggccatcgctggcgcctgcaatgccatccgccgcgaggctgacggtagcctgagcggagacatgttcgatggcgagggatttgtgctgggcctgcgtcgtaaagggtttaacccgcaggggacgcgggcgctggtggttggcagcggcggggtgggatcggctatcgccgcctccctcgcggcggcgggggtcagcgccctgaccctgtacgatacccggcccgaggtggcgcacgccctcgccgggcggctgcatcagcactatccgcagctcgatatcaccctgatgcagcccgatcctgccggacacgagctggtggtcaatgccaccccgctggggatgaaggccagcgatccgctgccgctggacgttgaccgtctggcgccaggcgcctgggtgggggaagtcgtcatgactcaggagtacaccccgctgctgagggccgctcaggcacgacagtgccacatccagcgcgggaccgacatgctgtttgaaatgatccctgcctatctgcgcttttttgacctaccggtagccacccccgagcagctgcggaccctggcagaaattcgctactga

SEQ ID NO: 121 - DNA, 1056 bp, Klebsiella pneumoniae
caatttattaaggataatcttatgactaccccgttcagaaacacccgtattgagtttcatattctgcagtctttcccggtgacctgccttaaccgcgatgacgtgggcgcccccaagtccgccatcgttggcggtgtgtcgcgcgccagagtgtcatcgcagtgctggaagcgccaggtgcgtctggcgctgcctgattttggtattcgtctcggggtgcgtagtaaaaaaactgcctcactgctggccaacgcctgtcgcgcactgggagcgagcgaagaacaggccaccggatgcggtgaagcgatggccgcttttttctccgatgataccctgctgtttctcagcgaggctgaggccgccgcatttgccgcttatgcgcagggaaaagattttgacgccgccagcctgaaagataaagagctggtcaaagtcgccaaaaaggtggttaacaataccctggatgccctggatattgcgcttttcgggcgcatggtggccaaagcggcggatatgaacgttgaggcggcggcatcgttcgcgcatgccatttccacccataaagtgagtaatgaggtcgagttttttaccgccgtggatgactgtaaaacggaggatgaaagcggttcggcacatatgggcagcctggagtttaattcggcgacctactatcgctatgtcagcttggatctcgggcaactggcgcagacgttgggtgaggacgccgatatgaaaaccgccgtcgccgcttttgttaaggcactctatgtcgccgtcccctcagcccgacagacaacgcagtccggggcctgcccgtgggaatatgcccgcgtgttactgcgtaaaggtcagggtctgcaggcttcattcgagcagccagttaagagtcagggtgaaggcttcttatctcccagtaaagcggcgctcaaaaactggttgcatacaaaagaaaaactctctggctccttgttcggcaaacaaggcgattatgagtggggtgaggacctcgactacagcattgaccgcctgatcgctgacttacagtcacatctgtaa

SEQ ID NO: 122 - DNA, 567 bp, Klebsiella pneumoniae
aaactcactaaagcgccttgtgcgccacatcatctgttcatcgaggtcactatgctctatgtcgtcgaatgcgcctacaccgatccccaaagcgaagcggcgtggaataccttttacaatcaggaaaaactaccggcgctggtctctgtgcccggtttctacgcctcccagcgcttccgcgctctcagcgagggctgcccctgctacctggcgctgcacgatatccacgatgctaccgtcatcgacagcgacgcctaccgccgcaacggcggcggccattttgcccgctggcaatcggcgatcgccgactggcatcgccacctctatctaacgaataatacgctgcgggaggttgccccggatgaagtgctgctgctgggcgataccgcggaggacttgcccgtcgctgcgccgatacacctgcagccaggcggcctggcgaccgaacaaagccggtatgccgccatcctcccacgagacaacctgcatcacctggccacgactgccgccgtctttatctatcagcccatcaccgcccggttacgcaacccggcgcagcgcgcgtga

SEQ ID NO: 123 - DNA, 1287 bp, Klebsiella pneumoniae
tttcactccaaagcgcagggcgatacccaggccaatcaccaccagcagaatattgataaaggagagcgccgcgacgatatcgatggcccccgccgcccacagcgacaccagcatcgagccgatggtttcggtacccggcgacagcagatagacgccggtggaatactcgcgctcaaagatcaggaacatcagcagccaggagccaatcagcccatagcgcgacagcggaacggtcacgtggcgggtgatctgcccccgcgaggcgccggtgctacgcgccgcctcctccagctccgggcccacctgcagcagcgtcgaggagatgagccgcaggccgtaggccatccacaccacggtgtaggccagccagacgctgaagatggtgttgcgcagggcgcgcagctgcacgataaggtgctcccgcagccagtcggccaccggcagcgccgagagccagccgtgcttcagcgactgatcgagccacatcggcacaaacaggaatacccacaggaatgccagcccggccagcagccccggtacagcgcgcgggaccagcacgctgtagtcgagaaagcgggtgacgttgtccgctttgcggtgcatggcgatgccgacaaacagatagcagatcaccgccagcgcgccgccgatgatgccgatagccatcgagttgacgatcgcccgcagcaggttgggctgctgccagatattgtggaacgtcgccagcgacagctcatcccacagcgacacgccgacgccccagttggagataaaagcgcgcagcgccacgccgagcagcggtacgccgatggtcaccgtcagccaggccaccaccaccgccccggccacccagcgccatttgcccagcggcagcgcccgcgcctgggacgccttgcccttcatggtgacaaagcggttggcggtgcgcatcagccgccgctggagcatcaccagcgggatggtgatgcagatcagcaccaccgccaccgccgccatcagatggtaggagggggtgccgagcttgttagtcagcttgtagagataggtcgccagcaccatgttgccctcggggtcgcccaacaccagcatcagaccgaaaacctccagaccgaggaaaaagagcaacacgcaggcgtaaagaatggatggccgcaccatcggcagactcaccgaggtcatcacctgcagcggcgtggcgccgacggtgagcgccgcctcttccacgtcggagccgacgctgcgcagcgccgaagagatatagagataggcatgcggaacgtgagttaa

SEQ ID NO: 124 - DNA, 1269 bp, Klebsiella pneumoniae
ttattatgcaactcaggacggcaatttgccgaaggatccactactgacctctccgtcatcggaaataaaatgtttaacccagaccagaatcgtcttgcccccacgctggcgatgatcatggccgcgtcgcttgtgggatttatcaccggctatacggtgccgttaatcagtcttgagctggcgcagcagcagatcgcgccgctgtacgtcggcctgctggccgccctgccgcccgccggcatgatgatctcctctttcctctctcctgcgctgtgccggcgcgttgaaatgggcgtgctgctgagcggcagtctgatcctgctggcgctggcgaccatcgcctcatgcatgactaccgatatgacgctgcttttgctgccgcgcctgctgaccggcctggcctccggggtcattatcgtactcggcgaaagctggatcaccggcggcgcggcgggcagccagcgcgctaccctcaccggtctctacgcctcggcctttaccggctgccagctggcagggccgctgctgatctccgtcggccccgcctggcagacatcagcgctgatagcgattgtcgcggtcaccgccgtctgcctgctgatgctgcgccatctgcccaccggcactcgtgaaagcctcggggagcgcgccagctggcgcagcctcggcgcctttctgccggtactggcctccggggtcttctgcttcgccttctttgacgccagcatcctcgccctgctgccgctgtacggcatggacaaagggctgaatgaagggctggcggtgctgctggtcaccgtggtgctgaccggagatgcgatgttccagaccccgctcggctggctggccgaccgggtcgggattcgccgcgtgcatctgagctgcgcggtggttttcagcctgtcgctgctggccctgccgctgatgctcggctcgcgcattcagctgatggccatttgtctgctgctgggcgccgcggcgggcgcgctttataccctgtcgctggtgcgggcggggaaaaccttcaatgggcagaagctgattatgattaacgccctgttcggctttttctggtccgccggcagcgtggccgggccggtagtcagcggcatgctgatcggcatcactggttacgatggcctgatcgtcaccctggtggccagcggcgtactgttcctgttgattcagtgtctgtgcaaaaacgagaaaaccctgcttgccagtgagcaggaagaggagatggacgaggcgacggagtccgcacggtag

SEQ ID NO: 125 - DNA, 216 bp, Klebsiella pneumoniae
gcttcgtgcaaaacacagcaacgatatttgaaagtctctggcgttgtcacttacgcttcggcacaacgtggcaatctggctgggatgaaagtatgctttgagcgaagagctacctgtcactgtgtgcgattgaatattttgtcacacgagcataacaaccctgttgagaaatctggatctaacatctatatatcagcaatatactccactttataa

SEQ ID NO: 126 - DNA, 699 bp, Klebsiella pneumoniae
tctgaccgcaaaagcagattcgttcacgagaaacagataatgactcaaccccatgtcgcctgcaggacgttgccagggcgcgcgcttttttcgcttctttttttagcctcaccgggattaatggccgccgacaatcgcgcggcgaaaagtactaacgacgcggaagagaccatcaccgtagtggccgacggcgcgcagcagagcgccacaagcggctatcagccgctcagctccgccaccgcgacgctaacctcgatgccgctgccggatattccccaggtggtcaataccgtcagcgatcgggttctcgaagatcagcacgccacctcactcgatgaggcgctgtataacgtcgctaacgtggtgcagaccaacaccctcggcggtacccaggacgcctttacccgccgcggcttcggcgccaaccgcgacggctcgatcatgaccaacggcctgcgcaccgtgctgccgcgcagctttaacgccgccaccgaacgggtggaagtcctgaaggggcccgcctcgacgctgtacggtatcctcgaccccggcgggctgatcaacgtcatcactaaacagccggagcggcagttctcccggttcggtttccggggacctccaccagcttttgggcggcggcaccggcagcgtcgacatcaccggccccatcggaaggcacaaatctggcgtaccgactga

SEQ ID NO: 127 - DNA, 717 bp, Klebsiella pneumoniae
tcgtcgggcaattcgaaaaacgtattgaacagcgcaccctgcgcgccggagggcactgagatgctgacccgtgaacaaatggcgatgcgcgtcgcccaggagctgcgcgacggcgactacgtcaacctcgggatcggtatcccgacgctggtggccaactacattcccgccggcattgaagtgatgctccagtcggagaacggcctgctggggatgggcgaatttcccgatgaggaaaccatcgacgccgacatgattaacgccggtaaacaaaccgtcaccgcgcaaaccggggcggcgatcttcgattccgcccagtcgttcgccatgatccgcggcggccacgtcgacctgaccgttcttggcgcctttgaggtcgacatcgcgggcaacatcgcctcatggatgatccctggaaaaatggtcaaggggatgggcggcgccatggacctggtagccggcgcgcagaacatcatcgtggtgatgacccacgcctcaaaaaacggcgaatccaaactgctgccgcagtgcaccctgccgctcaccggcgtgggctgtattcgccgggtactcaccgatctggccctgctggagattgtcgacggcgcgtttgtcctgcgcgaagtggccccgggggtcagccccgacgaggtgatacgtaaaacggcgggacggctgatcgtcgccgacgacgtgcgcgaaatgcgcttcagttaa

SEQ ID NO: 128 - DNA, 951 bp, Klebsiella pneumoniae
tattatttaaatgcaatttacgcatatattaatatgcaaatttcacataaggatcctatgcgcattgacgatatcgacgctttgctggccacggtgcagttttcctccctcaatcaggccgcggaatatctggggatcacccagtcggccatcacccggcgcctgcagcgtctggaacaggagctgaacgtcacgctgttagagcgccagacccgcccgctgactctgaccgccgccggacaccgggtgtacgagcagtgtctgagcattaagcgtgagacgaaaaaactctacagcctgttggatccgcaaggcgagccgcgcggcgcgctgcgtctcggcgtgccgcagagtctcagcgagattgccctgccggcggcgctgtcggcgctgagccagcagtttcccggactgtcgccgcagatcacctgcggctggagcggacagctgcagcgccggctggaaaacggcgagctggacggcatgctggcgatggggcccgcccagcaaagcttcgccgagggctacagcgggcgcctgctgtgtcccctggaggtggtgccgatcgtcggccggcgtttgaatttgcgcgcgtcatccctgcgggagtgcgccgaacggggctggatccttaaccccgacggctgtggcctgcgcgccgggctcattcgcgagctgcagagccagggattgcggttgacgctcaacgtcgagagcgcgggcgcgcagctgcagatagcgctggtggcgcaggggctggggctgggtctggtgccgagggcggcgctggccagcagcccgtggcgggacgaggtcgcggtcctcagcctcagcgattttcagcctgcggtctcactgtggctgatccacgcccagtatctggcgaacctgcagccgccgctggccttttttgccagcaaagtgatgcagcagctgaccgtatccgactga

SEQ ID NO: 129 - DNA, 1437 bp, Klebsiella pneumoniae
cgaacaggaaaaagaatgatgactgatgaacagcgtcaacacgcggtcgcggcgatccagcaggcactcccggcgctggagtggaccttacagccggcgaagatcaaacggctctcccgcgattttcactggttcagtccgctactcaccgagcaactggcggggaaacaggcggacgcggtggttcgcccgcgcgatgaagaggagctgcgccagctggtctgcgcctgcgcgcagcaccagctgccgctgaccctgcgcggcagcgccaccggcaactacggacagctggtccccctcgaaggcgggctgctggtggatatgaccgggctcaaccagatcgtcgccctcggcaacggcacagtgagggcccaggccggcattcgcctggcggacatcgaaaccgccgcccgcccgacgggctgggagctgcgctgtatgccatcgacctatcgactggcgagcctgggcggtctctacggcggcgggttcggcggcatcggctccatcaactatgggccgctggcggcgcccggcaatgtgctcagcgtcaaagtaatgaccgtcgagccggccccccgagtgctgaccgtcccggctcccgaagcgctgctcctgcatcacgcctacggcaccaacggcattatcctggaggttgagctggcgctggcgcctgcgcaccagtggattgaacgtctggacgtgtttgacgatttcgccgatgcgctgaactatgccaacgcctgcgtccgctcgccggggctggtgaagcgccaggtggcgctgctggccacgccgatcgctgactattttagccacctcaacgatcgttaccgcgccgggcagcatgcggttatcagcctgatcgccgaggagagcgaaggactctgcgccagcctgttaccgcgccatcgcgggagcaacgccatccggcaggccagcgaggaggcccggacgcgcaacggctcgttaatggaatactgctggaaccacaccaccctgcatgcgctcaaggtggacaatacgctgacctatctgcagacggcgtttgatccgctgcgctatccgcagcaaattttacagatggagcagcacttcgccggggaggtgatgtcccatattgaattcctgcgcgatatcgagggcaatctcaccgccagcggtctgcagctggtgcgctataccacgcccgaacgtcttaacgccatcatgcagatatttcgcgacaacgacgtcaagattaacaacccccacgtgctgcaggttgaggacggcaaacagggcgtgattcgtcccgacgtcgtggcggtgaaacagtctctcgacccggcgggattgcttaaccccggcaagctgcgcggctgggcgctgcgcgaccagctggaactggacggcaacccgctggcgcgggccacccgcgaaagccccacgacctga

SEQ ID NO: 130 - DNA, 300 bp, Klebsiella pneumoniae
tgggagggaaaggtgctcgtcgtactggcaaatgatctgccgccagcggtccgtggacgaatgaagctgtggtttgtcgaaccacggccaaatgtttttgtctcaggcgtcaaagattcggtcgcacaaaccgttgttgattacctgttgcagtacacgcctgtggaatcaggcctgatgctgtttcgcagtattcctcaaccgcctggttatgaaattcgctacaagggtgaggtcagaaagccgattattgatctcagtgggttacagctgattattgaaaccctaaaactgtcgtaa

SEQ ID NO: 131 - DNA, 294 bp, Klebsiella pneumoniae
attctgctgaaaatgatactggtgtgtgctgtccaggcctctggagtggaggaaattctctacaatatctgctatctgctgattattcttatccgcaaacgcaaaatgagtgttcccgtgtattccatgctcgggaagaataaagagcgtagcctgcccaccatgtcggttgagagtatcaacgaattgccgcgcacgtatttcattaacgcgccagagttcctcaccaaaactcgcactctcagaccgtacaacgttgtccccaatgatgaccataacggggatggctgttaa

SEQ ID NO: 132 - DNA, 186 bp, Klebsiella pneumoniae
atattcgtgaactatgtttgtcctatactttctttaggggcatctcaatcattcgagtttattactcgtctggagatattgttcttcatattaattatttatagctttttatattattatttttggcttttatctttaattcagtgtgttgtgggtatttttgattttataaaaagttatttataa

SEQ ID NO: 133 - DNA, 309 bp, Klebsiella pneumoniae
aacctttcgaaacagcgtgtatggtcagtgataagaatccagcagaatttaacaaaatatgtgaatatttctttggtggattatgaatataaaacgaatattactcatcctgctttcccgtgttatcagaggggctgggatgggattaggtgcttcaggtatcgcgctggctggctggttctttttttctcagtaaatgaatataaatttctctggggtttacttttagttgtggaattcctggtggggtatctgatatatcgatttgcatatgcatatatttatgatgaatggaatgattatcattaa

SEQ ID NO: 134 - DNA, 1182 bp, Klebsiella pneumoniae
ttctccgagaataagcgccttatcatgaaaaaaaaatttgatgcgtcaatcttgccattgatggcagcagctctgctgctgccatcggtcagcaacgcagcagatatctcccgctacgataaagcagcacggccccccattgtgctgacagacatgggtagcctgatgtttgcgggaaaaaccgatacggatgaggaaggtaatacttttcattacgatcatggttatgctcagtattttattcctcagagcagtcacagcctgcctgtagtgatgtggcatggtggaggtcaatcaggcaaatcatgggaaacaacgcctgatggacgtgacggtttctggcaaatgttcacccgtgcacactggccggtttttataattgaccagccgcgccgtgggagggcaggaagaacagagccggcctccgcagtatcagatattcccaccgaccataaagaatccatcgcatggaatacgttcagactgggtaaatggctcccgccacaaaaaccggtttttttcagcgactctcaatttcctcaaaacgagcgtgccattgagcaatttttaagatggcagaccccgaataccgggcctgagccctcaccggatattcaggaaaggcaatttatggcgaaatccatgactgctttgttgaaacaaacgggacctgccattctgatgactcattcactgagcggacagtatggatgggagactgcaatggagtctccgaagttggttcgaagcattattgctttcgagccaggggcgtttgcgtttccttcgaatgacctccctaaaaatgttaaaacctcactgtcatttgtaggaaaagcaacagccccgcaggttgtttcccctgagcgattcagagcattaacagccatccccgttatggtcatcattggggacaacgttgtacggtctgagagtgcgagttttggtgaggaactctggcgcgttaatgaaatacgtgcgcggcaattcgttgatactctcaaccgacatggtgggcaggctacgctctttattcttcccgagcatggaatacacgggaacactcattttgcgtttgcggataagaataatcagcagatagcagatattgtagagaatttcctccactccagaggcctggacagcacacaccagtatcattttcagcagaatttacagtga

SEQ ID NO: 135 - DNA, 903 bp, Klebsiella pneumoniae
tcaaaagagaatgagatttattttgatttgactgcagaatgtccagctatcgtctggaacgctgcggcgcaggagcgagttatgccacagcgggtgaaacctgcagagcaggggatcgtactggatgccctgtcggccggctacggccagaccctgatcgttgacgatatcaacctgaccattcccaccggcaaaatgacggtgctggccggggcgaacggatccggcaaatccacgctgctctcgaccatcgccagaatgctgaaaccgctcggcggctgcgtgcgtctggacgggcaagccattcaccagatgccgacgaaagccgtctcgcgccagctgggcatcctcccgcaatcgccgttgaccccggaaggattgaccgttttcgagctggtctcgcgcgggcgctacccgtggcaggggctgatgcgccagtggtccgaggccgatgagctggcggtagaggaggcgctgcgcttaaccggtaccgccgaattcgcccatctgccggtggacagcctctccggcggccagcgtcagcgctgctggatcgccatggcgctggcccagcaaacggccaccattctgctcgatgagccgaccacctggctcgatctgcgctatcaggtcgatatccttgagctgctccagaccctcacccgcgaacatggccgcacggtggtgacggtgctccatgaccttaactttgcggtgaactacgccgatctgctggtattccttaaacaggggcgcatcgccggcacgattagcgacaacgatgtctgtagccctgagctgattaaacgcgtgtttgacgttgacgtgcagatgtcgattaacccgcaaaccggcaaacccttctttatgccgtttcgcgaccgccaggcagcggcacaatga

SEQ ID NO: 136 - DNA, 1527 bp, Klebsiella pneumoniae
accatggagaaccgcttcaatttgattgatgaaccctggattgcggtcgtggatgtggggttggtcagtttaaccgatattttcagccagccggaattacgcgctttaggtgggaatccggtagaaaaaatcgcgctcactaaattgctactcgccatcgcccaggcagcagcgacgccgacagatgatagcgactggcagcagatgggctggcagggaatggcccattgctgcctgcagtaccttgctaaatggcatgaccgtttttatctgtatggcgaaaagccgttcttacagatgcccgctattcaggccgcggaatgtaagtcattgggcgtattatcaccggaggtgagtaccggcaataccaccgttttgaccgaaagtcagcaacagcagcaattaactgatgcagacaaagcgctagctattgttatgcaaatgggctttgggctcggaggcaagacaaccgataactctgtggtattaacgccgggctatcggggtaaacaaaacgacaagggaaagccgggcagtggaaaggccggggtttctgtcgggcatatgggattgttacattcgttctggcaggggaattcaatcgtacagagcatttggctcaatttgtttaccgctgaggatattacgcagctggcgatgtatcccacgctggggactgctccctgggagcgaatgccgacaggggaagatgatgacattgcacgctcgttgaaagcgtcgttgctgggccgcttgatctcgatgggtaaattttgtctgttagctgaggacggcattcactatagcgatggaataagccatgccggttatctggagggcaaaaccgacccctcggtgtccgtcgatttttcaggaaagaaaccaaaggcgttatgggttaatccgggtaaacgcccctggcgcgaactaacgtcgttattgcagtttattgagcaagatagcccccggggatatgaaacccgtcagcttagccttcctctgaagcggataacccatcatgcggagcagtttgcgctatggtcaggcggcttaagggtgagtagtaatgcgggggaacagtacgcttcagggaccgatgattatgttcagtcagaaatatggttgtcatcagatttaatcaatcacacatttttagagtatttaaaatatgaaatgacgcagcttgatgctgtgcaaaaacagctttggggtgcagttgtacgttatttccgccagctatcagatattgataaatcagcgacagggaaggctcaaccctttgtggcaaagcaggccgaaaaagcgacgacgatattctggcaactttgtgaacgtcaggctcagaccctaattaatgcttgcttgaattccggtgaagaccataccgcgcgtcttcagttacgaaaaatttttgccaggtacgccgggcaggtttttgatcagctctgtcccgccgacagtgcccgtcaattagatgcctgggcgctggcccggcctaatttttcccaatatctcaccctcgattaa

SEQ ID NO: 137 - DNA, 1218 bp, Klebsiella pneumoniae
cgtgctgctgaacgtgcgtggcgtgggttacaggtttcgtcagccatgaaagtaaaacaaccccagacgctctggcgctggctttgcctgcgcattctcacgcttgccatcggcacagttttactgatagccctgtgcatgtggctgcgatttactgtgcagtatctttggaccacgcaccgtatgccggaagcggtactgaatgaatttcttacgctccgggaacatccggaactcaatccagcccggtaccatgagattatcgataaatggtggggcataagcttttccagtccttccatcgcgtcgtcggactggctgactgtcggtgttctggtgctggtcaccatcccgtttattgcttattttgggttgcgtcatgcccggcccctgtcggcgcagttcagccagctcagaatagctgcagatgaggtgactgacggtcattttggtgcccaggcagagttaacgcctgaagcacccgccgaacttgtgcagtttgcgcaaaattttaatgccatgactcgccagctggcacgctatgaaaaagagcttcgcgcctcacatgttgctatggcgcatgagttacgatcgccattgactgcggccatggtgcgactgcaggcgctgctcgatggtgtattcactcctgaacaacggcatcttgctctcatcatgggccagcttagctgcctgagccggcttattgatgaacttcacctgctctccattgcagacgccggtcagctcagtctggaaaaggtgcgatgctgtccgtcagatattttgcgcgaacgcctgttgtggataaagccccagctggatgaagctggcattaatgtcgtttcagacatgcctgaaacgtcggtgctgaacgtcgatccctttcgtctgggccaggtgtttaccattttgatggaaaacgcgctgcgttatgccggcaaaggcaccactctgtttcttagcacccgaagcataaacggaaattacgaaataatttttcaggatacaggccccggcgtttcgcaggaattccttgatgtcatgttcgagcgctttgtgcgcggtgatacttcccgcgcacgacactctggcggcagtgggctgggcctgtctatcgcacaggcaatatgtcaggcacatggcggaaccatcgaggccagtcttccttcggggggcggtttgcggatgcgaatcgtactgcaggctactgcataa

SEQ ID NO: 138 - DNA, 837 bp, Klebsiella pneumoniae
cccgctgctgatgggccagctgcatctgagtcagattctgtaagtcatcacaataaggaaaggaaaatgaaaaaagtcgcacttgttaccggcgccggccaggggattggtaaagctatcgcccttcgtctggtgaaggatggatttgccgtggccattgccgattataacgacgccaccgccaaagcggttgcctccgaaatcaaccaggccggcggccgcgccatggcggtgaaagtggatgtttctgaccgcgaccaggtatttgccgccgtcgaacaggcgcgcaaaacgctgggcggcttcgacgtcatcgtcaacaacgccggcgtggcgccatccacgccgatcgagtccattaccccggagattgtcgacaaagtctacaatatcaacgtcaaaggggtgatctggggcatccaggcggcggttgaggcctttaagaaagagggtcacggcgggaaaatcatcaacgcctgttctcaggccggccacgtcggcaacccggagctggcggtatatagctcgagtaaattcgccgtacgcggcttaacccagaccgccgctcgcgacctcgcgccgctgggcatcacggtcaacggctactgcccggggattgtcaaaacgccgatgtgggccgaaattgaccgccaggtgtccgaagccgccggtaaaccgctgggctacggtaccgccgagttcgccaaacgcatcaccctcggccgcctgtccgagccggaagatgtcgccgcctgcgtctcctatcttgccagcccggattctgattatatgaccggtcagtcattgctgatcgacggcgggatggtgtttaactaa

SEQ ID NO: 139 - DNA, 807 bp, Klebsiella pneumoniae
ccggctgctgagctggcagcgaggagggatgcaatggtaaccgagacgatagcgcgcggcgcggcggtatccatcagccatcttcatcatgcgtttacgcttggcaaacagacggtaccggtgctggagaatattagcctgcagctgcgcccgggggaaagcgtggcgctgctgggcccttccggctgcggtaaatcaaccctgctgcggctgctggcggggctggaagcgccgcagagcggacagatgcagatcgacggcgcggcgctcggcgccccggggccggagcgaattctggtgtttcaggatccgacgctctatccgtggctgacggtgcggcagaacgtgctgctgggcccgcaggcgcaggggaaaaaggggctggaggcgaaggcagacgcgttgattgaccgcatcgggctgcaggccttcagcgaggcgtggccgcggcagctgtccggagggatggcacagcgtgcggcgctggcgcgcgccttgttgaacgaaccgcgtctgctgctgctcgacgagccgttgggcaaactcgattcgctgacccgcatcagtatgcagcgggagctgatcgccctctggcagcagcaggggtataccagcctgctggtgacccacgatatcgaagaggcgctgctgctgtgcgagcgggtgctggtgatgtcgccgcgtccagggcggattatcgccgagtttgcgctgccgctggcttttccccgtcatcgtgataacccgcagctgctgcagcatcgtcaggatatattgcgcatcctcggccaggaggcggactggtaa

SEQ ID NO: 140 - DNA, 1866 bp, Klebsiella pneumoniae
cccgaggaccttatgctgcgctctatcgccaccgtttcgatttccggcaccctgcctgagaagctgcacgctattgcggcggcggggtatcagggggtggaaattttcgagaacgatctgctctattatacggggacgccggcggaaatccgccagcttgccgccgatttagggttaaaaatcacgctttttcaaccctttcgcgattttgaaggcgccagtcgggcgcagtttgcggcgaatatggcccgcgctcggcgcaagtttgctctgatgcgcgagctgggctgcgagacgctgctgctgtgcagcaatgtgcagccggactgctcggcggatagcgaattgcaggtcgcggacctgcgggcgctggccacgctggcggaagaggaggggatcgctatcggctatgaggccctggcctggggaacccatgtgaaccgctggcagcaggcctgggagcgggtgcggcgggtggacagcccggcgttgggcctggtgctcgacagcttccatattctggcccgcggcgacacgctggacgcgctaccgtcggtgccggtggagaaaatcacctttgtacagctcgccgatgcgccgtatatgaaaatggatttgctggagtggagccgccacttccgctgctttcccggacagggggagctgccgctggaggcgtttgccgagcagatcacccgctgtggctaccgcggcccctggtcgctggagatcttcaatgacggttttcgcgcctcgccgaacggcgcgacggccaaagatggttatcgttcgctgctgtggctggaggagcaaacccgccgtcggctcccgacgtgcgatgccgatctgttttcaccgccgccgctgccggtctatcacgggctggagtttatcgagtttgccgccagcgccgccgaggcgcagcgcctggggcaacatctgcaggcgctgggttttcagcacgagggaagccaccgctccagacaggtgacgctgtggcgcaacggcggggcgcggatcgtcatcaaccatcagccgcacagctgggccgaccatttttatcaacgccacggggtatcgctctgcgcgatggcgctgcgggtcgagcacagcgcgtcgcttgtcgcccgcgcccgcgcgctggggtatgccacctggcagggcgacgccgggccgaacgaaacgccgatcccggcgatctgcgcccccgacggcagccttatctatctcatcgacgccggggaggctatctacgagcgcgattttcatctgcgtgatggcgtgacggtgcgcgaggattatctcggtatcgatcatctggcgctgggaatggaggccgacagccgcgataactgggtgatgttcttccgtacggtgtttggtttttcccttgagcatgagcagacgctgccggacccgtatggactggtgcgcagcctggcggtgcgcagcccgcagggcgatatccgtctggcgctgaatatttcgcagagccgggcgacgcagatcgcccgctccgttgcctgctaccagggggcggggctgcagcatgccgcctttgcctgccgcgatctgccggccgcctgcgaccagcttgccgaggttgcccgccatacgctgccgatcccggccaattattatgacgatttgctggcgcgctttggcggagagctggacgtcgggcagcttcagcgccagcagctcctctatgaccgcgatccgcaggggggagatttcctgcatctttacacccggccgtttaccgccggccgctttttctttgagttaaccgagcgccgggctggctatgcgctctatggcgcagcgaatgcggccgtccgtctggcggcgatgcagtattgttag

SEQ ID NO: 141 - DNA, 213 bp, Klebsiella pneumoniae
ccgggcggtgatgggctgatagataaagacggcggcagtcgtggccaggtgatgcaggttgtctcgtgggaggatggcggcataccggctttgttcggtcgccaggccgcctggctgcaggtgtatcggcgcagcgacgggcaagtcctccgcggtatcgcccagcagcagcacttcatccggggcaacctcccgcagcgtattattcgttag

SEQ ID NO: 142 - DNA, 885 bp, Klebsiella pneumoniae
gacgttttcgatatggaacttcgttatcttcgctattttgtcgccgtcgccaggacgcggcacttcacccaggccgccaaggagctgggtatttcacagcctccgttaagtcagcaaattcagcggcttgagcgcgaagtggggaccccgctgttccggcgtttaacccgcggggtggagctgacggaagcgggagagtctttctatgaggatgcccgccagatcctcgccatgagcgatgcggcgctggagaaggccaagggcattgcgcgcgggatgaacggcagcctgtcgctaggcattaccagttctgatgctttccatccgcaaatcttcacgctgctgcaccgttttcagctcgaccaccccggggtgaccctgcaccagatggaagacaatatggccaatctgatgaccgccctgagcgaggccgagctggatatcgccttcgtccgcctgccgtgcgagagcagtaaagcctttaatctgcggattatcgatgaggagccgatggttatcgcgctgccgcgcgataacccgctggcgacgcagccgaccctggccctggagcagctgcgcgacgtggcgccgatcctcttcccgcgggaggtggcccccgggctgtatgagctggtgtataacagttgcctgcgcgccgggatcgatatggagcgcgcctggcagtcgtcgcaaatttcgtcgtcgctgagcatggtcaatgctggcttcggcttcgcgctggttccgcagtcgatgacctgcatccagcagccgaacgtcagctatcacccgcttagcggggcgccgctgaagaccgatatcgccatcgcctggcggcgcttcgagcgctcgcgtacggtgaaacgctttctggcgatgttctga

SEQ ID NO: 143 - DNA, 1089 bp, Klebsiella pneumoniae
cggagaaacgatcgtttcacccattttcttgcacgccggacagttcaccgcgaaggggagttatctcttcgccgcccctggccgccctgcagacagcggagtgagggagagaaaacggtaatgcacagccacgatcttatttcggtctcggtcggggaaatacgccccaacggacagggaaatctatccataattttgcaggcggcggccggggaaatattaccggcctactccgccggggcgcatatcgatattattattcccggcgtcggtccgcggcagtattccctgtgcggcacgcctgaccgcagtaatacttatgaaatttgcgtcaggctgactgacacctccaccggcggctcacgctatttgcaccagcagctcaaagccggcgatcggctcgccatttcgccgccgcgcaaccattttcccctgccgcaggccgggcgctacctgctgtttgccggcggtatcggcatcacgcctttgctggcgatggctgaagcgattgccgccagaaagggggcgcaggagctgcattattatgtcgccagttcgcgccagacggccttctccccgcgcctgaaccagctgactgcgaacggcacggtggccattcactgcagcgaggaaggcgcgtcgtttcgccagcgggtcccggaatgcttaactgtgccccaccctgataccgtagtaatagcctgcggcccggagggttttattcagcgactgcggtcggtcatggaggaatatcgctggtcgccgtcgcagttcgtattcgagcgttttactcccgcggcggaaaataatactgcggcgaaaaatgcgttttatattgagctggcctccagcgggcagcgcctgcaggtcgccgcggatcaaaccattgctcaggtattacagcacgccggggtggaggtcatgctctcctgtgaacagggaatgtgcggctcctgtattaccggggtcctcgacgggatccccgagcaccgggacagcgtgctgacggcggaagagaaagccgacaacgaccagatcacgctctgctgttcgcgggcgaaatccccgcttctggttttggatctgtga

SEQ ID NO: 144 - DNA, 189 bp, Klebsiella pneumoniae
gacgccgacgatatcctcggcggcatgcagttgtaccagcaggttgagcgtctgatgctgcagaaccacaacgcgggtgacgtggtcggggagggtgacctggcgacccagctggtcggtgacggtgcggtcggcgaaggcctggccggtgaacaggctggcgctgagcagcgtcaggcccagcagtaa

SEQ ID NO: 145 - DNA, 297 bp, Klebsiella pneumoniae
tctcgtccagacccggctgctgggcctgctggcgattgcgctgctgtgcggcgcggcggtggcggtggccgggccgatcggcttcgtcgggctggtggtgccgcacatggtgcgccgtctggtgacggaagacatccgcctggcgctgcccctggccgcgccggtgggagcgctggcgctggtgctggcggatatcgccgcccggacgctggtcgcgccgcaggagctggccaccggagcgatgaccgccctggtgggcgcgccgttgtttatctttatcgccgcgaggttttttaa

SEQ ID NO: 146 - DNA, 729 bp, Klebsiella pneumoniae
tggacggtggagatgagacaaactacgcaatatatgctgctgtggcttgaagggccgctgcagtcctgggggggcgattcaaagttcggtgtgcgcgatacgctgaatttcccgactcgctcgggcattctggggctgatttgctgtgcacgaggcgccgcggggccagaggtcgagtggctggcggagatgaataacctgccgatggaggttcgcgcctacgcccgaaccgacaaggagggccagccgctcctgcgcgagccgacattgtgcgatttccagatggttggcagcggatatgacgacagcgatccgtggcaaagtctgctgatccctaaaacatccgatggaaagaaagccgtagggggtggaacgaaaatgacctaccgccactatctccaggatgccgtattcgccgtggtaatgggacttggcagccagcaagccgagtcgttaccagaggcgctacaaaatccggtatgggatttatatctcggtcgtaaaagctgcgtgccctgcgagcttatctaccaaggtatctatgacagcgcagaagcggcatggcagcaggccaggacattagctgagagtaagcggcgcacgctgagctacagggtcattgaaggggaaggggatggcgatgtcatcacgcttaatgatgtcccggtgcagttcggccggcataagcgttaccgggatcgtcaggtgaccgtgctggagtgcggctaa

SEQ ID NO: 147 - DNA, 789 bp, Klebsiella pneumoniae
tcatttaaggattgtgttatgctcgattatgctgctttccctcaacagcgacaagcgctgatttgccagatcctgcaggaaaacggcagagtggtgtgcgcggagctggcggcgcgtcttcaggtgtcggagcataccatccgccgcgatctgcatgagctcagccgcgagggattctgtaaaaaggtgtatggcggggcggtgctgagtctgccggaagcgggggattacagtcagcggaaagataaaaaccgcgcgataaagctcaggatcgcgcaacagtgtgcccggctggtgaagcccggcggcactattttcattgataccgggaccaccaatctggcgatggccgaggcgctgcccgccgagctggcgctgacggtggtaacgaactcgccggagatcgccgcggtactggtgaaaaaaccgctgtatgacgtggtgatccttggcggccaggtacagcgcgcgagcggcggttgcgtcggcgccgcggcggtggctcaggtgcagggcatgttattcgaccaggggtttatcggcggctgcgcgatggcgccagagtcgggcctgaccggctttgactatgccgactgcgagttcaagaaagcggtcattaaacagtgcagcgaaattattgttggtctgacttcggataaaattccggcagcagcgcggtttgtggtggccgccagcagcgatatcgatgtgctggtggtggaagagaatatcagtcgcgaatatcgcgttgcctttcagcagcacgatattcgcatctataccgtgtaa

SEQ ID NO: 148 - DNA, 297 bp, Klebsiella pneumoniae
agcgatgaggaacaggctgataaacgatgcaaccagtttggtaaagcaaccgccgaggcagtcacgctaccggatggttgttcaccgggggggcgcaatatcgacagcctgctgaatcagcaactgttaacccatatggcggcaggaccgaagccgcagcacctgacgcggagcgggatgaggaagaggggaacgcctcaagaggagtgtccgctttttttgcagggagtcttgccggattattattatccgttggagctgaaacatccagagcaatatacacgtcccgatatctga

SEQ ID NO: 149 - DNA, 810 bp, Klebsiella pneumoniae
caagaatgggaatcgttattcaaacagttgcgcagaaaacgcgcgccgccaacgcctgcttctccccgtctaacacacacctttttgacgtgctttcctgaaccagtttgctactctgtctgctccaaccgtccacacgttaccgaccgcctgcctgcggcggacataacaggagtcgctatgttcctatccagcctgatggccattgccgcggtgctgatcatgggcgtgatcagtcccggcccaagctttatttttgtcgcgcgcaatgccgtcgctcgctcgcgtctgcacggtatggtgaccgccctcggtaccggcgccggtgcggccattttctccattatggcgatgctgggcctgcagaaggtgctcaccgcggtgccggagctgtttattggtttgaaggtggcgggcgggctctatctgctgtggctgggctataaaatttttcgcgggtcggcgcagccgatggacttttccgccagcgggatggccggcaaccgctctttgctgaagaccttccgcgacgggctgtatactcagctcagcaatcccaaaactgcgctggtgttcgcctcaatttttaccgccctgctgccggcgcagatccccaccgccttctattacatcgtgccgctgatgagctttctgatcgacgtcagctggtattcgctggtggcgctggtgctgtctgccgaccacccgcggcgcgtctacctgcggctgaagcggcggatcgacatcgccacagcgacggtgctgggggcgctgggcctgcggcttatcgccacctccctcacccgctag

SEQ ID NO: 150 - DNA, 1092 bp, Klebsiella pneumoniae
atggttttactggaaatgaagtttttatgtctgagcggtataattttatttatttgcagtaatattttcccgcttctatttactgagatgaaattcaatcttataaaaacacctggaatacaaaacaaggtgaccgcaatgaaattttcctcccgaattaattctttccgttcaagacctgaactattcgatgcgaaaaacaaaatggatacgtgtgatctcattacccgtatgggtagtgcggaaggattaacacatatcgaacttaactatcctgagcattttattggccaggataaagaactgattaaaaaatgtattgctgataatggtctgcaggtaggtggtattgcgctgcgctacaataaagactttattgatggcgagtttaccaacccgaatcctgcgttgcgcagtaaagccattgagacgacgctggaagccgctgagatgtgtaaatttctcgagggcaataccgtcaccttatggtttggatatgacggctatgattacccgttccagcaagattacttccgcgcgtatgagctgctcgttgatgccttacgcatcgtgacccaggcacatggggatatgcagttcagctttgaatacaaaccttatgagccgcgtactttctcctttattggggatgtttcctcaaccttgatgttgattgatgatgttggcagtgacaatctgggtatcaccctcgatttctgccatatgataatgaagaaggaaaatccggccttctccctgttccagtcagctcgtaaaaaccgcctcgtcggtttccatcttaatgacggctacggtcatttcgatgatggcctgatgctgggttccgtacatctcctccagactctggaatatatctactacgcgaaacgcgttggttttagtggcctgatttatttcgataccttcccgagccgcgaagatccggtcgcggagtgcgctcagaatatccgtatgtacaaagcactgtctgactttattgaccgtctcagcattcctgaaattgagcaaatgatccaaagccaggacgccctgaaagtacagggtatgttactgaaaatgatcgccgaataa

SEQ ID NO: 151 - DNA, 228 bp, Klebsiella pneumoniae
tacaagtcactcttttttggcgcatgggtaagctcagcgcggtgtgaatgccgctggtttaccgcctcaaggttatggcagcactcttctcacgatgacagaccggtgaatttctctccgatttcccgcgtttcgttgagaatcgtctactatccaaacgataaccctataaatgatatcgcctctggcgatgttttatccgacttgccgggccgggccagacgctaa

SEQ ID NO: 152 - DNA, 900 bp, Klebsiella pneumoniae
ggcgggggttttcggctacaatcaaaacatcatcgaatgtgcaccaggtgcaccacactgtttttaaagcattttaagggggtatttatgcgtgacgatgggtccgcagcgtacaaaacggtgcgcggattaagccggggtttattgttattaaaattgttaaataaattcgacggcggcgcgacgccgggcctgctggcggagtttagcggcctgcatcgcaccaccgtgcgccggctgctggagacgctacaggaggagggttttgtccgccgcagccgctccgatgacagcttccggttgaccattaacgtccgccagctgagcgatggatttcgtgacgaacattggatttctgccctcgccacgccgctgctcggcgagctgctgcgcgaggtgcagtggccaacggacatcaccaccctcgacgtcgacgccatggtggtgcgcgagactacccaccgcttcagccgactgtcgtttcaccgcgcgatggtcggacggcggctgccgctgctgctcaccgcctccggactgacgtggctggcctttgcccccgacgcggaacgcgacgccatcgtcagcatgctggccgcccgtccggaagctgagtatcagctggcccgcgaaccggaacggctggcggcgatcctcgcccgcacccgccagaacggctatggcgaaaacttccgcggctggcggcaggaggagaaaatcgcctcgatcgccgtgccggtctgcagtcagcagcgggttatcggctgcctgaacctggtctatatcgccagcgcaatgaccattgagcaggcggcgcagaagcatctccctgcgctgcagagggtggcgagacagatagaagcccgcatggaggatgaagaagtgtggtacgaaatgccctga

SEQ ID NO: 153 - DNA, 1110 bp, Klebsiella pneumoniae
ttggcgccttgctggtgttggcgaccgatacccttggccggctggcgtttgccccgctgcagatcccggcggggattgtcattgccctggtgggctgcccgttcttcgttgtcttgctctggcgtcgccgtgatgccctttaaccaggaaggtagtatgcgttggttcgtctcattgctgctgttgctgacgggggccgtcagcgccgccgccccacaaactcaaactttcaccgatgatttaggccgcaccgtcaccgtgccgctgcatccgcagcgtatcgtttcgatgcacgatctcgatattaccattccgctgattgagctcggggcgccgccgatcgccagccacggccggacgcgcccggacggtagccactacctgcgatccagcgcccagctcaccggcgtcgatttcgacaacagcgatatccgctttattggcaccgccgatatcgatctggaagcggtagccgcagccaggccggatctgattatcaccgagcccagccgccacgtgtcagtggagcaactggagaagattgccccgacggtgagcatcgaccatctgcagggcagcgccccggagatttaccgcaagctggcgcagctgaccggcacccagccgcggctggcgatcctcgagcgccgctatcaggaacaaattaaacaactgaaagcgatggtcaacccaccgcagtacagcgtctcagtgatccaggcgaacaacggcaaggtcacggtgcatcattcgtatcatgcgctgggccgggtgctgcgcgacgccgggttccgctttccgccgctgattgagcggatccccgatggtcagcgcattgacgtcagcgcggaacagctgccggagctggacgctgattttgtcttcgccacctggcggtcggataccggcggtaagccgcaggatgagctgcaggcgatggaaggcgtgatgcccggctggtgtgactttatgcgcgcttgccgcaccgggcactatattttactgccgcgggaagaggtgatctctaactcctacgccgcgctgtccctgatggtggcccaggtgcagtcgcatattgccggcaggccgatcccggcggaggccaaatga

SEQ ID NO: 154 - DNA, 930 bp, Klebsiella pneumoniae
caatgcttctggttgataaacggaaactatattggccgggaatttatctcatctttctggactgacaggacaatgctcatgaaatttactaccctcaataatggcgttcagatgcctatactcgggtttggcgtctatcagatgcaggacttgaaagaatgtcaggaagccgttcttggtgctcttcagacgggttatcgtcttattgatactgctgctgcttatgagaatgaaaccgccgttggcgcggccattcagcaaagcgggatcgcgcgagatgaattgtttatcactaccaaattatgggtacaggacgcgggttatgaaaaagcccgcagcgcgttcctgcgagcacttgatcgtcttaagctggattatctggatttataccttatccatcagccttactctgatgtacacggtgcatggcgcgccatggaagagttatatgatgaaggcctgatcaaggctatcggcgtgagtaattttgctccggaccgattgaccgatttggcaacgtttaatcgtattacgccagctgtcaatcagattgaaatgcaccctttcttgcagcagggacaaaacgttgagttcatgcagagtatgaacgtgcaggcacaatcctgggcatcatttgccgaaggaaaaaacaacctgttcagcaatccactgcttgcctcgatcgcacaggtttataataaaagcgtagcccaggttgttctgcgctggctgatccagcgtaatgttatcgttatacctaagtcagttaatctgccgcgcatccgtgagaactttaacgtatttgatttctcaatcagcgatgctgatatggagaaaatcagccagcttgataccggtgaaacgttgtttacagcacataccgatcctgagcgaattaaaaccgttggcacaaaaatctttaatacctga

SEQ ID NO: 155 - DNA, 636 bp, Klebsiella pneumoniae
ttcagtgtctgtgcaaaaacgagaaaaccctgcttgccagtgagcaggaagaggagatggacgaggcgacggagtccgcacggtagtcctcacgggctggcctggcgccagcccttttttatggccctcaccggagggtatcctgttcttgctggctcactgctgttaaccattgccggcccccagccgaaaggaaatcccatggaaagtaatacattacatcgtggcagattgatcgatcatattctgctggttgtcgaagactttgaggcaagcaaaaacttctataccgccgtactgtcggcgctggagatcccggttatcaccaccgccaatgaatacttgctggccgacgaactggtggtggcctcacgccgcagcccggaggctgccgggaaactgactgggcgccaccacctggcattccaggccagagatcgtgacatggtggacgctttttaccatgcggcgctgacccatggcggacgtgataacggcgcgcctggcgaacgacactatcatcctggttactatgccgcttttgtgctggatccacaggagaataatattgaggcggtgtaccatggcaaggctgagcgcagcgccgggtctgttgcgatcagcttcacgcagtaa

SEQ ID NO: 156 - DNA, 540 bp, Klebsiella pneumoniae
tcaccttcctgctggcgcagctggttaaccgtctggaaaagaggtttggcaaaagtgattcacattaataacttacataagcgctacggcgacagccacgtgctgcgcggcatcagctgcgatattaaaccgcaggaagtggtgtgcatcatcggcccatccggctcggggaaaagcaccttcctgcgctgcatgaacgccctggagacggtcagcgaaggcgaggtggtggttaacggctttgccgcccacgaccggaccaccgacctcaacaagatgcgcgaaagcgtcggcatggtgttccagcgctttaacctgttcccgcacatgacggtgctggaaaacctgatcatggcgccgatgaatctgcgcaatatgccgcgccagcaggctatcgacctggccgaagccttgctggcgaaggtgggcttaagcgataagcgcgacgcctggccctcgagcctgtccggcggccagcagcagcgggtagccatcgccccgcgcgctggcgatgaagccgtcgattatgctgttcgatga

SEQ ID NO: 157 - DNA, 1713 bp, Klebsiella pneumoniae
caaattgcctgtcagccgggcagtttccgagtcgtgaggtcgctgagaatgacaacatctacacccgatattcaacccgccgtgcagcataccgctcaggtcgccatcgttggcgccggtccggttggtctgatgatggccaactaccttggccagatgggcatcagcgtgctggtggtggaaaagctcgccacactgatcgattacccgcgggccatcggcattgacgatgaatccctgcgggcgatgcaggcggtggggctggtgaatgacgtgctgccgcataccacgccgtggcacgccatgcgttttctcaccccaaaaggccgctgctttgccgatatccagccgatgaccgatgagtttggctggtcgcggcgcaacgccttcattcagccgcaggtcgatgcggtgatgtatcacggtctgcagcgtttcccgcaggtccgctgcctcttctcccgcgaagtggaagcctttagccagaccggtgacagtgtcacgttaaatcttaaaggaccggacggcgaacaggagacggtgcgcgcggactggctggtggcttgcgacggcggcgccagctttattcgtcgtacgctgaacatccccttcgaaggtaagaccgcgccgaatcagtggatcgtcatcgatatcgctaacgacccgctggccaccccgcatgtttacctgtgctgcgacccggtgcgaccctacgtttccgccgcgctgccccacggcgtgcgccgctttgaatttatggtgatgcccggagaaaccgaagcccagctcagcgagccgcacaatatgcgccgtctgctgagcaaagtgctgccggacccggaccgcgtcgagctgatccgccagcgggtctatacgcataacgcccgccttgccgagcgctttcgcatcgaccgcgtgctgctggccggcgatgcggcgcacatcatgccggtctggcagggccaggggtacaacagcggcatgcgcgacgccttcaacctggcgtggaagctggcgctggtggtcaacggtaaagcgggagaggcgctgctcgacagctaccagcaggagcgccgcgaccacgcgaaagcgatgattgatctgtcggtcaccgccggctacgtgctggcgccgccgaagcgctggcagggggccgtgcgcgacggtctctcctggctgctgaattacctgccgccggtgaaacgctacttcctcgaaatgcgctttaagccgatgccgcagtaccgcgagggggcgctgctgacggactgcgccggcaagacctcgccggtgggcaaaatgtttattcaaccgcaggtgacgctggagagcggcgagagcgtgctgctcgacgacgtcatcggcgcgaatttcgccattatcggctggggctgcaacccgcagtgggggctcgacgccgggcagatcgcccgctggcgcgcgattggcgtgcgctttatccaggtggtgcccgaggtgcagatccatcgcgagcaggataacgcccccggcacgctgcgggtgggcgacaggcaaaatcgcctgaagagctggtttgctcagcataacaccgccatcgccgtggtcagaccggaccgctttgtcgccgctctcgccatcccgcaaaccctcggcgcgcagctgaccgctctggcggaaaaaatgaccctcgcaaccggggataccgcccacgctgaagagaaggtggcctga

SEQ ID NO: 158 - DNA, 285 bp, Klebsiella pneumoniae
acccgctgctggtacccagcagcacaccgagccccagcagccccagggagtgcagcaggctgtcgagcaggcgcggccagtcgtcgtgcagcacctcgatcagcgcctgcggcggcgcgaagaatggtaccggcagcacggcagttttggcggtcagcccttcccagacagcaaacagcaccggcagcagcgccagccacttgctggcatgcagcacacgcgcgccgcgcgcccgccagtagcgatagctcagcgccagcagcagcaagccgccgccgagggtga

SEQ ID NO: 159 - DNA, 1596 bp, Klebsiella pneumoniae
caagtgcgacttttttcattttcctttccttattgtgatgacttacagaatctgactcagatgcagctggcccatcagcagcgggttatcgcgataatccaccgggatggccactaccgccgggccgtcgacgtccatcgccgcgcgcagggtcggctccagcgcctcggcgctttccacggcaaaccctttcgcgccgaaggattcggcataggctttaaaatccatcggcccaaactcgacgccggacaggcgctgatattttttctcttcctggatagcgaccatgttgtagccgttatcgacccagataagatgcagcacgttggctttcaggcggacggcggtctccagctccatgctcgactgcaggaagccgccgtcgccggagacggagaccactttgcgctcaggattgaccagccaggcgccgatggcccagggcagggcgacgcccatggtctgctggccgttggagatcatcacctggcgggcgcggaagctgtacaggtagcgggcaatccagatatggaagctgcccatgtccacggtcaacgtgacgtcgctgttgacgatgtcctgcatggcgcgaacgatacgcaggggatgcagggcaaactggttgagctgcgcgccgcggcggtccagcagctcgcgctggtgctggcggtcgcggaggatctccgccgcctgcggggagagcaccagccgatgatcgatattttgcgccagcttgttgagagtgccggcgatatcgcccaccagctcgacatccggggtgtagttgcgctcttcataggcgggcagcacgtcgatgtgcaccagcgtcgcgttgccgctgttccacatcgccggttcgtattccaccgggctgtagccgatgcagatcaccaggtcggcgagctgcagcagacggtccccggcctggttgttaaacagcccaacccggccggcgaagcgagagaagttatcctgattcaccgctccggcggcctgataggtgctggtgactggaatatggctggtctccagcaaatggcgcagcgccttgctgttttccggctggctggccatcaggccgagcaggaagatcgggttcttcgcctgggcgataagtttcgccacctggtcgatggcatcatccggcgcggcgcccatctgcggggccccgctggccggcagcactttgccgctgaccgggccatcgaccacatcctgcggcaggctaacgaacgcgctgcccggccggccctgctcggcggcgcggaaggcgttggagaccacttccgccagcgcatccggcgccgtcacctcgacggcgtatttggtgaccgggctgaacatcgccaccgtatccatactctggtggacctgcttcgctttatcggcgcgttttaccgcgccgcccagggccaccaccgggtcgccttcgctgttcgcggtggccatgccggtgatcaggttggaacagcccggaccggaggtgaccagcgccacgcccgctttgccggtaatgcgtccgacggcggcggccataaatgcggcgttggcttcatggcgtaccggaataatgcgaatggaggaatccagcagtga

SEQ ID NO: 160 - DNA, 1194 bp, Klebsiella pneumoniae
aagcccgcatggaggatgaagaagtgtggtacgaaatgccctgatcgcgatgagggtaaccgcgatcaaccattgcgcccggcctcgttatataatttaatacacaacgaattttcacgccattcgggccacaccatgtcaaaacaccccttactgctgggcctgacgctgctcagcgccagcctgttcaccggccaggccttcgccgaccgcaccgtcaccgaccagctgggtcgccaggtcaccctccccgaccacgtcacccgcgttgtggttctgcagcatcagacgctcaacctgctggtacaactgcatgccgccgaggatatcgtcggcgtcttaagcagctggcagaaacagctcgggccgcagttcgcccgctttatgcccgagatcgggcaactggcgaccccgggcgatctcacccaggtcaatattgaaagcctgctggcgctgcgtccgcaggtggttttcgtcgccaactatgcgccgccggcgatgatcgcgcagatccaacaggccgggatcccggtggtggccatctcgctgcgccatgatgccgccggggaaaaaaataaaatgaaccccaccatggctgacgaagagcaggcctataacgccgggctgatggaggggatccgccttatcggcgaggtggtcgagcgccagcccgaggccgaggcgctgattcactacaccttcgaggcgcgcaagcaagccaatgcgccggtggccgatattccaccgaaccagcgggtgcgggtgtacatggccaaccccgatctgaatacctatggcgctggcaaatataccgggctgatgatggcgcacgccggggcgctgaacgtggcggccgccagcgtaaaaggcgcccgccaggtgtcgctggagcaggtgctggagtggaacccacaggtgatcttcgtccaggaccgttatccgcaggtggtcaaacagatagagaacgacccgcagtggcaggcgatcgatgcggtgaaacatcaccgcgtgtggctgatgccggagtatgccaaagcctggggttacccgatgccggaggccctggcgctgggcgagctgtggatggcgaaaaaactctatcctgcgcgctaccagagcatcgatgtggacagtaaagccagcgattactatcagcgtttttaccgtgtgacgtggacgccagatgcccgctaa

SEQ ID NO: 161 - DNA, 744 bp, Klebsiella pneumoniae
gcgtctatgtggaaagcgttacatcaactggcgatccccgagcggctgtaccgcctgtgcggatgctggatcccctggctggcggcgttgagcgcgctgttgctggtcatcggcctggggtggggctttggcttcgcccccgcggactatcagcagggggaaagctaccggatcatgtaccttcacgttccgacggcgatgtggtcgatggggctgtacctggcgatggccgtcgcggccttcgtcggggtggtctggcagatcaaaatggccgatctggcgatcgccgccctggcgccggtgggggcggtctgcaccctggtggcgctggtcagcggcgcggcatggggcaagccgatgtgggggacctggtggatctgggacgcccgcctgacctcagagctggtgctgctgtttctgtatgccggggtcattgccctgtggcacgcctttgacgaccggcggctggccgggcgcgcggcggggatcctcgtgctggtcggggtggtcaatctgcccatcattcattactcggtctactggtggaacaccctgcaccagggctcgaccaacctgcagcaaaccatcgacccaagcatgcgtctgccgctgcggatctgcatctttgccttccttacgctgtcggtcaccctgaccctgatgcgcctgcgtaacctgatcctgcaactggagcgccgtcgaccgtgggtggtggcgctggtgaataaaggagccgcccgatga

SEQ ID NO: 162 - DNA, 285 bp, Klebsiella pneumoniae
ccaaaaccgtggcccctggaaaccgcgcgcagcggcatcacctgcaacgccatctgccctggctgggtgctaaccccgctggtgcagcagcagatcgacaaacgcatcaccgagggggtcgacccggagcaggccagcgcccagctgctggcggaaaaacagccctccggggagtttgtcaccccgcagcagctgggcgaaatggcgctgtttctgtgcagcgatgccgccgcccaggtgcgcggcgccgcatggaacatggatggcggctgggtggcgcagtaa

SEQ ID NO: 163 - DNA, 795 bp, Klebsiella pneumoniae
acgaggaagtggtatatgaatcattctgctgaatgcacctgcgaagagagtctatgcgaaaccctgcgggcgttttccgcgcagcatcccgagagcgtgctctatcagacatcgctcatgagcgccctgctgagcggggtttacgaaggcagcaccaccatcgccgacctgctgaaacacggcgatttcggcctcggcacctttaatgagctggacggggagctgatcgccttcagcagtcaggtctatcagctgcgcgccgacggcagcgcgcgcaaagcccagccggagcagaaaacgccgttcgcggtgatgacctggttccagccgcagtaccggaaaacctttgaccatccggtgagccgccagcagctgcacgaggtgatcgaccagcaaatcccctctgacaacctgttctgcgccctgcgcatcgacggccatttccgccatgcccatacccgcaccgtgcctcgccagacgccgccgtaccgggcgatgaccgacgtcctcgacgatcagccggtgttccgctttaaccagcgcgaaggggtgctggtcggcttccggaccccgcagcatatgcaggggatcaacgtcgccgggtatcacgagcactttattaccgatgaccgcaaaggcggcggtcacctgctggattaccagctcgaccacggggtgctgaccttcggcgaaattcacaagctgatgatcgacctgcccgccgacagcgcgttcctgcaggctaatctgcatcccgataatctcgatgccgccatccgttccgtagaaagttaa

SEQ ID NO: 164 - DNA, 513 bp, Klebsiella pneumoniae
acggccgggtgtaaagatgcaggaaatctcccccctgcggatcgcggtcatagaggagctgctggcgctgaagctgcccgacgtccagctctccgccaaagcgcgccagcaaatcgtcataataattggccgggatcggcagcgtatggcgggcaacctcggcaagctggtcgcaggcggccggcagatcgcggcaggcaaaggcggcatgctgcagccccgccccctggtagcaggcaacggagcgggcgatctgcgtcgcccggctctgcgaaatattcagcgccagacggatatcgccctgcgggctgcgcaccgccaggctgcgcaccagtccatacgggtccggcagcgtctgctcatgctcaagggaaaaaccaaacaccgtacggaagaacatcacccagttatcgcggctgtcggcctccattcccagcgccagatgatcgataccgagataatcctcgcgcaccgtcacgccatcacgcagatgaaaatcgcgctcgtagatag

SEQ ID NO: 165 - DNA, 324 bp, Klebsiella pneumoniae
gcgtcggggtgccaagcagcaaggtcagcgccagcacaccggcgtcatgcagactcatccccagcagcagcgccgccagcggcgagacgatcagcagcggcaggccgctcatcatccagtgggcaaccaccttcaccagcaccaccgccaccagcggcgtcggcaggagcatcagttgctccagggaaccgtcctgccagtcgtcgcgaaacaaccgatccatcaccagcagcgccgccagcagcgcggcgacccacaccacgcccggcgcaatctgcgccagcagctgcggcgcggcgcctacgccgaacggaaacagggtga

SEQ ID NO: 166 - DNA, 225 bp, Klebsiella pneumoniae
tggatccttcggcaaattgccgtcctgagttgcataataattaatcgactggccgttgtcaccgttgaaatcactaccaaaaaagggccgcagggcagcaggtgggctgtacgccgcgccgccgccgcatttcgtgacgttgtcagcgtggtaacgacaggatataacggagggagcggcagcgccccgacgccggtgagcgacggggaaaaacgcgacgcatga

SEQ ID NO: 167 - DNA, 1119 bp, Klebsiella pneumoniae
cagcctgatcgatttccagcgccgcccctggctgtggatgccgccgggcatcgccatctttatcaccgtgatcgccatcaacgtgctgggcgatggcctgcgcgacgccatggatcccaatatgaaaccgaggctgaaatgaccacgccgttagtctcctttaatcatctctccgtctctttcgccggcgaacgctctcgcgtgcgcgcggtgcaggaggtctctttcaccattcaggccgggcaaaccgttggcgtggtgggtgaatccggctgcggcaaaagcgtcaccgccatggcgctgatgggcctcctgccgccgcagacggcgcgcatcgacggcggcgagatccgcttcgcggaccgcgatctgctgcggctgaaagccagacagatggccgatctgcgcggtcacgagctggcaatgatttttcaggaaccgatgtcggccctcaacccggtgttgaccatcggggagcagctgtgcgaaccgccgatccgccacctcggcgccacgccgaaagccgcctggcatcaggccatccagctgttaagcgaggtcggcctggcgcgcggggacagcctgatgacccgctatcctcaccagctttccggcggcatgctgcagcgtgtgatgatcgccatggcgctgagctgtcggcccaaactgctgatcgccgacgaacccaccaccgcgctcgacgtgaccgtgcaggcgcagatcctacgcctgctgcgggatcgggcccgggccagccagatggcgatgatgctgattacccacgacctgggggtgatcgcgcagatggccgagcaggtggtggtgatgtatgccggacgaattgtggaacaaggcgccaccgcggaagtgctacggcatcctcagcatccctacacgcgggggctgatcgcctcccgaccggtgcccggtgagcggcgtcggcggctgtactcaattcccggccaggtgccggatctggccgccctgccggcgggctgcgcctttgccgggcgctgcgaacgggcgacgccgcgctgccgggaggcgattccgccgctgctcggcgagcgccagcgggccgcctgcttttatagcgaatttgcggaggcgacagcatga

SEQ ID NO: 168 - DNA, 345 bp, Klebsiella pneumoniae
gcaggtgatcgagatggtgcgcgaggggcgggtggagatgggcatcgctttcgagccatcgcccaaccacaacctgctgtttaccccgctggcggtggaccgcttcgtggcgatcgttccccaacaatccccgctggcgaagaaaaagcagctcacctggcaggagctgttgagcctcgactttattaccctgcagcgcccctcggcggtacgcctgatgctggaggaggcgctggcgcgcagcggacgtcagctggacgtggcgctggagagtcatcagctggtgacggtggggaggatggtggccagcggcctggggggcagcgcggtgccggcgctgtgtaa

SEQ ID NO: 169 - DNA, 762 bp, Klebsiella pneumoniae
ccccctccccgcgccgtttacatcgccagcaacagggtttattcgttgaatattttaattcacagcaataatatttattttaatatcggtatcgcccagtgttttcgggatattcagaaaacagcgcccgaattaaaggttattcactccctgcccctcagccatcttccagaactgtccgggctggatgtgattattttgtcactggaaaactatcatgattacctggctgccgctgaaatcgctcagcactttcagggcctggtcattggctttacgtcagccggcaacgtaaggcgcggacgcgcctttttcgcggataccctactgtgggtcagccagcgcgaagcggtacgtgaagtgagccgccttctgcgctgcctggccgagcgccgctggccactcgtgccgcgtcaccaacgtcagagcgtttctttccgtcaacgagccccgctcaaccgcctggagatgcggatgattgatgccaccatgaagggtcagtcggttcatcaaatggccgctacgctggggattaatcgcaagcgtgtttataacggcctggaaaggattaaagtgaatttccgcctggtcagtcatagccattttcatcatttcatgaccgacaggctctcttttagtcgcctgtctgccgacctccgatgcctgaccacagcagctaatgcaaccctgccgccgcgcgcagcctcgaggctggcggaaaatcattcatattatttgaaagagtttcgcaaattgttttga

SEQ ID NO: 170 - DNA, 1218 bp, Klebsiella pneumoniae
ggttatccccgaggacaggccggtcaacctgcccggcgtcggctgtttttccggcctgaaaaccgcggtgtacctcgaagtggaaggggcggcgcactatctgccagcgtacgcgggcaacctcgatattatgacctcggcggcgctggcgacggcggagcaaatggccggggcaatgcacagcgcggcgggagcgacagcatgaacggtaaaaaactttatatctcggacgtgacgctgcgcgatggtatgcacgctattcgtcaccagtattccctggcgcaggtgcagcagatcgccggcgcgctggataaggctggggtcgactccatcgaagtggcccatggcgatggcctgcagggatccagcttcaactatggctttggcgcccacagcgacatcgcgtggattgaagcggcggcggcggcggtcagccaggcgaaaatcgccaccttgctgctgccgggcatcggcacgctgcacgatctgaaagcggcgtatcaggccggagcgcgggtggtgcgggtcgccacccactgcagcgaagcggacgtcgccgcgcaacatattgcctttgcccgcgagctgggaatggacaccgtcggttttctgatgatgagccatatgatctccccgcaggcgctggcgcagcaggcgttgaagatggaatcttacggcgcgacctgtatctatgtggtggattccggcggggcgatgaacatgaacgacattcgcgaccgcttccgcgccctgaaggcggtgctgaagccggagaccgccaccgggatgcatgcccatcataatctgagcctcggggtggcgaactcgatcgtcgcggtggaagaggggtgcgatcgcattgacgccagcctggccgggatgggggcgggggcgggcaatgcgccgctggaggtgtttattgccgccgccgacaagctcggctggcagcatggcaccgatctctacgccctgatgaacgcggccgatgagctggtgcggccgctgcaggatcgcccggtgcgtgtcgaccgcgaaacgctggcgctgggctacgccggagtctactccagcttcctgcgccacagcgaagcggcggccaagcgctatggcctcagcgcggtggatattctcgtcgagctgggcaagcggcggatggtcggcggccaggaggatatgatcgtcgacgtcgcgctggatctgcttaaccgcaataaataa

SEQ ID NO: 171 - DNA, 288 bp, Klebsiella pneumoniae
ccatcgccccgcgcgctggcgatgaagccgtcgattatgctgttcgatgagcccacttcggcgctggatccggagctggtgggcgacgtgatggaggtgatgaaaaacctcgccagcgaggggatgaccatggtgatcgtgactcacgaaatgggctttgcccgcgaagtagccgacagggtgatcttcatcgaccagggcgtgattcaggaagagggcaagccggggcagatctttagcgcgccgaccaacccacgcaccgccgcgttcctcagcaaggtgctgtaa

SEQ ID NO: 172 - DNA, 825 bp, Klebsiella pneumoniae
gccgttcaccgccctcgacgccacggcgatggaaaccctgacccgtcgcctggagcagcacgcccggcaggggggatgcgccatcctcaccacccaccagccgctgcggccgctgggctgtccgttgcgcaccctgcgcctcggcggcgacgctggaggcgggcaatgatgcgtgcgctgttggcccgggaactgcgcctggcgtggcgcagcggggcggagatcctcaatccgctctggttctttctgatcgtcatcaccctgtttccgttcggcgtaggcgccgcgccgcagctgctggcgcagattgcgccgggcgtggtgtgggtcgccgcgctgctggcggcgctgctggtgatggatcggttgtttcgcgacgactggcaggacggttccctggagcaactgatgctcctgccgacgccgctggtggcggtggtgctggtgaaggtggttgcccactggatgatgagcggcctgccgctgctgatcgtctcgccgctggcggcgctgctgctggggatgagtctgcatgacgccggtgtgctggcgctgaccttgctgcttggcaccccgacgctcagttttctcggcgcggtgggggttggcctgacggtcggcctgaagcgcggcggcgtcctgctgagcctgctggtgctgccgctggcggtgccgctgctgattttcgccaccgcggcctgccaggcggccgccgccgggctcccggtcggcggctatctggcgatgctggcggcgttcttaaccgccagcgccaccctgtgtccgttcgccaccgccgctgcgctgcggctgaccgtgcgataa

SEQ ID NO: 173 - DNA, 339 bp, Klebsiella pneumoniae
cccgcaaaccggcaaacccttctttatgccgtttcgcgaccgccaggcagcggcacaatgagcgtggccatcctgctttccgcgcggcgtcgcccccgcccccggctggcgctgcttctgctaacgctgctgcttatcgccgcctcgctggtgcatcttggcttaggcgcccgctggatcgccccgcagacggtgctgcgagcgctgctggagtacgatccgcgtaactttgagcagcggattatcgtcgatctgcgtctggtgcggctggcggcgggcgctgctgaccggcgcggcgctcggcgtcgccgggctgctgctgcagacggtgatccgtaa

SEQ ID NO: 174 - DNA, 297 bp, Klebsiella pneumoniae
agcgcctgccgccaggcgctgcagcgcgccggctggacgctggacgaggtggaccttatcgaagccaacgaggcttttgccgtccaggcgctggccgtcggccagctgcttgaatgggacagcgagaaggtcaacgtcaacggcggcgccatcgccctgggccatcccatcggcgcctccggctgccggatcatcgtcagcctggtgcatgagatgcagcgccggggcgccagcaaagggctggccaccctgtgcgtcggcggcggccagggcatcgccatgacccttcaacgttaa

SEQ ID NO: 175 - DNA, 1455 bp, Klebsiella pneumoniae
atggttcgccgtcgatctccactggctgccggtaggcgggatgaccaataccggcagcgacgagagcggctggcagtatgtgctgcaggtggctgcccacctggcgctgccggtgctggcgctggtgatgctgcaggcgggcagcctgacgcgctatgtgcgcgccagtatgctcgacgtggtgaaaatggattttatccgtaccgcccgcgccaaggggttgcaggagcgcacggtgatcctcaaacatgccctgcgcaacgccctgctgccgattatcaccctgctgggcttcgagctgccggggctgttctccggggcgatcattaccgaaaaggtattcaactggccgggggcgggccacattcatatcgactcgctggccgcccgcgactatccggtactgatggggtttaccctgtttctggcggtgctgacgatcgtcgggaatctgctcgccgacgtgctgtacgcctgggccgatccgcgtattcgggtgaggtcataatgatcctgtcttacttagcttcccgtcgccgccagcggcaggcggctatcccggcgctggcgcacattaccccctctccctggcgccaggggtggcgacagctgcgccgtaaccggctggccatgttctgcctgctcctgctggcggtgatggcggtgtggtgcgtgctggggcccgtctggtcgccgtggagtgatgatgccaccgacgccctgagcatcaaccagccgcccggggcggaacactggctggggaccgatttcctcggtcgcgatgtctacacccgcctgctgctggccgggcgcatctcgctgattatcggcctgctgaccatggtgatgtcggtgtgcctcggctacctgctcggcgccctctcgggttacgtcggcgggttaaccgacaaactgatcatgcgcgtggccgacctggtgatgactatccccgggttaccgctgttaattgtcgccggggcgatgctttccgagctcgatttttcgccggactcgcgcatttatatggtggtggtgatgctcagcctgctggagtggccccgactggcgcggctggtgcgcggacaatgtctctccctgcgcgaacgcgattttatgctggccacccaggtgctgggcctgtcggcgcgtcgccggctgtttggccacctgctgccgaataccattccgattctggtggtgatggcgaccatggccgtcgccaacgccattctcagtgaatccgcgctgagctatctcggcctcggcgtggtgccgccgacgccgtcgtggggcaatatgatggatgccgctaacagcctgatcgatttccagcgccgcccctggctgtggatgccgccgggcatcgccatctttatcaccgtgatcgccatcaacgtgctgggcgatggcctgcgcgacgccatggatcccaatatgaaaccgaggctgaaatga

SEQ ID NO: 176 - DNA, 1062 bp, Klebsiella pneumoniae
cgtgcccgccgccgaggtgacgccatgaccagaacccctttttcccgccgccgttttttacagctcagcggcggcctggcgctggccggggtctctctgccgctgtgggctcatgatatggcggacatggccggcggcgatgcccatccggcgctgcgcctgccagagccctacaagatcaagctggcgatcaacaaaagcgcggtatgcctcgcgccggtcgccgtcgccgagcagcagaagatattcagtaaatacaacctcgacgtagagtttgttaacttcggcaactccaccgatgtgctgctggaggcgatcgccaccggtaaggccgacgccggggtggggatggcgctgcgctggctgaaggcgctggagcagggctttgacgtcaagctcaccgccgggacccacggcggctgtctgaacctgctgacggccaaagactcgccgttcggcggcctcgagagcctgaaggggcaaaccatcggcgtcaccgacatggccggaccggataaaaacttcttcgccattctgcttaagcgccacggtatcgacccgatcagcgacgtgcagtggaaagtctacccggcggatctgctcagcgtggcgctggacaagcgcgaaatcgccgccatcagcggcagcgagccgttcagctatcgtctgctggagaccggcaagtatcagctgatcgccagcaatatgaccggggattatgccaacctcagctgctgcgtgctgggggtgagcgggagcctggcgcgagaccataaaccggccgccgcggcgctcacccaggcgatccttgaggcgcacagctatgccgctgagcatccggaaagcgtggcgcaatccttcctcgcccatgccctgaataccagtgaagcggaggtgagcggcatcctgcacgggcagggccacggccatcacgcggtgggcgaagcgttcgtgaaagagctgacgcagtatgcggtcgacctgcagcgggtgcaggtgatcaagccgggtaccgatccccatcagttcgcggagagtatctatgccaacgtattcgcctga

SEQ ID NO: 177 - DNA, 981 bp, Klebsiella pneumoniae
ctcctacgccgcgctgtccctgatggtggcccaggtgcagtcgcatattgccggcaggccgatcccggcggaggccaaatgaaaagcgcggtaaaaaaagagaagggcaaagtcgatctgttcggcgaacgctatcgcgcccgggcgcaccagctctccccccggctgcgggcggtggtcagctatatcaacgacaaccgcgaggtggtgctggagcatacggcgatggagatcgccaccgcgacccagacctccgacgccacggtggtgcgtgccatccaggcgctgggcttcgccgggctgcgcgagcttaagcagaccatggagcgctggttcggcacctcggtcacctcggcggaaaagatgcgctcgacggttaccgcgctctccagcgacgtcaactccagtattgattttgtgcttgaaggccatcagcgggtgtgcgaggttctgtcgcgggccgacaaccgcgcggcggtggctcaggcggtggcattgctcagcgacgcgcgccaggtggggatcttcggtatcggcgcctcggggatcctcgccgaatacaccgcccggttgttcagccgtattggcctgccggcgtacgtgatgaaccgcacgggctttagtcttgccgaacagcttatcggcctgcagcgcggcgatgtgctgatcatgatggggcaaaaatccccccatcgcgaagggttgaccaccctgcgcgaggcgaagcggctgggtattccgaccatcctgctgacccaggcggtggactcgcgcttcagccaggaggcgcaggtggtgatcgacgtcccgcgcggcggggacagtagccggatgccgctgcacggtacggtgctggtctgtctggagatgattgtcctgtcggtggcctctaccacgccacaaaaaacggtgaaatccctgaaacgaatcaacgatctgcatcgggctatcggtaaatccggcggtaaacggggccattga

SEQ ID NO: 178 - DNA, 219 bp, Klebsiella pneumoniae
tggagtggccgcgacagcggcgctggtcattaccctatacagagcgtgttaatgagcaaaatgcatttttatcatatcttaatatgcttaattagcattaaacaaaaatgcatagtgctttcagtcggatacggtcagctgctgcatcactttgctggcaaaaaaggccagcggcggctgcaggttcgccagatactgggcgtggatcagccacagtga

SEQ ID NO: 179 - DNA, 231 bp, Klebsiella pneumoniae
cttccgttacgcggtgatacgctaattctgaacttgtggaactacccagggaatggttcattacttttcaggagcgtttttatggtcattgcaactcgtaagcctctgtgcaacaaacgctggtcggccagcccggcctcccaggatcttcagttgactcagctacgtcacccgtgggtcgccaccaaagctagctgcaaaagtaaaaaaggctggaagagccgcggttaa

SEQ ID NO: 180 - DNA, 1080 bp, Klebsiella pneumoniae
cgaataatacgctgcgggaggttgccccggatgaagtgctgctgctgggcgataccgcggaggacttgcccgtcgctgcgccgatacacctgcagccaggcggcctggcgaccgaacaaagccggtatgccgccatcctcccacgagacaacctgcatcacctggccacgactgccgccgtctttatctatcagcccatcaccgcccggttacgcaacccggcgcagcgcgcgtgaggtcgccatgtcacctgctcccttttatacgttgaccgctggcgacctgacggtgactgccgtgagtgatggtctgatgtcagcgccgctgtccttactctcgggtatctcacgggaggaggcggaacatctgcagcggcagtcaggattagcctcgccggagaccattgcgattggcgcctatctgatccgcggtcgcgggaacacggtgctggtggataccggcaccggcggagccaatggcgttggcggcgaacttatcgccaatctggcgcggctcggcgttggtcccgaggagatcgacgccatccttctcacccacgcccatccggaccatatcggcggcctgctgtccgccgctggtacgccagcgtatcccaacgccacggtgttcctgcctacgcgggaaagcgcttactggctggcaacatccacgttcgacaacgccagcgatcgcggccggcgcaacgtgctgcttgttcgccgtgtactggcgaactgcgcggcgcaaatcagcggggttgatgatgaggaggtgatcgccgggatccgcccgtgccctctgcccggccatacgcccgggcataccgggtatcgtctcgaagcgggcgatacctcgctgctgatctggggggatatcgtccatttcccgtccattcagtctgcgcggccagaagcctcggtcgccttcgacgtcgatcctgaacaggcccggcgtaccagggagatcctgctgcgccaggccgccagcgaacggtggttgattgccggtatgcatcttggcctgccgggattcgccagagtggagaacaccgcctcaggctattgtctgcgctcggtgtga

SEQ ID NO: 181 - DNA, 216 bp, Klebsiella pneumoniae
ataaagtcgcttgctcctgaggggaaacattcataccgggaaacctttgtcatcatcatgggcaaaataggcgaacactcgccagtgtccgcattcgatttcagcgcagtgataatcagtccggccagtgatggtcggaagtctgattatcagatgattaggttttccagcatcgacgcctcagctatgggtatgaattatttatcaaggaaatga

SEQ ID NO: 182 - DNA, 438 bp, Klebsiella pneumoniae
gccaggggacgcggacaggcaaggcggcggcccggcatttttttaccagaccgccggatgcatatcagaccatggccgcgcgctgctggcgatgcatcagccagaacaccgccacgccggccagcacaatgcccggcgccgaggccgccatcaccccgacggtgccggtgccgagggccagcatcttgccggccagcagcgggccgctcatcgccccaagacgccccaccgccacggcggtgcccaccccggtggcgcggatggccgcgggataaaaaagcggcgccagagcgtaaagcacactttgtccgccggtggcgaacagcccggcgacaaaccccgccagcagcatgccagtcagcgacgacgcgctgcccagcgccaacagcgacgccagaatgccgctgtagatcaggagcgacatccgcagcggggtga

SEQ ID NO: 183 - DNA, 273 bp, Klebsiella pneumoniae
acaacggcgcgcccaccagggcggtcatcgctccggtggccagctcctgcggcgcgaccagcgtccgggcggcgatatccgccagcaccagcgccagcgctcccaccggcgcggccaggggcagcgccaggcggatgtcttccgtcaccagacggcgcaccatgtgcggcaccaccagcccgacgaagccgatcggcccggccaccgccaccgccgcgccgcacagcagcgcaatcgccagcaggcccagcagccgggtctggacgagattaa

SEQ ID NO: 184 - DNA, 300 bp, Klebsiella pneumoniae
gatctgcatagctacgttgccttcgttcatagggccttttatgtggagatgagttgtatatttccttcggtaggccaaaagcgaggctgtgaccattcgcctcacaggagaggtcgtaatgtatacacgcttctcttagcgaacctgctggtgttaaaatatattgaaagtcttcaggatttaattggcgtattaaatcatgtgactggtaaagtcgaaacatatgaattccctatccttcattttataagaatcattcgccgttattgctttaaacagttcccttctctttcgcaataa

SEQ ID NO: 185 - DNA, 282 bp, Klebsiella pneumoniae
ggatgccgtagcacttccgcggtggcgccttgttccacaattcgtccggcatacatcaccaccacctgctcggccatctgcgcgatcacccccaggtcgtgggtaatcagcatcatcgccatctggctggcccgggcccgatcccgcagcaggcgtaggatctgcgcctgcacggtcacgtcgagcgcggtggtgggttcgtcggcgatcagcagtttgggccgacagctcagcgccatggcgatcatcacacgctgcagcatgccgccggaaagctggtga

SEQ ID NO: 186 - DNA, 1254 bp, Klebsiella pneumoniae
caaagcatcagccgccagtcacctgctccgtttgttcggctatcgctaaggtaccctatgaccaagataacgactgcaaccccctcgcgcctggtggtcaccatcgggctctgttttatggtggccctgatggaagggctggatctgcaggcggcggggatcgccgccgtcggcatggcgcaggcctttgcgctggataaaatgcagatgggctggatcttcagcgccgggatcctcggcctgctgcccggcgcgctggtgggcggcatgctggcggaccgccacgggcgtaagcgcattctgttggggtcggtgctgctgtttggcctgttctcactggccaccgcgctggcatggagcttcccgacgctgttgctggcgcgcctgctcaccggcgtcgggctcggggcggcattgccgaacctgattgccttaacctcggaagccgctggctcacgtttccgcggccgggcggtaagcctgatgtactgcggcgtacccattggcgccgcgctggcggcagcgctgggcttttccggtctcgccgcggcctggcagattattttctggattggcggcgtggtcccgctgctgctgatcccgttgctgatgcgctggctgccggagtcgcaggcgtttcagcgcgcggaggccagcgtgccgctgcgcaccctgtttgccccgggccaggccgccgctacgctgctgttgtggctgggttattttttcaccctgctggtggtctatatgctgatcaactggctgccgatgctgctggtgggccagggattccgcgccagccaggcggcgggggtgatgttctctctgcagatcggcgccgcctgcggcacgctgctgctgggggcgctaatggataagctcaccccgctgcggatgtcgctcctgatctacagcggcattctggcgtcgctgttggcgctgggcagcgcgtcgtcgctgactggcatgctgctggcggggtttgtcgccgggctgttcgccaccggcggacaaagtgtgctttacgctctggcgccgcttttttatcccgcggccatccgcgccaccggggtgggcaccgccgtggcggtggggcgtcttggggcgatgagcggcccgctgctggccggcaagatgctggccctcggcaccggcaccgtcggggtgatggcggcctcggcgccgggcattgtgctggccggcgtggcggtgttctggctgatgcatcgccagcagcgcgcggccatggtctga

SEQ ID NO: 187 - DNA, 636 bp, Klebsiella pneumoniae
cgggcatacagggaaaaggccgggctgacgcggaacgcctcgctgcgcgggaacggctcgcggatggggatatcttcgaccacccgtccgggacgggccgccatcatgatcacccgctgggagagaaacaccgcttcgtggatcgagtgggtgacgaacactaccgtcaggttttgctcctgccagagacgcaacaggtcgctgtcgagtttgttacgcgtaatttcatccagcgcgccgaagggctcatccatcagcagcagctttggtcgggtgaccaggccgcgggcgatggagacgcgcatttgcatgccgccggagagttcgcgcggcaggacgtcggcgaacttgccgaggcccaccagctcaaggacttcactcacccgggtatttccctccgcccgcggcacgccggccagatccagcggcagcctgacgttattgcgcacgctgctccacggcatcagggtggcttcctggaagacgaacgacagcggatgctgggccttttcccgactgtcgcgccgccacagcatcagcttgccgtcgctgggctccaccaggccggcgaccatcttcagcagggtgcttttaccgcagccggacgggccgagcagggtaataaactccccctga

SEQ ID NO: 188 - DNA, 927 bp, Klebsiella pneumoniae
tcaatggacagcctcacctcgctgacgtcctttgtccgcaccgccgaaacgctaagctttgttcaggccgccaggctgctgggcatatctgcctcggcggtgggtaagaatgtcgcccggcttgagcataaactgggggtccggctgttcaaccgcagcaccagaaacgtcagcctgacggcggagggggccgcatttctgacccgctgtcagagtatcctggagctgatccaggaggccgagtcagagctgaccagcagtctctcacagcccaccggcaaactgaggatttcactgcccgtcattggctaccgcctgttactccccgccctcaccgcctttagccgtctttatccgcaggttgaactggatctcgactttagcgaccggctggtcaatctgatcgatgagggagttgatgttgctatccgcagcggtgaattagcggactcccgcttgatcgccagaacgctggggggttttcgttttgtgctctgcgccagcccggcctatctggcggaatacggcgcccccggctcaccagcggaattggcggcacacaagtgcatttttttccgcttccccgcgacggggctgatccagccctgggaactgcgcggtatgcgactgacgggagatttcagggccgctgccgtgatgacggtcaataacattgaggccgccattcgcttaagcgcggcggggatgggcatcgcttatgtgcctgattttgtcgtgcgcgaggcaatggatgagggacaactgcaggaggtgttgcccggctgttgcgtcaaggatgggcatttctcggtcctgtggcccgccagccgctacctgtcaccaagaatacgctgttttatcgattttatagctgcggcagagatacccttgtcacccgcatcggcgacccctgccccttgtgtctaa

SEQ ID NO: 189 - DNA, 339 bp, Klebsiella pneumoniae
ccccgacggctgtggcctgcgcgccgggctcattcgcgagctgcagagccagggattgcggttgacgctcaacgtcgagagcgcgggcgcgcagctgcagatagcgctggtggcgcaggggctggggctgggtctggtgccgagggcggcgctggccagcagcccgtggcgggacgaggtcgcggtcctcagcctcagcgattttcagcctgcggtctcactgtggctgatccacgcccagtatctggcgaacctgcagccgccgctggccttttttgccagcaaagtgatgcagcagctgaccgtatccgactgaaagcactatgcatttttgtttaa

SEQ ID NO: 190 - DNA, 1752 bp, Klebsiella pneumoniae
cccaccggcagcgacagagggagcgcgctgcgctccctgaggtcagacgtcggcagcggctttcagtcgcgctttcatgtcgctgtaggccgtccaggcatagcgctccgcccattgctggtcggcaatcgcttccactttcaccgcacagtatttggtttccggcgttttggagatcggatcgaggttatcctgggtcagctcattgcaggcgcccacccaccactgataggtcatatagaccgcccccggattgatgcgatcgctgaggtcggcgcgggagatcaccttcccgcgccgggagctgacccacaccagctgtttgtcggcgatccccagtcgttgcgcatccgcgggattcatctgcacccgtcccggctcgtcggccagcgactgcagcgcggcgcagttgccggtcatcgagcggcaggaataatgcccgacttcccgcacggtgcagagcaccagcggccactcgtcatccgggcgctccgccggcgcgcgccaggcggtggcgaacagctgccctttacccgagggggtgtcgaagcggttgtctttatacagccacggcgtgccgggatgatcgagggtcgggcacggccactggacatggcccatatcgcccattttctcccaggtcacgccgtagaacagcgggcagagctcgcgcatctcgtcccagatttgctggttgttctcatagtgcatcggatagcccaattcgctggccagcaggctaatgatctcccagtcgcgcttcacatttcccgccggagggatcgcctgttcaaaccgctggaacccgcggtcggcgcaggtgaagacgccgccgtgctcgccccaggaggtggccggcagcaggacatcggccatttccgctgttttggtcatgaagatgtcctgcacgaccacgaagtccagcgcctcgatgcctttgcgcaccaggccgaggtcggcttcggtctgcagcggatcttcgcccatgatgtaataggctttgatctcgccggccagcgctttatgcggcacctcggtgatgcgggtgccgacctggtcgtccatcagcgccgggtcgatgccccaggcggcggcgaatttcgcccgcacgtccgggtcggtgacctcctgatagccggggaacaggttcggcagcacgcccatatcgcaggcgccctgtacgttgttttgcccgcggaccggccccacgccgacgttgggccgtcccaggttgccggtgagcagcgccaggcttgccaggccgcgcaccacgtccaccgcctggccaaactgggtgacccccatgccccacataatggtggcggatggggcggcggcgaacatgcgcatcgcctcccggatttcccgcgcgctgaccccgacaatcccttccaccgcttccggggcgtaatccttcaccgcctcgcggtaagcatccagcccttcggtatagcgttcgacataggttttgttgtacagctcctcctccagcagcacatagccgaaggcatttaccagcgccatgttgctgccgttgttgagctgcagatgacgatcggcaatgcgcgcggtttcaatgcgccgcggatcgcagacgatgattttggcgccgttgtcccgggccttgattacccggcgggcgacgatgggatgggagtcggcgcagttgtagccaaaaaccagcaggcacttcgagttttcgatgtcgctaatcgagttgctcatcgccccgttgcccagcgcctgctgtag

SEQ ID NO: 191 - DNA, 396 bp, Klebsiella pneumoniae
cagaggggcagtaataacccacgctgtgctaacaaaaattttactccgtcagtcgggaatgtcccctcctttttcatccaccgtaaagacggccagccaatcatcatggccgcgatcggaagcaccccgttagagcgtgttgatgaggcggaagggattctgattgtcacggccgcggctgataaaggtctcgttgatatccatgaccggcgcccacttgtcctggtaccggatgccgcccgggagtggatgaaacaggacgtttcgggtaaggaggctgaagaaattgcaactgatggagctgtatcagctgatcatttcatatggcatcctgtaacgcgcgctgttggtaatgtgaagaatcagggaccagagctcatcgagcctgttggctga

SEQ ID NO: 192 - DNA, 198 bp, Klebsiella pneumoniae
aatgtggcaaggtgttatgcgttttatcatgcagtccaatgcgctgaaaccattcaagaaagaatcgaagcgcattatacgctgccgaaatcaaaaaggaaaataaaaacctcgtttcaaattatggacaaaacgcgtaacaaaaccggcacgttatgcaaaaatctacgcaacacactttttcgtcaccggctatga

SEQ ID NO: 193 - DNA, 657 bp, Klebsiella pneumoniae
ctacagagaagagacactgctatgcaacatatcattgagggcttcctcaacttccagaaagagatcttcccccagcgtaaagaactcttccgcagcctggcctccagccagaatcccaaagcgcttttcatctcctgttctgacagccgtctggtgccggaactggttacccagcaggagccgggacagctctttgtcattcgtaatgccgggaatatcgtgccgtctttcgggccggagccgggcggcgtttccgcgaccatcgaatatgccgtggttgcgctgggcgtgacggatatcgtgatctgcggccattccaactgcggcgcgatgaaagcgatcgccacctgtcagtgccttgagccgatgccggcggtgtctcactggctacgctatgccgatgccgcgaaagcggtggtggaaaagaaaacctgggctagcgaaaccgataaggtcaatggcatggtgcaggaaaacgtcatcgcccaactgaataacatcaagacccatccttcggtggcggttggtctgcgcgaccataccctgcgcctgcatggctggttctacgacatcgaaaccggcgatattcaggcgctggataaaaacacgaaatcctttgtttcgctgtcggaaaatccggacgtctttttcgaataa

SEQ ID NO: 194 - DNA, 1041 bp, Klebsiella pneumoniae
cgattaacgagggggacagctttgtcgcccatatcgaaggtattggctcagtcgcggcacgcttcgtcgccgccggagaaggagatcgtgatgcgtaaacgtaaagttgccattatcggctccgggaatatcggcaccgatttaatgattaaaatcctgcgccacggccagcatctggagatggcggtgatggtcggcatcgacccgcagtcggatggcctggcccgcgcccggcgcttgggcgttgcgaccactcacgaaggggtgggcggcctgatgcagatggcggaatttgccgacatcgattttgtttttgacgccaccagcgccggggcgcacatcaaaaacgatgccgcgctgcgcgaagcgaagccggggatccgcgttatcgacctgacgccggcggcgattggcccgtactgcgtaccggtggtcaacctcgcggacaatctccatcagggcaacgtcaatatggtgacctgcggcgggcaggcgaccatcccgatggtcgccgcggtctcgcgagtggcgaaggcgcattacgcggagattgtggcctcgatcgccagccaatccgccgggccgggcacgcgggccaatattgacgaattcaccgaaaccacctcgcaggcgattgaaaaagtcggtggggcgggtaagggcaaagcgattattgtactgaaccctgcggagccgccgctgatgatgcgcgataccgtctacatcctgagcgagctggcgtcgcaggaggcgattgccgcctcgatcgccgaaatggcggcggcagtgcaggcttacgtcccgggctaccggctgaagcagcaggtgcagtttgaggttatccccgaggacaggccggtcaacctgcccggcgtcggctgtttttccggcctgaaaaccgcggtgtacctcgaagtggaaggggcggcgcactatctgccagcgtacgcgggcaacctcgatattatgacctcggcggcgctggcgacggcggagcaaatggccggggcaatgcacagcgcggcgggagcgacagcatga

SEQ ID NO: 195 - DNA, 702 bp, Klebsiella pneumoniae
gtcatgcagagcaaaaatattctgattatcgaggatgacgccgatgcggcagaggtgctggaagcctatctgcgtcgggaaagttacaccgttcgcgtcatggcggacggtctctcagggcttgagcaggctcaacgctggcagccagacctgatagttctggacgtcatgttgcccggcctgaacggcactgaagtgctggcgaaaatcaggcgtagtagcgacgttcccgtcattatggtgacggctatcggggatacgcccgatcgtatcggtgcgctgcgctatggggcggatgattacgtggttaagccttatcatcctggtgaagtcgttgcgcgtgtgcaggccgtgctgcgtcgtagcggtggcagcagagatccgcaggaagaggtgttgcgctggcaggggatggaggtcaatacgggagcgatgacagtcactgtggctgacagtaaaggcagggtaaccagtgttgacgttacacccacagaattcaatctgctggtcacaatgatgcgcgccccggttcgcgcgctgagccgtcagtttcttctggagcagtgtctgccggacagcgacgcgctggaacgcgtggtggacacccatatttataatctgcgtaaaaagctcgagtcagccgggcagtctgacgtgctgctgaacgtgcgtggcgtgggttacaggtttcgtcagccatga

SEQ ID NO: 196 - DNA, 1437 bp, Klebsiella pneumoniae
accctgaggagcgacgccatgtcattaatgattaaaaatgcccatgccatcctcagcggtctgcccggagaggcggcgcggctggccgggccggatattcgcatccgcgacggcaagattgccgccatcggcagcctgacgccgctgccggaagagcgacagatcgatgcccgcgactgcgtgatctatccggcgtgggtgaacacgcaccaccatctttttcagtcgctgctgaagggcgagccgcaggggctgaaccagagcctgacggcctggctgagcgccacgccgtaccgctttcgcgcggctttcgatgaacatacctttcgtctggcggtgcgcattggcctggtggagcttctgcgctcgggctgcgccagcgtggcggatcacaactacctgtactggccggatatgcctttcgatacctcggagattgtcttcagcgaaggggaagcgctggggatgcgcatcgtcctgtgccggggtggggcgacccagggccgggcggtggaacaggatctgccggtggcgctgcgtccggaaaccttcgacggctatatggcggatgtcgaacggctggtcagccgctatcacgacccccggcccgagtctctgcgccgggtggtgatggcgcccactaccgtcctgcactccgcgccgggcgcccagctgcgggagatggcgaagctggcccgccagctggggatccggttgcacagccatttatcggaaaccgtcgattatctcgacgccgcgcggcagaaattcgccatgacgccggtgcagttctgcgcggaacacgactggctgggaaatgacgtgtggtttgcccatctggtgaagctgctgccggaggagattgccctgctgggccgtaccggaaccggcatcgcccactgcccgcaaagcaacggccggctgggcagcggcatcgccgatctgctggcgttagagcaggccggggtcccggtctcgctgggggtggacggcgccgcctcgaatgaagcggcggatatgcaaagcgaagcccatgccgcatggctgctgcagcgcgcgcgcaaggggatgctggcgcagccgcgctacgccgggggcacctttgagggtggggccgatgcggccacggtggaggatgtagtgcgctggggcagcgccggaggggcgcagatcctcggcttagcgcagagcggcaccctgcaggtcggcatgcaggcggaccttgccatttaccggctggacgatccgcgctacttcggcctgcacgatatggccattgggccggtggcctgcggtgggcgcgccgcgctgaaggcgctactgctcaatggccgccccatcgtggaagacgacgccattcccggtctcgaccttgacgcgatgcgtcacgacgcgctggcggccgtccgtaccctccaacagcgcgccgctgtttaa

SEQ ID NO: 197 - DNA, 507 bp, Klebsiella pneumoniae
aattcacttggtcagtcagcagcgggcaggtactctgcaccggcaagaagaggatttgtcagggagttgtggatgactaaaggctataaactacttggctataagttagcggataatattttctactgcctgcatcatcgggaaattatcacgctgcgcgggacacggacgcaagtccagctacgcagcaccatggcctgtttactggagtacctgctggcgcacggcagagaacgtctggtcagcgatgaagagttaatgattaacgtttgggaaaaaaataatctccgcccttccgcgcagcgcctatggcaggttattcagagcttaaagtctcgcttacaccaggctggcgtggagagcgcgttaatcatccgcgttaagtgtgcggggtattatattaataacgtttacgtagccgaaatttattcatacaaaccgccggggatgatgaattatataaacacttcgcctgctgatatgaataagcttctggtacgcagctaa

SEQ ID NO: 198 - DNA, 1104 bp, Klebsiella pneumoniae
ttaaaggttggtatcatgtataagaaaataagtggtttagtggtttcactgacggccgttttcgcctgtgccgcctgggcggaggtgcctgcgggctatcccgcggattatcaaaaaacgattgatgccgccgtaaaagagggcaaggtggtgatctattccacgaccgacaccaaagcggccgggccgttaattaagggatttgaagcgcaatacccgggcgtcaaagttgaatataacgacatgaacagtactgagctgtataaccgctatatcagcgaacaggccgccgggggcggcagcggggatgtggtgtggagctcatcgatggataccgcgctgaaattagccaccgaatacgccgaacaatatgcctcgccggaggtgaagcaattacccgactgggcggtctggcagcagaaagcctatggcaccacctacgagccggtggtgtttatctataacaaacggctgatcccgcagaatgaggttccggattcgcataccgcgctggcaaaactgatcgccagccaggccgataaatttaaaggcaaagtcaccacctacgatatcgaaaaatcgggcctcggctttatgctggcggtacaggacagccaggccgacgcgaactattttgccgacctggcgaatatcgccaaaggcggcctgacggtgcagtcttccaccggcacaatgatggagcgcgtctcctccggcgaaaacctgatcggctataacattcttggctcttatgccgaagcgcgggcgaaaaacgatccctctttaggtattacctatccgaaagattacgtgctggtgctctcccgcgtctcgtttattagccaggagagcgaacatcccaatgcggcgaaattgtggctggattatgtcctgtcggaaaaaggccagcagatcctcgccagccaggcggatattccctctattcgtcgcgatattgcaggtaaaaatgatatcgacggcatgaccgcgctgctgggcaaagcgttaaaaccgatcccggtcaacgaaacgctgctcgattatttacagccgcaaaaacgtctgcagtttattaaacaatggcgcagcgccgccgcgaaataa

SEQ ID NO: 199 - DNA, 189 bp, Klebsiella pneumoniae
agtgctgctggggggcatcgcggcggcgtgcctggtgacatggtttaccttttgccctcgtttatctttattctcgccggcgggtcgtttattgaaaccacccataataaagtgggatttaccgcgccgttggccgccgccgcggtgggctttatcgtccatatggcgggactgtccggcgcaggatga

SEQ ID NO: 200 - DNA, 918 bp, Klebsiella pneumoniae
gcgcccgctggatcgccccgcagacggtgctgcgagcgctgctggagtacgatccgcgtaactttgagcagcggattatcgtcgatctgcgtctggtgcggctggcggcgggcgctgctgaccggcgcggcgctcggcgtcgccgggctgctgctgcagacggtgatccgtaacccgcttggcgagccgcatattctcgggcttaacgccggcgcctcgctggcggtggtggcgacctcggcgctgggcctgtccttcggcgctttccccgccgggcgcccgctgaccgccgcctgcggcgcggggctgctgttcggtggcgtgatggcgctggcctctgccgggcgcggcggggcgacgccgctgcgcatcacgttgtgcggagtggcgctgtcagggtttgcgtcggcggtgacggcggcgatattaattctcgatgaacagacgctgctggcgatgcgcacctggctggccggcgacctggccggactgaactggagcacgctgcagacggcgctggttccagcgctgatcggccttggcgtcgcgctgctcattgccccacgcctcaacgtgctggcgctgggggataaggtggcgctgggccttggcgttaatctcgtccagacccggctgctgggcctgctggcgattgcgctgctgtgcggcgcggcggtggcggtggccgggccgatcggcttcgtcgggctggtggtgccgcacatggtgcgccgtctggtgacggaagacatccgcctggcgctgcccctggccgcgccggtgggagcgctggcgctggtgctggcggatatcgccgcccggacgctggtcgcgccgcaggagctggccaccggagcgatgaccgccctggtgggcgcgccgttgtttatctttatcgccgcgaggttttttaaatga

SEQ ID NO: 201 - DNA, 828 bp, Klebsiella pneumoniae
tatgcatccggcggtctggtaaaaaaatgccgggccgccgccttgcctgtccgcgtcccctggcctaaggtaagacatcattccctgacgcttatcgtccctatggcttacacctcccgtttgctcaatgcgatccctggcatccgccacgcttttctcgatgtccatgaaaccgccgcctttccctatgccgagctggctccggtgaagctggtgcatggtaatgaggttcatcattatcagcagccgctgccgacgcgcccgcacgccgacgcggtgtttaccgcggtagccgggcaaaaggtgggggtggtgaccgccgactgtctgccgctgctgatcgcctcgcgcgacggtcgctacgtctgcagcgtgcatgccggctggcaggggctggtcagcggtattgtcgacaacagtctggcctgttttcgccagcagggggtggcattggccgatctggtcatcgccgtggggccgcatattcacccctgctgttacgaagtctccgccggattctatcagcaactgctggaccagcccggcggtgaccgggtggcccgccatcgccagcggctgttccactcccgttcgggcccggtcagcgatccgctcaaagccgccgcacgcggcagcgataatctgtggtttgatctgcgggcctttgccgaagcgatcttcgcagaggcgggggtggcgccggcgagcgttgaatggctggggagttgtacctactgcaccccgcagtcgctgggctcctaccggcgccggacccattttccggcgccgaagagctttcagtattcgtggatcatgcgcgaagcctga

SEQ ID NO: 202 - DNA, 993 bp, Klebsiella pneumoniae
cgaatttgcggaggcgacagcatgagcgatcgctatgttattgaagtggatggattgaagaagtattttccgctgcgcgacggcctctttggccagcagaccggcgagcttcgcgcggtggacggcgtcagctttaacatccgtccgggcactatttttggccttgtgggcgagtccggcagcggcaaaaccaccgtcggccgaaccctgcttggcctgtacgagaagagcgccggcagcgtgaaatttcacggtcaggagctggccgacctgaccgcgcctgccctgcgcgctatccggcccaggatgcagctggtgtttcaggacccctatagctcgctgaacccgcggctgcgtattggcgacgcgattggcgaagccatgctggagcacaaactgtgcgcccgcaatgagctatatgaccgggtgatcgacgtgatgaagatctgcggcctggcgccggaacactatgcccgcttcccgcatcagttctccggcggccagcgtcagcggatcggtattgcccgggcgctgatcctcaacccggattttatcgtcgccgatgaacccatctcggcccttgatgtgtcgattcaggcgcagatcatcaatttgttttccgacctgcgcgacaaccgcggggtcacgtttctgtttatctcccacgacctcggggtggtggagcatttatgtgacgatgtggcggtgatgtatctcgggcaactggtggaaagcgccagccgcgatgcgctgttcagccgccccctccatccctatacccgcgccctgatggctgcggtgccgaccctcgacccgcacagcgaaccgcaggcgctggtgcaaggcgagatcccggatccggccaatccccccgccggctgccgcttttcatcccgctgcccgctggccagcgaacgttgccgcagagagcctccggcgctgcgcgagttggccccgggccatcgggtcgcctgccattgggtcgcatcctga

SEQ ID NO: 203 - DNA, 360 bp, Klebsiella pneumoniae
ccagcgcgcgggcaatcagcaccagctgctgctggccgccggagagggcgccgaagtcatcttcggccagggcggcaatccccagctgcgccagcgcctgctcaacccgccgggcatcctcctcgtccggctgggcaaagagatccacgtgacgggcccggcccatcagcaccacatcgctcacgcgccagcggaaagcgggacgaaacgactgcgggaccagggccacgccgccctcgcactgcacctcgccgcccagcggcggcagcacgccggtcagggtatccagcagggtgctttttccccggccattggcgcccagcaccgcccagatctcaccgggacggcaggccagcgtga

SEQ ID NO: 204 - DNA, 207 bp, Klebsiella pneumoniae
aaattcagcggcgaggaacaggacgttttaaacacctccagtagggaatgttctgtagttatctatctgatattattttattttaattatattgggttggcacagcctcgctgtagtcagcgtccccgtctgaagacgatggcgagtattgactactacattcatccccgtcatgatcaaaagagaatgagatttattttgatttga

SEQ ID NO: 205 - DNA, 393 bp, Klebsiella pneumoniae
gcgcgcagcggaaagtcgtcgccttcggtacggaacaggtactcccagcggtcgccgaggtacatgctggtcagcagcggtagctggaggctattatcctgcgcggcgccgtcaagtcgcaggcgctcgacgcggatcaccgccgtcgccggctcgccaacgctaaccccctcgcccgctcgcccccacaggctccagctggcgccttcgatccgtgccctgccgttctccagcgccatcactttgccgtgcaggcggttattgctgcccataaactcagcggcgaacagcgtcgccgggctgccgtacatctcctgcggggtcccctgctgctcaatgacgccattgttcagcagcaaaatacgatcggagatggccattgcttcattctga

SEQ ID NO: 206 - DNA, 573 bp, Klebsiella pneumoniae
gaagctgcaggaggcctcatgaaccggaagctactgtttatcccgctggtgctgtttctggcgctggccgccgcgctgttctggcaactgatgcgcaacgccgagggcgatgacccgacgaccctcgagtcggcgctgattggcaaaccgctgccggaatttcgccttgaagcgctgaatacccccggtcagacgctggaccgacggacgctgattgacggcaagccgctgctgctcaacgtctgggccacctggtgtccaacctgtcgcgccgagcatcagtttctcaacggcctggcgcagcagggcgtgcgggtggtggggatgaactacaaagacgatcgccagaaggcgatgagctggctgcagcgcctgggtaatccctacaggctgagcctctacgacggcaacggcatgcttggcctggatctcggggtctatggcgcgccggagacgtttctcatcgacggtcagggcattatccgctggcggcacgccggcgacctgaacgaacgggtgtggcgcgaggagctccagccgctgtgggatcaatacaaccggagggcgggctga

SEQ ID NO: 207 - DNA, 918 bp, Klebsiella pneumoniae
gcgttaccgggatcgtcaggtgaccgtgctggagtgcggctaatggcccagggggagaggctgtttgtcaaagttacccgcgaactcctgcctcaggtaaaagataaatatccttttctctatcttgagcgcgggcggctggaaattgatgacagcagtgtgaaatgggtggatgcggatggcaacgtggtgcctctcccagtggcgaccatcaacacgctgctgcttggccccgggacaactgtgactcatgaggcgatcaaaaccgcaactgcggctaactgtgcggtgtgctgggtgggcgaggatagcctgctgttttatgccgccggttttttgcctactgcagatacccgcaatcttaaagcgcagatggcgctggcctgcgatgcatcgtctgccctcaaggttgcccgggcgatgtttgctaaacgctttccggatgccgatctggagggtaaaagtttaaacagcatgatgggcatggaggggagtcgggttcgcgcgttgtatcagcagaaagcgcaggagtatggcgtcggctggaaagggcgtcagtttacaccaggcaagtttgaactgagtgacctgacaaaccaggtactgacctccaccaacgccgccctgtatggcattttatgctcggttgtgcatgcgatgggctactcgccgcatatcggctttatccattcaggtagccctttaccgtttgtctatgatctggccgacctttacaaagaacggctctgtattgatttggcattttcactctcgagggaaatggcgggccgctacgataaacacaaagtctctgaggcattcagaaagcgagtgatagccctggatttgctcaacctgattgcggccgatatcaatgagctgatgggagggaaaggtgctcgtcgtactggcaaatga

SEQ ID NO: 208 - DNA, 210 bp, Klebsiella pneumoniae
ggttgtcagggccagaccggccatatacatcagcatttttccgggtatcattatgtcacctcgttatttgttcgttatccgcccctgcccgggcggccgcatcgcgaatccggagtgtcacgcagctgtgtcaataaacagccagggatttatgaagaaactgtcaaggtgagtcatgcagagcaaaaatattctgattatcgaggatga

SEQ ID NO: 209 - DNA, 1803 bp, Klebsiella pneumoniae
tggggagagggcgtaatcatggccaccgtattgaaaaaaaccgatgtcgcgatcgtcggcttcggctgggttggggcgatcatggccaaagagctgaccgaagcggggctcaacgtcgtcgcgctggagcgcggcccgatgcgcgacacctggccggacggcgcctatccgcaggtgattgatgagctgacctacaacatccgccgcaagctgttccaggatctgtcgaaaagcaccgtcaccatccggcataacaccagccagcaggcggtgccctatcgccagctggcggccttcctgccgggtaccggcgtgggcggcgccgggctgcactggtccggcgtccatttccgcgtcgatcccattgagctgcggatgcgcagccactatgaagaacgctacggcaaaaacttcatcccccaggatatgatcatccaggatttcggcgtcacctacgacgagctggaaccgttcttcgataaagcggaaaaagtattcggtacttccgggaccgcctggtcgatcaaaggcaaggtcgtcggcaaaggccgcggcggcaacgccttcgccccggaccgctcggacgacttcccgctgccggcgcagaaaaacacctggtcggcgcagctgtttgaaaaagcggcgctggaagtggggtatcacccctataacctgccgtcggccaacacctccgactcctataccaacccctacggcgcgcagatgggcccgtgcaacttctgcggtttctgcagcggctacgcctgctacatgtactctaaagcctcgccgaacgtgaacattctgccggcgctgcgccaggaaaaacgctttgagctgcggactaacgccaacgtgctgaaggtcaacctgaccgacgacaaatcccgcgccaccggcgtgacctacgtcgacggccaggggcgcgaaatggaacagccggcggacctggtgattatcggcgccttccagttccacaacgtgcacctgatgctgctctccgggatcggcaaaccgtacaatccggagaccggcgaaggggtggtagggcgtaacttcgcctaccagaacatgaccaccatcaaggccattttcgacaaagacacctataccaatccgtttatcggcgcgggcggcaacggcgtcggcgtcgacgacttcaacgccgacaacttcgaccacggtgcggcgggctttgtcggcggttcgccgttctgggtcaaccaggccgggaccaagcccatctccggtttcccggtaccgccgggcaccccggcgtggggcagcaagtggaaagcggcggtggccgatacctacacccatcacctgtcgatggatgcccacggcgcgcaccagtcctatcggcagaactacctcgatcttgatccgaactacaaaaacgtcttcggccagccgctgctccgcatgaccttcgactggcaggaaaacgacatcaagatggcgcagtttatgttcgataagatggcgccgatcgctaaagcgatgaagccgaaatatatcctcggcagcccaaaaaacgccaacagccactttgataccaccacctaccagaccacccatatgaacggtggggcggtgatgggggaagatccgaaaaccagcgccgttaaccgttatctgcaaagctgggacgtgcataacgtcttcgtcatcggcgcctccgcgttcccgcaggggctgggctacaacccaaccggcacggtggccgcgctggcctactggtcagcgaaggcgatccgtgagcagtatctgaaaaatccgggtcccctggtgcaggcataa

SEQ ID NO: 210 - DNA, 753 bp, Klebsiella pneumoniae
cgatatcctatggcaaataccactctcacgctgctggcggcgggaagcctgagaagcgccttcctgccgctggtggcgcactttcggcagcacactggcctggcggtcgatgcgcagtttggccctgccggcctgctgcgcgagcggatcgaagccggggcgccgtgcgcggtttttgcttccgccaacgcggcgcacccgcaggcgctgctgcaggcgggtctggcgcaggaatgccagggatttgccagcaaccagctgatgctgaccgcccggcggtcgccggacaacgatagcctggactggctggcgctgctcagcacgccccgcctgcggttggcgacctccacgccaggctgcgatccgtcgggagattatacctggcagctgttcgcccgaattgaggcacgttatccagggttgggcaacgcgatggccgggcgggcgcagcagctggccggcggcagagactcactgagcgtgccgccgggagagatagccggcgcgtggcttattcgccaggatctggcggatctgtttatcggctatgcgcactatggccccgcgctggccacctgcgacgatctgcgtaccctgaccatcccggcgccgtggaatattcgctgcgattaccagctggcgcgtctcagggccgaccccgccgcgctggccctgtatcgctttatcctcggcgacgttggtcaggggtatctccggcaggcgggttttatgccgttcagcgacgcagcgtaa

SEQ ID NO: 211 - DNA, 774 bp, Klebsiella pneumoniae
ggaaggactatgacgggattccgttgggagatcatcgaggagtacggcccgctgtttgtggacggcgccctgatgacgattaaatgtaccattatctgcgtgatcctcgggacgctgtgggggttaactctcggtctcgggcggatggcgaaggccgagcacgggccgtggaaatatattctccgctacctggtgcagtttccggtgcgcttttacgtcagcgccttccgcggcacgccgctgttcgtgcagattatggtggtgcactttgcgctggtgccgctgtttatcaatccgcgcgacggcctgctggtgaccagcggcctgatgagcgccgactttgcccgcgaactgcgcgccagctacggggcgttcctctcctgcatcgtggcgatcacccttaacgccggagcctatgtgtcggagattttccgcgccggcatccagtcgatcgacaaagggcagatggaggcctcccgcgcgctgggcatgccgtggtggaaaaccatgcgcaaggtgatcctgccgcaggcgtttcgccgcattctgccgccgctgggcaataacgccatcgccattgtcaaagactcgtcgctggcctcggcgattggcctggccgatctggcctatgccgcgcgcaccgtctccggcgcctacgccacctactgggaaccctacctgaccatctctctggtctactgggtgatcaccttcctgctggcgcagctggttaaccgtctggaaaagaggtttggcaaaagtgattcacattaa

SEQ ID NO: 212 - DNA, 1125 bp, Klebsiella pneumoniae
ggaattcatatgtttcgactttaccagtcacatgatttaatacgccaattaaatcctgaagactttcaatatattttaacaccagcaggttcgctaagagaagcgtgtatacattacgacctctcctgtgaggcgaatggtcacagcctcgcttttggcctaccgaaggaaatatacaactcatctccacataaaaggccctatgaacgaaggcaacgtagctatgcagatcctatctatgatgaggtagagcacaggctacaaattggctggcttgttggtgtggatatctccaggtgttggagcagtgacagaaatccattttacatcgacgacaatggcgatttaatttttacccctaccgcttcgtcataccatgcgtggtttaaggacgaaattatgaacgcctacaggcacacgattgccgatcgccaaggaaggaggccagctcccactcagcgtatacaacacaattataatggctcaagaatcgcaccagcgtcaaagacactaaacagtaagaccattggccgactgctagccgctggcggtatatataatggcaaccttgaaggattccatgaaacagcgttgcaactgggtggggatgcgcctgcaggttacgaccagattatgggcaataaaggattactcattgcaggagcctctttcgctgcaggattaacaatgggtagattgaatcctttaagtgagttagatgagttatcgagtctcagtaaaataccagccttcgaaagcccgtatgtgaagggcttcatctctgagaacggtacgttagtgaatgctgaatacgccgttatcgatccgaaaaaactcgcgacgtacgctttagattcaacacatcctacaggcggtcataaggctcgggtgtttgagtctgccctggggtacaacccaacgaatgcggatgtcttagcagcacgaattcagaagggcgtattatcggccccggcaacgattttgcagacaaacaactacggtcaaacaatggctgtagatatgccaattttaggcatcaatggtgaaacggcggtcatccgtacaggctggatgtatgaaacagatgcgctcgttcctcgcctgacaactatttacgttaaatag

SEQ ID NO: 213 - DNA, 456 bp, Klebsiella pneumoniae
gaagctaatatcgctgtcgacgtggtcgggcttgccgtagtttttccgtttgccgtgatcttcagtggactggcctttattttgccctttattgccatggtcgccactgttaccgttgttaccatgattgccgctattgccatggttaccactgttcccgtgattaccaccgccgttgccattgccattacccgggttggcatacgctggcgcggccatgacggcaagagaaataaccgccgccagtgctgttttgagagtgcgacgcttaagcatgatgttgataccttaagagggagtacacgcttaaaaaataagataaagctataccccaggcaatctcatgttgtcttatttttttgcccttatttaattagcggcgggaaaagggtagcgggacgcggacgagcaattccattgctgcgttttgacagacgggcgaccgcgccccgctaa

SEQ ID NO: 214 - DNA, 183 bp, Klebsiella pneumoniae
gccggtaatatttccccggccgccgcctgcaaaattatggatagatttccctgtccgttggggcgtatttccccgaccgagaccgaaataagatcgtggctgtgcattaccgttttctctccctcactccgctgtctgcagggcggccaggggcggcgaagagataactccccttcgcggtga

SEQ ID NO: 215 - DNA, 441 bp, Klebsiella pneumoniae
ctatcttgtatctattgtccggctagcgccttcagctggcgatatcccatccacaggagaagagaagatatgttcgatcatgtgaaattcggcgttagcgactatgccgccagcaaagcgttctttttgcaggccctggccccgcttggcgtaacgctggttggcgaaggcgaaccgagctacggcgcagagttggccggcagcggcgatgcttctctatgcctctatcaaagtgcggaaaaaccggcgccgctgcacattgcctttcgcgccgacagcagcgagcaggtcgatgccttctggcaggcggcgctggccgccggaggaaaggacaacggcgcgccggggctacggccaaactaccacgccagttactacgccgcgtttgtgattgcgccagacgggcacaatattgaagccgtgtgccatctggcggggtaa

SEQ ID NO: 216 - DNA, 240 bp, Klebsiella pneumoniae
atacctggtatgggcgtcagcgatgtgcagagcagccgtagccgctatacgcgttacaaagcaacaggcggattttgcggtgttgaaactacagtgacgtggagccatcagtttgatccacactgggcctcactcgtgagcgcagactacacatggcttggcgatcatgccgcagacagcccaatagtatcccggcgtaatgaagccacgggcaccgtgggttttacttattcattctga

SEQ ID NO: 217 - DNA, 1278 bp, Klebsiella pneumoniae
cgccttctcatcatgcgccgcagtctccttacgcaccttcgccacatcgctggcgctgaccgccggcgcgttgttgccccagctggtgcggatgaaattgaccacatccgccacctgctggtcgtccaggcgccagccgaacgacggcatggtcaggttggagaccgcatctttcaccgccggcgtggtgctcccggtcagaacgatgtggataagcgaagtggcatcttccgtctggaccaccgggttgcccttcagcgacgggaaggcgcgtttatagcccgcgccgtcggtacggtggcaggcggcgcagttatcgacgtacagcgcggcgcctgttttgctgtcgttacccttccacagatctttcgccacgctgtcttccaccggggctggggtctgtttgccgccgcgcggcgggagcgatttcaggtagcgggcgatggaggtgatgtcgtcatcagagagatactgcagactatgctccaccacatcgctcatgccgccgaagaccacggatttatcgttgcgtccggttttgaggaactcggccagctcggcttcgctccaggtccccaggccgtcgcggttttcgccgcgcaggctggaggcgacccagccgtcaatcggcgcattgctacccgccaggtaatcatcgccttcgctttcgctgagcgctttttcctgcatcgtcaggctacgcggggtatgacaggcgccgcagtggcccaggccttccaccagatagcggccgcgctccagcaccgggtcaacctgcgggttggcgacaaagtcgctcggcgtcggggcgaagatgccgcgccagaacgccagcggccagcgcatcgacagcggccatgggatgtcggtgtccttgttggcgacattcaccggctccacgccgtgcataaagtaggcgtacatggcgcgcatgtccgcttcgctgatccgcgcaaacgagggatacggcatcgccggatagagcgtggaaccgtctttccgcacgcccttgcgcaccgcgtcgtcgaactcttcgaaggtgtacccgccaatgccgtgttctttatccggcgtgatattggtggagtagatggtgccgatcggcgtctccatcggcaaaccgccggcgaaaggtttccccgctttgccgttggtgtggcaggcgacacagtcccccgcccgcgccagatactccccctgcttaatcagattgctgtccgcaggcgcctcttcggcgaaggccgcgcagctcaatgccccaagcaccagggccgataa

SEQ ID NO: 218 - DNA, 894 bp, Klebsiella pneumoniae
ggagagatcatgaccgatattgctattgttgctgccgtacgcaccccgataggcagctttcgcggcgccttcgcccctctttccgccgtcgacctcggcgcggcggtggtgcgcggcctgcttgaacgctgccagctgcccgccgcagcggtcgacgaactaattttcggccaggtgcttaccgccggctgcgggcagaacccggcgcgccagaccgcgctgcgggccggcctgccggtcgacactccggcggtcaccgtcaatctggtgtgcggctccgggctgaaagcggttcagcaggcggtgcaggcgatccgctgcggcgacgccgggatcgttatcgccggcggccaggagagcatgagcaatgctccctatctgatgcatggcgcccgcgacggcctgcgtttcggccacgccagcctgcaggatagcatgatccaggacggcctgtgggacgcctttaacgactaccacatgggcattaccgccgagaacctcgccgacgccttcgacatcagccgcgagcgccaggacgccttcgccgccagctcccagcgcaaagcagcggccgctatcgccgccgggcgctttcgcgaggagctcgttccggtcagcgtcccgcagggcaaaaagccgccgcgagtcgtgactgacgatgagcaaccccgcccggagaccagcgagcagcagctggcccagctgcgcccggcgtttcgcccggctgacggcagcgtcaccgccgggaatgcctcgtcgctgaacgacggcgccgcggcggtcctgctgatgcgcgtcgataaagcgcgcgagcttgggctgccggtgctggcgcgcattgtcagctcagcggtcaccggggtcgacccgtcggtgatgggcatcggccggtga

SEQ ID NO: 219 - DNA, 1689 bp, Klebsiella pneumoniae
gggggtcacatggacaaacagtatccggtacgccagtgggcgcacggcgccgatctcgtcgtcagtcagctggaagctcagggagtacgccaggtgttcggcatccccggcgccaaaattgacaaggtcttcgattcactgctggattcctccattcgcattattccggtacgccatgaagccaacgccgcatttatggccgccgccgtcggacgcattaccggcaaagcgggcgtggcgctggtcacctccggtccgggctgttccaacctgatcaccggcatggccaccgcgaacagcgaaggcgacccggtggtggccctgggcggcgcggtaaaacgcgccgataaagcgaagcaggtccaccagagtatggatacggtggcgatgttcagcccggtcaccaaatacgccgtcgaggtgacggcgccggatgcgctggcggaagtggtctccaacgccttccgcgccgccgagcagggccggccgggcagcgcgttcgttagcctgccgcaggatgtggtcgatggcccggtcagcggcaaagtgctgccggccagcggggccccgcagatgggcgccgcgccggatgatgccatcgaccaggtggcgaaacttatcgcccaggcgaagaacccgatcttcctgctcggcctgatggccagccagccggaaaacagcaaggcgctgcgccatttgctggagaccagccatattccagtcaccagcacctatcaggccgccggagcggtgaatcaggataacttctctcgcttcgccggccgggttgggctgtttaacaaccaggccggggaccgtctgctgcagctcgccgacctggtgatctgcatcggctacagcccggtggaatacgaaccggcgatgtggaacagcggcaacgcgacgctggtgcacatcgacgtgctgcccgcctatgaagagcgcaactacaccccggatgtcgagctggtgggcgatatcgccggcactctcaacaagctggcgcaaaatatcgatcatcggctggtgctctccccgcaggcggcggagatcctccgcgaccgccagcaccagcgcgagctgctggaccgccgcggcgcgcagctcaaccagtttgccctgcatcccctgcgtatcgttcgcgccatgcaggacatcgtcaacagcgacgtcacgttgaccgtggacatgggcagcttccatatctggattgcccgctacctgtacagcttccgcgcccgccaggtgatgatctccaacggccagcagaccatgggcgtcgccctgccctgggccatcggcgcctggctggtcaatcctgagcgcaaagtggtctccgtctccggcgacggcggcttcctgcagtcgagcatggagctggagaccgccgtccgcctgaaagccaacgtgctgcatcttatctgggtcgataacggctacaacatggtcgctatccaggaagagaaaaaatatcagcgcctgtccggcgtcgagtttgggccgatggattttaaagcctatgccgaatccttcggcgcgaaagggtttgccgtggaaagcgccgaggcgctggagccgaccctgcgcgcggcgatggacgtcgacggcccggcggtagtggccatcccggtggattatcgcgataacccgctgctgatgggccagctgcatctgagtcagattctgtaa

SEQ ID NO: 220 - DNA, 540 bp, Klebsiella pneumoniae
ggtatcaacatcatgcttaagcgtcgcactctcaaaacagcactggcggcggttatttctcttgccgtcatggccgcgccagcgtatgccaacccgggtaatggcaatggcaacggcggtggtaatcacgggaacagtggtaaccatggcaatagcggcaatcatggtaacaacggtaacagtggcgaccatggcaataaagggcaaaataaaggccagtccactgaagatcacggcaaacggaaaaactacggcaagcccgaccacgtcgacagcgatattagcttctcacgggcgcgctcccttgccgtgaactacggtctggtcggctatcaggcgctgccgccgggtatcgccaaaaatgttgcccgcggcaaaccgctccctccggggatcgccaaaaagaccctgccagcttctatgattaacgacctgccctattatccgggctatgaatggcgggcggtcggcgatgatctggtgctggtggccctgagcaccgcgatcgtcaccgccgtgatcaacggtgtgtttgactaa

SEQ ID NO: 221 - DNA, 597 bp, Klebsiella pneumoniae
cgaggtgacataatgatacccggaaaaatgctgatgtatatggccggtctggccctgacaacctcagctacagcccaggctgacagcagtgactcgcagaatggcgtggcaataggtgctggcgcacagtatgcgccccgttacagtggatcagaaaagatgcgtctccaggtggtaccgttctttcaggccagagaggatgccttcttcgcggatgcccggaaagggattggctatgacctgcagagtgacagcggactgtatctggagcataccctgggttacaaccttggacgggatgacaaagattcagactggcgcgacggtgccagcagcctgaaaggtatgggaaaaatcagggcgaccgttaacacggcgctggcagcaggctggcagtttactccctggttcagcgctgagggaaaggcaaccctgccgctcagcgatgatcagggtgttaattatcaggcctccgtcactcttttgccgctgcagagtgatacggacaccgtcgcgtaccacaccgcggccctgtttggcgacgcacgctacatgaatacctggtatgggcgtcagcgatgtgcagagcagccgtag

SEQ ID NO: 222 - DNA, 480 bp, Klebsiella pneumoniae
gctgccagcatcagtaacgccagcgcggccagggctattatcacactcatcacgacgtctcactctcattgttattgtaggggtacagaacgcgatactagggtttcagggcgaagcgcagctggtgttcccggcgcgactggatgcgctggtgccgggcctcgtcccagcggtaaaagccttgcccgctgcgggcgccggtgtcgcctcgcgccactttctccgccaccagcgacatcatctccgtgccgctggccagctccggcagcaggtgctggcagatatcctggactgtcgccaggccggtcatgtccgcagcctccagcgggccgaccatcgcatagcggcggcccagcgaggcgcgcatcacctggtccaccacctccggggaagcgatgccgctgtggacgatatgcagtgcttcgcgcagcagggcgaactgcagccggttgccgacaaagcccggcgcggcgcggttga

SEQ ID NO: 223 - DNA, 606 bp, Klebsiella pneumoniae
tttttcccaatatctcaccctcgattaaggaggatcatcatggatcaggttcctgcagacgttaccgccgaaagcgccggtaacgaatcgcctgccaaacgatttgtcggttacgtgattgagcgtatcgcgaaagacaatggctttgccgcccgccttaaacgagcggataacccggcgaccgagtatcagagctgggaaatcctggcggggtttggcattgacctggaaaaagagtggcaacgcctgccgtactgcgtcattggcgccgcgctggcaaaggcgaaaccggccagcaatggcacaatcactctgggggccgccattgccggttgttatcccgaaggcaatcagtctgaacaggcgaaagctcgcctgcgacggctgttggcctgtacttcgaccagcgaagcgtgccgtattttgcgcccgttgttggcattaatggccagccgcagtgtgacgccggatttcgcagggctactcaatgaactgcagtggttctccggcagcagtcgcgaacggatccgcgcccgctgggcgcaggaattctatcgtcgtgccggtgaggctgccgggagtgaggcgaggaattcacatgactga

SEQ ID NO: 224 - DNA, 288 bp, Klebsiella pneumoniae
gctccagcaatcaagcgtattctttatcacatcagggcaacaggccctttatcagacaccaaattaaggaatacgaccatgaaattcatcaaaactttcgttgctgttgctgcgctgtctctgttctctgctgccagctttgctcagagcgtcagcgccactgcctccacgctggaccgcgcggaagctaaaattgccgcccaggccgcagaacagggtgcatcctataaaattaccagcgcccagtttaacaaccgtgttcatatgacggctgaactgagcaaataa

SEQ ID NO: 225 - DNA, 894 bp, Klebsiella pneumoniae
aaaatgagaatgagtgtcaaacagttacgcgcgtttttagcggtagctcacactctgaatttcgcccacgccagcgaaaggctgaatctgtcgcagccagctctcagcctgaccatcaaagggttggaggaggcgctgggcggcgcgctgctgcagcgcagcacccgcaaagtgacccttacccaggagggggaactctttctgccgatggcccgtcagctgctggccgactgggataacgtcgaggaggccatgcgtcagagctttaccctgcagcggggtaaaatttcggtcgccgcgatgccgtcgtttgccgccaacgttctgccggaggcgctgaaagcctttcgcgaccgctatgccggggtgaacgttacggtgcatgacgtgattaatgagcaggtgatcgagatggtgcgcgaggggcgggtggagatgggcatcgctttcgagccatcgcccaaccacaacctgctgtttaccccgctggcggtggaccgcttcgtggcgatcgttccccaacaatccccgctggcgaagaaaaagcagctcacctggcaggagctgttgagcctcgactttattaccctgcagcgcccctcggcggtacgcctgatgctggaggaggcgctggcgcgcagcggacgtcagctggacgtggcgctggagagtcatcagctggtgacggtggggaggatggtggccagcggcctggggggcagcgcggtgccggcgctgtgtaaaacgcagatggcatcgttgggcgccgtctgcatcccgctcagcgatccgccgattgagaagtgcgtcggcgcgatccatgccggacatctgccgctgtcgaaggcggcgcaggcgctgctggatacgctgaaagggtttttacccacctga

SEQ ID NO: 226 - DNA, 444 bp, Klebsiella pneumoniae
cattatggaattaaaattatgttttctagtgagatcagtgaattcagatatcagctcacaaggcttgcaaggcaacttcggcgaatttctcagaacgatccccagtcgtggtcgcgcatgctggtcgtcagtgcaatagacaggatgggaaataatgtcaccccgtctgagctggctatggcagaagatatctacagctccaaccttgcagtgattctcagacagcttgaagaagagggcatggttgagagaaagactgatgccacggaccgcagaaagacgagagtccgtcttacagaaaaaggctgctcagtactggctgaaagccggaaacgccgcgatgactggctggcacaggcctttgatgaggctctgtcccctgaagaagcaacacacttgttaaaaatgacgccattgctgaataaactagcagaccatacttaa

SEQ ID NO: 227 - DNA, 1119 bp, Klebsiella pneumoniae
tttttcctgattgtaaaaggtattccacgccgcttcgctttggggatcggtgtaggcgcattcgacgacatagagcatagtgacctcgatgaacagatgatgtggcgcacaaggcgctttagtgagttttcatcatcctatcggctaaaaatggcgctgaaaaacgatgttaattcaagacttagtgatattctgtcactgactttcggtgagcctgcacaaggagcattggctatgcgtcgtaaaatccccagcagcgctgcgctactggcttttgaggccgcggctcgtcacggcaactttgcccgcgcggcggcggagctcgcgttaacggaaggggccatcagccggcagattgcccgtctggaagcgctcctcgacagtaaactcttcgacaggacggggagccgggtgcggctcaatccggcaggcgcccgctatgctcgtcaggtccgcgagatcctcgctcgtctggaacgggacacccatgacgtcagcgggatgcccgtcgatggccgcagcctggagatcgccgtgctccccaccttcgccagccgctggttaattccccggctcgggcgctttgcggcgcagcatccgcatatcgtggtcaatatcgccgcccgcagcgatcccttcattctgccgggaagcggatttgatgctgccatccattttgaacacccggcgtggaccggaatggaggtgacgtttttatttgcggagtatttgctgccggtctgccatgctgcgctgctgacggatgacgatcttccggggctgcttaaccggctaacgcgcattcaccggcggcaaaacccggacgcctggctgcactatgcccgcgagtgcggtctggcgctggataaccccgcccaggggccgcgctacgatctgcatgagatggcgatcgccgcggtacttagccagcagggtgtggccctggtgccgaagatgtatgtggaaagcgagctgagcgccggaacgctggttgccccgtggccgggctccccgacgctggctaagcgcttctgtttgatcaaacccggcggcggggagggggagccagcgctgcagatgtttgagcgctggctgcagacggagattgcggcaggttaa

SEQ ID NO: 228 - DNA, 1077 bp, Klebsiella pneumoniae
aattacatgattgagttatcggtagaaaatctgcatctcacctatggcgacaacccggtgttgaagggggtgtccatgacgctcggccggggggaggtagtatcgctgctggggccttcgggaagcggcaaaaccacgctgctgcgggcggtggccgggctggaaaaaccgacgagcggacggatcgccatcggcaaccgcacggtgtacgacggcacgccgcgcagcgagatcccggccgaagagcgtaacctcggcctggtgttccagtcctatgccctgtggccgcacaaaacggtgttcgacaatgtggcctatccgctgaagctgcgtaaagtggccgccggggagataaaagagcgggtgcagcgtgtgctggatcagctggggctggggcaccttggcaaccgccatccgcaccagctctccggtggccagcagcagcgggtggccatcggccgggcgctggtttacaacccgccggtgatcctgctggatgaaccgctctccaaccttgacgccaagctgcgcgaagaggcgcgggtgtttttgcgcgagctgatcattaagttgggcctctcggcgctgatggtcacccacgatcagaatgaagcaatggccatctccgatcgtattttgctgctgaacaatggcgtcattgagcagcaggggaccccgcaggagatgtacggcagcccggcgacgctgttcgccgctgagtttatgggcagcaataaccgcctgcacggcaaagtgatggcgctggagaacggcagggcacggatcgaaggcgccagctggagcctgtgggggcgagcgggcgagggggttagcgttggcgagccggcgacggcggtgatccgcgtcgagcgcctgcgacttgacggcgccgcgcaggataatagcctccagctaccgctgctgaccagcatgtacctcggcgaccgctgggagtacctgttccgtaccgaaggcgacgactttccgctgcgcgcctacggaacggcgctgcgcgatgccgaacactgccatctgacgctcccggcggaggatgtgtggatttttccgcagcggtaa

SEQ ID NO: 229 - DNA, 243 bp, Klebsiella pneumoniae
ttgataatgataaaatacgagccaaattctatgggaaataaagcaaaagacgacgacctgtaccaggaaatgtgccgcgtggtgggtaaagtcgtgctggaaatgcgtgacctgggtcaggagccgaaacacattgtcattgccggtgtgctgcgcacctcgttggcgaaccgcaaaatccagcgttcgccgctcaccgtggaggctatggagaaagtcattcatgcgctttccgggcactga

SEQ ID NO: 230 - DNA, 1401 bp, Klebsiella pneumoniae
gacgtcgtgatgagtgtgataatagccctggccgcgctggcgttactgatgctggcagcctatcgtggatacagcgtgatcctctttgcgccgatcgccgccctcggcgcggtgctcctcaccgacccgggcgcggtcggcccggcctttaccggcctgtttatggaaaaaatggtcggctttgtgaagctctatttcccggtgtttctgctgggcgcggtattcggcaagctgattgagctgtcgggattctctcgttcgattgtcgccgccgccatccgcatccttgggcgccgccacgcgatcccggtgatcgtgctggtgtgcgccctgctgacctacggcggggtgtcgctgtttgtggtggcctttgccgtctaccctttcgccgccgaactatttcgccagagcgggatccccaaacggctgatccccgccaccgtcgccctcggggcattctcgtttaccatggacgccctgcccggcacgccgcagatccagaatattattcccaccagcttcttcggcaccaacgcctgggcggccccctggctggggcttatcggctcgctgttcattatcatcttcggtttgctgtggctggagcgtcagcgccgcaaagcgcaggcccgcggcgaaggctatgggaccgacctgcaaaatgagccggagaccccggatgacatcgatctgccgcatccgctaatcgctatcgccccgttgctgctggtgggggtgctgaatctgctgttcacccactggatcccgcagtggtacggcgccagccatgagctcaacctgccgggcctggcgaagcctgtcgtcaccgaagtggggaaaatcaccgccatctgggcggtgcaggcggcgctgctctccggcattgtgctggtgctggtttgcggctatcgcaatatccgcggccggctggcggagggaagtcggacggcggtgggcggggctattctcgcggcgatgaacaccgcctctgagtatggcttcggcgcggttatcgccgccctgccgggtttcctggtgctgtcaaaagccctcgcggccattcccaatccgctgttaaacgaggcgatcagcgtcacggtgctggccgggatcaccggctcggcctccggggggatgagcatcgccctggcggcgatgtccgagacctttgtcgccgccgcccacgccgccaatattccgctcgaggtactgcaccgtgtcgccgccatggccagcggcggcatggacaccctgccgcacaacggggcggtgatcaccctgctggcgatcaccggcctgagccatcgccaggcctacggcggcattttcgccatcacggtgatcaaaagcctcgcggtactgtttgtcattgccacgttctatgtgaccggcattgtctga

SEQ ID NO: 231 - DNA, 1527 bp, Klebsiella pneumoniae
tcatcagtgatagagacaatgaaaaaaagggtatatctgcagatcctgttgccggtgctgatgacgcttattgttctgtcagtaactaactattttattgttttgtcccagaaggactaccagtcgagggtggctgaacggttattacaatactccgaacgggtagcagggcagttagcagatgctattgaagttgctgaaagctcaggtattgcaggctgtacaccagccggtatcaatcttttgagaaccatccgacaaaaaaataaatacattgatgatataggtatcgtcaacggcaaccgcattctctgtacggctggatggggaacattaaggagcagtattctcctgtcgtctcctccctaccagacgccgagcggatatttattgtacccggtcagaaaagacaatgttcatcttcgcaaccccggaaccgtaacgataaaacataatattgcagtagtatctcctgcgctgacgtttgccaacgtcctgaatgtgaatcccgacttttacattgccctggccgtgcgtaacgggcaaaagcagctcttttccctggggaaaaattatcttgccctgcaggcgacatcgggttctccttttcgtatcagtacccgccattgcagccagatccgcgatttatgtgtcacaacgaataaaccggacggtggggttatgtcactctcctggatgctgattttccttctgagcctgttcgggataattaccggttgctggatggtctcgcttatcgattcagctcttgaagctaaaaactcgctagaaaaacggtttatccgggcggtcaagaaaaaagatttttatattgagtaccagccgatcgttcaggccagcgacagagttgtggtggcgtatgaagccctggtcagatggcaggaccggtattttggccgggtatctccggagctgtttattggcctggccagcaggctaaaactgtaccagaaactatcaggatttgtgacggaaaccgctctggatgaaatgcaggaacatctgagaagaaatccttcactccggctttcactgaacgtaggtgataatgaaatgaatgactgtcagttcctggaacaactggtatcaggctgccgccgccttaaaattcagctccaacagatcaaactggagatcactgaaagttcacgatctgaatcaggtttgattgccgcattttgccagcgagccagggaatatggttttaatatttccctggatgatttcggtacaggaaccgcgaatatcgaatggctgacggtactggattttgatgagataaaaatagaccgaatttttattgccaatattgatgaccccgtgaagcgcgccttactggtttctgtggtgaaaggattacgtggcaccggaaaaccactggtgtttgagggggtggaaacacccgcccagtttaaatttatccgttatctggataagaaagcgctgatacaggggtggtttacaggaaaacctgcgccaatcgctgccttgaacatacaggtttaa

SEQ ID NO: 232 - DNA, 1314 bp, Klebsiella pneumoniae
cgccgcgcgatcgcagatcagccgcgactgccggtcgaacaggtcgctgagctgagcgctgaacagaccgcaggccagggtgtccagcgggtcatagctccccgccgggcagaaggcatcctgcacgttgtcgcagccgagcagggtggccacgccggcggcctgcgcctcgtgcagcagcgtgatcccccgctggcgcggcgtgcggccgaacgtcgcatcctgcagcagcaggttggtcatcggcagagcgataagggtgacgccgtgcgccgccagctggcgcaggatcggcgccgcctgttcgtcgctgccggcggccagcgcgcagccgtggctgcagcagatatgtccgggaaaagggtggcgggagagatgatccgccagccaggtcagcccctgagacacttcgctgagctcctcatcaatatgcaaatccagatccagatcccagcgggccgcgctgcacagcagattttccatggcggcggcgtcccagttggaggagtggatgaagccgcccagcaggcagcgctctccgctgttggcgaccgtccgggcgatggcctccgcttgcgctggctcgcgaaacaggggcagcgggaccagcgccacccgctccagggtgatgccgacggtatcgaggcgggcgatctcctgccaggcgtccggcgcgtcggcggtaaaccagtcgacatggctgcgcaaatgggtcacgccattcgctgccgcccgggccagcgcggcggacgcccgacgttgaatatccgccctggtccagtgccggcgatcctcgtgcatagcgtggatcgccgccagcagcccggcctgcgccggacggcagcgttcaatggtgaatgtcttgtccagatgggcatggggttccaccaggccggggagcgtcagggctcccgccaggtcccacaggccgggagtcggctggtcggttggggtcagtgcggcaatccggccgtcgcgaaaggccaggtccgccagcagcggctcaccgttggcccgcgtcggccagccgtcgggcagcgcccaggccgggagtcgggcgcggctgatcccggtgagcggcgcgcaagaggaggggaacgtcatcgtcagtctcctcacagatccaaaaccagaagcggggatttcgcccgcgaacagcagagcgtgatctggtcgttgtcggctttctcttccgccgtcagcacgctgtcccggtgctcggggatcccgtcgaggaccccggtaatacaggagccgcacattccctgttcacaggagagcatgacctccaccccggcgtgctgtaatacctga

SEQ ID NO: 233 - DNA, 671 bp, Klebsiella pneumoniae
accacaaggatatttcttcgccagcgagcatcacggctctcatttttcaggcagtccaaacctgcgcggaagggttgccgatgtgttaaattatcggccaccagaagagaaggagtcataacgaagatgaaatcgattggtattttctgcggttcttcagctggcgaacatccgctgtacctcgaaaccgcccgtctggttggacgtacgctggcgcagcaggggttggcgcttgtctatggcggcggcaaagttggtctgatgggggcggtcgccgatgcggcgctggaggccggtggcgtggtgatcggcgtgatgccgcgcggcctggtggagcgggaaattgcccaccgcggcttgacggagctgcatgtggtcgaggatatgcacgagcggaaaaccaaaatggcggcgctggcggatggctttattgccctgccgggcggggcggggacgctcgaggagattttcgaacaatggacctgggcgcagctggggatccatgagaaaccgtgcgcgttcctgaatattaagggttattacgatccgcttcaggcgatggtcgataacatggtacgggaaaggtttatgcacccgcgctacgcggagatgctgccgtttgctacctcggcagacgagattatcgccggttttcgcgactatacgccgcc

SEQ ID NO: 234 - DNA, 1449 bp, Klebsiella pneumoniae
acagggaatgtgcggctcctgtattaccggggtcctcgacgggatccccgagcaccgggacagcgtgctgacggcggaagagaaagccgacaacgaccagatcacgctctgctgttcgcgggcgaaatccccgcttctggttttggatctgtgaggagactgacgatgacgttcccctcctcttgcgcgccgctcaccgggatcagccgcgcccgactcccggcctgggcgctgcccgacggctggccgacgcgggccaacggtgagccgctgctggcggacctggcctttcgcgacggccggattgccgcactgaccccaaccgaccagccgactcccggcctgtgggacctggcgggagccctgacgctccccggcctggtggaaccccatgcccatctggacaagacattcaccattgaacgctgccgtccggcgcaggccgggctgctggcggcgatccacgctatgcacgaggatcgccggcactggaccagggcggatattcaacgtcgggcgtccgccgcgctggcccgggcggcagcgaatggcgtgacccatttgcgcagccatgtcgactggtttaccgccgacgcgccggacgcctggcaggagatcgcccgcctcgataccgtcggcatcaccctggagcgggtggcgctggtcccgctgcccctgtttcgcgagccagcgcaagcggaggccatcgcccggacggtcgccaacagcggagagcgctgcctgctgggcggcttcatccactcctccaactgggacgccgccgccatggaaaatctgctgtgcagcgcggcccgctgggatctggatctggatttgcatattgatgaggagctcagcgaagtgtctcaggggctgacctggctggcggatcatctctcccgccacccttttcccggacatatctgctgcagccacggctgcgcgctggccgccggcagcgacgaacaggcggcgccgatcctgcgccagctggcggcgcacggcgtcacccttatcgctctgccgatgaccaacctgctgctgcaggatgcgacgttcggccgcacgccgcgccagcgggggatcacgctgctgcacgaggcgcaggccgccggcgtggccaccctgctcggctgcgacaacgtgcaggatgccttctgcccggcggggagctatgacccgctggacaccctggcctgcggtctgttcagcgctcagctcagcgacctgttcgaccggcagtcgcggctgatctgcgatcgcgcggcgctaaccggttcgccggcagacgcggcgccctttgccgtcggggcggcggccagcgtggtgattttcccgggtagcgaccgttttacctggcctttaaacagcgccgcccgtctggtggttaaccacggcaggttaacccaccgacgcgtgtggcaggaggagatggcacatgagtcttga

SEQ ID NO: 235 - DNA, 681 bp, Klebsiella pneumoniae
tcattatgtgtattttttgtcacccaagaaaaaggagttgccatgaccgtcgttgcccatgatgaagcacaatccctgaaggcgcggatcttcagcgccgctatcgctgtctttgctgaacacgggctgtcaggcgcccgcatggagcagatcgccaccgaggcgcagaccaccaaacgcatggtggtttactacttcaaaagcaaagaacagctctatcaggaggtgctgcagcatgtgtatgcgcggatccgcgaaaccgagcagcagctggggctggagaatgtgccgccggtggaggcgctggtgcggctggtgcgctggagcgtgcgctatcacgccacccatgcggactatatgcgcgtcatttgcatggagaatatgcagcgcggcaagtggttaaaaagctcgggtgaactgaagccgctgaatcgtaccgccctgtcgatactggaagacattttactgcgcggccagcagcagggcgtctttcaggcggggctcgacgcgcgcgatgtccaccggttaatcagcagcttcagcttttatcaggtgtcgaacttctacaccttcagcagcctgtatcttgacgatccgctacccgccatcgacgatgaagcgatggtggctcaccattgtgacattgccgtcagggcggtgatccgcttcgtgatttcctga

SEQ ID NO: 236 - DNA, 429 bp, Klebsiella pneumoniae
gtgccgtccgtcttccccacgcacgtgggggtgtttcgagtaaagttgtttttttgcttaatcagatttcgtcttccccacgcacgtgggggtgtttccacctgcgggactacttcatggagcgcgtccgcgtcttccccacgcacgtgggggtgtttccaaacgggggtgatccatgatactaagcaaatcgtcttccccacgcacgtgggggtgtttctgccgcgccctcgtgagttcgagcagatcctgcgtcttccccacgcacgtgggggtgtttccgaggaaatgatcgccattgaccgtaaggcgatgtcttccccacgcacgtgggggtgtttccgatgcgcagtttttggagacgcgaaaattccagtcttccccacgcacgtgggggtgtttctttactcgaaggttaagcgggcgtaa

SEQ ID NO: 237 - DNA, 972 bp, Klebsiella pneumoniae
tggcggcccgtcccggacgggtggtcgaagatatccccatccgcgagccgttcccgcgcagcgaggcgttccgcgtcagcccggccttttccctgtatgcccgtcagctgcaggacagtctgttgcaggccagccagtccggtatggagccataatatgaaaaccacaaccgcaacgccgtggatccagcatccgcgttttctcaaaattctctatccgaccctcgtcgcggtggcggtggtgctcctgtggcagggcgcggtgagctatttccgtatcccggcctttctggtgccgtcgccgctggtgatgctggaaagcctgtggacgcatctcacgccgctgctgctggcgctgctgttcaccctcaagatcaccctgatctcatttctgctgtcgattgtcatcggcgccgcggtggcgtttatcctggtgcagaaccgctttgtggaaaccgccctgtttccctacatcgtgtttttgcaggtgacgccgatcgtcgccatcgccccgctgatcatcatctgggtgaaggatgccacgctctcgctggtggtgtgcgccaccctgatggcggtgtttcccatcatctccaataccactcagggactgcgcagcgtctcccccggcctgctgagctattttcgcctcaatcacgccagccgctggcaaacgctggtgcggctgcgtatcccctcggcgctgccctatttcttcggcgcgctgcgtatttccagtgggctgtcgctgattggcgcggtggtggcggagtttgtcgccgggaccggcgggaccaataccgggctggcctatcagatcctacaggccggctaccagctggatatcccgctgatgtttgccgcgctgctgctgatctctctcgccggtatcgcgctgtttggcgtgatgtcctgggtctcgcgccgggcgctcagcgcctggcatgaaagcgaagccgtgcaatctcattaa

SEQ ID NO: 238 - DNA, 972 bp, Klebsiella pneumoniae
tgtgagaccgtcatgagaaatttcatcctgaggcgcctgctgcaaacgctgccgatgctgctgctggcctccttcattatttttttgctgtttgccaaaacccccggcgactttatcgatggcaatatcaccctgaccgctgcccgcgccgcggagctgaaggcgatctacggcctcgaccagccgctgttgacccgctacctccactggctgggacagttgctgcgcggtgatttaggcttttcgctgcagtatcagatcccggtcagccagttgctcaaccagtacatctggaactcttttctgctggccagcgtcgcgctggtcttttactggggcatcggcctggcggtgggcgtggtttctgccctgcgccctggctcctggtttgatcatctggtgagcgtcgcggtgtttgccgccatgtcgttccccacctttttcctctgcctgctgctgattaaatggttcgccgtcgatctccactggctgccggtaggcgggatgaccaataccggcagcgacgagagcggctggcagtatgtgctgcaggtggctgcccacctggcgctgccggtgctggcgctggtgatgctgcaggcgggcagcctgacgcgctatgtgcgcgccagtatgctcgacgtggtgaaaatggattttatccgtaccgcccgcgccaaggggttgcaggagcgcacggtgatcctcaaacatgccctgcgcaacgccctgctgccgattatcaccctgctgggcttcgagctgccggggctgttctccggggcgatcattaccgaaaaggtattcaactggccgggggcgggccacattcatatcgactcgctggccgcccgcgactatccggtactgatggggtttaccctgtttctggcggtgctgacgatcgtcgggaatctgctcgccgacgtgctgtacgcctgggccgatccgcgtattcgggtgaggtcataa

SEQ ID NO: 239 - DNA, 1161 bp, Klebsiella pneumoniae
tacatggccgtatcgccgtcactgatcgccgaagccgttggctggcgacgtgaatttcacgccgcgcctgagctcggatatcaggagcaggagacctcgcgccgcgttgcggagctgctggcctcgtttgggctgcaggtgcatcgcgggctggccggcaccggcgtcgtggcgacgctggagaacggccccgggccggttatcggcctgcgcgccgatatggacgccctgccgatcaccgagctggggagcgtcagctaccgttcacgccgcgccggggtgatgcacgcctgcggccacgatggccataccgcgatgctgctggcggccgccgcccatctggcgcagacccgccatttcagcggcaccgtccactttgtctttcagccggcggaagagaacctcggcggcgcgcgcaaaatggtggaggaggggttgtttgagcgcttcccgatggacgccatctacgcgctgcataactggccggggatccctcttggcgaagtggcgctcagcgatggcgcgatgatggcctcgctggacgccttcgagatcaccctgcgcggaaagagctgtcatgcggcgatgccggagagcggggccgatccgatcgtcgcggcggcgcagctgataatggcgctgcagaccattccttcccgccgcttgtcgccgcaggattccgcggtggtcagcatcacccagataaacggcggcgaggcgatcaacgtcctgccggacaccgtggtgctgcgcggtaccttccgctgcctgagcaatcgcgttcgcgcccgcgtgcgggagctcatcgaaagctatgtggcgacccagccgcaggtgtccgatgtgcagggcgagattagctggttcccgggttatccggtgaccaaaaaccatgcgctgcaggcgcagcaggtgcgcgaggtggccgtcgccactctcggcgcgcaagcggtgcgctggaatcaggcgccgtcgatggcctccgaagattttgcctgcatgctggaggcctgtccgggggcctatttctggataggcaccgacggcgaaaccccgtcgaagccgctgcataacgcaagctatgactttaacgatgcgctgatcggccccggcgtcgccatgtgggtggggctggtggagaaacagctgccggcggcgtaa

SEQ ID NO: 240 - DNA, 627 bp, Klebsiella pneumoniae
aaaaggtacgttatgacagttacatggacggtcacgcccgtggggtatcagcacattgccaaacgctgccccgcctgcaatgtaaaacgcgactttgcgccttccggcgccatccgggtgaattcgcaaaagaagctgctggatatctggagcatctataaatgcacgcgctgcgattacacctggaatatcgccctgttttccaggctgcacgtcagcaagataaaccgcgaactgcttcagcgcctgctgaagaacgatgcagccatggttcactattatgccgctgacctcgcgacgctgaagcgcaaccgcgccgagccgtcggggcaacctgattttcgtattcacgagcaatggtcggttacgttgatggcatgtcagcggataacggtgcgcgtcagagtcagtcagccatttcgcatcagcctgctatcaatactgaaaaaacagctcaagctgagtacggctgaaatccggtggttggtcgcgacagggcatatcgagggtattccactaaaacagctcaagacgaaaaagctgaaggcgatggaatatgattttcagctggcggcggaaacgctgtatgcgcgacgccggattacgttatcactttgcggtagataa

SEQ ID NO: 241 - DNA, 1773 bp, Klebsiella pneumoniae
accatgaacgtattacgcagaaagtggcaggggctgccgcgcggcgtggtggtgtgcatcacggcgctggtgatttatgtcccgctgttatttattgtggtgcagagttttctttcggcaccgttcttttcccgctccaaatcgtggagtctggaagccttcgcctttatttttaccgacccggatttttatctggcattaaggtcaggttttattctggcctttggcctggtgattatcgccattccgctgggcggtattttggcgtttctgatggtgcgcaccgatttacccggccggcggatcattgagccgctgatcctggtgccgatcttcgtctcgccgatggtgctgggctttggctacgtggtggccgccgggccggtaggcttcttttcccagtgggcgcagcagctgatcggctttgtgccgtggaatatctactcgatgttcagcattgtggtcatcgccggcttaactcacgttccgcatgcctatctctatatctcttcggcgctgcgcagcgtcggctccgacgtggaagaggcggcgctcaccgtcggcgccacgccgctgcaggtgatgacctcggtgagtctgccgatggtgcggccatccattctttacgcctgcgtgttgctctttttcctcggtctggaggttttcggtctgatgctggtgttgggcgaccccgagggcaacatggtgctggcgacctatctctacaagctgactaacaagctcggcaccccctcctaccatctgatggcggcggtggcggtggtgctgatctgcatcaccatcccgctggtgatgctccagcggcggctgatgcgcaccgccaaccgctttgtcaccatgaagggcaaggcgtcccaggcgcgggcgctgccgctgggcaaatggcgctgggtggccggggcggtggtggtggcctggctgacggtgaccatcggcgtaccgctgctcggcgtggcgctgcgcgcttttatctccaactggggcgtcggcgtgtcgctgtgggatgagctgtcgctggcgacgttccacaatatctggcagcagcccaacctgctgcgggcgatcgtcaactcgatggctatcggcatcatcggcggcgcgctggcggtgatctgctatctgtttgtcggcatcgccatgcaccgcaaagcggacaacgtcacccgctttctcgactacagcgtgctggtcccgcgcgctgtaccggggctgctggccgggctggcattcctgtgggtattcctgtttgtgccgatgtggctcgatcagtcgctgaagcacggctggctctcggcgctgccggtggccgactggctgcgggagcaccttatcgtgcagctgcgcgccctgcgcaacaccatcttcagcgtctggctggcctacaccgtggtgtggatggcctacggcctgcggctcatctcctcgacgctgctgcaggtgggcccggagctggaggaggcggcgcgtagcaccggcgcctcgcgggggcagatcacccgccacgtgaccgttccgctgtcgcgctatgggctgattggctcctggctgctgatgttcctgatctttgagcgcgagtattccaccggcgtctatctgctgtcgccgggtaccgaaaccatcggctcgatgctggtgtcgctgtgggcggcgggggccatcgatatcgtcgcggcgctctcctttatcaatattctgctggtggtgattggcctgggtatcgccctgcgctttggagtgaaattacatgattga

SEQ ID NO: 242 - DNA, 894 bp, Klebsiella pneumoniae
cgagcggtggtttcgttggtggtcagcgccaggatggtggcatccgggaagtatttgcgcacagcgcgtgcggatttaccgccctgggtggcgaccacgatcagcggcgcttccagtttctcagcggtttctaccgcgccgcggcacaccgcttcggtgatgcgcagtttacggttgtcgttgttgaagtccagacggctggtcatcacgcggtcggtacgttcgcaaatggtcgccatgatggtgaccgcttccagcgggtatttacctttcgcggattcgccggacagcatcaccgcatcggtgccgtcgaggatggcgttagccacgtcgccggcttcagcgcgggtcggacgcggattcttgatcatggagtccagcatctgggtggcggtgataaccactttacgcgcgcggatacatttttcgatgatcattttctgggcgaagataacttcttcaaccgggatctccacgcccatgtcgccacgcgcaaccatgatgccgtcagacgcttcgaggatttcgtcgaagttgttcaggccttcctggttttcgattttggagatgatctggatgttttcgccgccgtgggctttcaggtgctcacggatctcgacgacgtcggaacgtttacggatgaaggaggccgcgacgaagtccacgccctgttcgcaaccgaagatcagatcctgtttgtctttctcagccagcgccggcagggcgatggagacgcccggcaggttaacgcctttgttctcgccgaggtcgccattgttcagcactttacagataactttgttgccttcgatagccgtaacttccatgccgatcaggccatcgtccaccaggacggtgttgccgacggcgaggtcggaggtgaagccttcatag

SEQ ID NO: 243 - DNA, 282 bp, Klebsiella pneumoniae
tgcacctcggtcttccccacatgcgtgggggtgtttctgcaggacgagcaggcagtaaagcgccaggcgggtcttccccacatgcgtgggggtgtttccgagttaacgcttgaacaagcgattcagcatacgtcttccccacatgcgtgggggtgtttcttcatcacgtgtgagcggatttggctctatcctgtcttccccacatacgtggaggtgttttcgcctttcaagtgtcgacaagtaacgtctgtgcgcatttctcagatgaaaggggattcctga

SEQ ID NO: 244 - DNA, 1251 bp, Klebsiella pneumoniae
gcaaaaccggtaagaaagccgctattctgctggacaccaaagggccggaaatcccgtaccatcaagctggaaggcggcaacgacgtctccctgaaagcaggccagaccttcaccttcactaccgataaatccgtcatcggcaacaacgaaatcgttgcggtaacctatgaaggcttcacctccgacctcgccgtcggcaacaccgtcctggtggacgatggcctgatcggcatggaagttacggctatcgaaggcaacaaagttatctgtaaagtgctgaacaatggcgacctcggcgagaacaaaggcgttaacctgccgggcgtctccatcgccctgccggcgctggctgagaaagacaaacaggatctgatcttcggttgcgaacagggcgtggacttcgtcgcggcctccttcatccgtaaacgttccgacgtcgtcgagatccgtgagcacctgaaagcccacggcggcgaaaacatccagatcatctccaaaatcgaaaaccaggaaggcctgaacaacttcgacgaaatcctcgaagcgtctgacggcatcatggttgcgcgtggcgacatgggcgtggagatcccggttgaagaagttatcttcgcccagaaaatgatcatcgaaaaatgtatccgcgcgcgtaaagtggttatcaccgccacccagatgctggactccatgatcaagaatccgcgtccgacccgcgctgaagccggcgacgtggctaacgccatcctcgacggcaccgatgcggtgatgctgtccggcgaatccgcgaaaggtaaatacccgctggaagcggtcaccatcatggcgaccatttgcgaacgtaccgaccgcgtgatgaccagccgtctggacttcaacaacgacaaccgtaaactgcgcatcaccgaagcggtgtgccgcggcgcggtagaaaccgctgagaaactggaagcgccgctgatcgtggtcgccacccagggcggtaaatccgcacgcgctgtgcgcaaatacttcccggatgccaccatcctggcgctgaccaccaacgaaaccaccgctcgtcagctggtgctgagcaaaggcgtggtaccgcagctggtggaagagattgcctctaccgatgatttctatcatctgggcaaagacctggcgctgaagagcggcctcgcgcgtaaaggcgacgtagtggtgatggtttccggcgcattagtgccgagcggcacgactaataccgcttccgtacacgtgctgtaa

SEQ ID NO: 245 - DNA, 1380 bp, Klebsiella pneumoniae
aaaatccgggtcccctggtgcaggcataaaggaaggcagatgatgaaaatgcaatggttatcggccctggtgcttggggcattgagctgcgcggccttcgccgaagaggcgcctgcggacagcaatctgattaagcagggggagtatctggcgcgggcgggggactgtgtcgcctgccacaccaacggcaaagcggggaaacctttcgccggcggtttgccgatggagacgccgatcggcaccatctactccaccaatatcacgccggataaagaacacggcattggcgggtacaccttcgaagagttcgacgacgcggtgcgcaagggcgtgcggaaagacggttccacgctctatccggcgatgccgtatccctcgtttgcgcggatcagcgaagcggacatgcgcgccatgtacgcctactttatgcacggcgtggagccggtgaatgtcgccaacaaggacaccgacatcccatggccgctgtcgatgcgctggccgctggcgttctggcgcggcatcttcgccccgacgccgagcgactttgtcgccaacccgcaggttgacccggtgctggagcgcggccgctatctggtggaaggcctgggccactgcggcgcctgtcataccccgcgtagcctgacgatgcaggaaaaagcgctcagcgaaagcgaaggcgatgattacctggcgggtagcaatgcgccgattgacggctgggtcgcctccagcctgcgcggcgaaaaccgcgacggcctggggacctggagcgaagccgagctggccgagttcctcaaaaccggacgcaacgataaatccgtggtcttcggcggcatgagcgatgtggtggagcatagtctgcagtatctctctgatgacgacatcacctccatcgcccgctacctgaaatcgctcccgccgcgcggcggcaaacagaccccagccccggtggaagacagcgtggcgaaagatctgtggaagggtaacgacagcaaaacaggcgccgcgctgtacgtcgataactgcgccgcctgccaccgtaccgacggcgcgggctataaacgcgccttcccgtcgctgaagggcaacccggtggtccagacggaagatgccacttcgcttatccacatcgttctgaccgggagcaccacgccggcggtgaaagatgcggtctccaacctgaccatgccgtcgttcggctggcgcctggacgaccagcaggtggcggatgtggtcaatttcatccgcaccagctggggcaacaacgcgccggcggtcagcgccagcgatgtggcgaaggtgcgtaaggagactgcggcgcatgatgagaaggcgttaggcaacgccgatatctcgaagctgccgggggccggacagtaa

SEQ ID NO: 246 - DNA, 1038 bp, Klebsiella pneumoniae
tcaagccgggtaccgatccccatcagttcgcggagagtatctatgccaacgtattcgcctgagcaggctctggcgcgccccaccggccgcgcgccgctgtggggagaagggctgctggccgccgcgctgtggctgatgggcggtctgtttactctgacctggcccgacgccgggcggcgctggccgtttagcgaaggctgggcgctggcgcaattcaccctcggcggcggcttgctgctgctggcgctgagctatcgctactggcgggcgcgcggcgcgcgtgtgctgcatgccagcaagtggctggcgctgctgccggtgctgtttgctgtctgggaagggctgaccgccaaaactgccgtgctgccggtaccattcttcgcgccgccgcaggcgctgatcgaggtgctgcacgacgactggccgcgcctgctcgacagcctgctgcactccctggggctgctggggctcggtgtgctgctgggtaccagcagcgggttcatcactggtctggccatcggctggtcgcaacggattggctactgggtgcatccggtgttacgtctgctggggccggtgccgtccaccgcgctgctgccgctgtgcctgtttatttttccctcgagcttcggcgccagcgtgtttttgatcgcgctgagcacctggttcccggtcacggtgctgacctggtccggagtgatgggcattgataaggcgtggtacgacgtggcgcggaccctcggcgccagccagcgtttcctgatcctgcgggtggcgatccccgccgcgttgccgaacgtctttgtcggcctgtttatggggctcggcgcgtcgttttcggtgctgattgtcgccgaaatggtcggggtgaagtcggggatcggcttttacctccagtgggcccagggctgggcggcctatccgaatatgtatgccgcgctgctggtgatggccttgttatgctccggcctgataagcggattatttatgctgcgtgaccggctgctgagctggcagcgaggagggatgcaatggtaa

SEQ ID NO: 247 - DNA, 957 bp, Klebsiella pneumoniae
aggcctctattaccggccgatccccgagtggatcgccggattcggctcgctgagcgccaccaccgagatttgattaaccgggagactaacatgagctatcaaccgcaaaccgaagccgccaccagccgattcctcaatgtcgacgaggggggccgcacgctgcgtatccatatcaatgactgcggcgacgggaaagagaccgtggtcatgctgcacggctccgggccgggggccaccggctgggccaacttcagccgcaatattgacccgctggtcgaggcgggctatcgcgtgctgctcctcgactgtccggggtggggcaaaagcgatgctatcgtcaacagcggctcgcgttcggatctcaacgcccgcattctgaaaagcgtggtcgatcagctggggatcgataaagtccatctgctgggcaactcgatgggcggccatagcgcggtggccttcaccctgagctggccggagcgggtggctaagctggtgctgatgggcggggggaccggcggcatgagcctgttcacgccgatgccgaccgagggcatcaagctgctgaacgccctgtaccgcgagccgaccattgaaaacctcaaaaagatgatgagcatcttcgtcttcgacacccgcgacctcaccgaggcgctgttcgaggcgcgtctcaacaatatgctgtcgcgccgcgaccatctggacaacttcgtcaagagcctggaagccaacccgaagcagtttcctgactttggcccgcggctgggcgaaatcagcgcgccaactctgatcgtctggggacgcaatgaccgcttcgtgccgatggacgccgggttgcgcctgctcgccgggatcgccggttcggaactgcatatttaccgcgactgcggccactgggcgcagtgggaacatgccgacagttttaatcagctggtgctcaatttcctcgcacgggcttaa

SEQ ID NO: 248 - DNA, 1659 bp, Klebsiella pneumoniae
ggctgtccattgattataaaccttatgtctcttaagaagatattttcagtctatttatcggcattaacatccgcaataggatggcgacagtttattcattccttgccgactgatgagggccgcccgatgttactcaccgccagaacaccttcccgatacgccagcgccctggccgcgctttctgtctttatggcggccttgctgctgccgttatgttttaccggcggcgtcatgaccacccccgcgatacagcagtcgctgggcggctctcccgcagcgctgtcgtggctgaccaatggctttatgctgactttcggcagctttttgctggccgcaggggtgacggcggatgccatcgacagaaaacgtatttttatcgccggcgccgcgctgttttgcctgagcagcctgctgttttgtctgacgcacaatctcttcctgtcaggcgtgttgagggcgctgcagggcctggccgcggcgatgattttagccagcggcagtgcggcgctggcccagctgtatgatggcgcccagcggacgcgggcattcagcatcctgggcacggtgttcggcattggcctggcgttcggtccgctgctgatcggcttcatgatcgacgcggtgggttggcgcggcgtatacgccctgtttgcgctgctctcggcaggggttctgcttataggcctggtatctctgcctgcgacagaaaaaagcgagccgcggacacccgacaacctgggcttaaccctgtttacgctggccctgatgctgtttactgcatcgcttatggtcattccggcccgcggttttttatccctgaccacgctggccttgctcatcgcgtcgggggggctgttcgtggcgtttgtcgtacgctgccggagggtgaacaatccggtgctggaactctccctgctgcgtcatccgcgttttgtcggcgtactgttgttgcctgtcgccacctgctgttgctacgtggtcctgctgattattgttccactgcattttatgggcggagaggggatgagtgagtcgcagagcgcactgtatctgatggcgctgaccacgccgatgctggttttcccatccgttgcggccctgctcacccgctggttttcaccggggcaggtgtccacggcgggactgatgatggcctccgtcggggtgctgttgctgggcgatgcttttcacagtaaccacctcccgcagctggtgctggcgctgatcctctgtggggcgggggcggcgcttccctggggactgatggacggcctggcgatatccgctgtgccggtcgccaaagccggtatggcggcaggcctgttcaacaccgtacgcgttgccggcgaggggatcgccctggcgatagtctccgcggtattaacggcaagcaataccctgaccctgcagagtcgcgtacacgggtatgcccccgaggtgattcaccgcgccgcaggctggctgggggccggcaatatgccgcaggcggctgcgcttttgcctgatttttccctccgggtgctgcgcgagagctatgactctgcttatacgctactgtttagcgggctggcggtcgtcaccctgctgtgcgccctgatggtctggcggacgctatgccggaaggggggcgctatccaaacccgcgacagcggatcctga

SEQ ID NO: 249 - DNA, 378 bp, Klebsiella pneumoniae
gaaacgctttcccgggctgagaaccaggaaaccaataatagtctccaccaccgccggcaagaaatcaggctccgagcccaacatgttgccgggtggcggctagcgccttacccggcctacaaaggccacccgcgatttggcgctctattcgcgcccttcgtaggcccgcgcaagcgtagcgccgccgggcaaggacagcgggcacggagccgattttgtgccgggtggcggctgcgccttacccggcctacaaaactcttctggtggcatgcccctggcccgcgcctgcgcagcgccgccggacagtcactgcgcctgctgctgcgcctgcgccagctggcggacgatcgcctcgcgccgcgcatccccttccggtag

SEQ ID NO: 250 - DNA, 783 bp, Klebsiella pneumoniae
cgccggatttcgcagggctactcaatgaactgcagtggttctccggcagcagtcgcgaacggatccgcgcccgctgggcgcaggaattctatcgtcgtgccggtgaggctgccgggagtgaggcgaggaattcacatgactgacctctttgcgagtgctttacatctcgatcgcgctgcggtgaaagcgctgaaaataagcgatgcctactccctacaccgggtggtgtacagcctgtttgctgacgcgcgtacagaccgggagaagtgcagccatatttcgagcgggatcgcctatgccgaccagggcggggattttcatggccgcaaaatattgatcgtctctgacagacctccggctgcaaaggttgatgggctgtacggtgaggtcatcagtaaatcgattccggccgcctttctctcccattcgcgttatcgctttcaggtacaagtgaatccggtacggaaagataagcaaacgggtaaacgcgtcgcggtgaaaggccgggccgatattgcgcagtggtttattcagcgagccgccagccgctggggctttgacgttgaccttcctggcttgcaggttgaggcgatggaagtgctgcagtttaaagataaagccggccgccaggtaacgcttggcaaggcgacggtgcaggggctgctcaccgtcaccgaccgacagaagttccagcatagttttcatcatggcattggtaaagggcgagcctttggctgcggcctgctgcagattgtgcccgttgttgatgcgcttttttcctga

SEQ ID NO: 251 - DNA, 780 bp, Klebsiella pneumoniae
gtcacaaattcaaaattatcaaatcagtcgcctgcgccaatgataaggctatcgcaaggcaggagagacaagatggcaggactggataaacgcgtcgccagttacgaagcggcgctggaagggttaacggacggcatgacgctgctcgccggcggcttcggcctgtgcggcattcccgagaacttgatcgccgaggtgcagcgtcgccaggtgcaggggctgacggtggtctccaacaactgcggggtcgacggtttcggtctcggcatgctgctggagtcgcgccaggtcagcaaggtggtggcctcttacgtcggggaaaacgcgctgtttgaacagctggtgctgagcggcgagctggcggtagaactcaccccgcagggaacgctggcggaaaaaatccgcgccggcggcgctggcatccccggcttttacaccgccaccgggtatggcaccccggtcgccgaaggcaaagaggtgcgccagttcgacggaagacactacatccttgaagaggcgatccgcggcgatttcgcgctggtcaaaggctggaaagccgactggtacggcaacgtggtctatcgccacaccgcgcagaatttcaacccgctgatggccaccgccgggcgcattacggtagtggaggtggaagagattgtgccgccgggcgaactgcccccctccgccatccatactccggggatctatgtcgaccggctgatcgtcgggcaattcgaaaaacgtattgaacagcgcaccctgcgcgccggagggcactga

SEQ ID NO: 252 - DNA, 693 bp, Klebsiella pneumoniae
aattttgcctcgccgtcgccacgacgctgcctggctaccgcagtatgcgcgaactggtggggacgcgtgacaacgtcgtcttctccctgtggcgtacacccattaaaccaggacgagccctgggaggtagagactctgcgcgcgctggcagcggaagagggcgtcgtggcgatgggggagaccggtctggattatttttataccccggaaactaaagcccaacagcaaagctcgttccgcgaccacattcgtatcggccgtgagctcaataagccggtgatcgtccatacccgtgacgcgcgtgccgatactctggctattttgcgcgaagaaaaggtgacggattgcggtggcgtactacactgtttcactgaggacagggagacagcgggcaagctgctcgatatggggttctatatctcgttttccggtatcgtcacttttcgtaacgccgagcagctgcgtgatgcggcgcgctacgtgccgctggatcgcctgctggttgaaaccgattcgccgtacctggcgccggtcccccaccgcggcaaagagaaccagccggcgttggtccgtgacgttgccgagtatatggcggtactgaagggggtgtcgcttgagcagctggctcagcagaccaccgacaattttgccaccctgttccacatcgaccccgcccgtttgcaacctgcttga

SEQ ID NO: 253 - DNA, 210 bp, Klebsiella pneumoniae
ggcgctggctcgacggctgctggcgcgacaacttccgcagcatcaacgaacagcggctcggcggccgctaccggctcgacgactaccggctcagcggttactggttccatggtagccggctcgacggtgaccggcgcagcggtaacggtttcaacgacggcgaccggggccgctacggcctcgacagttttcgcgacgctggcgtcctga

SEQ ID NO: 254 - DNA, 741 bp, Klebsiella pneumoniae
gacgaattatctgagattgtcgtgaatcgtatgaataatactccggtacagcgtgaatatttcttcgacagcatccgcgcctggctgatgctgctggggatccctttccacatttcgctgatctattccagccacagctggcatgtcaacagcgctgagccctcgtggtggttgacgctgtttaatgacttcatccatgccttccggatgcaggtctttttcgtcatctccggctatttctcctacatgctgttcctgcgctacccgttgaaaaagtggtggaaagtgcgcgtcgaacgggtcggtattccgatgctgaccgctatcccactgctgacgctgccgcagtttattatgctgcagtacgtcaacggcaaggcggaaaactggcacaccctttccgggtacgacaaatttaacaccctggcgtgggagcttatttcccacctgtggtttttactggtgctggtggtgctgacctcgctgggcgtggtgctgtttaaatggctgacgcgccgcccggcagggggtgcctcagcctttggtgacactgtcactatgagccagctaacgatgattttccttgcgctgggagtgctttacgcgctgatccgccgatcgctgttcctgatttacccgccgctgcttagcaatggtctgtttaactttgtggtgatgcagacgctgtctatcttcccttctttgtgctgggggcgcagacctttattaatccgcgtctga

SEQ ID NO: 255 - DNA, 330 bp, Klebsiella pneumoniae
ggaaactcatcgcgcataaaggccgttatcgcggcgaatgcctcagcttcatcttcgccgctgataagcagctggcaggcgtcgcccttcagggtattgctgccgataatcgccagcgcgcttttggcatttccgccggtcccgcggcgcaagttccgccactcaatcgctgatgaaaaacgattacacagcgtttcgaccagactggccggacgcgcatgcacgccgttgggcaaatcacatgtaaattcaatgaccagagccatcgccttcctccagagcaatccattatttcctcaaaaagtaataaaagacagccccaggcactag

SEQ ID NO: 256 - DNA, 498 bp, Klebsiella pneumoniae
aaccgaccatcaacgtcagtcgacgtcgcgccgccagctcgaccagcgtctccgcctcactcagcttgtccgccaatggtttatccacacaaacatgaaccccggcattcagtaagtgattcactacttcataatgtgaagccgtcgaggtatggacaaagaccgcatcgcactgtgccgccagggcatcgagggaatcagcgtatggcatccgccaggtttcgcagatccgcagcgccttctctttacccggcgaccaggccgcctgcagcgtccagctttccgccgcccccagcaccggcagccacgctttctgcgcaatgctgcctaagccgaccaccccaatgcgcaatcttgtccccacgttttagtctcccagatggtgtaacagcgaatcgaggcgcgctttcagctccgccacctcgccctccagcgcttcaaccctggcgcgcagatcgccgtcatcgtccagcggcgcgagagcttccactgtggtga

SEQ ID NO: 257 - DNA, 1353 bp, Klebsiella pneumoniae
aagggccgatcaccaccctggcggaagatctggctcagctgcgcgggatcctggggctggactaagtcgatggcacagcagaaaccccacgacgtgaacgagccgtcacgtcgtcgcttactgaaagggatcggcgcgcttggcggcgcgctggccatcaccggcggctgcccggtagcgcatgcggcaaaagcggaaagttccccggggacgctcacacccgacgcgcgccaggaaaagcagccattctatggccggcatcaggcgggcattctgacgccgcagcaggcttcgatgatgctggtggccttcgatgtgctggcggctgataaagccgacctcgagcggctgtttcgactgctgacccagcgtatcgcctttttaacccagggcggcccggcgccggacacgccgaatccgcggctgcccccgatggattccggcatcctggggccgtggattgcgccagataacctgaccatcaccgtctcggtcggccattcgctatttgatgagcgctttggcctggcggataaagcaccgaaaaagctgcagccgatgacccgcttccccaacgattcgctggatgccgcgctgtgccatggcgacctgctgctgcagatctgcgccaatactcaggatacggtgatccacgccctgcgtgatgtcatcaaacatacgccggatctgctcagcgtgcgctggaaacgggaagggtttatctccgacagcgcggcgcgcagcaaaggcaaagagacccctatcaacctgttggggtttaaggacggcaccgctaacccggcgagccacgacagcgcgttgatggataaggtagtgtgggtgacagccgatcaggacgagccggcctggaccgtgggcggcagctatcaggcggcgcgaattatccagtttcacgtggagttctgggatcggacgccgctcaaggagcagcagacgatctttggtcgcgacaagcacaccggtgcgccgctggggatgaaaaacgaacacgataccccggattacagtaaagatcctaacggcgaagtcattgcgctggatagccatattcgtctggccaatccccgcacgccggaaacccagtccagcctgatgatgcgccgcggctacagctattcgctgggggttactaacgccggacaactggatatggggctgttattcgtttgctatcagcacgatctggaaaagggttttctgacggtgcagaaacggcttaacggcgaggcgctggaggagtatgtcaaaccgatcggcggaggctacttctttgttttacccggcgtagtggatgataaacactatctgggagagtcgctgctgcaggcctga

SEQ ID NO: 258 - DNA, 1452 bp, Klebsiella pneumoniae
gcaggtttgtcacgcggacgttgggcccgcaaactgttaacagcaagggggggatgggcgatggctattaatcctccggcgcataacgccgctcaggcgggcagaccgcgtctgcgtaaatccctcaaactctggcaagtggtgatgatggggctggcctatctgacgccaatgacggtgtttgataccttcggcatcgtctccggcatcagcaatggccacgttccggcgtcttatctgctggcgctggctggcgtgctgttcaccgccatcagctacggcaaactggtgcgtcagtttccggaagccggttccgcctatacctacgcgcaaaaatccatcagtccgcacgtcggctttatggttggctggtcgtcgctgctggattatctgtttctgccgatgatcaacgtcctgctggcgaagatctatctctcggccttgttccccgaagtgccgccgtgggtgtgggtagtgacctttgtcgctattctgaccgccgcgaacctgaaaagcgttaacctggtggccaacttcaataccctgttcgtgctggtgcagatttcgatcatggtggtgtttgtcattctggtggtgcaggggctgcataaaggcgagggggtgggtaccgtctggtcgctgcagccgtttatcagccagaatgcgcatttgatcccgattattaccggcgcgaccattgtctgcttctcgtttctcggtttcgacgcggtgaccaccctgtcggaagagacccctgacgccgcgcgggtgatcccgaaggcaatttttctcaccgcgatgtacggcggcattatctttatcgtcgcgtcgttctttatgcagctgttcttcccggatattcatcgctttaaagaccccgatgccgcgctgccggagattgcgctgtacgtgggcggcaagctgttccagtcgattttcctgtgcaccacctttgttaacaccctggcgtccggcctggcctcccatgccagcgtctcccgtctgctgtacgtgatgggccgcgacaacgtcttcccggagcgcatttttggctatgtgcatccgaaatggcgtaccccggcgctgaacgtgattatggtgggcatcgttgcgctgtcggcgctgttcttcgacctggtgaccgccaccgcgttgattaatttcggcgcgctggtggccttcaccttcgttaacctgtcggtgttcaaccacttctggcggcgcaaggggtacaacaaaacctggaaggatcgactgcattatctgctgctgccgatggtcggggcgttgacggtcggggtattgtggatcaatctcgaggccacctccctgacgctcggcctggtgtgggcggcgcttggtctgctgtacctgacttatctgacccgacgcttccgcaaaccgccgccgcagtttgatgccgctaaagcggagcaggcctgggagtcatag

SEQ ID NO: 259 - DNA, 591 bp, Klebsiella pneumoniae
aaaaatatgtctgatcttatcctcgcgtcaacctctccctggcggcgcatgctgctggaaaaactgggtttaccgtttgaatgtgccgcgcctgacgtcgacgaaacgccccggcctgatgaatccgcacgtcagcttgtcacccgactggcgcaggccaaagcgcaaagtctggccacacgcttccctaatcaccttattataggctccgatcaggtttgcgtactggacggtgaaatcaccggcaaaccgcacaccgaggaaaatgcccgcaggcagttaagaaaggccagcgggtcaatcattaccttttataccggactggcgctgtacaactctgccagcggccatctgcaaaccgaatgcgaaccctttgacgttcactttcgccatctcagtgataaagagatagaaggctatgtgcgcaaagagaacccgctgcagtgcgccgggagtttcaagagcgaaggattgggcattacgctgttcgaacggctggaaggccgcgacccgaacaccctggtcggtttacccttaatcgcgctctgtcagatgttgcgccgtgaaaactacaacccgctgttaggctga

SEQ ID NO: 260 - DNA, 186 bp, Klebsiella pneumoniae
ggagtaaggtccatggccgtacaacagaataaaccaacccgttccaaacgtggcatgcgtcgttcccatgacgcgctgaccgcagtcaccagcctgtctgtagacaaaacttctggtgagaaacacctgcgtcaccacatcactgccgacggtttctaccgcggtcgcaaggttatcgctaagtaa

SEQ ID NO: 261 - DNA, 702 bp, Klebsiella pneumoniae
cctatactgttccaaaaatggaacaatggaggaaggatgcaggatctcaatgacttcgcctggtttgtccaggtggtagaccatggcggtttcgccgcggcggggcgagcgcttgaccagccgaaatccaaactcagccgccgcattgcgcaactcgaggagcggttgggcgtgcgtttgattcagcgaaccacccgtcagttcgcggtcaccgaggtcgggcagaccttttatcagcattgcaaagcgatgctgattgaggccgaggcggcgcagcaggcggtcgagacgctgcgcgccgagccgcgcggtagcgtcaggatcacctgtccggtcaccttgctgcatgtccatatcggaccgatgctggcgcgatttatggcgcgctatcctggggtaacgctgcatcttgaggcgaccaaccgccgggtggatgtggtcggggagggcattgatgtggcgatccgcgtccgtccccggcccatcgaggatagcgacctggtgatgcgcgtgctggcggaccgcgggcaccggctggtggccagcccggatctcatttcccggctcggacgtccgcaggcgccgtccgagctgagcgcctggccgggactcagcctgggagcgaacaagcatcagcataaatggcagcttaccgggcccgggggagcgagagcggaagtgtattcacgccgcgaatggtga

SEQ ID NO: 262 - DNA, 324 bp, Klebsiella pneumoniae
gacattatgtttttagtcgactcccactgccatcttgatggtctggattatcaaactctgcacaaaaacgtcgacgacgtgctggcaaaagcggccgcacgcgatgtgaaattttgcctcgccgtcgccacgacgctgcctggctaccgcagtatgcgcgaactggtggggacgcgtgacaacgtcgtcttctccctgtggcgtacacccattaaaccaggacgagccctgggaggtagagactctgcgcgcgctggcagcggaagagggcgtcgtggcgatgggggagaccggtctggattatttttataccccggaaactaa

SEQ ID NO: 263 - DNA, 336 bp, Klebsiella pneumoniae
aaaatcatgtttatttttgaaggcaacgaaattgaaacggatagcgaaggctatctgaaagataccacccagtggagcgaggcgatggcggaagtcattgccgcgcaggaagggataacgctcgccgttgaacactgggaagtagtgcgctttgtgcgcgagttttaccttgaatttaacacctctccggcgatccgtatgctggtcaaggcgatggccaacaagtttggcgaagagaaaggcaacagccgctatctctatcgcctgttcccgaaaggacccgccaaacaggcgactaaaatcgccggcttgccgaagccggtgaagtgcatctaa

SEQ ID NO: 264 - DNA, 1398 bp, Klebsiella pneumoniae
tcccttttcccggccgcgctcatcccggccgggaagcttcgccgctcaggctttaggctctcctttagctttaaaagctctcctccattgcggcatctatttctcaggcgcataattagcaggctcatattttctcttaatttgacctgccgcgcaggccagtggaaccctatgtcgtctgctgaaacccccattaactggaaacgaaacctgaccgtgacctggcttggctgctttttaaccggcgccgccttcagcctggtcatgccctttctgccactctacgtcgaacagctcggcgtcaccgggcatagcgccctgaacatgtggtccgggctggtctttagtattacctttcttttctccgccatcgcctcgccgttctggggggggcttgctgatcgcaaggggagaaaaatcatgctgctgcgttccgccctcgggatggccatcgtgatgatgctgatgggaatggcgcagaatatctggcagtttctgctgctgcgcgcattgctcggcctgctgggcggttttattcctaacgccaacgccctgatcgccacccagatcccgcgccataaaagcggctgggcgctggggacactgtctaccggcgcggtaagcggcgccctgctcggcccgctggcaggtggcttcctggccgacccctggggattgcgcaccgtcttctttatgaccgcgggggtactatttatctgtttcttgtttaccctgtttttaatccgcgaaaattttgtgccgatcgccaggaaagagatgctcagtgccagagaggtattctcctcgctgcagaatcccaaactggtgctcagcctgtttgtgacctcgctgataatccaggtggccaccggttccattgcgccgatcctgacgctttatgtacgcgatctcgcgggcaacgtcagtaacatcgcctttatcagcggaatgatcgcctcggtgccgggcattgccgcgctgatgagcgccccgcggctgggcaaactgggggatcgcatcgggccggaaaaaatcctcatcgtggcgctgattatctcggtgctactcctgatcccgatgtcgttcgttcagaccccgctgcagttaggtatcctgcgattcctgctcggcgccgcggacggcgcgctgctgccggcggtgcaaaccctgctggtgtacaactccaccagtcagatctccgggcgaatcttcagctataaccagtcgttccgcgatattggcaacgttaccggccccctgattggcgcgtcggtttccgctaactatggcttccgcgctgtatttctggtcaccgcaggggtggtattgtttaatgcgatctactccaccctcagcctgcgtcggccagctgcggatacttcgcattcagtaaattaa

SEQ ID NO: 265 - DNA, 438 bp, Klebsiella pneumoniae
ttaaggctcccggacgggagccttttttatgggagcagaacaatgaaacgcacgttatttgccgtgatggccctgctggccagcggcgcggcgctggcggacgagtgcagcagcgccaacacccaaaccgaaatgaatcagtgcgcggctgcgcagtatcaggcggccgataaaaaactgaacgacacatggcagcaggccctgcagcgggcggtgggtaaacaacaaacattactgaagcaggcgcagcaggcatggatcgccttacgcgacgccgactgcgcctttctcgcgtccggcgccgaaggcggcagcatgcagccaatgctgatcagccagtgcatgaccgataagagcgtggagcgggagtctttcctcgcctcgctgctacagtgcgaggatggcgatcaaagctgcccgctgccgcccgccaattaa

SEQ ID NO: 266 - DNA, 534 bp, Klebsiella pneumoniae
tatgcgcgccctatgcaaaaggtaaaattacccctgactcttgatccggtacgcacggctcaaaaacgccttgattacgaaggcatctatgcccgcgatcaggttgaacgtgtaaccgattctgtagtcagcgtggacagcgatgtggaatgcagcatgtcgttcgctatcgataaccagcgtctcgccgttattactggcgatgcaaaggtaacggtaactctcgaatgccagcgttgcgggaaaccgttctcccatcacgtccacaccacgtattgttttagccccgtcagaaatgacgaacaggccgaagcactaccggaagcgtatgagccgattgaggttaacgaattcggtgaaatcgacctgcaggcaatggtcgaggatgaaattatcctctccctgcccgtagttccggtgcatgattctgaacactgtgaagtgtccgacgcggacatggtctttggcgaactgcctgaagaggcacaaaaaccaaacccatttgccgtattagccagcttaaagcgtaagtaa

SEQ ID NO: 267 - DNA, 324 bp, Klebsiella pneumoniae
aaacgcagccccctgttgtcaacgttaaccggatactgtataaataaccagtatcgaacgcagggggcaattatgcgcattgaagtgtctatcgccaaaacgaccgccttacctaacggcgcgctggaagcgctgaataacgaactctctcgccgtatcgccgagcaattcccggccatcgatagccaggtgagcatccgctacgccaccggtaatcagctctcggtgtttggcgccctgaaagaagacaaagaccggataagcgaaatcctgcaggaaacatgggaaagcgcggacgactggtttgtccacgatctctcctga

SEQ ID NO: 268 - DNA, 405 bp, Klebsiella pneumoniae
gttccagtgcctgcacggcatgggcgaaccgctgtacgagcaggtggtgggcaaggtcgccgacggcaaactgaatcggccgtgccggatctacgccccggtgggcacccacgagacgctgctggcgtatctggtgcgtcgtctgctggagaacggcgccaatacctctttcgtcaaccgtatcgcggacaataccctgccgctggacgagctggtggccgacccggtcagcgcggtagaaaaactggcgcagcaggaaggccaggccggcctgccgcatccgaaaatcccgctgccgcgcgatctctacggcagcggccggagcaactccgccggtctcgatctggcgaacgagcaccgtctggcctccctctcctcttccctgctcaacagcgcgctgcataa

SEQ ID NO: 269 - DNA, 471 bp, Klebsiella pneumoniae
aagatgccgccggcggtggcgcgaaccgcttgttgcagatccgggcaatcggcgaagacaatgttggcgctcttgccgcccgcttccagccacacgcgcttcatattgctgtcgccggcgtctttcagcagctgcttgccggtgcgggtggagccggtgaaggtgatgacttcaacatcaggatgcagggccagctcctgcccggcctcgtggccaaagccgctgaccacgttcaacacgccgtccggcaggccggcctctttcgccagcccggccagacgcagggcggtgagcggcgatttttccgagggtttgaggattacgctattgcccgccgccagcgccgggccgagtttccagcaggccagcagcagcgggaagttccacggcaccaccgcggcgatcacgccaattggttcgcgaacgatcatcgccagctcgttgctgccggtgggggccacttcgccatag

SEQ ID NO: 270 - DNA, 990 bp, Klebsiella pneumoniae
  unsure (554): Identity of nucleotide at the above locations are unknown.
aataagacgccagcgttaatcggccaaaggcgtctgctatcaggagcccctatggagattattttttaccatccgacctttgatacccaatactggatctgtgagctggaaaagcagttacccggcgcgcgggtgcgcgagtggaaagcgggcgataaccggccggcggactatgccctggtctggcatccgccggtagagatgctgcagggccgggcgctgaaggccgtgttcgccctcggggcaggggtggactctattctcagcaagctgcgcgaccatccggatatgctgccgctgtcgattccgctgtttcgtctcgaagataccggtatgggacggcagatgcaggagtatgccgtgagccaggtgctgcactggttccgccgctttgatgactatcaggcgctgaagctggcttcccgctggcagccgctgcccgagtaccgcgccgacgaattcaccgtcgggattatgggcgccggcgtgctgggggcgaaggttgcggaaagtctgcaaccctgggggttcccgcttcgcgtctggagccgtanccgcaaatcctggccgcaggtgcagagcttcgccggccaggccgagctgggcgaattcctgcagggcactcgcgtgctgatcaacctgctgccgaataccgccgaaaccgccggcattattaaccagacgctgctggcgcagttgccggatgagagctatgtcctcaaccttgctcgcggcgtgcatgtcgttgaagaggatctgctggcggcgctgaacagcggtaagctcaaaggggcgatgctcgatgtcttcagtcgcgaaccgctgccgcaggagagcccgctatgggcgcatccgcgggtggccatgaccccccatgtggcggcagtgacccgtccaatggaagctatcacctacattgcggagaccattagccggcttgagcgaggggagccggtaagcggtcaggtcgaccgccagcgcggttattaa

SEQ ID NO: 271 - DNA, 1056 bp, Klebsiella pneumoniae
acaaactggccgattttttacaggccttctgcaagctcaagctgcagcatattcagttcaacgtggtcaatgccgacaccctgcgtgaagcgcagcagcggccgcaggactttgccggcctggtggtacgggtcgcgggctacagcgccttctttgttgagctgtcgaaggagattcaggatgacattatccgccgcaccgcgcatcagctgtgaggtcatcgacacgcgcgccgaccgggcgcgtatttttaacctccagcgctactcgctcaatgacggacaagggatccgcacggtggtcttttttaaaggctgccctcatacctgcccgtggtgcgccaatcccgaatcaatttcacctaggattcagaccctgcgccgggagagcaaatgcctgcgctgcacccgctgccagcaggacgttgccgaatgtccatccggagcgtgggaacagattggccgcgatgtgacgctggataacctgttgcaggaggtgctgaaggatgaggtcttctttcgcgcctccggcggcggagtcaccctctccgggggcgaagtgctcatgcaggccgggtttgccgcccgctttctccagcgcctgcgccagtgggggatccgcaccgccatcgaaaccgcgggcgacagcgcttttgaccgcttcctgccggtggccgaagcctgtaatgaagtgctgtttgattttaaaatcatggaacctgagcgggcgcggtcgctgctgcgaatgaatcagccacgggtgctggacaattttcgccagctggcggcgagaaaaatcaacctgatcccgcgggtgccgctgatccccggctacaccctgaataccgataattttcgccagattctggcgttcctcgcccctttcgcgctaaaagaaatgcacctgttgccgtttcatcaatatggcgagcccaaataccgtcttctgggcaaaccctggacgctggccagcgtgaaagcgcctgacgaagcggaaattcaaccatatcgggtgatggccgaagcggccggtttccacgtcactatcggcggttaa

SEQ ID NO: 272 - DNA, 771 bp, Klebsiella pneumoniae
gcatgctggccgaaatggctgccggcgtgggcggtcattgaagagaccttcggtgaagcttccacagcgttgggttacgatctgtgggcgctgactcaacatggcccggtcgaagaactgaataagacctggcagactcaaccggcgctgctcgccgcctccgtggcgctgtaccgcgtctggcaacagcagggcggcaaagcgccagcgctgctggcgggtcacagcctcggcgaatactccgcgctggtatgcgcgggcgttatcggtttcgctgatgccgttcgcctggttgagctgcgtggtaaattcatgcaggaagccgtaccggaaggtaccggcgccatgtccgcgattatcggtctggacgacgccgctatcgccaaagcctgtgaagagtctgccgaagggcaggtggtctctccggtgaactacaattccccgggccaggtggttatcgccgggcacaaagaggccgttgaacgtgcgggcgccgcttgtaaagccgccggcgccaaacgcgcgctgccgctgccggtgagcgtgccgtcccactgcgcgctgatgaagccagccgcagaaaaactggcggtagagctgcagaaaatcaccttcaacgcgccgacgattccggtggtgaataacgtcgacgtgaagtgcgaaaccgcgccggacgccattcgcgacgcgctggtgcgccagctgtacagcccggtgcagtggaccaaaaccgttgagttaatggctaccgagggcgtatcgcacctgtaa

SEQ ID NO: 273 - DNA, 636 bp, Klebsiella pneumoniae
caacttaagtttaattacatgattaacaaaggaatgatcatgagaaaactagtttgtccgcggctcccgcaatttcaggcctgcgtctcaccgctgggtcaactgcatactcgtccgctctttggcggctacagcctggctattgatgatacggtatttgcgatggtggccgaggggaacatttatctgaaggcctgcgagcagagcgctgcttatcgggtggaacatcgtaatcctctgttaacgctgcgccgacacggccgcatagtgccgctgaagtattatcaaattgacgacactttatggcgcgatgagcagcagctttttcggctatcgctactgtcgtggcagagtgcgcagcgcgaaaagaactgccgacgggcgtcgggccgcctgaaggatttacccaatatcagctttcatatggaattgcagctgattcacgcgggcataccggacgttaggacgttgcgggaagttggtgcgcaggaggcatggctgaggctacgcgtaaataatgcttctttatcgctgagcgtattgctggcgctggagggggcgattgccggggtacatgccgccgcgctcccgacgccacggcgtcaggagcttctcgaatgggcggctacccggtag

SEQ ID NO: 274 - DNA, 645 bp, Klebsiella pneumoniae
taccattttacgcgacgggctgtccgctatgctgccggtcgccagggagacccgatgaacgacgcgataaaccacacggcctgcgagacgctgtttacccaggcccggacccacaacggctggctggataagccggtgagcgatgcgcagctgcaggccgtctgggacctgatgaaaatggggccgacttccgccaactgttcgccagcgcgcatcgtgttcgtgcgcagcgcggaaggcaaagagaaacttcgcccgacgctctccagcggcaatctgcagaaaaccatgcaggcgccggtgaccgccatcgtggcgtgggatagcgccttctacgaccggctgccgaccctgtttccccacggtgacgcccgcagctggtttacctccagcccgcagctggcggaagagaccgcgtttcgcaacagctccctgcaggcggcgtatctgatttttgcctgccgggcgctgggcctcgacaccgggccaatgtctggttttgaccgggaaaaagtcgacgcggcattttttgccgacaacggctggaaaagcaacctgctggtgaacatcggctatggcgaccccggcaagctgtacggccgcctgccgcgcctgtcctttgatgaagcctgcctgctggcataa

SEQ ID NO: 275 - DNA, 858 bp, Klebsiella pneumoniae
cggtgctttacatttaagggtattggcatgtttgtcccatttctcattatgttacgcgaaggcctggaggcggcgctgattgtcagcctgatcgccagctatctgaaacgcacccagcgcggcaactggattggcgtgatgtggattggcgtgatcctcgcggcggcgctatgtcttggcttaggcatctttatcaacgaaaccaccggtgaatttcctcagcgtgaacaggagctgttcgaagggatcgtcgcggtcattgcggtggtgatcctgacgtggatggtcttctggatgcgcaatgtctcacgcaacgtcaagcagcagctggagcaggccgtggacaaggcgctgcagcgcggtaatcaccacggctgggcgctggtgatgatggtctttttcgcggtcgcccgtgaggggctggagtcggtcttctttctgctggcggccttccagcaggatgtcggcatctggccgccgctgggggcgctgctgggtctggccaccgctatcgtgctgggcttcctgatctactggggcggtatccgccttaaccttggcgtgttcttcaaatggaccagcctgtttattctgctggtggccgctggcctggccgcgggggcgatccgcgccttccacgaggcgggcctgtggaacctgttccaggataccgccttcgatctgagcaacgtgctgtcgacgcatacgctgttcggcacgctgctggaagggatcttcggctatcaggagacgccgagcgtcagcgaagtggctgtctatctgctttatctgatcccggcgctggtgctgtttgccctgccgccgcggaataataccactgcctcgcgggctgcctga

SEQ ID NO: 276 - DNA, 204 bp, Klebsiella pneumoniae
cccgccactacgaccggcttgctcaccgggggctcggctttgaccggttcggcaggggccgcttcggtcactggcgcttgctccacggtttctgcgaccggggcgatagtttccactggcgctgcaacgacaggcgtcgtttccaccgcttcaggttctaccaccaccggctcggcgtcgagcgtcactggcgcgatagcctga

SEQ ID NO: 277 - DNA, 555 bp, Klebsiella pneumoniae
atgaacgagttttcaatcctctgccgcgtgctgggttcgctgtattaccgtcaaccgcaggacccgctgctggtgccgctgtttaccctgatccgcgagggcaaactggccgccagctggccgcttgagcaggacgagctgctggcgcgtctgcagaaaagctgtgaaatgcagtccctggcgacggactataatgcgctgttcgtcggtgaagcctgcagcgtcccgccgtaccgtagcgcgtgggtggagggttcctcggaagcggaagttcgggcttttctgagcgaacacggcatcccgacaggggaaggtccggcggatcatctcggctcgctgctgctggccgcctcctggctggaggatcatgccgcagaagaccagagcgagacgctggagctcctgttcgccgactatatcctgccgtggtgcgggacgatgctggggaaagtcgaagcccatgcgcacacgccgttctggcgcaccatggcgcccttgacccgcgacgccatcgccgcgatgtgggacgagcttcaggaagaagatgagcaataa

SEQ ID NO: 278 - DNA, 2382 bp, Klebsiella pneumoniae
acaagatatacagccacctttcccagagcgcctgaagccttaaaagggcgccttcgcgcccttcgccacaacatggagtttatcatgacgaatcgtacccaacgcctgaaagccagcctgttcgcccagccgcgcgaaatctcccttgagcgcgcattactctacactgccagccatcggcagacggagggcgagccggtgattatccgccgggcgaaagccaccgcgtggatcctcgataaggtgatgatttcgattcgtgaggatgaactgatcgccggcaaccgcaccgtcaaaccgcgggcagggattatgtcgcccgagatggacccctactggctgctcaacgagctcgacgccttcccgacccgcccacaggaccgcttcgcgataagcgaagaagataagcaaatctaccgcgaaacgctgtacccctactgggaaaagcgttcaatgaaagatttcatcaacggccagatgaccgaagaggtcaaggccgccgtcaacacccagatatttagcgtgaaccagaccgataaaggccagggccatatcatcatcgactatccacggctgctgaatcatggccttggcgccctggtctccgagctcaaaacgcactgtgcccggcaaccggagaaccccttttatcaggcggtactgatcctgctggaagcttcccagcgccatattctgcgctacgccgcgctggccgaggagatggcagggcactgtcaggacccgcagcgtcagcaggagctgttaaccatcgccgctatttcgcgccacaacgcgcagcatcggccaacggacttcccccaggcctgccagctgttctggtatatgaatatcattctgcaatacgaatccaacgccagctcgatttcactcggacgctttgaccagtacatgctgccgttttatcaggcatcgctgaatcagggtcaggatcccgcatatctcaaggagttgctggagtcgctgtgggtgaaatgcaacgatatcgtcctgctacgctcctccagcagcgcgcgctatttcgcgggttttcccaccggctataccgccctgctcggcgggctgacggacaccgggcgcagcgcggtcaacgtgctgtcatttttatgcctcgacgcctatcaaaacgttcagctgccgcagccgaatctgggcgtgcgggtcaacgagctgattgatcgcccgttcctgcgcaaaactgccgaaaccatccgcctgggcaccggcatcccgcagattttcaacgatgaggtggtcgtgccggccttccttaaccgcggcgtgtcgctggaagatgccagagattacgcggtggtcggctgcgtggagctctctattccagggcgcacctacggcctgcatgatatcgccatgtttaatctgctgaaggtgatggaaattgtgctgcaggaaaatgaacatcagcctgacgtcagctgggacggccttatctgccagatccgcgacaaaatccgccattacatcaagctgatggtcgagggcagcaacatttgcgatatcggccaccgcgactgggcgccggtcccactgctctcctcgttcattgaagattgcgtgcagcacggcaaagatatcaccgccggcggcgcgcgctataacttctccggcgttcagggtatcggaatcgctaatctgagcgattcgctgtacgccctgaagggtatggtctttgaccagcagcgtctcagctttgaccaactgatggccgtgctgaaagccaatttccagacgccggatgggaaaaagatccgcgcccggctgattaaccgttttgacaagtacggcaacgatatcgacgatgtcgacaatattagcgccgatctgctgcgtttttactgcaaagaagtcgagcagtatctgaacccgcgcggcggtcattttacccccggctcctacaccgtctccgcgcacgtgccgctgggttcggtggtgggcgccaccccggacgggcggctggccggtgaacagttggcggacggcggcctgtcgccgatggttggtcaggattcccaggggccgacggcagtgctgaaatcggtcagcaagctggataactatctgctgtcgaacggtacgctgctgaacgtcaaattcactccggcaacgctggccggcgacggcggcctgaacaaactggccgattttttacaggccttctgcaagctcaagctgcagcatattcagttcaacgtggtcaatgccgacaccctgcgtgaagcgcagcagcggccgcaggactttgccggcctggtggtacgggtcgcgggctacagcgccttctttgttgagctgtcgaaggagattcaggatgacattatccgccgcaccgcgcatcagctgtga

SEQ ID NO: 279 - DNA, 1473 bp, Klebsiella pneumoniae
ggtttcttcacctttgcgcacgcgcaggacggagtagtgcggcgtttgcatttcgtcgtttggcacgataataacgcgcacatcgccctgacgggattcgatagcgctcactgcggcacgtttttcgttcagcagataggaggcgatcggtaccggaacaatggcgtggacttctttggtattctctttcagcgcttcttcttcgatcagacgcagaatagagagcgacagcgattcgttatcacgcacggtgccggtgccggagcagcgcgggcagacgtggtggctggactcgcccagcgacgggctcaggcgctgacgggacatctccagcaggccgaagcgcgaaatatggctgatctgaatgcgcgcccggtcctgacggacggcttcgcgcagacgattctccacggcgcgctggtggcgaaccggggtcatatcgatgaagtcgataacgatcaggccgccgaggtcgcgcagacgcagctggcgggcaatttcgtcagccgcttcgaggttggtattgaaggctgtctcttcgatatcgccgccgcgggtggcgcgggcggagttgatatcgatcgcggtcagcgcttcggtgctatcgataacgatagacccgccggaaggcaggcgcacttcgcgctggaaggcagactcaatttgcgattcgatctgataatggctgaacagcgggatttcaccggtgtacagtttgattttgctgctgaaatccggacgacccagcgcggcgatatgctggcgcgccagctcaagcactttcgggttatcgatcaggatttcgccgatgtcctggcgcaggtagtcacggaaggcgcggacaatgacgttgctttcctggtggatcaggaacggcgccggacggctttccgcggctttctgaatcgcttcccagtgcttcaggcggaagctaaggtcccactgcagggcttcggcggatttgccgacgccagcggtgcgaacgatcaggcccatgccgtccggaagctccaggctcgccagcgcttctttcagttcggtacggtcgtcgccctcgatacggcgggaaattcccccggcgcgcgggttgttcggcatcagtaccagatagctgcccgccaggctgataaaggtggtgagcgcagcgcctttgttgccgcgttcttctttatcaatctgcacgataacttcctgaccttcccgcagtacgtctttgatattaggacgaccatgcgcattgtagttggcggggaagtattcgcgggcgatttctttgagggggaggaaaccatgacgctcggcgccgtaatcaacaaacgcggcttcaaggctgggttcaatgcgggtgattttgcctttgtagatgttcgcttttttctgttcgtgcccggggctttcgatatccaggtcgtacaggcgctgcccatcaacaagggcgacgcgcaactcttcctgctgagttgcgttgattaa

SEQ ID NO: 280 - DNA, 1158 bp, Klebsiella pneumoniae
caacaagtcacgcccccggtgaaggatttaaccgtgaggtcttttgtaacttcatggcgaattttggatgataatgaggcgcaaaaaatgaaaaagacagctatcgcgattgcagtggcactggctggcttcgctaccgtagcgcaggccgctccgaaagataacacctggtatgcaggtggtaaactgggttggtcccagtatcacgacaccggtttctacggtaacggtttccagaacaacaacggtccgacccgtaacgatcagcttggtgctggtgcgttcggtggttaccaggttaacccgtacctcggtttcgaaatgggttatgactggctgggccgtatggcatataaaggcagcgttgacaacggtgctttcaaagctcagggcgttcagctgaccgctaaactgggttacccgatcactgacgatctggacatctacacccgtctgggcggcatggtttggcgcgctgactccaaaggcaactacgcttctaccggcgtttcccgtagcgaacacgacactggcgtttccccagtatttgctggcggcgtagagtgggctgttactcgtgacatcgctacccgtctggaataccagtgggttaacaacatcggcgacgcgggcaccgtgggtacccgtcctgataacggcatgctgagcctgggcgtttcctaccgcttcggtcaggaagatgctgcaccggttgttgctccggctccggctccggctccggaagtggctaccaagcacttcaccctgaagtctgacgttctgttcaacttcaacaaagctaccctgaaaccggaaggtcagcaggctctggatcagctgtacactcagctgagcaacatggatccgaaagacggttccgctgttgttctgggctacaccgaccgcatcggttccgaagcttacaaccagcagctgtctgagaaacgtgctcagtccgttgttgactacctggttgctaaaggcatcccggctggcaaaatctccgctcgcggcatgggtgaatccaacccggttactggcaacacctgtgacaacgtgaaagctcgcgctgccctgatcgattgcctggctccggatcgtcgtgtagagatcgaagttaaaggctacaaagaagttgtaactcagccggcggcttaa

SEQ ID NO: 281 - DNA, 1602 bp, Klebsiella pneumoniae
actatcgccactttccagcgcccgcatttgcgggcgttttactccagggtttggaataacagcgtaatgaaccttttaaaatcactggcggcagtcagttcgatgaccatgttttcgcgcgtgctgggctttgcccgcgatgcgattgtggcgcgtatttttggcgccgggatggcgaccgatgccttttttgtcgccttcaaactgcctaacctgctgcggcgtatttttgccgaaggcgccttctcacaggcgtttgtgccgatccttgccgaatataaaagcaagcagggcgaagatgccacccgcgtgtttgtctcatacgtctccgggctgctgaccctggccctggctatcgttaccgttatcgggatgctggcggcgccgtgggtaatcaccattactgcgcccggctttgccgataccgccgataagtttgcgctaaccacccagctgctgcgtattacctttccctatattttgctgatctccctggcttcgctggtgggggcgatcctcaatacctggaaccgcttctcggtgccggcctttgcgccgacgttcctcaacgtcagtatgattggctttgcgctgtttgccgcgccgtatttccatccgccggtgctggcgctggcctgggcggtgacggtcggcggcgtgctgcagctggcttaccagctgccgcatctgaagaagattggcatgctggtcctgccgcgaattaatctgaaagatgccggcgcgatgcgggtggtgaagcagatggggccggcgatccttggcgtgtcggtaagccagatctcccttatcatcaataccattttcgcctcattcctcgtgtcgggctcggtgtcgtggatgtattatgccgaccgcctgatggagtttccctccggcgtgctgggcgtggcgctcggcactatcctgctgccatcgctgtcaaaaagcttcgccagcggtaaccatgacgagtattgccggctgatggactggggactgcgtctctgttttctgctggcgctgccgagcgcggtggcgctggggatcctcgccaaaccgctaaccgtggctctattccagtacggcaaattcagcgcctttgacgcggcgatgacccagcgcgcgctggtggcctattccgtggggctgatgggccttatcgtggtgaaagtgctggcgccgggcttctattcacgtcaggacatcaagaccccggtcaagattgctattatcaccctgattatgacccaggtaatgaacctggcgtttatcggcccgctgaagcatgcgggtctgtcgctgtccatcggcctggcggcctgcctgaacgccgcgctgctctactggcagctgcgtaaacagaaaattttcaccccgcagccgggctggttggccttcctgctgcgtctgattattgcagtgctggttatggccgcggcgctgctgggcgtcatgcatctcatgcctgagtggtcgctggggacgatgccgttccgtctgatgcgtttgctggcggtggttatcgccggggtggtagcctatttcgccacgctgctggtgctgggcttccgcgtgaaagagtttgtccgtcgcacggcgtaa

SEQ ID NO: 282 - DNA, 414 bp, Klebsiella pneumoniae
tgtaattacacccctccagcaggcggaacagcgggcgcggatagcgcacgccgagccacgcaatggggatcgcgcaaaccgttgtcagcagcgccccgcccgcccccaggagcagggtctggcgcagagaatgccagagatcggcatgcagccagttgtcgatgccgcccagccatagccagcggcacaggaccagtaagggaacccccatcgccagcatcaccagcagcagaagcagtagctgcgcgccaaaagcggcccctttacccagcacaagccgcttctgctcgcgggccgccccggcgccgatacgcgcgtaacgcgctttaccgcgtgaggcgctctccagcagcaggatcgccaggcagcacaaggccagcacgcctgccagcatattggcggccggaccgctga

SEQ ID NO: 283 - DNA, 315 bp, Klebsiella pneumoniae
aatcacttaacggagtgttacgccatttcaggtgaaacccaggcggtcacatccctgcgggaaatattttatcacaaccccgccgccggatattctcgcgatgaggcgtcatctttcagacatatcccgatgttatcttcacacagagccctgtatctttttccctttccaaacagaatattaggttggtctatgtcgggtcttattctctttatcgtcgcggtggcgctgctgggcgtcgccatctacagcctggtgtcgtacctcaaagagcggcgcgccagtcagttacctgtccataaaaagaagaaataa

SEQ ID NO: 284 - DNA, 204 bp, Klebsiella pneumoniae
aagaaggggttaccgaaaggtaacccctttttgcttttacctgtagccgtcctgactgcacttcaccttcacctcccgactccgcaaacccgccatgtctgtagtgttatcgctggcgaaaaggtgacgatcaatccattacaaatggttgttattttaattattcagcctcttgttataaacggcaatggtgctgaggaataa

SEQ ID NO: 285 - DNA, 318 bp, Klebsiella pneumoniae
aagaggaaaaccatgagttttgaaggaaaaatcgcgctggttaccggtgcaagccgcggtattggccgtgccatcgctgaaacgctcgtcgcccgtggcgcgaaagttatcggtactgcgaccagcgaaagcggcgcgcaggcgatcagcgactatttaggcgccaatggtaaaggtctgatgttgaatgtgaccgacccggcatctattgaatctgttctggaaaatgtgcgcgcagagtttggcgaagtggatatcctggtgaataatgccgggatcactcgcgacaatctgttaatgcgcatgaaagatgactag

SEQ ID NO: 286 - DNA, 699 bp, Klebsiella pneumoniae
atcatggaaaccaatatcgtagaagttgagaattttgttcagcaaacggaagagagacgggttagcgcgttcgcgaaagaagtgaagcgctacctcgaaacctaccctgatacccagtatgtcgatgtcctcctcactgacctgaacggctgcttccgcggcaagcgcatcccggttgccggcctgagcaaactggagaaaggctgttatttcccggcctcggtgtttgcgatggatattctcggcaatgtggtggaagaggccggtctgggccaggagatgggcgagccggatcgcagctgcatcccggtacccggcaccttaaccccttcggcggctgacccacaatcgatagcccaggtacagctaaccatggttgatgaagatggcgctccctttgacgttgagccgcggaacgtactcaaccgcctctggcagcagttgcgccagcgcgggctgttccccgtggtagcggtagagctggagttctatttactggaccgcaaacgcgatgccgaaggctacctgcagccgccgtgtgcgccgggcaccgacgatcgcaacacccaaagccaggtctattcggtcgataaccttaaccacttcgctgacgtgctcaacgacatcgacgagctggccaaactgcagctgatcccccgccgatggcgcggtggcggaagcctcgccgggccagtttga

SEQ ID NO: 287 - DNA, 426 bp, Klebsiella pneumoniae
caggaggaaaccatgaaagagaatgatattgctggcatcctgacctcgacacggacgattgcgctggtcggagccagcgacaagcctgaccgtccgagctaccgggtcatgaagtatctgctggatcaggggtatcacgttatcccggtttcgccgaaggtggcgggcaagacgctgctgggacaacaggggtatgcgacgctcgccgacgttccggaaaaggtcgacatggttgatgtcttccgtaattcagaagcggcgtggggcgtagcgcaggaggcgatagccatcggcgcgaaaacgctatggctgcagctgggggtgatcaatgagcaggctgcggtgctggccagggaagccggattgagcgtagtgatggatcgctgcccggccattgaactaccgcgactagggttggcgaaataa

SEQ ID NO: 288 - DNA, 1101 bp, Klebsiella pneumoniae
aaagtgagaaccggaatgaaaaaaacctgtcgtattgccgccatcccgggtgacggaattggcaaagaagtgctgcctgaagggattcgcgtgctgcaagccgccgcgcagcgttgggatctgtcgctgagcttcgagcagatggagtgggcaagctgcgaatattacgcccatcatggcaagatgatgccggactactggcgcgagcagctgcagggcttcgatgctatctacttcggcgccgtcggctggccggataccgttcccgaccacatttcgctgtgggggtcgctgctgaagttccgccgcgagttcgatcaatacgtcaacctgcgcccggtgcgcctgttccccggcgtcccctgcccgctggcgggtaaaaaggccggcgatatcgatttttacgtggtgcgcgaaaataccgaaggcgaatattccgcccttggcggccgcgccaatgaaggcaccgagcatgaagtggtgattcaggagtcggtctttacccgccgcggcgtggaccggatcctgcgctacgccttcgaactggcgaaaagccgcccacgcaaaacgctgacctccgcaaccaaatccaacggtctggcgatcagcatgccctactgggatgagcgggtggaagagatggccaaaaactatcccgaaattcgctgggacaagcagcatatcgatatcctgtgtgcccgcttcgtgctgcagccggagcgttttgacgtggtggtcggctccaacctgttcggcgatattctctccgatctcggcccggcctgtaccggcactatcggcattgcgccgtcggccaatctcaatccggagcgcaatttcccgtcgctgttcgaaccggttcacggctccgcgccggatatctacggtaaaaatatcgccaatccgctggcgacgatctgggccggggcaatgatgctcgacttccttggcaacggcgacgaacgctaccgcgccgctcacgatggcatcctggcggcaatcgaacagacgatcgccagtggtccgaagacgccggatatgcaaggaacagcgtctacccggcaggtcggggaagcagtttgcctggccttaacccaataa

SEQ ID NO: 289 - DNA, 471 bp, Klebsiella pneumoniae
tatttcctgactaataccaatgaggatagcaaagatgacgttcagacagggtgcaatggcgctggtgctggcagggttactcagcggctgcgtggcgggtggaagttcatcgaccagcgcgccgaagcccggggttttgcccgggcggataagtccatggtgcaaaccacgctttacttcggtctgagccgcccggcggggaaagacatcaccgctgaagagtggcaacagtttgtcgaccgtgacgtcacgccgcgctttcgcgacgggctgacggtgtttgatgcccacggccagtggcttggccagaatggtcaggtggtgcgggagcagagcaaggcgctgatggtgatccatgggcatgacgcgcagagcgaggcgggtattgaggctctgcgccagggctataaatcacgcttcgcgcaggagtcggtgatgcgtgtcgaccagccggtctgcgtgcagttctga

SEQ ID NO: 290 - DNA, 1332 bp, Klebsiella pneumoniae
cctggtccgacggcacgggccattacagcgcaggatatcgtctggagctggcaacggctggtctcgccggcaacagcctccccctacgcgagctaccctggcaatatgcatatcgccaacgcccgcgagattgccctcgggcaaaagggacccgagacgttgggggtgaaagcgctgaacgacaccacgctgcaggtcactctgacccagccgaatgccgccttcctggcgatgctggcgcacccttcgctggtaccgatcgacaaagtgctggtggagcggtatgccgataaatggacccgaccagagcatatcgtcaccagcggcccgtataagctgtcccaatgggtggtgaatgagcggctggtggctgaacgtaatgcgaagtactgggataatgcgcacaccgttattaataaagtgacttacctgccaatctcttcggaggccgccgatgtcaaccgctacaaagcaggggagattgatattgtctatacggtgccgatcaatcagtttgcgcagttgcagaaaaccatgggcgaccagctggacgtttcgccgcagctggcgacctattactacgaattcaatactacccggccgccgtttaacgacgcccgtgtgcgtcgcgcgctgaatatggcgcttgataaagatatcattgccggaaaagtgcttggccagggccagcgcccggcctggctgatcggtcagccggatatcggcggcgtgacgctgcataacccggactacgccagctggccgcgtgagaaacggattgccgaggcgaaaaaactgctggcgcaggcggggtatgatgaaagccatccgctggtctttaccctgctctataacacctctgagtcgcaccagcgtatcgccattgccgccagctctatgtggaagaaaaacctcggcgtcgaggcgaagctacagaaccaggagtggaagacgatgctggataccatgcatacgcataacttcgacgccgtccgctacgcgtggattgccgactacgacgatgccgccaccttcctcaatactttccgtaccggggatagcgagaacaccagtcagtacagcaacccggcttacgacgcggcgctgcgcaacgcggcgaaagcctccgacgtggcgacccggggcaaatactatcagcaggcggaagatctgctggcgcaggatgttcccgccattccggtctatcactatgtacgtacccatctggtgaaaccttgggtagggggcttcacgccggataagctggggtattactacaccaaagacatgtacattaaaaaacacccatccgccagcggcgatgggcgttga

SEQ ID NO: 291 - DNA, 528 bp, Klebsiella pneumoniae
ccgccccggaccaggtgctccagcgcaaaaaaacgttacaatcatcaggtcttattatccaccgggcaaaaccgaggctttatgcgtaccattctgaatattttgaactttatccttggcggtttcgccaccactctaggctggctactcgccaccctggtcagcatcattctgattgtcacgctgccgctgactcgttcctgctgggaaatcactcgcctttcgttatttccctacggtaacgaggcgattcatgttgacgagctcgagccggggcgcaaaaacggtctactgaacgccggcggtaccgttctgaacattctgtggttcatttttttcggctggtggctctgcctgatgcacattttcagcggtatagctcagtgcctgactatcataggcatcccggtggggatcgcgaatttcaaaatcgccgccatcgccctctggccggtgggtcgccgggtcgtttctgtggaaaccgcgcgtgctgcgcgtgaagccaatgcgcgtcgtcgctttcagtaa

SEQ ID NO: 292 - DNA, 927 bp, Klebsiella pneumoniae
aacgtggggacaagattgcgcattggggtggtcggcttaggcagcattgcgcagaaagcgtggctgccggtgctgggggcggcggaaagctggacgctgcaggcggcctggtcgccgggtaaagagaaggcgctgcggatctgcgaaacctggcggatgccatacgctgattccctcgatgccctggcggcacagtgcgatgcggtctttgtccatacctcgacggcttcacattatgaagtagtgaatcacttactgaatgccggggttcatgtttgtgtggataaaccattggcggacaagctgagtgaggcggagacgctggtcgagctggcggcgcgacgtcgactgacgttgatggtcggttttaatcgccgcttcgcgccgctctatcgggagctgaaggggcggctgggcgaggcggcctcgctgcggatggataagcatcgtagcgatagcgtcggcaacgatctgcgctttacgctgcttgatgactatctgcatgtggtggataccgcgctatggctggccgacggtcaggcacgtctgcgcggcggcgcgctgaagatcaccccgcagggcgaaatgctctatgccgaacatcagttcagttcgccccggctgcaggtcaccaccagcatgcatcgtcgcgcaggcagccagcgcgagtgggtgcaggcggtcacggatggcgggctatatgccgtcagcgagatgcgcgaatggcaggaggagtgcggtcatggcgtggtccagcgcccggttgccggctggcaaaccacccttgagcagcgcggctttgtcggctgcgcgcgccattttatcgaatgcgtgcaaaatcagacagttcctgaaactgcaggcgaacaggcgctgctggctcagcggatcgttgagaaactgtggcgcgacgccattagcgaataa

SEQ ID NO: 293 - DNA, 957 bp, Klebsiella pneumoniae
ccattttgcgcagcggattgccggccagctgtagcgcatgcatcgccggaaaagagattattgatgtccatcacactttgtgggctcgcgtacgtatgtccagttttttgtagcgctcgcctcgtgtcatgccgcggagggaccagtagagtttgtttgtgttatcggaacgttaaaaaggaacgtaaaatgaactcatcatcggctaactttctcgatgcgttaggcgccagccagacgctcagcgcgcaaatgaaacacgagctcgacaccctcggctacaccgtcgtgcataacgtcgttgacgcccagtggctgagcgaaatgcgcctgcttattgacaccctggttgaacgcgaaggcgataatctggcgatggagcaccatcaggaggcgacggcgacgcggatcgctaacctgattaataagggggttatctgggagaaagtctggtcacacccgctgatcctctccgcttgtcgctatatcttcaacggggattttaaagtctccagcctgaacgcccgcgaggcgctgtataacggcggccaccagccgctgcacgccgactggaaaaagccgcgcccggattttcccaaagtccacctggtgaataccatctgggcgatagacgatttgagcgccgccaacggcgcgccgcggatcattcctggtacccacctccgccccgagttaccggaggaggtgctggccgacccggaacaggcccatcccgatgagattgtgtttgccgcgccggctggcagcgtgatgatctacaacgcccacgcctggcacggcggcacccgtaatcgtgaaggcagcagacgacgcgtactgcatgggttatatatcgatcgtgcggatacgccgcagcaggaccagcggcgctggctcacgccggagacggcaagccgcctgacgccggcgcaaaagtggctgctggatgtagaataa

SEQ ID NO: 294 - DNA, 2181 bp, Klebsiella pneumoniae
agccaatgcgcgtcgtcgctttcagtaaccgaacggaacacggacatgattagccccctgctacgccgctacacctggaacagcgcctggctttataacgtacgaatttttatcgcgctctgcggcacaacgctgtttccctggtggatcggcgaagtcaaactgaccatccccctcaccctcggcgtcgtggctgcggctctgaccgaccttgacgaccgtctggccggccgtctgcgtaatcttgccattactctggtttgcttttttatcgcctccgcctccgtggagctgctgtttccgtggccgccgctgtttgcccttggtttgaccgtgtctaccatcggctttattttgcttggcggcctcggtcagcgctatgcgaccattgccttcggcgccctgcttatcgccatctacaccatgctcggcgtcacgctgtacgatcattggtatctgcagccgttgttcctgctggcgggggccgtgtggtacaacctgctgacgctgtccgggcacctgatctttccgattcgtccattgcaggacaacctggcgcgtagctatgagcagctggcccgctatcttgagctcaaatcccggctgtttgatcctgaccttgaggatgagagccaggcgccgctgtacgatctggcgctcgctaatggccagctggtagctacgcttaaccaaaccaaggtctcgctgctaacccgactgcgaggcgatcggggccagcgcggcacccgccgcaccctgcagtactactttgtggcccaggatattcatgaacgcgccagctcatcgcatattcagtatcaaaccctacgcgatcaatttcgctatagcgatgtgatgttccgtttccagcgtatgctttcgatgcaggcgcaggcctgccagaaactgtcgcgggcgattctgttacgcgaaccctatcagcatgatgcccattttgaacgggcgttcatgcatctcgatgcggcacttgagcgcgtgcgcgccggcggcgcatccgacgagcagctcaacgccctcgggtatttactgaataacctgcgcgctatcgatgctcagctggccaccattgaatcggtgcaaaccaccgcgcctgccgggagtaataccgagacgctgctggccgacgacagacttggcggtctgagcgatatctggctgcgcctgcagcgcaatatgtcgccagagtcggcccttttccgccacgcagtacgtatgtcgttggtgctctgcgccggctatgcctttatccagtttaccgggctccagcatggctactggatcctgctaaccagcctgttcgtctgtcagccgaactataacgccacccgccatcgcctggcgctaaggattatcggcacgctggttggggtggcgatcggcctgccggtcctgctgctggttccctctgttgaagggcaactgctgttgatcgtcctgaccggcgtgctgttttttgccttccgtaacgtgcagtacgcccatgccacgatgtttattacgctgctggtgctgctgtgctttaacctgcttggcgagggctttgaagtcgcgctgccgcgtatcattgatacgctgatcggctgcgccatcgcctgggcagcggtcagcttcatctggccggactggaaatttcgcaacctgccgcgggtgctggaccgggcaatgaacgcgaactgccgctatctggacgcgattctggagcagtatcatcagggccgcgacaaccggctggcctaccgtgtcgcgcgtcgtgacgcctacaaccgtgatgctgagctggcctccgtcgtctcgaacttatcgactgaaccacgcgcggatgccacccagcgagaaaccgcctttcgtctgctatgccttaaccacacgttcaccagctacatctccgctcttggcgcgcatcgggaaaaactgtccacgccggaaatcctcgccctgctggatgatgcagtctgttatgtggatgacgccttgcaccatacccccgcggatgaacagcgggtgcaacaggctttgaacagcctgcaaagccggatccatcatctggaaccgcgcgcggacagtaaggaacccttggtcttacagcagattggcctgctgctggcgctgctgcctgaaatctgccgcctgcagcaacgggtccacgcccaaaccgaataa

SEQ ID NO: 295 - DNA, 414 bp, Klebsiella pneumoniae
cgatctcttttgaagggctggttaacgtgtcgccagcgggagcaatccagcccgggattggcggaacgttgggaaaacaaagacaacttgttaaggacctttcatttacgccccggtctgacctggtccgacggcacgggccattacagcgcaggatatcgtctggagctggcaacggctggtctcgccggcaacagcctccccctacgcgagctaccctggcaatatgcatatcgccaacgcccgcgagattgccctcgggcaaaagggacccgagacgttgggggtgaaagcgctgaacgacaccacgctgcaggtcactctgacccagccgaatgccgccttcctggcgatgctggcgcacccttcgctggtaccgatcgacaaagtgctggtggagcggtatgccgataa

SEQ ID NO: 296 - DNA, 1080 bp, Klebsiella pneumoniae
cgcaactcagccgctggatgccgtggcgcgcgacattcgcgccacgatcgcccagtggatggcggagcaagcggcatgaaatggtatccgtggctgcgcccctcgttcgagcaactggtcggtagctatcaggccggacgaggccaccacgccttactgttacagtccctgaacgggatgggcggcgaggcgttgatttacgcgctgtgccgcttcctgatgtgccgccagcccgaaggacataaaagctgcggccattgccatagctgtcagctgatgcaggccggcacgcaccccgattactatgcgctcagccccgagaagggcaagagcgcgctgggtattgacgcggtgcgcgatgtcaatgaaaagctctatgaacatgcgcgccttggtggggcaaaagtggtctggattagcgatgctgccttgctgaccgatgccgccgccaacgcgttgctgaaaacgctggaggagcccccggagaatacctggttcttcctcgcctgcgaggagccggcgcgtctgctgaccactctgcgcagccgctgtcgcctgcatcatctggcgccgccgtctgagccttatgctctggcctggctggagcgtgaggtgagcctgccgcaggagtcattgttgaccgcgttacgcctgtgcgccagcgcgccggctgcggcgctcgaactgttacaggaaccgctgtggacggcgcggcagcagttgtgtcaggcgctggcggctaccctggcgagcggtgactggctggcgctgctgccgatactcaatcatgaacaggcggcggttcgcctgcactggctggcgtcgctgctggtcgatgcgcaaaaacgacagcaggggattaccctggtgagtaaccctgacgtctggccgctgctggagcagctggcgcacagcctgcccgccgcccggctgcaggcgattgcccatgacgtctgtacctgccgcgagcaattgctcaacgttgtcggtgtcaaccgcgaactgctgcttaccgagcgcctgctgcgctgggaacattacctgcaacccgggacgggtttacccgtctcccacctctga

SEQ ID NO: 297 - DNA, 366 bp, Klebsiella pneumoniae
ctgcggtcagcgcgtcatgggaacgacgcatgccacgtttggaacgggttggtttattctgttgtacggccatggaccttactcctcaattacttacgctttaagctggctaatacggcaaatgggtttggtttttgtgcctcttcaggcagttcgccaaagaccatgtccgcgtcggacacttcacagtgttcagaatcatgcaccggaactacgggcagggagaggataatttcatcctcgaccattgcctgcaggtcgatttcaccgaattcgttaacctcaatcggctcatacgcttccggtagtgcttcggcctgttcgtcatttctgacggggctaaaacaatacgtggtgtggacgtga

SEQ ID NO: 298 - DNA, 486 bp, Klebsiella pneumoniae
cctcccgcggcagtttcttcgccagatcgcgctgcagggcgctgtccggccacagtacttcacaacccaccgccagcacagccgccagctggatcagcgcatcctgttcgttatccgctacgcacagcacgcgctcgcgcggcatcagcgtcagggtgttgcgctcgccggttggccccggcagcaggcgttgggtgccgctttgcgcctgctcgctgtactgctggcacagcgcctgcagctcaggacggcccgcggcccactgctgcagcgcctgcagcggtttttccagcagcgttttcagctgggcgtccagcggacgctctgcatcctggcgggcgaaggtcacgccaaccgcgtcctgcggacggctggagagcagacggtacagatacagcggaccgccggctttcggaccggtaccggacaacccttcgccgccgaacggctgaacgccgaccaccgcgccaaccatattgcggttga

SEQ ID NO: 299 - DNA, 300 bp, Klebsiella pneumoniae
atggcagcttaccgggcccgggggagcgagagcggaagtgtattcacgccgcgaatggtgaccaccgatatgctggcgctgcgcgaggcggcgatggccggcgtaggcgtggtgcagcttcctttattaatggtgcgcgatcagctggcgtcaggggaattagaggtggttctggacgagtggcagccgcggcgggaagtgatccatgcggtatttgcctcacggcgcgggctgctgccctccgtcagggcgctggtggactacctcagcgaagagtatcagcggatggaggaggattag

SEQ ID NO: 300 - DNA, 1119 bp, Klebsiella pneumoniae
tgtacttattacatacgcggtagttcccggcagtgtgacgtttcactatggagatcgcgaatggtaaggtcccgtaccggacaacgtaaaacctcagaccgtactcttcagcacggaagccccgcttccggcagcgattttcttactctttctctctccgcttcgcattattacaaccttggcagggtacgcggtgcgcgtagccgcgactcgttgtcagttctaccggcaagcaatggcttacaaggaagccaaacctcaatcgttcgtgcgcatagtcgcgtcgatgttgacgcgtgtgatgtaaaccaacaacgcaaggtgctatccatgggaagacaaaaagcagtgatcaaagctcgtcgtgaagcaaaacgtgtgctgagacgggattcacgcagccataagcagcgtgaagaagaatcggtcacatcgcttgtgcaaatgagtggcgtagaagcaattggcatggcgcgggacagccgtgatacttccccaattgaggcgcgcaatgaggctcaggcgcattatttgaatgccattgacaataagcagctgattttcgctaccggcgaagctggatgcggcaagacctggatcagtgcggcgaaggcagctgaagccctgatccataaggatgtggacagaattattgttacccgtcccgttctgcaggccgacgaagatctcggcttcttaccgggagatatcgccgagaagttcgctccctatttccgaccggtttacgatgtgctggtgaaaaggctgggggcttcctttatgcagtactgcctgcgtccggaaatcggcaaggtggaaatcgcgccgttcgactatatgcgcggacgtacctttgaaaatgcggtggtgattctggacgaggcccagaacgtgaccgcagcgcaaatgaagatgtttttaacccgcctcggggagaacgtgacggtcatcgtcaatggcgatatcacccagtgcgacttgccctctggcgtgagatctggcctgagcgatgcgctggcgcgttttgaggaagacgagatgatcggcatcgtgcgtttcaccaccgatgactgcgtgcgctcggccctctgccagcggacgctgaaagcctattattaa

SEQ ID NO: 301 - DNA, 222 bp, Klebsiella pneumoniae
atatataattacatcccgatggaaatcaaatttatcttgcataaaataaagtataataagacaatcatccttatctacattgatataatactctctcttttaccactgttatgccgccaccatggctaccaccacctaactgttcagttgctgttgtataaaacaattctttcgctacagtgcctgactgacatgagcaggtgtttgtttccgggttattaa

SEQ ID NO: 302 - DNA, 1143 bp, Klebsiella pneumoniae
caaggcaattacccggaactcaccatgcaatacgatcttatcattattggcagcggctccgtcggcgccgccgctggctattatgcgcgccgtgccggactcaatgttctgatgaccgatgcccatcaacctccccaccaggaaggcagccatcacggcagcagccgtcttatccgtcacgcctatggcgaaggtgagaaatatgttccgctggtgctgcgtgcccagcagctatgggatgaactggcagagatcagtggcgaagccgtgtttgaacgcaccggcgtcattaacctcggccccgccagctccgcttttctcgccaacgtcgccgccagcgcccgtgcgttccagcttgaggtggaagagctggatgcccaggccgtgatgcagcgctggccggagatacgcctccccgatgactatcgggcgattttcgaacccgcttccggcgtactgcgcagcgaactggccgtcgaaacctggatccgtctggcgcgggaagcaggctgcgcgcagctattcaactgtccggtctcggctattcatcaccatgctgacgggatcaccatcgataccctcgacggtgaatatcatggtaaaaagctgctggtcagcgccggcacctgggtcacccgcctgcttccggatctccctatccagccggtacgcaaggtgttcgcctggtaccaggccgatggccgttacagcagcaagaatcacttcccggccttcaccggcgagttgcccaacggcgatcaatattacggtttcccggcggaagataatgaactgaaaattggcaagcataacggcggccagccgatctccaccccgcaggaacgggtagcgtttggcgctgtcgccagcgatggttccgaatccttcccgtttttgcgtaacgtcctgcctggcatcggcggctgcctgcacggcgcctcctgtacctacgacaataccgtcgatgaggactttattatcgatacgttgccaggcaggccagacacgctgctgatcaccgggctgagcggccacggctttaagtttgcgccggtgctgggcgaaattgccagtcagtttgctcagggcgaagcatcgagcttcaatctggcccccttttctctggcgcgctttaacgcgtaa

SEQ ID NO: 303 - DNA, 615 bp, Klebsiella pneumoniae
cgtcgcctctatttactacgcgcagccgctgctgccgttgatgggcgccaatctccacctgactgtagaaggtatgggtctggtccctaccctgacgcaggcgggttatgcgctcggcattctgttcctgctcccgctcggcgaccgccacgatcgccgccggctgatcctggtgaaaagcgcgctgctggcgctcctgctgctcctgtgcagcctcaccggccagctcagctcactgctggtggtcagtctgctgatcggtatggcggcgaccatggcgcaggatatcgtcccggcggcggcgatcctcgccccggcgggcaagcagggaaaaatggtgggcacggtgatgaccgggctgctgctggggatcctgctctcccggacggtcagcggcgtggtgggcgccgtattcggctggcgggtgatgtatcaggcggcggcggtcagcgtcgcgctgattggcctgttaatgtggcgcgtcctgccgcgcttcgctgtgcactcgacgctgagctatccgcagctgatggcctcgatggcgcatctgtggcagcgttacccggcattacgccgcgccgcgctagctcagggcgcgctctccatcgcctttag

SEQ ID NO: 304 - DNA, 1158 bp, Klebsiella pneumoniae
gcgacactctacttaccgaaagggatgatcatgatgattcattttcgccgtaatgcgctgcgggtgaccgtggccgcgctgctcagctctgcattcggtgctcaggctgcggatatcccgcaggtcaaagtcaccgtcaacgacaagcagtgcgagccgatgcaggtgaccgttaacgcgggtaaaacccagtttattattcagaaccacagccagaaagcgctggagtgggagattctgaaaggggtgatggtggtggaagagcgcgaaaacatcgctccgggctttactcagaagctcaccgcgaacctgcagccgggcgaatatgacatgacctgtggcctgctcaccaacccgaaaggcaaactgatcgtcaccggcgccgccaccaaagacgcggcgaaagcggatgcggtgctgagcctcggcgacgcgatcaccgcctataaagcctatgtgacggcggaaaccgcgcagctggttagcggcaccaaagcctttaccgacgcggtgaaagccggcgatatcgaaaaagcgaaagcgctgtacgccccgacgcgtcagcattacgagcgcatcgagcccattgccgagctgttctctgaccttgacggcagcatcgacgcccgcgaagacgacttcgagaaaaaagcggaagatccgaaatttaccggtttccaccgtctggaaaaagcgctgtttggcgataacagcgtcaaggggatggaaaaatatgccgatcagctgaacagcgatgtgctggagctgcaaaagcgtatcagcgagctggcgttcccgccgtcaaaagtcgtgggcggcgcggcaggattaattgaggaagtcgcggccagcaagatcagcggtgaagaagatcgctacagccataccgatctgtgggacttccaggccaacattgacggcgcgcagaaaattgtcgacctgctgcgcccgcagctgcaaaaagagaacagcgcgctgctggcgaaagtggacgccaactttaagaaagtggacagcatcctcagcaaatatcgcaccaaagacggtttcgagacctacgataagctgaccaccgccgaccgtaatgcgctgaaagggccgatcaccaccctggcggaagatctggctcagctgcgcgggatcctggggctggactaa

SEQ ID NO: 305 - DNA, 504 bp, Klebsiella pneumoniae
ctaattgattttgtattaaatatggcggtgagggggggattgactcgcttcgctcgcccctgcggggcagcccgcttactgcgtgcgcggtctgtccaactggctgcgccagttgtcgaaccccggtcgggggttctcatccccccctgcggagaatataaaagaaaagagcccgtacttgcgtacgagctcttcttaaaatatggcggtgagggggggattcgaacccccgatacgttgccgtatacacactttccaggcgtgctccttcagccactcggacacctcaccatattgtctttcccgttgttgtcgggaacgggcgctaatgtagggaaatacgtatcgcccgtcaatcaactttttgcaaaaaaagcgcgtttagacaaacttcgagcaacttgctccttaaacgtgcgaaatccgttttttttgtcgccagtagcttttcccttttcgctcgggggaaatttgttatgctggcaaaccaatagaaaacaatga

SEQ ID NO: 306 - DNA, 726 bp, Klebsiella pneumoniae
aagaggcaatatatgtcatccagtaatagtagttcaacattttcggtattaagctttgtagatggattgtgggatttagcgaaagtagcaaaattaatttatttcacactatgttttgatgttctatttttctatctaaaaggaaatggtttatttggcataaaattagggaaggaattcgatctttcacttgcagatttggccggaatgattattgctttaggaattttctcatcaataatattagaaataacatctctatgctttaatctacttctgatacgaattaagtatagtaatctactacaaagtaaagatgagaggatctaccaaaaatcatctactgaagtttttatgtcagaactacgagatgatgctttagaaaatggcgacgacatgtcattaaaattgtatactgaagagcaaagcaaaagagagaaaaattataaagaagggagagcagctgaaataatctcttttggaacaatttttgttttctcaatagagtggtatttatctgcatcaaatggttccagtcggatgtttattgactggttatgggaacaatcaaaacacagtgatcctacaacaccacattatctcattggtctattaatttcttcagcattactattctatgcagtatcagtctgctggcccaaagaggatggtcacaaaatatattaccccaagcttgctaagaaattgagaaaaaaagaacattag

SEQ ID NO: 307 - DNA, 414 bp, Klebsiella pneumoniae
  unsure (164): Identity of nucleotide at the above locations are unknown.
aaatggaaatatctggtaaagaagcaccgggaaggtgagctgattacccgctacattgaggccagcgctgcgcaagctgcggtagatgacttgctgacgctcgagaatgaacctgtgctggtgcatgcctggattgagcagcatatgaatccagcgctgatganccgcatgaagcagactatccgcgcgcgacggaaacgccattttaacgctgagcatcagcatacgcgtaagaagtctatcgaccttgagtttgtcgtttggcagcgtcttgctggcctggcgcagcggcggggcaaaaccttttctgaaaccatcgtccagctgattgaagatgccgagcacaaagagaaatatgccagcaaaatgtcgagcctgaagcacgatctgcaggtactgttagggaaagaatag

SEQ ID NO: 308 - DNA, 960 bp, Klebsiella pneumoniae
gcgtacatgtatacgaagattattggtaccggcagctatctgcccgagcaagtgcgtacaaacgccgacctggaaaaaatggtagaaacctctgacgagtggattgtcacccgcacaggtatccgtgagcgtcgtattgccgcagcgcatgaaacagttgctacgatgggctttgaagccgcaaagcaggcgctggcgatggcgggcgtgtccgcggagcaaattggtctgattatcgttgcgaccactttcggcacgcacgcgtttccgagttctgcatgccagatccagtcaatgctgggcgttaagggttgcccggcgtttgatgtcgccgccgcctgcgccggtttcacctatgcgctaagcgtcgccgatcagtatgtgaagaaacgcgcggtagattatgcgctcgtttgtggcgccgatgtgctggcgcgcacctgcgatccggcggatcgcggaacgattattattttcggagacggcgccggcgcggttgtgctgggcgcctccgaagagccgggcattatctcgacgcatctgcatgccgacggcagctatggcgaactgctgaccctgccgaacgccgatcgtgtcgatccggaaaacccgatctatctgacgatggccggcaacgaagtcttcaaagtggcggtcaccgagctggcgcacatcgttgatgagacgctggcagcgaataatcttgaacgttcagcgctggactggttggtgccgcatcaggctaacctgcgtattatcagcgcgacggcgaagaaactgggtatgtcgatggataacgtcgttgtgaccctcgaccgccatggcaacacctccgcggcgtcagtcccttgcgcgctggatgaggccgtccgcgatggccgtattcagcgcggtcagctgattttgctggaagcctttggtggcggtttcacctggggttccgcgctggttcgtttttag

SEQ ID NO: 309 - DNA, 2049 bp, Klebsiella pneumoniae
cgcggcgcccacggtctccccgcggcccggcagcagttgaataacgcccggcggcacgccggcttccagcagaatcgccacgccctgggcggcgataagcggcgtctgctcggcaggtttcgccagcacgctgttgccggccgccagcgcggcggcaatctggccggtgaagatcgccagcgggaagttccacgggctgatacagaccaccggacccagtgggcggtgagtttcattatcgaaatcgtcgcgcacctggccggcgtaatagtgcaggaagtcaacggcttcgcgcacttcagcgatggcgttgctgaaggttttacccgcctcgcgcaccaggatccccatcagggtcggcatctggctttccatcagcaccgcggcgcgctcaagaatggcggcgcgctcctgcggcggagtggcgaaccagatcggcgcattgttgatagcgctggtcagcgcctgctgcacttcagcgtcgctggcttcgcggacgtagccgacgatatctttcggctctgccgggttaaccaccggctgcatctcgccttcggccaccggctgctccagcatcggcaatgcctgccatttatgcagcgcgctgttgagcagggaagaggagagggaggccagacggtgctcgttcgccagatcgagaccggcggagttgctccggccgctgccgtagagatcgcgcggcagcgggattttcggatgcggcaggccggcctggccttcctgctgcgccagtttttctaccgcgctgaccgggtcggccaccagctcgtccagcggcagggtattgtccgcgatacggttgacgaaagaggtattggcgccgttctccagcagacgacgcaccagatacgccagcagcgtctcgtgggtgcccaccggggcgtagatccggcacggccgattcagtttgccgtcggcgaccttgcccaccacctgctcgtacagcggttcgcccatgccgtgcaggcactggaactcatactggcccgggtagtagttctggcccgccagctggtagatagccgccagagtatgggcgttatgggtggcgaactgcgggtaaatcaggttcggcaccgccagcagcttcttcgcgcaggcgaggtaggagacgtcggtgtaaaccttgcgggtgtataccggatagccttcgagaccttccatctgcgcgcgtttaatttcgctatcccagtaggcgcctttcaccagacggatcatcaggcgacggcggctgcgggtggcgaggtcaatcaggtaatcaatgacaaacggacagcgcttctggtaggcctgaatcacgaagccaatcccgttccagccggccagttccggctcgaagcacagtttttccagcaggtcgagggagatctccagacggtctgcctcttcggcgtcaatattgatgccgatgtcatactggcgcgccagcagggtcagcgatttcagccgtgggtaaagctcttccatcacccggtcatactgcgcgcggctgtagcgcgggtgcagcgcggagagcttaatggagatacccggaccttcataaatgccgcggccgttggaggctttgccgatggcatgaatcgcctgctgataagaaaccatataggcctgggcgtcagcggcggtcagggcggcttcgccgagcatatcgtaggagtagcggaaccctttttcttccagcttgcgggcgttggccagcgcttcggcgatggtttccccggtgacgaactgctcgcccatcaggcgcatcgccatatccacgcctttgcggatcagcggttcgccgctcttgccgatgatgcggttcagggagcgggagaggctggtctcgttatgggtcgacaccagttttccggtgaacagcagcccccaggtggcggcgttgacgaacagcgacgggctgcgcccgatgtgcgactgccagttgccgttgctgattttgtcgcggatcagcgcatcgcgggtggctttatccggaatacgcagcagggcttccgccaggcacatcagcgccaccccttcctgtga

SEQ ID NO: 310 - DNA, 2475 bp, Klebsiella pneumoniae
tttacctgccatggtttttacgcagatacagagaccagagaggtcagcatgcctgacattaacccgcaaaatatcaaagaattacgggcgttggttgaacagcaattacagtacacattgtgtgttagcttaaataaagctacgcatggcgatatttttaacgcggtggcgctggccattcgtcattttcaacaggaccattttttgttgagccagaagcggcaacgtgaagaacgtaaaaagcgcgtttactatctgtcgatggagtttttactgggacagtcgctgcgtaataaccttttgaatatgaatttactggcggagatgcaccaggtggtgaatgacctggggtttgatcttgaccaccttcttgacgaagagcccgacgccgcgctgggtaacggagggttagggcgcttagccgcctgttttatcgattcgatggccacccttgatattgccgcatccgggcatggcatcaaatacgaatatggtctttttcgccaatcctttcaaaatgaccagcagatcgagcatccggatgactggcattccatgcactccccgtggctggtcgaacatcacgctcagcaaatcctgatcccgctgggaggctatattgaacacagcgaagatgttgatggcaattacaatccaatgtggctgggctggaaaacgattatcggtataccccatgactatttcgtttccggttaccgggatacgacgaccaacaagctgcggctttatagcgcggtggcctctgactcctttaatatccatattttcaatcgcggtgattatatcaaggcggtgagtgataaaatcgcgtcggagaatatttcaaaaatactctatccatccgatgaggtgctgaccggaaaagagctgcggctgacgcaagagtattttctggtggcctgtacgctgcgggatatatttcgcgactatgccgaggttaatgacgatattactttcctgccgcagcatgtggcgattcagctgaatgacacccatccggcattagtggtggtggagctgatgcgtatcctcgtcgatgaataccggctgccctgggagcaggcgtgggagataacgcaaaacacctgtgcctacacgaatcatacgttgatgccggaagcgctggagacctggccggtgacgctgtttgaaaaactgctgccgcgtcatttgcaaattatatttgagatcaaccatcgtttccttgaagaggtggcccggcgctggccggataaaaatcatctgttatcttcgctgtctttaattgacgaacatcacgataagcaaatccgcatggccaatctggcgattgtcggtagccatcgcgtgaacggggtagcatggctgcattcggaactggtcaagaaacaactggtgccggacttctattttatgaccccggagaaattcattaatcagaccaacggcgtcacgccgcgacgctgggtgcagcaggctaaccccggcctggcagcatttttgcaccaacagctgggggaagggtggccaaccgatttacccttgctgtccagtctggaaagcctggccgatgatactgctgttattgataatatccgggccattaaatttgccaacaaaaccgcgctcagccagctggtcgctcaacgctatggcatcgccctcgatccgctggcgatgtttgattgtcaggtcaaacgtattcatgaatataagcgtcagttgctcaatattcttcatgtgatcgcgctttatctggatatcaaagagacagggaaaactatcgcgcctaaggtgcatttatttgcgggtaaagcggcgccgggctatcggatggcgaagctgattattcagttgattaataccgtcgcccggaaaattaaccgcgacccgcaggtcgccggacagcttaaagtggtttttctcgaagattacaaagtctcgctggcggaaaaaatcattccggccacagacctctccgagcaaatttccaccgccgggaccgaggcgtccggcaccagcaatatgaagtttgccatgaacggcgcgttaaccatcggcacctatgatggggcgaatatcgaaattcgcgaggccgtggggatcgataatttttatctgtttggcgccgtggcggaagagattgaagagagccggcgccttgggcatcaccataatttctatcatcagaacccggctatggcgcgtgttgtcgataccctcgtgtctgggttgttcaccagcgatcgtgagctgtttgcaccccttcaccacatgttgactgagggcgatcattactgtcatttactggatttcgacagctattgccaggcgcagcagcaggcgatgatcgattttgaacagccggaacaatggcaccgtcgggccttactcaatatttgccggatgggcgaattttccagcgacagaaccatacgtggctacgcccgggatatttggggtatcaccagctaa

SEQ ID NO: 311 - DNA, 1254 bp, Klebsiella pneumoniae
tctacgcgccatttttcggtgccgacattcccgttgcttaaaggtagccccatgacagattccctattcccccgcttagtgttagccaaaggacgcgagaaatccctgctgcgtcgccatccgtggatattctccggcggcgtcgcccgcatggaaggtaaagcccgcagcggtgaaaccatcgatatcgttgaccatcagggaaaatggctggcccgcggcgcttactcgccgtcgtcgcagatccgcgcccgcgtgtggaccttcgaccgcaatgaagccatcgatagcgccttctttgaacgccgtctgcagcaggcgcaaacctggcgtgcctggctggccgagcgcgatggcctcgacagctaccgcctgatcgccggcgagtccgatggcctgccgggcgtcactatcgaccgctttggcaactttttcgtgctgcagctgctcagcgcaggcgccgaataccagcgcgccgccatcatcagcgccctgcagaacctgttcccggactgcgccatttacgatcgcagcgatgtcgccgtgcgtaaaaaagagggactggagctggcccaggggccggtggtgggcgaactgcccccggcgctgctgccgatcaccgagcacggcatgaagctgttagtcgatatccagggcgggcacaagaccggctactacctcgaccagcgcgacagccgcctggccacccgccgctatgtcgcggataaacgggtgctgaactgcttctcctacaccggcggctttgcggtgtcggcgctgatgggcggctgccgccaggtcaccagcgtggatacctcgcaggaggcgctcgacgttgcccgccagaacgtggagatcaacggactggatctgtccaaagcggagtttgtgcgcgacgacgtgttcaaactgctgcgtaaataccgcgatcagggagagaaattcgacgtgatcgtgatggatccgccgaagttcgtggaaaataaaagccagctgatgggcgcctgccgcggctataaagatatcaatatgctggcgatccagctgctgaaccccggcggcgtgctgctgacattctcctgctccgggctgatgaccaccgatttatttcagaaaatcatcgccgatgccgcaattgatgccgggcgtgatgtacaatttatagaacagttccgtcaggctgccgaccacccggtgatcgcaacctacccggaagggctgtatctgaaggggtttgcctgtcgcgtcatgtaa

SEQ ID NO: 312 - DNA, 1203 bp, Klebsiella pneumoniae
tcatcaggccacctcacgggtaacagaagcaatgtggttccggcagcgcatcagcggctgaatgcgttcgccaaaggcgtcaatgccggcaagaaaatcatcaaaggtcagcagcacgccgtcggtgccgggcacgctcgctacttcatcaagcatacgggcgacgctggcatacgatccgaccagggtgcccatattaatgttgaccgccgaggtggggtcggccatctggcgcacgttggtatcgctgccggagcgggtatctttctgactctgctcggtgagccacgccagcgcttcttcatcggcgcccgctttgtaatgttcccatttggcgcgcgccgcctcgtcggtttcgtcggcgataaccatgaacagcacataggaccccacgtcgcggccggttttttccgccgcctgcatcatgcgtgcggcggtcggggcaaaggccgttggcgtgttgacccctttgccaaagcaaaagttgtagtccgcatgctgggcggagaaggccatcccggcatcgctctgcccggcgcagatcaccttcatcggctgcgacgggcgcgggctgacacggcagtcgttcatggtgaagtagtcgcctttgaaatcgctgcgcccggtgccccacaggtcacggagcacctgaacgtattcggtgagatagtcatagcggctggcgaaatagtcatctcccggccacatgcccatctggtcatattccggtttttgccagccggtcaccagattgacgccaaaccggccgccggagatggagtcgatagtggaggccatccgggcgacaatcgccggcggcagcgtcagggtggcggcggtggcgtagatctggatcttcgaggtcaccgcggccaggccggccatcagggtgaaggactccaggttgtgatcccagaattcagttttcccgccgaagccgcgcagtttgatcatggagagcgcgaagtcgaaatggtagtgctcggccttctgcacgatggccttattcagttcaaaggtcggcatatactgcggggcatgggtggagatcagccagccgttgttgccaatgggaacgaaaacaccaattttcatacctacctctctgcagtcatggaagatgggttgcgatggtgcggcatcctgcctctccctggaccacctcgcagaaaaggtaaagcaaaggcgatgccagttttataa

SEQ ID NO: 313 - DNA, 801 bp, Klebsiella pneumoniae
aaggtcggtctgatggagagtatccactttcagcataacgccttaaccgcggcggagatcaccacccgacggctatgcagactgcatcgcgtgcggctgttctccccggcgctctgtcgggtgaaacgcggcagcaaagtgattgtgcaaggggagagccgggtgctggcgactccgcaacagctgattgttttgccagctgacgtggaactggaggtgattaaccagccggagaatggcctattttgctccgatctgctatcgctgacgcccgagctgctgacgaggtttaagactcgttatctcagcgaaccaccgccagggcgcctgacctcgctctgcgcaccggtgacgacagagctggcgtttatgtggcaaagcgttctgcaggcggttcgggagggattgtccgtcgcgctgcagcagcaccagaccatggggctgctgctggccctgcatgaggctggctatgcgggcccgctgctcgtcgagcggcagcaggatctgtcggcgcaggtgcggcagctgattatgctgtcgccggcgcaggcatggagcgtgtcgcgggtggcgaaaatgctctttctcggcgagtccacgctgcgccgtcggctgcagcaggaatcgcagagttttcgccagatcgtcgaggaggtgcggatggcccacgccctggggcagctgcagaccacctcgcggccaataggcgaaattgcgcagaacagcggatatcagtcgggatcgcgctttaccgcgcgcttccgtcagcattatggtttactgccgaagcatgtacgctga

SEQ ID NO: 314 - DNA, 2094 bp, Klebsiella pneumoniae
actgaaaaacaatccaccctgattgaaaatcgacattatatggaacttaaagcgacaacattgggcaaacgcatggctcagcacccttatgatcgggtgcagctactgaacgccggggtaaaagtttccggcgatcgtcatgagtatcttatacctttcaatcagttattgtcagtgcattgtaagcgcggtctggtctggggcgaactggagtttgtgctaccggacgggaaagtcgtgcgtttgcacggtaccgagtggagcgaaacgcagcgcttttatcatcatttacatacgctctggcagcagtggagcacggagatgagcgatatcgccgccggcgtgctgaagcagcagctggcgacgatcgagcacactcgcgcagaaggcaagtggctaacccgtcagcaggtggcggatgttcaggataatatacgccatgcgttgactggtttgccgatgcccaccagtcggcttgatgcctttgataactgccgggagctgtggcgggagtgtcagcgctggttaggcgatattgaagcgacgcgtctggcccataaccaggcctttaccgaggcgatgctggagcaatatcgcgaattttttgatagcgttgagtcgtccccgctcaatgcgtcacaagcgcgtgcggtagtgaacggcgagcgctccctgctggtgctggcgggagcgggcagcggtaaaacctcggtgctggtggcgcgagcgggctggctgctggcgcggggagaagccgcggcagatcaaattttgctgctggcattcggccgccaggcggcgcaggaaatggatgagcggatccgcgagcgtctggcatcagatgatattaccgcgcgtactttccattcgctggcgttgcatattattcagcagggcagcaaaaaagtgcccactatcagtaagctggaaagcgatactgcggcccgccacgcattgctgctgaaaagctggcaaaagcagtgccaggagaaaaaagcgcaggcgaaaggttggcgcctgtggctggaagaagagatgggctggcaactgccggagggggacttctggcaggacaaaaaggtgcagcggcggatggccagccggcttgaccgctgggtgagcctgatgcgcatgcacggcggctcccaggcggagatgattgccggggcgccggaagcggtacgcgacctgttcagtaaacgggtgaagctgatgtcgcctctgatgaaagactggaaggcggcgctcaaggccgagaatgcggtcgatttttccggcctgatccatcaggcggtcaatattctcgataaaggccgcttcgtcagcccatggaaacacattctggtggatgaatttcaagatatttcgccgcagcgagcctcgctgttggccgcgttacgccggcagaatagccaaaccacgctctttgccgtcggggatgactggcaggcgatctaccggttcagcggggcgcagctttctctgaccaccgcattcaaccactactttggcgaaggggattgctgtgcgctggataccacctatcgctttaacgggcgtatcggcgaaatagccaatggctttatccagcaaaatccgcatcagttaagcaaaccgctgaacagccttatggcaggtgataaaaaggccgtcacgctgttagccgacgacaagctggacgatcttctggataagctgagcggttacgttaagcccgagcagcgcatcctgctgcttgcccgttatcaccatctgaagcctgaggcgctcaacaaagcggcgacgcgctggccgcacctgcagcttgattttatgaccattcatgccagcaaaggtcagcaggctgactttgtcattgtgttgggactgcaggagggggaggatgcgtttccggccccggcgcgcgagtcgattatggagcaggcgctcctgccacagccggaagattttccggatgcggaggagcgtagactgttgtacgtggcgctcacccgcgctcgtcaccgggtatggctgttatttaacaaggcgcaaccttcgccgtttgtcgagatcctgcaggcgctggatgtgcccgtggccaggaagccgtaa

SEQ ID NO: 315 - DNA, 966 bp, Klebsiella pneumoniae
ctggtgaaacataaaacacagatcatgaataatctgccgctgctaaatgatttacgcgtctttatgctggtcgctcgccgggccgggttcgccgccgccgccgaggagcttggcgtatcgccggcgttcgtcagcaagcgggtttcgctgctggaacaaaccctgaatgtgatgttgctgcaccggaccacccgccgggtcaccattaccgaagagggggagcggatctatgaatgggcgcagcgcattttgcaggatgtcgatgagatgatggatgagctttccgacgtgcgccaggtgccgcagggaacgctgcgtattatcagtagcttcggctttggccgtcgggttgtcgccccggcgctgtcggcgctggctctccagtacccgcagctggagctgcgtttcgatgtccaggaccggctggtggatttagtcaatgaaggggtggatctcgatattcgcgtcggcgacgatatcgcaccgaatctgattgcccgccagctggcggccaatcaccgcgtactctgcgcctcgccgcagttccttgcccgccatgcgccgccgaaacagctgagcgatctggccgcgttaccctgcctggtgattaaagagcgcgatcacccgttcggcgtctggcaattgcatagtaaagagggccagcacgccatcaaggtaaccgggccgctctcctccaaccatggtgaaattgtgcatcagtggtgtctggacgggcaggggattgcgctccgttcgtggtgggacgtccgggagaatatcgccagcggacatctggtgcaggtgctgccggactactggcagccggccaacgtctgggcggtttacgtctcccggctggcgacgtcggccaaaatccgcaccaccgtggagtttctgcgccactactttcagttgcactatccgcagcatgagccgacggccagcgccgtcggcagaggcgattaa

SEQ ID NO: 316 - DNA, 372 bp, Klebsiella pneumoniae
aaaacgaaacatgagcctcatatagggagtattcatgtttcccaggaggtgcctatgatagccagcaaattcggtatcggccaacaggtccgccatacgctcttgggctacctgggcgtcatcgtcgatgtcgatcccgagtattcgctcgcggagccggaagaggatgaaattgccgccaatgacgaactgcgcgcggcgccctggtaccatgtggtgatggaagatgatgatggccagccgattcacacctatctggcagaagcgcagctgagcagcgaaacccgcgacgaacacccggaacagccgtcccttgacgaactggccaaaacgattcgtcagcagctgcaggctccgcgccttcgcaactaa

SEQ ID NO: 317 - DNA, 288 bp, Klebsiella pneumoniae
aggcgagggcaggcacggagatatccggctcaggaaatctcacctgtaggtgatctttttgaccgattaaccgatgcagtatatccggcagatcttcaatcattctttgccctcagcatgcgcattatcctgttgatggtaatctattttttccttcccggcagcgttagtttagccattttgcgcagcggattgccggccagctgtagcgcatgcatcgccggaaaagagattattgatgtccatcacactttgtgggctcgcgtacgtatgtccagttttttgtag

SEQ ID NO: 318 - DNA, 828 bp, Klebsiella pneumoniae
atttggtttaataatgcaaccttttacgaggcatttctcatgacccaaccatcgcacacagcttttatcaccggcgcgtcctcaggtatcggcgcgatctatgccgaacgactcgccgcccgcggctacaacctgatcctcgccgcccgtcgtgaagaccgtctgcaggcgctcgccgaccagctgcaggcgcgctacgccatccaggcaagcatcctcaaagccgatcttagcgaagagcacgggattgccgccgtagagcagcgtctgcagcaggatcccgccatcgacctgttcattaacaacgccggcactgcgaaattggcgggttttctcgccagtacgccacgcgagcaccaggcgattcatacgctcaacaccaccgcgctgctgcgtctgagctatgccgcgctggccgctttcaccccacgacgccgggggacgctgatcaatattgcctctatcctcgcgctgcatacgctgccgggcagcgcagtctacagcgccagcaaagcctgggtgttgagcttcacccgcggcctgcaggaggagtttgccgacagcggcgtgcgtattcaggcggtattgccggcggcgaccgctaccgatctgtggccgacctccggcgtggcgctggacgctctgcccagcggcacggtaatgaccaccgaggatctggttgacgccgctctcagggggctggagatgggggaacaggtcaccttaccaccggttcatgacctgggactgtgggagacttttgagcagtccagactggcgctgtttaccagcgcgcgaaccggacagcctgcgccgcggtatcgataa

SEQ ID NO: 319 - DNA, 783 bp, Klebsiella pneumoniae
cccggtttcctgctattcttgcggcaaacagaagaggagaatgtgatgtatcccgttgacctgcacatgcataccgtcgccagcacccatgcctacagcaccctgcacgattatattgcggaagcaaagcgtaaagggatcaaactcttcgccatcaccgaccacggcccggacatggcggatgctccgcactactggcacttcgttaatatgcgcatctggccccgcctggtagacggggtggggatcctgcgcggtattgagtcgaatattaaaaatattgaaggcgagatcgactgttccggaccgatgttgacttccctcgatctgatcatcgccggatttcatgagccggtgtttccgccgcaggatcgtgacacccatacacaggcgatgatagccgcgatggccagcggtaaagtgcatatgattagccatccgggtaatccgaaattcccggtggatatcccggcgattgccgaagcggcggctcgctaccaggtggcgctggagattaataactcctcgttcgtatcatcgcgcgtgggcagtgaagacaactgccgggccatcgccgccgcagtgcgtgatgccgggggatgggtggcgctgggctcggactctcacaccgcctttaccctcggggagtttaccgaatgccgcaagatccttgatgcggtcgatttcccggaggagaggatcctcaacgtttctccgcgtcgcctgcttaacttcctcgagtcgcggggcatgccggcgatcccggaatttgctgacctttaa

SEQ ID NO: 320 - DNA, 588 bp, Klebsiella pneumoniae
gtgtatgctaatccgcagcagggggccatccagcctaacccacagattcagcaaaattttcatccccgatgcttgcagcgacagccacattcagtaatctgtttgcaggtcaaaatgtggaatgaaaatatggaactgacaacacgtaccctgcctgcgcaaaaacatatcgcgctggtggctcacgatcactgcaaagatatgctgatgaaatgggttgctcgccatcaggcgctgctggcgcaacatattttgtatgctaccggcactaccggtaatctcgtctcccgggctaccggcctggaggttaatgccatgctgagcggtccgatgggcggcgaccagcaggtgggtgccctcatttcagaaggcaaaatcgacgtgctgatcttcttctgggatccgctgaacgccgttccccacgacccggatgtcaaagcgttgctgcgcctggccaccgtctggaacattccggtcgccactaacgtctccaccgctgactttattatccagtcgccgcacttcggtcaaccgctcgatattctgatcccggattatccacgctatcttgccgagcgcctgaaataa

SEQ ID NO: 321 - DNA, 222 bp, Klebsiella pneumoniae
tttatgaataagaaaatattagtattgtccgttttatttggtttttcaactatgtcccatgctagtgaaccaaagtatgcttttccgcaatcagataaacaggtagtctcaaaaattaaaattcaaaatgcaccgataaatcatgataaatatggtcatggtgaggttcttgccaatggggcgtgggttaaaggaaattctggtagtcaaaacaaaaaatga

SEQ ID NO: 322 - DNA, 582 bp, Klebsiella pneumoniae
aaacaggataatgataaatataagcatataaaaatgagtggcgctaatgcgtccggctatttagaatcgcgcaccatgaaaactgagaccccaaccgtaaaaatggttgccattgctgctgatgaagcggggcaacgtatcgacaactttttgcgtacgcaattgaaaggcgtaccgaagagcatgatttatcgcatcctgcgtaaaggcgaggtgcgggtaaacaaaaagcgcgtgaagccggagtataagctggaagcgggcgatgaagtccgtatcccgccggtacgcgtggcggagcgtgaagaagaggcggtatcgccgcacctgcagaaagtggccgcgctctctgaggtgatcctctatgaagacgatcatattctggtgctcaataagccttctggtactgcggtacacggcggcagcggcctgagcttcggcgtgattgaagggctgcgcgccctgcgcccggaggcgcgcttcctggagctgtgccatgtctcgaccgggatacctacggcgtgctgctggtggcaaaaaagcctcagcgcttgcgtcgctgcacgagcaactgcgcgataa

SEQ ID NO: 323 - DNA, 783 bp, Klebsiella pneumoniae
aaaagtaccaaatactcaggagcactctcaattatgtttaagaatgcatttgctaacctgcagaaggtcggtaaatcgctgatgctgccggtatccgtactgcctatcgcaggtatcctgctgggcgtcggttccgctaacttcagctggctgccagccgtggtctcccacgttatggcagaagcaggcggttcagttttcgccaatatgccgctgatcttcgctatcggtgtggccctcggcttcaccaataacgacggtgtatccgcactggctgcagtcgtggcttacggcatcatggtgaaaaccatggcggttgttgcgccgctggtgctgcatttacctgctgacgagattgcggcaaaacaccttgctgataccggcgtgcttggcggtattatctccggtgctatcgccgcctacatgttcaaccgcttctatcgcatcaagctgccagaatatctcggcttctttgcgggcaagcgttttgtgccgattatctctggtctggccgctatcttcaccggcgtgatcctctccttcatttggccgccgatcggctccgcgatccaaaccttctcccagtgggctgcttatcagaacccagtggtggcgtttggtatctacggtttcatcgaacgttgcctggtgccgtttggtctgcatcacatctggaacgttcctttccagatgcagatcggcgaatacaccaacgcggctggtcaggtgttccacggcgatatcccgcgctacatggcaggcgacctgctgattgaaacgtga

SEQ ID NO: 324 - DNA, 255 bp, Klebsiella pneumoniae
ataatatacaaaacattaatacgaataagaatagttagtagtaaatgggttaaagcctctggaacttcaggattttttacaatgaacaaaggcgtttgcttggttaataacccggaaacaaacacctgctcatgtcagtcaggcactgtagcgaaagaattgttttatacaacagcaactgaacagttaggtggtggtagccatggtggcggcataacagtggtaaaagagagagtattatatcaatgtagataa

SEQ ID NO: 325 - DNA, 570 bp, Klebsiella pneumoniae
ggaaatgcaaatatgagcgatgacggactggcgccagggaaacgtctgtcagagatccgccaacagctgggtctctcacagcgtcgtgccgccgaactgtctgggttaacacatagtgccatcagcaccatagagcaggataaagtcagtcctgccatcagtacgctgcaaaagctgctgaaagtctatgggctgtcgctctcggaattcttttctgaacccgaaaagccggacgaaccccaggtggtcattaatcaggatgacctgattgagatgggaagtcagggcgtttccatgaagctggttcataacggaaatccgaaccgtacgctggcgatgatttttgaaacttaccagcctggaaccacgaccggggagaggattaagcatcagggtgaggagataggcaccatactggaaggtgagatcgtgctgaccattaacggtcagtcgtaccacctggtggctggacagagctatgccattaataccggcattccgcacagcttcagcaacacctcggcaggcatctgccgcatcatcagtgcccacacccccaccacattctga

SEQ ID NO: 326 - DNA, 534 bp, Klebsiella pneumoniae
tcgctcgcaaacttagaccgtagccgaaaatttcccctgccgggcaaagagttttataatgaaacaattaacctggaggctttcgtgaaacgtacccgtctggaaaacagctgttgccctatcgcccgctccctcgacgttatcggcgactggtggtcgctgctgatcgtccgcgatgctctgcgcggggtgcgccgttttagtgaattccagaaaaacctcggtatcgccaaaaacatgctcgccgggcggctgaaaatgctggtggatgaaggcatcctgcgcctgcagccggcctccgacggcagcgcctggcaggagtatgtcctgaccgataagggccgtgccctgcagacggtgctggtcgccctctcccagtgggcagacgactatctgttcgatcctgacgaaccggcgacccggctcattgaccgccagcagcgccagcccctgcgtaagctggtcctgcaggcggcggatggccgtgagctggccccggcggacatcaccatcgctatcccgctgaacgactaa

SEQ ID NO: 327 - DNA, 300 bp, Klebsiella pneumoniae
gtcactgaaaaatattgccttattgcggttctgcgactaagtgtggaagagggggattaccccgtacgtcaaaggcaaagggaaatgacattacacaaaaaaaatcacatcacccgaacactcctggctgtcagtatgctggctatgagcggcggggcgctggcggcgcaggtgccgccgggcacccagctggcggaaaagcaggagctggtcagaaataacggcagtgaaccggcgtcactcgatccgcataaagtcgagagcgatgttgaattcaatatcattagcgatctcttttga

SEQ ID NO: 328 - DNA, 408 bp, Klebsiella pneumoniae
ccaaggagaaacgttatgcctaaacaggtgattattccgccaggcaccaccgcgccgattgccccctttgttccggggacgctcgccgacggggtggtctacgtctcgggcaccctgccgtttgataagcaaaacaatgtggtgcacatcggcgacccaaaggcgcaaacccgccacgtgctggagaccatcaggagcgttatcgaaacggcgggcgggagtatggcggatgtgactttcaacagcatctttatcaccgactggacaaattacgccgcgattaacgaggtctacgccgagttcttccccggcgataaaccggcgcgcttctgcattcagtgcggactggtgaagcccgatgcgctagtggaaatcgccagcgtcgcccatatcgggaccccgacatga

SEQ ID NO: 329 - DNA, 531 bp, Klebsiella pneumoniae
tcgattttgaacagccggaacaatggcaccgtcgggccttactcaatatttgccggatgggcgaattttccagcgacagaaccatacgtggctacgcccgggatatttggggtatcaccagctaaagagcgaacacgccgggctaaaaagggactcgtcgacgaatatcagtcactattgaggatgagcatgaacgttgaattacacaccgagcagggcgtaaaaattattgtgccactggtgcgccgactggatgcttccgtcgtgcaggcgtttaagcagcaggttctggaggctatcgatccggataccaaaaatgtgctgctggatctgagtcacgtcgatttcattgacagtagctgtcttggcgcgctggtatccattctgaaaagcgtcaatggtcagggcgagctggcgctgtgttcgctcaatgacacgattaaaaacctgtttaagctcacccgtatggatcgcatctttgccattaaggagacccgacaggatgcgttaaacgcgttcacctcgttataa

SEQ ID NO: 330 - DNA, 189 bp, Klebsiella pneumoniae
cagataatgaaaagaagtgaaatcaggaaagcgattgaatcgtggtttgacattgaacgctatgacgcaattgaacagctcactctgcagcagttctatgttgagattgaacggcgtatcttggcttacaggatgttgttgagccgaaataccataccgaccctgaacagattattgctggatgattag

SEQ ID NO: 331 - DNA, 3240 bp, Klebsiella pneumoniae
gttacgatgaaaagaatgttaatcaacgcaactcagcaggaagagttgcgcgtcgcccttgttgatgggcagcgcctgtacgacctggatatcgaaagccccgggcacgaacagaaaaaagcgaacatctacaaaggcaaaatcacccgcattgaacccagccttgaagccgcgtttgttgattacggcgccgagcgtcatggtttcctccccctcaaagaaatcgcccgcgaatacttccccgccaactacaatgcgcatggtcgtcctaatatcaaagacgtactgcgggaaggtcaggaagttatcgtgcagattgataaagaagaacgcggcaacaaaggcgctgcgctcaccacctttatcagcctggcgggcagctatctggtactgatgccgaacaacccgcgcgccgggggaatttcccgccgtatcgagggcgacgaccgtaccgaactgaaagaagcgctggcgagcctggagcttccggacggcatgggcctgatcgttcgcaccgctggcgtcggcaaatccgccgaagccctgcagtgggaccttagcttccgcctgaagcactgggaagcgattcagaaagccgcggaaagccgtccggcgccgttcctgatccaccaggaaagcaacgtcattgtccgcgccttccgtgactacctgcgccaggacatcggcgaaatcctgatcgataacccgaaagtgcttgagctggcgcgccagcatatcgccgcgctgggtcgtccggatttcagcagcaaaatcaaactgtacaccggtgaaatcccgctgttcagccattatcagatcgaatcgcaaattgagtctgccttccagcgcgaagtgcgcctgccttccggcgggtctatcgttatcgatagcaccgaagcgctgaccgcgatcgatatcaactccgcccgcgccacccgcggcggcgatatcgaagagacagccttcaataccaacctcgaagcggctgacgaaattgcccgccagctgcgtctgcgcgacctcggcggcctgatcgttatcgacttcatcgatatgaccccggttcgccaccagcgcgccgtggagaatcgtctgcgcgaagccgtccgtcaggaccgggcgcgcattcagatcagccatatttcgcgcttcggcctgctggagatgtcccgtcagcgcctgagcccgtcgctgggcgagtccagccaccacgtctgcccgcgctgctccggcaccggcaccgtgcgtgataacgaatcgctgtcgctctctattctgcgtctgatcgaagaagaagcgctgaaagagaataccaaagaagtccacgccattgttccggtaccgatcgcctcctatctgctgaacgaaaaacgtgccgcagtgagcgctatcgaatcccgtcagggcgatgtgcgcgttattatcgtgccaaacgacgaaatgcaaacgccgcactactccgtcctgcgcgtgcgcaaaggtgaagaaacctcaacgctgagctatctgctgccgaagctgcatgaagaagaaatggcgctgccaggcgacgatgagccggcggagcggaaacgtccggaacagccggccctggccgcttttgtcatgccagatgcgccgccagccccgatgctcgaagagcctgccgccgcgcctgtcgccgcagcggcaccggtcgcggccgccgcaccggcgcagcctggcctgctctcacgcttcttcagcgcgctgaagaatatcttctctggcgccgaagaggccaaaccggctgaagttcaggtcgagaagaaagcggaagaaaaaccggagcgtcagcaggagcgtcgtaaaccgcgcgccaacaaccgccgcgaccgcaacgaccgccgtgataaccgcgacaatcgtgacaaccgcgataaccgtgacaatcgcgacacccgtgcggacaatgccgagggccgtgaaccgcgcgaatcgcgtgaagagaaccgtcgcaaccgtcgcgagaagccgtcgcagaacgtggaagcccgtgatgttcgccaaacctcaggcgacgacgcggagaaagcgaaatcccgtgacgagcagcagccgcgccgcgaacgcacccgccgccgcagtgacgacaaacgtcaggcgcagcaggaagccaaagctcagactcgcgaagagccggttgtgcaggagacggagcaggaagagcgtgtacaaactctgccgcgtcgtaaaccgcgccagctggcacagaaagtgcgcgttgagtccgctgtcgtcgagccagttgccgagatcgtgccagaagccgtagtggctgaagttatcgctccgcacagcgagccggtgaaagccgagctgccggcaggggtggagagcgtggcggaccaggacgaaaatggcgaatcccgtgaagcgaacggtatgccgcgtcgctcacgtcgctccccgcgtcacctgcgcgtcagcggtcagcgtcgtcgtcgctatcgtgacgaacgctatccgacccagtcgcctatgccgctgaccgtagcctgcgcatcgccggagatggcttccggtaaagtctggatccgctacccggtggttcgtccgcaggatcagcagccggaagaggttcaggttcaggacgccagcgtcgcgaaaactgtcgaggccgtagcggccccggtcgccgtcgttgaaaccgttaccgctgcgccggtcaccgtcgagccggctaccatggaaccagtaaccgctgagccggtagtcgtcgagccggtagcggccgccgagccgctgttcgttgatgctgcggaagttgtcgcgccagcagccgtcgagccagcgcctcaggagccggtcaccgaagcaccggctgtcgaagcgcctcaggctatcgcgccagtgacgctcgacgccgagccggtggtggtagaacctgaagcggtggaaacgacgcctgtcgttgcagcgccagtggaaactatcgccccggtcgcagaaaccgtggagcaagcgccagtgaccgaagcggcccctgccgaaccggtcaaagccgagcccccggtgagcaagccggtcgtagtggcgggtcatcgccatgccaccgcgccaatgacccgtgcgccagctccggactatgtcccggaagcaccgcgtcacagcacctgggtgcgcccgccgttcgcctttgaaggtaaaggcgccgccggtggtcatagcgcgacccataaagccaccgctgaaccgactcgcccacagcccgtcgagtaa

SEQ ID NO: 332 - DNA, 297 bp, Klebsiella pneumoniae
ggggggattgactcgcttcccggcggtactgcgcgtggccggactacctggcgggtagggtctggtagcccgggagaggcattgctgccgaccccggggatgtctgcggtgccacatgcgaaaaaaaagcccgtacttgcgtacgagctcttcttaaaatatggcggtgagggggggattcgaacccccgatacgttgccgtatacacactttccaggcgtgctccttcagccactcggacacctcaccatattgtcttgctgctcaccttgggtgggcaacggggcgctactatag

SEQ ID NO: 333 - DNA, 933 bp, Klebsiella pneumoniae
tacgggtatgaaatgactcatttgcctaaattttctccggcgctgttgcatccgcgctattggctgctgtggctgggtatcggcctgctgtggctggttgtccaactgccctacccgctgatctaccgcctcgggaacgccatcggccggctggccatgcgctttatgaagcgtcgggcgaagatcgcctatcgcaaccttgagctctgcttccccgacaaaagcgagcaggaacgtcaccgaatggtggtgatgaactttgaatcggtgggtatgggactgatggagaccggtatggcctggttctggccggttcgccgtatcgcccgctggaccgataccatcggctttgagcatatccgcgatgtgcaggcgcagcagcgcggcattctgctgatcggtattcatttcctcactctcgagatgggtgcgcggatgttcggtatgaacgagccggggattggcgtctatcgccccaacgacaacccggtgatcgactggctgcagacctggggccgcttgcgctccaataaggatatgattgaccgtaaggatctgaaaggcatgatccgggcactgaaaaaaggcgaagtggtgtggtacgcaccggatcacgattacggcccgaccgccagcgtctttgccccactgtttgcggtcgaccaggcggcgaccacctccggcacctggatgctggcgaaaatgtccaaagcctgcatcgtgcccttcgtcccgcgccgcaaaccggacggtaaaggttatgaactgattatcctgccgccagagtgttccccgccgctggacgacgcggaaaccaccgccgcgtggatgaacaagatcgttgagcagtgcatcatgatggccccggaacagtatatgtggctccatcgtcgcttcaaaacccgccccgaaggcatgccctcccgctactga

SEQ ID NO: 334 - DNA, 834 bp, Klebsiella pneumoniae
ccgaccagtgaaaaggagtcctttatgttcttgataaacggcgttgtacaggacacgttggcagcgaacgatcgcgccacccagtttggcgacggctgttttaccaccgcccgcatccagcaagggcaggttgcgctactggacgcccatctgcagcgtttacagacaacctgtgaaaaattacatatcccatttaacgactggctgacgctgagcgaagagatgcagcgtctggctcggccgcacgcgcagggcgtgctcaaggtgactctcacccgcggcgttgggggaaggggatacagtacggcaggctgcgtgtcgcccactcgcattctcagcttctctccattcccggcgcattatgcgcgctggcgggaggagggcattactctgacccagagtccggtgcccctggggcgcaactcctggcttgccggcctgaagcaccttaatcgccttgagcaggtgctgatccgctctcatcttgagcagacggacgccgatgaggcgctggtccttgacagtgacgggtggcttacggaatgctgtgccgcgaatttattctggcgtcagggacgtgatgtatttactccgcgactcgattatgccggggtcaacggcattatgcggcagcgctgtatcgcgcagctggcaccatcgacgtttcgcgttgtcgaagtgacagcgcgtcccgagacgttgcgggaggccgatgaagtgctgatctgcaatgcgctgatgccgctggtgccggttcgccgctgggaggagaccacctggtcctcgcgtgagctttaccattttttagcccctttgtgtgagctgtctggttag

SEQ ID NO: 335 - DNA, 525 bp, Klebsiella pneumoniae
ctttgtggtgatgcagacgctgtctatcttcccttctttgtgctgggggcgcagacctttattaatccgcgtctgaaggcgatgtttaccaccccgtcaccatggtgctgcgcagcggcgctgctgggatttatcgcctaccggctgaaccagcagtacggctccggcgacggctggatgtatgaaacggaatcggtgatcaccatggtgcttgggctgtggatggtcaatgtggtcttttcgctcggccatcgcctgctgaacttccagtcggcgcgcgtaacctatttcgtcaatgcttcgctgtttatttacctggtgcaccatccgctgacgctgctgtacggggcgtggatcaccccggccattaagtccaataccttaggctttattggcgggttggtttttgtagtgggtattgccctgatcctgtatgaaattcacctgcgcattccgctgctgcgtttcctgttctccggtaaaccgatgaacaaaccggccaaaaccccagcctcggccagctaa

SEQ ID NO: 336 - DNA, 1029 bp, Klebsiella pneumoniae
tgccgggtcgacgtcaacgaaaatggtcgggccaacggcggcaggccacgggttttttcgtccgtcgaggaacagggtgctttggctttcgccgccgcgaataaagctatgcacgttgtcggcatgggtattgtcaatcagcatgcccatggtggtgtccggatcgagcgggttgcccggctgccagtgttgcgcctcagctttcagccgcgccaggaactcgtcagcgatgctctcctcgagcagcagacgggtcccggcgatgcacacctgtccctggttgtagaagatgccgccggcggtggcgcgaaccgcttgttgcagatccgggcaatcggcgaagacaatgttggcgctcttgccgcccgcttccagccacacgcgcttcatattgctgtcgccggcgtctttcagcagctgcttgccggtgcgggtggagccggtgaaggtgatgacttcaacatcaggatgcagggccagctcctgcccggcctcgtggccaaagccgctgaccacgttcaacacgccgtccggcaggccggcctctttcgccagcccggccagacgcagggcggtgagcggcgatttttccgagggtttgaggattacgctattgcccgccgccagcgccgggccgagtttccagcaggccagcagcagcgggaagttccacggcaccaccgcggcgatcacgccaattggttcgcgaacgatcatcgccagctcgttgctgccggtgggggccacttcgccatagactttatccagcgcttcggcataccagcgaatggcgcgggcggcgccgggaatatcgtcgcgcaggctgtggcgaatcggtttgccggtatccagcgtttccagcagcgccagctcttcacgatgggcctccatcagatcagcaaagcgagtgaggatcgctttacgctgtgcgggggaggcctgcgaccagtcgccgttatcaaaagcctggcgcgcggctttcaccgcccgttcgacgtcggcttttttaccgcgggcgacctgggctaa

SEQ ID NO: 337 - DNA, 774 bp, Klebsiella pneumoniae
tcccccgccgatggcgcggtggcggaagcctcgccgggccagtttgaaatcaaccttcaccataccgataacgtgctggacgcctgcgatgatgcgctggcgttaaaacgtctcgtgcgtttgatggcggagaagcataagatgcacgccacttttatggcgaagccttatgaagagcatgccggcagtgggatgcatatccacatcagcatgctgaacaataaaggggaaaacgtgctggtggacggcgatggggaagactctgcgctgctcaaacgcgcgctggccgggatgatcgatctgatgccggcctcgatggcgctgctggcgccgaacgtgaactcgtatcgccgcttccagccggggatgtacgtcccgacgcaggcttcgtgggggcataacaaccgcaccgtcgcgctgcgtattccgtgcggcgagcggcagaaccaccgcgtggagtatcgcgtcgcgggggcggacgccaacccgtatctggtgatggcggcgatttttgccggcattctgcacgggctggataacccccagctgcctttacaggaagaggtggaaggtaacggtctggaacaagagggcctgccgttcccgatccgccagagcgatgcgctgtgggagtttatgcagaacgatcacttgcgtgagcgcctcggcgagcgtttctgccatgttttccatgcctgtaagcatgatgaattactgcagtttgagcgtcttatcacagaaaccgaaattgagtggatgttgaaaaacgcctga

SEQ ID NO: 338 - DNA, 288 bp, Klebsiella pneumoniae
tgcttcggcctgttcgtcatttctgacggggctaaaacaatacgtggtgtggacgtgatgggagaacggtttcccgcaacgctggcattcgagagttaccgttacctttgcatcgccagtaataacggcgagacgctggttatcgatagcgaacgacatgctgcattccacatcgctgtccacgctgactacagaatcggttacacgttcaacctgatcgcgggcatagatgccttcgtaatcaaggcgtttttgagccgtgcgtaccggatcaagagtcaggggtaa

SEQ ID NO: 339 - DNA, 1410 bp, Klebsiella pneumoniae
ctcccaggcctgctccgctttagcggcatcaaactgcggcggcggtttgcggaagcgtcgggtcagataagtcaggtacagcagaccaagcgccgcccacaccaggccgagcgtcagggaggtggcctcgagattgatccacaataccccgaccgtcaacgccccgaccatcggcagcagcagataatgcagtcgatccttccaggttttgttgtaccccttgcgccgccagaagtggttgaacaccgacaggttaacgaaggtgaaggccaccagcgcgccgaaattaatcaacgcggtggcggtcaccaggtcgaagaacagcgccgacagcgcaacgatgcccaccataatcacgttcagcgccggggtacgccatttcggatgcacatagccaaaaatgcgctccgggaagacgttgtcgcggcccatcacgtacagcagacgggagacgctggcatgggaggccaggccggacgccagggtgttaacaaaggtggtgcacaggaaaatcgactggaacagcttgccgcccacgtacagcgcaatctccggcagcgcggcatcggggtctttaaagcgatgaatatccgggaagaacagctgcataaagaacgacgcgacgataaagataatgccgccgtacatcgcggtgagaaaaattgccttcgggatcacccgcgcggcgtcaggggtctcttccgacagggtggtcaccgcgtcgaaaccgagaaacgagaagcagacaatggtcgcgccggtaataatcgggatcaaatgcgcattctggctgataaacggctgcagcgaccagacggtacccaccccctcgcctttatgcagcccctgcaccaccagaatgacaaacaccaccatgatcgaaatctgcaccagcacgaacagggtattgaagttggccaccaggttaacgcttttcaggttcgcggcggtcagaatagcgacaaaggtcactacccacacccacggcggcacttcggggaacaaggccgagagatagatcttcgccagcaggacgttgatcatcggcagaaacagataatccagcagcgacgaccagccaaccataaagccgacgtgcggactgatggatttttgcgcgtaggtataggcggaaccggcttccggaaactgacgcaccagtttgccgtagctgatggcggtgaacagcacgccagccagcgccagcagataagacgccggaacgtggccattgctgatgccggagacgatgccgaaggtatcaaacaccgtcattggcgtcagataggccagccccatcatcaccacttgccagagtttgagggatttacgcagacgcggtctgcccgcctgagcggcgttatgcgccggaggattaatagccatcgcccatcccccccttgctgttaa

SEQ ID NO: 340 - DNA, 1602 bp, Klebsiella pneumoniae
aatagatcggatcgatttaagcacacaaagggggaagtgcttacttatatgaaacataaaccacagatgatgaaaatgcgttggttaagcgcagccttaatgttgtccctgtgtacttcatctgcatgggcatttagcattgatgacgttgcaaaagaggccaaaacgttagccgggaaaggctatgaagcgccgaagagtaacctgccctccgctttccgcgacatgaaatacgcggattaccagcaaattcagtttaatcacgataaagcttactggaataaccagaaaaccccattcaagcttgaattttaccatcagggtatgtacttcgacacgccggtcaccatcaatgaagtgacggccaccagcgtgcgcaaaattaaatatagcccggactattttaactttggtaacgttcagcacgataaagacacggtgaaagacctcggtttcgccggcttcaaagtactgtatccgatcaatagcaaagataagaacgatgagatcgtcagcatgctcggtgccagctacttccgcgtgctgggtcagggtcaggtttacggcctgtccgcgcgcggcctggctatcgataccgcgctgccgtccggcgaagagttcccgcgttttcgcgagttctggatcgagcgtcctaaagccaccgacaaacgtctgactatctatgcgctgctggactccccgcgggcaaccggcgcttatcgctttgtcatcatgccgggacgcgacaccgtggtagatgtccagtccaaagtttacctgcgtgacaaagtgggaaaactgggcgtggcgccgctgaccagcatgttcctgttcggttccaaccagccttctccggcgcttaactatcgtccggcgctacacgactccaatggtctgtcgatcctggccggtaacggcgagtggatctggcgtccgctgaacaacccgaaacaccttgccgttagcagctatgcgatggaaaacccgcaagggttcggcctgctgcagcgcggccgtcagttctcgcgcttcgaggatctcgacgatcgttatgacctgcgtccgagcgcctggatcaccccgaaaggggagtggggcaaagggaaaatcgaactggttgaaatcccgaccaacgatgaaaccaacgataacatcgtgacttactggacgccggatcagctgccggagccgggcaaggagatgaacttcaagtacaccatcaccttcagccgcgatgaagacaagctgcatgcgccggataacgcttacgttatgcagacccgccgctctaccggcgacgtgaagcagtcgaacctgatccgccagccggacggcaccattgctttcattgtcgacttcaccggcgccgatatgaaaaaactgccggcggataccccggtcgccgcccaggcgagtaccggcgataacgctgaaatcgttgaaaataccgtgcgttacaatccggtgaccaaaggctggcgaatgatcctgcgtttgaaggtgaaagatccgaagaaaacgacggaaatgcgcgccgcgctggttaacggtgatgacacgttgagcgaaacctggagctatcagctgcctgccaatgaataa

SEQ ID NO: 341 - DNA, 1266 bp, Klebsiella pneumoniae
atgactaaggatgaagggatgaaaaaacgtctacttgccgccgccgttaccggcgcggtgatgttatccgctggcgctcaggcgcaggacaaggccgccccggaggggtatcagctgcagcaggtgctgatcatgagccgtcacaacctgcgtgcgccgttggccaataacggcagcgtgctggaacagtccaccgccaaggcctggccgcagtgggatgtgccgggcggccagctgaccaccaaaggcggtgtgctggaggtgtatatgggccactatatgcgcgaatggctggcgcagcagaagctggtgaccagcggcgagtgcccgccggaaaacgcggtttatgcctacgctaacagcctgcagcgcaccgtcgccaccgcgcagttctttatcaccggcgcgttcccgggctgcggcatcccggtgcatcaccagcctcagatgggcaccatggacccgaccttcaacccggttattaccgacgactccccggcgtttcgcgagaaagcgctgcaggcgatggaaaaagagcgccagggaatgcagttgaccgagagctacaagctgctggagacgatgattgactaccgcaactcgccctcctgcaaagagaagaaggtctgttccctgagcgagggtaaagatacctttagcgccggttatcagcaggagccgggagtgtccggaccgttgaaggtgggcaactcgctggtagacgccttcaccctgcaatattatgaaggcttcccgaaagatcaggtggcgtggggggagatcgccagcgataagcagtggcgagtgctgtcgaagctgaaaaatggctatcaggatagtctgtttacctcggtggcggtggcgcaaaacgtcgccaaaccgctggttaaatatatcgataacgcgctggtgggcgagggagccagcaaggcgaaagtcacgctgctggtgggacacgactcgaatatcgcttcgctgctcaccgccctggactttaagccctatcaactgcccggccagtatgagcgcactcctatcggcggcaaactgctgtttcagcgctggcatgacagcgccggcaatcgcgatctgatgaagattgagtatgtctatcaaagtaccgagcaactgcgtaacgccgacgcgttaaccctgcaggccccgccgcagcgggtcactctggcgcttaacggctgtccggttgatgaccagggattctgcccgctggagacctttaaaatggtgatcaacgaggcggcgaaataa

SEQ ID NO: 342 - DNA, 315 bp, Klebsiella pneumoniae
acaaaaaaggaaataaaaatgaatatatttaaaaataaatctactgaaatcttttatgttgtgtccttgcatatctacgcggagctttttaactcaaaggataaaacaaccagtaatatgattataacgcatgtaatggatcatgagtttgtcagtaaactaatcgatctggcgatgagaaatgcggagaagcatcttctgaaaaaagcatggaaaaagaacgctgatgaaaaactgtctgaggtggattttaaagaggttaagcaggcattagccaaaatgcattacactgttctggcggaatcaatatgttga

SEQ ID NO: 343 - DNA, 357 bp, Klebsiella pneumoniae
cgccaggaggatgttatggacttcaatattgtcgccgtcaccgcctgcgtcagcggcgtggcgcatacctacatggccgccgaacgactggaaaaggtcggtcatcatgaaaaatggcacctgaaggtggaaacccagggggcgctcggcgtagaaaatcggatcaccgcggaagatatcgcccgcgccgaagtggtgctgctggtgacggatatcgaaatcgacgaccctcatcgctttcgcggcctgcggacgataaaaaccagtatcaagagcttcctgctgcagccgcagcagatcgtcgaggccgtgaaaagcatcatgaaaaagccggtcgtctatgtagaacttccctga

SEQ ID NO: 344 - DNA, 1209 bp, Klebsiella pneumoniae
ttaacaatctgcctgactgggatagtctggagtaaagatctctgtagtggctatataacctctaaatggactgagtgtgagatggaaaaaataaaatattggttaatagcgggatttattatccttcttgcaattgtttacactgctatcagtgacaggtattctacgctttctaggttgaaatcagcaggtgaaaacggagatgtagaagctcagtatgcgttgggtctcatgtatttatatggagaaatactggatgtcgattatcagcaggcaaagatttggtatgaaaaagccgctacccaaaatgatccgcgtgcacaggttaaactcggtttgatgtatgcaaatggtctcggggtaaatcaggattatcaacaggccaaatcttggtatgaaaaagcatcggttcaaaatgatgttgatgcgcaatttttgcttggagagatgtataacgatggtctcggggtaggccaagactaccaacaggcaaagatgtggtacgaaaaagctgctgctcaaaatgatgagcgtgctcaggtcaatctcgctgttctatacgcaaagggtaatggggtagaacaggattatcgtcaggccaaaagctggtatgaaaaggctgcagctcaaaatagccctgatgcgcagttcgccattggaattctgtatgccaatgctaatggtgtagagcaggactatcagcaggcaaaagactggtatgagaaagcagcagaacaaaatttcgccaacgctcagtttaatcttggtatgttctattacaaaggtgagggagttaatcaaaactttcagcaagccagagaatggtttgaaaaagccgcgtctcaaaatcagctgaatgctcaatataatttaggtcagatctattactacggtcagggcgtaactcagagctatcgaaaggctaaggaatggttcgaaaaagcagctggggaaggtcatgtcgatgcccaatataaccttggcgtaatatacgaaaatggtgaaggggttgggcaggactttcatcaggcgagagcttggtatgaaaaggcagcttcgcaaaacgatgcgcaggcacagtttgatcttggtgttatgaatgagcttggtcaggggggaagtataaatctgaaacaagcaagaacttggtttgggctggcatgcaataatgggcataaggaaggttgcgaacgttatgaaaataattga

SEQ ID NO: 345 - DNA, 345 bp, Klebsiella pneumoniae
ctaacagactggaaggaacagattatgacccacattatcgctgtcaccgcctgcccgtcgggcgtggctcacacctacatggccgctgaatcgctggaaagcgccgccaaagccaaaggctggcaggtcaaggttgaaacgcagggttctatcggcattgaaaacgaactgacggcggaggagattgccgccgccgatatggtcattctgaccaaagatatcggcatcaaattcgaagagcgttttgccgggaaaactatcgtgcgcgtcaatatcagcgatgcggtcaagcgcgccgacgccatcatgaacaagatatacagccacctttcccagagcgcctga

SEQ ID NO: 346 - DNA, 582 bp, Klebsiella pneumoniae
ttgaagggctgcgcgccctgcgcccggaggcgcgcttcctggagctgtgccatgtctcgaccgggatacctacggcgtgctgctggtggcaaaaaagcctcagcgcttgcgtcgctgcacgagcaactgcgcgataaaggcatgcagaaagattatctggcgctggtgcgcgcccagtggcagtcgcataccaaagtgttccagcccccgctgttgaagaatattctgcagagcggggagcgcatcgttcgcgtgagtcaggaaggcaagccgtcggagacgcgctttaaagtggaagagcgttacgaattcgccacgctggtgcgctgcagcccggtcaccggccgcacgcatcagatccgcgttcatacgcagtatgccggccatcctatcgcttttgacgaccgctatggcgaccgcgagttcgacaagcagctgtccgctaccggcttaaaccgcctgttcctgcacgcggcggcgctgaagtttacccacccggggagcggggaggtgatgcgcgttgaggcgccgctggacaaccagctgaagcactgtttacaggtgctacggaagagcaaataa

SEQ ID NO: 347 - DNA, 1257 bp, Klebsiella pneumoniae
ttgcccggatggcggcgcaccgcaccttatccgggctaccctttggcggtggtaggtagccccggtaagcgcagcgccaccggggagcccgttttagccgatggtcatcaggctggcgttaccgcctgccgccgcggtgttaacgctcagcgaacgctcgatatacagccgctccagcagcagattggtttcgccgcgggcgaagccctgcacggagacaatcgccccgtcgcgcgccgccacctgctcgcacagctcgcgcagctggtcggaatcgccgtggtagataaccgcgtcgaaggcctggccaggcaactgctccgctttggcaaagcgaatgcgctcgctgacctcccgcggcagtttcttcgccagatcgcgctgcagggcgctgtccggccacagtacttcacaacccaccgccagcacagccgccagctggatcagcgcatcctgttcgttatccgctacgcacagcacgcgctcgcgcggcatcagcgtcagggtgttgcgctcgccggttggccccggcagcaggcgttgggtgccgctttgcgcctgctcgctgtactgctggcacagcgcctgcagctcaggacggcccgcggcccactgctgcagcgcctgcagcggtttttccagcagcgttttcagctgggcgtccagcggacgctctgcatcctggcgggcgaaggtcacgccaaccgcgtcctgcggacggctggagagcagacggtacagatacagcggaccgccggctttcggaccggtaccggacaacccttcgccgccgaacggctgaacgccgaccaccgcgccaaccatattgcggttgacgtacaggttgcccaccttggcgctgccggtgacctgggcgatggtttcgtcgatacgggtatgcacgccgagggtcaggccgtagccagaggcgttaatctgctcgaccagtttgtccagctcgttacggttatagcgcaccacgtgcagtaccgggccgaagacctcttttttcagctcgtcgaagctgtcgagctcgataagcgtcggcggcacgaaggtcccgtgacgccattcgcgggcgtcttcgctattctcacgcaccgcctggtaaacggtgcggcctttggcgcgcatcgcctgaatatggcgttcgatattctctttcgcttccgcatcgataaccggaccgatatcggtggtcaggcgccccggattgcccatccggcactcgctcatggcgccgcgcagcatggttaa

SEQ ID NO: 348 - DNA, 651 bp, Klebsiella pneumoniae
aggagaggatgtatggcacagggcgcggtgaagaaaagcggcaaacgttcacaagcggtcagcgccaaaaaggaggccatcctggccgccgcgctggaggcattttcgcaatttggtattcacggtacgcggctggagcaggtggctgagcgcgccggggtatcgaaaaccaatctgctctattactacccttcgaaagaggcgctgtatgtggctgtcctgcagcagatcctcgccatctggctggcgccgctgaaggcctttcgtgaggatatcagcccgctggtggcgatccgcgaatatattcgcctgaagctggaggtgtcccgcgatcacccccaggcctcgaagctcttctgcctcgagatgctgcagggggcgccgctgctgatgggcgaactgaccggggatctgaaagcgctggtcgacgaaaaatcggcgatagtctccggctggatcgaccgcggcaagctggcgccggtcgatccacagcatttaatctttatgatctgggctaccacccagcattacgccgacttcgccacccaggtggaggcggtcaccggcgccacgctgcaggatgcggccttttttgaacaaacggtcgataatgtccagcggatgattatcgaaggcattcgcgtccgttaa

SEQ ID NO: 349 - DNA, 429 bp, Klebsiella pneumoniae
attgaatcgtgttcaattcatattcttctcaggagattcgctatgccaaaggattcgatgttctacgccacgcttgaagaagctattgatgcagcacgtgaagaatttctcgccaacaaccctgacagcgatgaagagagcgccaacgttgagcagctcaacattcaaaagtatgtgctgcaggatggcgatatcgcctggcaggccgaattttttgctgacgaagaggaacaaggcgaatgcctcccgatgctcagcggcgaagccgcgcagagcgtcttcgtcggggattatgatgagatagagctgcgtcaggagtggctggaggaaaatacgctccacgaatgggatgaaggcgaatttcagctcgagccctcgctggacaccgaagaggggcagacggcagccgacgagtgggacgagcgttaa

SEQ ID NO: 350 - DNA, 330 bp, Klebsiella pneumoniae
gcgaatttgctatcctcagcgtatagcgtgagcgaaaaggagatgattatggccagtatctgcacaatggcatgggtttacggttcggttcagggcgtgggatttcgctattccacgcagcgggaagcgctgcagctgggggtgaccggttatgcccgtaatctggatgacggcggggtggaagtgcttgcctgcggcgaggcggagcaggtggaaaaactcatcgcctggctgaaagccggggggccgcgcagcgcgcgggttgaccgagtgttaaccgagccccatcaacccacccgcagctgggacaaattcgcgatcctctattag

SEQ ID NO: 351 - DNA, 1101 bp, Klebsiella pneumoniae
cgcgcgactcgcactgttctctttgatgcggtgttaatctccccgacccaaccgcatcgccctcgccgccggcatctgccggcggtttttttatctgtcggtggttgcgctcccgccgggcggattgcacactggtcgcccgttaatcgtcatggctgtcttatgtcttcgttaaaattctccgttagccgccaggaagcgctccttatcatgatcaccatgttctggggagggacgttccttgccgtacagtacgcggtgagcctcagcgggccgctgttttttgtcggtttgcgtttcgcgaccgccgcgctggcggtgggcctgctttcgctgcgcactctgcgcggtctgacgtggctggaggtgaaggccggggtagcgattggcgtggcgattgcgctggggtatggcctgcagacctggggactacagaccatctccagcagtaaatctgcctttatcaccgcgatgtatgtgccgctggtgccgctgctgcagtggctgtgcctgggacgtatgccgggggtgatgtcctgcgtggggattgtgctggcctttattggtttaattctgctggccgggccggaaaataatctgctggcgcttggcgtgggggagatgatcactctggcaagcgcggtagcgatcgcggcggagattatccttatcagcgcctgggccggaaaagtcgatgtccgccgggtgacggtggtgcagctggcgaccgcgtcgctggtggctttcgccgccatgaagccggcgggtgaatcggtgccgtcgttgacgccggccctgctcggcgtcgcgctggggctggggattttcagcgcgatcattcaggtgaccatgaactgggcgcagcgcagcgtctcgccgacgcgggccacccttatttataccggtgaaccggtatgggccggtatttttggccggctggccggtgagcgtctgccgctgctggccctgctcggctgcgttttgatcctcgcgggggtgctggtgagcgagctgaagtggaagcgcaagtcgccgccgcaggtttccacaaacgacgatgcgcagccgctcacggacctggccgatcgccgcgagccataa

SEQ ID NO: 352 - DNA, 1194 bp, Klebsiella pneumoniae
aactggcatcgcctttgctttaccttttctgcgaggtggtccagggagaggcaggatgccgcaccatcgcaacccatcttccatgactgcagagaggtaggtatgaaaattggtgttttcgttcccattggcaacaacggctggctgatctccacccatgccccgcagtatatgccgacctttgaactgaataaggccatcgtgcagaaggccgagcactaccatttcgacttcgcgctctccatgatcaaactgcgcggcttcggcgggaaaactgaattctgggatcacaacctggagtccttcaccctgatggccggcctggccgcggtgacctcgaagatccagatctacgccaccgccgccaccctgacgctgccgccggcgattgtcgcccggatggcctccactatcgactccatctccggcggccggtttggcgtcaatctggtgaccggctggcaaaaaccggaatatgaccagatgggcatgtggccgggagatgactatttcgccagccgctatgactatctcaccgaatacgttcaggtgctccgtgacctgtggggcaccgggcgcagcgatttcaaaggcgactacttcaccatgaacgactgccgtgtcagcccgcgcccgtcgcagccgatgaaggtgatctgcgccgggcagagcgatgccgggatggccttctccgcccagcatgcggactacaacttttgctttggcaaaggggtcaacacgccaacggcctttgccccgaccgccgcacgcatgatgcaggcggcggaaaaaaccggccgcgacgtggggtcctatgtgctgttcatggttatcgccgacgaaaccgacgaggcggcgcgcgccaaatgggaacattacaaagcgggcgccgatgaagaagcgctggcgtggctcaccgagcagagtcagaaagatacccgctccggcagcgataccaacgtgcgccagatggccgaccccacctcggcggtcaacattaatatgggcaccctggtcggatcgtatgccagcgtcgcccgtatgcttgatgaagtagcgagcgtgcccggcaccgacggcgtgctgctgacctttgatgattttcttgccggcattgacgcctttggcgaacgcattcagccgctgatgcgctgccggaaccacattgcttctgttacccgtgaggtggcctga

SEQ ID NO: 353 - DNA, 663 bp, Klebsiella pneumoniae
ctcatggatcgcataattacatcatcgcgtgaccgttcctcgctgctcagcacgcacaaggttctgcgtaacacctacttcctgctcagcctgacgctggcgttttccgctatcaccgccaccgccagcacagtgctgatgctcccttcgccgggtctcattttgaccctcgtagggatgtacggtctgatgttcctgacctacaaaacggcgaataaacccaccgggattatttccgccttcgccttcaccgggttcctcggctatatccttgggccgatgctgaacgcgtatctttctgccggcatgggcgatttaatcggcctggcgctgggcggcacggcgctggtcttcttctgctgctcggcctacgtgctgacgacgcgtaaagacatgtcattccttggcgggatgctgatggccggcgtggtggtcgtcctgattggtatggtcgctaacctgttcctgcagctgccggcgctgcacctggcgattagcgcggtgttcatcctgatctcttcgggtgccatcctgttcgagaccagcaacattatccgcggcggtgaaaccaactatatccgcgcgacggtcagtctgtatgtctcgctgtacaacatctttgtcagcctgctgagcatcctgggcttcgccagccgggactaa

SEQ ID NO: 354 - DNA, 1623 bp, Klebsiella pneumoniae
atacacttccgctctcgctcccccgggcccggtaagctgccatttatgctgatgcttgttcgctcccaggctgagtcccggccaggcgctcagctcggacggcgcctgcggacgtccgagccgggaaatgagatccgggctggccaccagccggtgcccgcggtccgccagcacgcgcatcaccaggtcgctatcctcgatgggccggggacggacgcggatcgccacatcaatgccctccccgaccacatccacccggcggttggtcgcctcaagatgcagcgttaccccaggatagcgcgccataaatcgcgccagcatcggtccgatatggacatgcagcaaggtgaccggacaggtgatcctgacgctaccgcgcggctcggcgcgcagcgtctcgaccgcctgctgcgccgcctcggcctcaatcagcatcgctttgcaatgctgataaaaggtctgcccgacctcggtgaccgcgaactgacgggtggttcgctgaatcaaacgcacgcccaaccgctcctcgagttgcgcaatgcggcggctgagtttggatttcggctggtcaagcgctcgccccgccgcggcgaaaccgccatggtctaccacctggacaaaccaggcgaagtcattgagatcctgcatccttcctccattgttccatttttggaacagtataggtcatttttgctcactaccgcatacgtcgtcccggatataagcttattcacatcagataccgatacacaggagaaagccatgaaacagatcacaggagtttacaccgcgcctgcgcagcattgggtaggcgacggcttcccggttcgctcgatgttttcctatcagacgcacggccagcagctgagccccttcttactgctcgactatgccgggccgtacaccttcccggcgggcagcgaaaaacgcggcgtcggtgagcatccgcatcgcggatttgaaaccgtcaccatcgtctacgccggtgaagtagagcatcgcgactccaccggacgcggcggggtgattggtccaggcgacgtgcagtggatgacggcgggcgccgggatcctgcacgaagagttccactcggaggccttcacccgcagcggcggcgagctgaagatgatccagctgtgggtcaacctgcccgcgaaagacaaaatggcgccccccggctaccagagcattaccgctgggacgatccccaccgtggcgctggcgaacggcgccggacaggttcgggttattgccggccagtatgacgacgtcagcggtccggcccataccttttcaccgcttaacgtgtgggatctgcagctgaatcaggggcacgacctcacgctgcgccaaccggagggctggagtaccgcgctggtggtgctggaaggggaagtgatcattaacggttccgaatctgctcgcgaaggccagctggccgtcctgagccaggcaggtgacgcagtgcatctggaggcgaccgccccggcaaaagttctgctgatggccggagaaccgctacaggagccgattgtgggctatggcccgtttgtcatgaataacaaaacgcagatcgcagaagctgtacgcgattttaacagcggccgctttggccaaatctaa

SEQ ID NO: 355 - DNA, 603 bp, Klebsiella pneumoniae
tcttgctcccgcaggcgggaatgccctagtctcggcagaaagccgtatccacacgctatgccgacaggaggagaaatggctgttaaacctgaggtaattctcggcgatattacgacacttgatgtcgatgtgattgttaatgcggcaaatccctcgctgctgggtggtggcggagtagacggggccatccaccgggcggccggtcccgcgctgctggcggcttgcaagcaggtgctgcagcagcagggcgaatgccctcccgggcatgcggtaattactattgccggcaatctgccggccagcgcggtgatccacaccgtgggcccggtctggcacggcggcgaccgcatggaggcgcaaaccctggccgatgcttacaaaaacagtctgcagttggcctcggcaaacaactatcgctccattgcgtttccggcgataagcaccggcgtgtatggctatccgaaagaggaagcggcggcgatcgctgtgcgcaccgtcaccgcgtttctcactcgctataaccctcttgagcgcgtcctgttcgtctgttttgacgaggaaacggtggctatctatcgccgcctgctggagtcatacccctga

SEQ ID NO: 356 - DNA, 1344 bp, Klebsiella pneumoniae
cctttaacccgggatatcatcatggcactcttcgattttcctcgctggaagctgacctctcccgccgccgaatccggcgttgtcgcccccgatgaacgcttgtcggccgggcaaacgctggtgatgggcgtgcagcacgccgttgcgatgttcggcgcgacggtgctgatgccgttgttgatggggctcgacccgaacctgtctattctgatgtcgggcgtcggcaccctgctgttctttgtcgtcaccggcggacgggtgccgagctatctcggctccagcgccgcttttgtcggggtggtgatcgccattaccggctttaacggccaggggctgaaccctcatctgagcgtcgcccttggcgggatcatcgcctgtgggctggtctacaccctgattggtctggtggtgatgaagatcggcacccgctggatcgagcgcctgatgccgccggtggtgaccggcgcggtggtgatggctatcggcctgaacctggcgccgattgccgtgcgcagcgtctccgccagcgccttcgacagctggatggcggtgttaactgtgctctgcatcggcatagtggcggtatttacccgcgggatgctgcagcgactgctgatcctggtcggcctgatcgtcgcctgcgcgctgtacgccctgctggctaacggcctgggccttggcaaaccgctggacttctcccccctcgcccaggcggcgtggttcgggctgccgcactttaccaccccatcctttaacggccaggcgatgatgttgattgcgccggtcgcggtgatcctggtggccgagaacctcgggcacctgaaggccgtcgccgggatgaccgggcgcaatatggacccgtacatggggcgcgccttcgtcggcgacgggctggcgaccatgctctccggttcggtgggcggcagcggggtcaccacctatgcggagaacatcggcgtcatggcggtgaccaaggtctactcaacgctggtgtttgtcgccgcggcgctgattgccatgctgttgggtttctcgccgaagttcggcgcattaatccacaccattcccgggccggtgatcggcggcgcctcgatcgtggtctttggcttaattgccgtcgccggggcgcggatctgggtgcaaaaccgggtggatctgagtcaaaacagcaatttgatcatggtgtcggtgaccctggtgctgggcgccggcgatttcgcgctgtcgctgggcggctttacgctgggcgggattggcacggccaccttcggggcgatcctgctgcacgcgctgcttcatcgcgggacgcgcgaggcgaaggaggccagggtaacgccggtgtaa

SEQ ID NO: 357 - DNA, 195 bp, Klebsiella pneumoniae
ggggcttcacgccggataagctggggtattactacaccaaagacatgtacattaaaaaacacccatccgccagcggcgatgggcgttgattttctgtgcaaactgcctgaaattcagacgaataacacaaaattgtttgtttttaaggcagttgatcaaaatgatgctttacagcatccgccgaggtgtttatag

SEQ ID NO: 358 - DNA, 1347 bp, Klebsiella pneumoniae
atcgctgcacgcactggaaaaattcaccgaactgaaaaccatctggattgccctggagtcttgatcatgactgaacataccactagctactatgccgccagcgccaacaagtatgaaccgttcccgacgctggagggatccatcaactgtgacgtctgcgtcgtcggcggcggctacaccggcctctcgtctgccctgcatctggccgaaatgggctacgacgtggtggtgctggaaggggcgcgcatcggcttcggcgccagcggccgcaacggcggtcagctggtcaactcctatagccgcgatatcgacgtcattgaaaagaactacggcccagatgcggcaaaaatgctcggcagcatgatgttcgaaggcggcgatatcatccgcgaacgcatccagcggtatcagatccagtgcgattaccgcccgggcggcctgttcgtggcgatgaaccataaacagctggaaaccctggaagagcagaaagccaactgggagcgctacggcaacacccagctggagctgctggacagagaggccattcgtcgcgaagtggacagtgaccgctacgtcggcgccctgctcgaccacagcggcggccatattcacccgctgaacctcgccatcggcgaagcggatgccattcgcctgaacggcggccgggtgtatgagcagtcgccggtcacccgcatccagcacaccagcccggcggtggtcagcaccgcgcgcggccaggtcaccgcgcgctacgtgatcgtcgccggcaacgcctatcttggcgataaactggagccggagctggcgaaacgcagcatgccgtgcggcacccaggtggtcactaccgctccgctgtcggaagaggtcgcccgctcgctgatcccgaaaaactactgtgtggaagactgtaactacctgctggactactaccgtctgaccggcgacaaccgtctgctgtacggcggcggcgtggtctacggcgcgcgcgatccggacgacgtggagcggctgattatgccgaaactgctgaaaaccttcccgcagctgcagggggtgaagattgactaccgctggacgggcaacttcctgctaaccctgtcgcggatgccgcagttcgggcgtctcgataacaatatttactacatgcagggctacagcggccacggcgtgacctgtacccaccttgccggacgcttgatttcagagctgctgcgcggcgacgccgagcgtttcgacgccttcgccaaactgccgcactacccgttcccgggcggccgcagcctgcgcattccttttaccgccatgggcgccgcctactacagcctgcgcgaccgccttggggtttaa

SEQ ID NO: 359 - DNA, 1356 bp, Klebsiella pneumoniae
ttacatcaacggccaccaggcgtaagtgaacatctccaggcggtcattcgaccgcctgagttttatcttttttttgtcccacaagaatctattttccctccctggaggacaaacgtgtctaagcgtcgtgtagttgtgaccggactgggcatgttgtctcctgtcggcaataccgtagagtctacctggaaagctctccttgccggtcagagtggcatcagcctgatcgaccatttcgatactagcgcctatgcaacgaaatttgctggcttagtaaaggattttaactgtgatgacattatctcgcgcaaagaacagcgcaagatggatgccttcattcaatatggaattgtcgctggcgttcaggccatgcaggattctggccttgaagtgacggaagagaatgcaacccgtattggcgccgctatcggctccggtattggcggtctcggcttgatcgaagaaaaccacagttcgctggttaacggcggaccgcgcaagatcagcccattcttcgttccttccacaattgttaacatggtggccggacatctgaccatcatgtttggtctgcgtgggccaagtatctctatcgcgaccgcgtgtacttcaggcgtgcacaacatcggccaggccgcgcgcatcatcgcctatggcgatgccgatgcgatggtggcaggcggcgcggaaaaagccagtaccccgcttggcgtgggcggcttcggcgcggcgcgtgcgctctccacgcgcaatgacaacccgcaggcggcgagccgtccgtgggataaagatcgtgacggcttcgtgctgggcgacggcgcgggtatggtggtgctggaagagtacgagcatgccaaaaaacgcggcgccaaaatctacgccgagatcgttggcttcggcatgagcagcgatgcttaccacatgacgtcaccgccggaagatggcgcgggcgccgcgctggcaatggtgaatgctattcgcgatgcgggcatcgaaccgggccagatcggctacgtcaacgcccacggcacctcgacgccggccggcgataaagcggaagcgcaggcggttaagtctgtcttcggtgatgcggcgagccgcgtactggtgagctctaccaaatccatgaccgggcatctgctgggtgcggcaggggcggtagagtcgatttactctatcctggcgctgcgcgatcaggcggttccgccgacgatcaacctcgacaacccggatgaaggctgcgacctcgacttcgttccacacgaagcgcgtcaggtttccggtatggagtacaccctgtgcaactccttcggctttggcggcactaacggttcgctgatcttcaaaaaagtgtga

SEQ ID NO: 360 - DNA, 891 bp, Klebsiella pneumoniae
accggcgcgcttctgcattcagtgcggactggtgaagcccgatgcgctagtggaaatcgccagcgtcgcccatatcgggaccccgacatgatgaggctcaatattgctccggcaccatggtccggcgcgccggtggtggtcctcagcgccggtctgggcgggggcggcggctactggctggcgcagcgcgcggcgctggaggaacagtatcagctggtgagttatgaccataacgggaccggggagaacgccggtccgctgcccgccgactacagcctggcgacgatggccggggagctgttcagcgctctgcaggcggcggggatcgcccgcttcgcgctggtgggccacgccctgggggcgctgattggcctgcagctggcgctcgatcgccccgaggcggtgagcgccctggcgctggtcaacggctggctgtcgctgtcgccgcatacccgccgctgcttccaggtgcgcgagcgtctgctgcatgccggcggcgcgcaggcgtgggtcgaagcgcagccgctatttctctacccggcggaatggatggccgcgcgcctgccgcgcctcgaagcggaagatgcgcttgccatcagccattttcagggcaaagagaatctgctgaagcggctgcaggccctgaagcaggctgatttttcacgccgtgcgtcggccatcgcctgcccgacgctgattatcagcgccgctgacgacctgctggtccccgcctcctgctcccgcgtgctgcagacggcgatccccggcagccagctcgtggaaatgccgtggggcggccatgcctgtaacgtcaccgacgccgatacctttaataccattttacgcgacgggctgtccgctatgctgccggtcgccagggagacccgatga

SEQ ID NO: 361 - DNA, 930 bp, Klebsiella pneumoniae
tcgacaaagcggatggaaatcagcggaaaaacgacaaaaaagcccagcacgaccagcatgttatcgactaacaggaaatatttacccaggctccttgcctgcgagacgcgggacatttcccctccagggaaaaatagagataagcgaggatattctgcgggcaatctgctgcttttcccagcacccttgcgacaatatttttttatcaaaaagcaagatcgattgagcctattcatcgaaaagaggagatggcgcagaaaatggtatgttgctgttttcacactatcgtgcaggaaaggtatagtgatgaaagcaagagtgaagtcagggggactgaaaaaggaaatgtttggctatcgcagtaacgtgccgaaggtgcgtttgacgacggaccggctggtggtgcgcctggttcacgatcgtgacgcctggcgtctggccgattattacgccgaaaataaagcgttcttaaaaccctgggagccggttcgtgacgacagccactgctatccctccggatggcaggcgcgtctgtcgatgatcgctgagtttcataagcaggggtcagctttttatttcgcgctgctcgaccctgaggaaaaagagatcatcggtgtggcgaatttctccaacgtggtgcgcggatctttccatgcctgttatcttggctattccattggcgagaagtggcaggggcaggggctgatgtttgaagcgctgacgtcggcgattcgctatatgcagcgcacgcagcatattcatcgcattatggccaactacatgccgcataatcagcgcagcggcgcgctgctggcgcggttggggtttgaaaaagagggttacgccaaagattatctgctgattgacgggcagtggcgtgaccatgtactgacggcgctaacgacgccggactggtctgcgggacgttaa

SEQ ID NO: 362 - DNA, 384 bp, Klebsiella pneumoniae
ataggtgagcgaagggaatctggagggaactgtatgagctttgaagctaaaaaggaacatgccattgccatcatggaaagcaagaaaatgtggcgtagtaactatgcgcctcctttgctacgcctcgcatggaaagctggcctcaagatcccaccgttgccttttgccacgttctggcaaataaccttgctgatgggaggttggtttggtccggcatgggggatttgtatgtggttttcttcatggaaggacagtggtatgcagccgggcgttgcatttgtctcaagcatagtcgcaggtatttgctttggtgttcttatggctgcgtatcattggtggcgaaaggtagttaacaatctgcctgactgggatagtctggagtaa

SEQ ID NO: 363 - DNA, 690 bp, Klebsiella pneumoniae
cacacctggcgcacgcaagcatctttcgcccggcaggcacaggtgagcgtttcggcacaaaatgcaggcgcttcggcacattcagctggtgcggactctcataccctgttttctcaccccaacgaggagcagacgatgaaaacaggtatccgcatggctgtggcgatggtaacggctgtgagcagcggcgcgatggccgcgccgtttagcgtaagcagcaatgatatgcgtgacgggcagccgctggcccagcagcactggtttgccggtttcggctgtaccggaggcaatgtctctccgcagctggcatggaaaaacgccccggcgggtacgcgcagcttcgcggtcaccgtccgggatcccgatgcgcctaccggcagcggctggtggcactggacggtggtcaatatcgccagcagcgtcttttcgctgcccgctggcgcgggagataaaaacagcgctacactgccgggcggagcgatccagggccgcaacgattttggctatgccggcttcggcggcgcctgtccgccggcgggagataaaccgcaccgctatcgctttacggtatgggcgctggatgtccccacgctgccggtggatgccggggccagcggggcgctggtcggctatctgttacacagccatgctctcgccagcgcacagttgacggcgatggccgggcgttaa

SEQ ID NO: 364 - DNA, 1131 bp, Klebsiella pneumoniae
attaaacagctttgctatatcatgcccgccgtttatttcctcatttctatgtcgagcaggtacaccatgccagtgttacacaaccgcatttcaaatgagacgttaaaggcgcaaatgctggctgaaaccgagccgcgcacgacgatctcattctataaatatttcaccattgtcgacccgcaggcgacccgtgatgcgctgtgggttgccttaacccagctgaaggtctttggccgcatctatctggcccgggaagggatcaacgcgcaaatcagcgtgccgcaaagcaacgttgaggctctgcgtgagtttctctatggcttcgatccggcgctggcggggctgcgtttcaatatcgccgtggaggacgatggtaagtctttctgggtgctgcgcctgaaagttcgccatcgtatcgtcgccgacggcatcgacgatccctcgtttgacgcctccaatgtgggggagtatctcaaggcggcggaagtcaacgcgatgcttgacgatccggatgccgtgtttatcgatatgcgcaaccactatgaatatgaggtgggccatttcgaaaacgcgctggagatcccggcggataccttccgcgaccagctgccgaaagccgtggaaatgatgcaggaccataaagacaagaaaattgtcatgtattgcaccggcggcattcgctgtgaaaaagccagcgcctggatgaagcataacggcttcaataaggtctggcacatcgagggtggcatcatcgagtacgcccgtcgcgcccgcgagcaggggctaccggtgcgcttcattggcaaaaactttgtctttgatgagcggatgggcgagcggatctccaatgacgttatcgcgcactgtcatcagtgcggcgcgccgtgcgacacccatactaactgcctgaacgatggctgccatctgctgtttatccagtgcccgagctgcgccgagaagtttgccggctgctgtagcgaagcctgcatggaagagcataagctaccggaagaggagcagcgtaagctgcgcgccgggcgtgaaaacggcaacaaaatctttaataaatcccgtggccggctgaataccaaactcgggatcctcgatccggagccgtcagaaaaaccataa

SEQ ID NO: 365 - DNA, 513 bp, Klebsiella pneumoniae
actatgtttagttcagctcacgcaaaccgttcagcacaggcttctgctccggcaggccactacgctcatcgttctggcgaacagaacaccaatgggctgatcagtgaaattgtctattgtgaagatcaacccatgatgacgcagttattgctgctacctttattacagcagctgggtcaacagtcgcgctggcagctgtggctcacgccgcaacaaaagctcagccgcgaatgggttcagtccgccggtctgccgctgtccaaggtcatgcaaattagccagctctctcccagccataccatagactcaatgatccgtgccctgcgcacgggtaattatagtgtagttatctgctggctggcggaggagttaaccgctgacgaacacgaacgacttgttaacgctgcccaggtagggtccgcgatgggattcatcatgcgcccggagcgaaatcagggcacgctcggcagacaactcagcgggctaaaaattcactcaaatttgtatcattga

SEQ ID NO: 366 - DNA, 810 bp, Klebsiella pneumoniae
acccgctatagcggtcataatttagtccactttgtgagggcgatcatggaaaatataatgtacaagccagttattggcgtcgtgatgtgtagaaacaggcttaagggtcaccagacccagaccttgcaagaaaagtacctgaatgcaattgttaacgccggcggactgccgattgccctgccgcatgcgctggcggagccggagctactgaacgcggtcgttgataaactggacgggatctacctgccaggcagccccagcaacgtgcagccgcacctttatggtgaaaacggcgatgagcctgacgccgaccccgggcgtgatcttctgagcatggcgctgattaacgccgcgctcgaaaggcgcatccccattttcgccatctgtcgtggactgcaggaactggttgtcgccaccggcgggactctgtatcgtcgtctgttcgagcagcctgagctccttgaacatcgcgaagatcctgaactgcccgtcgagcagcagtatgcgccgtcccatcaggttgaggttcaggaaggaggattgctgtcgcaattgataccgggctgcaacacgttttgggtaaactcgctacatgggcaaggggcaaaaaccctcagtccgcagctgcgcgtggaggcgcgagcgccggatggactggtggaagcggtcagcgtgaacgatcatcctttcgcgctgggcgtacagtggcatccagaatggaacagtagcgaatacgccctgtcgcgtatgttgtttgatggttttatcaccgcctgtcagggccatcatgctgaaaagcggcggcgctga

SEQ ID NO: 367 - DNA, 1251 bp, Klebsiella pneumoniae
ggaaagaatagccaggtaggatcgtcgacccgcctgccggtggttgccctggccggggggctgcttcacagctctcagccgctaaagtgggcgagagggcataaaaaaaacccgccgaagcgggttttttttatcggttataacttaagccgccggctgagttacaacttctttgtagcctttaacttcgatctctacacgacgatccggagccaggcaatcgatcagggcagcgcgagctttcacgttgtcacaggtgttgccagtaaccgggttggattcacccatgccgcgagcggagattttgccagccgggatgcctttagcaaccaggtagtcaacaacggactgagcacgtttctcagacagctgctggttgtaagcttcggaaccgatgcggtcggtgtagcccagaacaacagcggaaccgtctttcggatccatgttgctcagctgagtgtacagctgatccagagcctgctgaccttccggtttcagggtagctttgttgaagttgaacagaacgtcagacttcagggtgaagtgcttggtagccacttccggagccggagccggagccggagcaacaaccggtgcagcatcttcctgaccgaagcggtaggaaacgcccaggctcagcatgccgttatcaggacgggtacccacggtgcccgcgtcgccgatgttgttaacccactggtattccagacgggtagcgatgtcacgagtaacagcccactctacgccgccagcaaatactggggaaacgccagtgtcgtgttcgctacgggaaacgccggtagaagcgtagttgcctttggagtcagcgcgccaaaccatgccgcccagacgggtgtagatgtccagatcgtcagtgatcgggtaacccagtttagcggtcagctgaacgccctgagctttgaaagcaccgttgtcaacgctgcctttatatgccatacggcccagccagtcataacccatttcgaaaccgaggtacgggttaacctggtaaccaccgaacgcaccagcaccaagctgatcgttacgggtcggaccgttgttgttctggaaaccgttaccgtagaaaccggtgtcgtgatactgggaccaacccagtttaccacctgcataccaggtgttatctttcggagcggcctgcgctacggtagcgaagccagccagtgccactgcaatcgcgatagctgtctttttcattttttgcgcctcattatcatccaaaattcgccatga

SEQ ID NO: 368 - DNA, 261 bp, Klebsiella pneumoniae
actgcacggctaatcttctgcaggaggagcactatgccaactcaagaagcaaaagcacatcgcgtcggcgaatgggcaagtttacgtaacacctcaccggaaattgccgaggcgattttcgaagtcgcccactacgatgagaaactggcggagcaaatctgggaggaaggcagcgacgaagtgctggcgctggcctttgccaaaaccgataaagacagcctgttctggggcgaacagacgattgagcgtaaaaacgtctag

SEQ ID NO: 369 - DNA, 660 bp, Klebsiella pneumoniae
aagtacttaaggaaaaaaatgcgcagtaactatatcgtcatcgaggggctggagggcgccgggaagaccaccgcacgtcaactggtggtggagacgctgcagtcggcgggtattcacgatatggtgtttacccgcgagccgctgggcacaatccttgccgaaaaactgcgtagcctggtgctggatatacagtccacgggcgatgaagtgattaacgataaagcggaagtgctgatgttttacgcggcgcgcgtccagttggtggagaccgtgattaagcccgcgctggcccgcggccagtgggtgatcggcgatcgtcacgatctgtcgacgcaggcctatcagggcggcggccggggaattgaccgcacgatgctggcgacgctgcgcgacgcggtactcggtgattttcgccccaatctgacgctgtatctcgacgtcacgccggaagtggggctgcagcgcgcccgggcccgcggcgagctggatcgcattgagcaggagtccatgaactttttcaaccgtacccgcgcgcgctatcttgagctggccgccgccgatccttctatccgcacggttgacgcaactcagccgctggatgccgtggcgcgcgacattcgcgccacgatcgcccagtggatggcggagcaagcggcatga

SEQ ID NO: 370 - DNA, 1527 bp, Klebsiella pneumoniae
aaattctggagactttgcatggctattagcacaccgatgctggtgacatttattgtttatatttttggtatggtattgatagggtttattgcctggcgttcgaccaaaaacttcgatgattatattctcgggggaaggagtctggggccatttgtgaccgcgctttccgcaggggcgtcggatatgagcggctggctgctgatgggcctgccaggggcgatttttctctccgggatttccgaaagctggatcgccattggcttaacgctgggggcatggattaactggaagctggtggccggtcgcctgcgcgtgcataccgaggtgaataataacgccctgacgctgcccgattattttaccggccgttttgaagataaaagccgggtgctgagaattatttcggcgctggttattctgctgttctttaccatctattgcgcttcaggaattgtcgcgggggcgcgtctgtttgaaagcaccttcggcatgagttatgaaaccgcactgtgggccggggcggcggcgacgattatctataccttcgtcggcggcttcctcgcggttagctggaccgataccgtgcaggccagcctgatgatttttgctctgatcctcaccccggtgatcgtgattatttccgtcggcggctttggcgattcgctggaagtgattaagcagaagagcatcgaaaatatcgacatgctgaaagggctgaacttcgtggcgattatctcgctgatgggctgggggctgggttatttcggtcagccgcatattctggcgcgctttatggcggcggattcgcaccacagtatcgttcacgcacgtcgcattagtatgacctggatgatcctgtgcctcggcggggcggtggccgtcggcttctttggcatcgcctacttcaataacaacccgagcctggcgggcgcggttaaccagaacgccgagcgcgtgtttatcgaactggcgcaaatcctgtttaacccgtggattgccgggatcctgctgtcggcgattctggcggcggtgatgtccaccctgagctgtcagctgctggtctgctcgagcgcaattaccgaagacctgtataaagccttcctgcgtaaaaacgccggtcagaaagagctggtgtgggtgggccgtatgatggtgctggtggttgccctggtggccattgccctagcggccaatccggaaaaccgcgtgctgggtctggtgagctacgcctgggctggcttcggcgccgcctttggcccggtggtcctgttctcggtaatgtggtcgcgcatgacccgtaacggcgcgctggccgggatggtgattggcgccctgaccgtgatcgtctggaagcagtttggctggctgggcctgtatgaaatcattccgggctttgtcttcggcagcatcgggattgtggtctttagcctgctggataaagcgccgtcggccagcatgcagcagcgctttgccgaagcggatgcccactaccatacgccgccgccggtacgcgccacggctgagtaa

SEQ ID NO: 371 - DNA, 378 bp, Klebsiella pneumoniae
gttatctctggcgggtggtgggtagagaacagcaagtcctgttgtcggatactgctgtttgccctgttaaaggatttaccacatgtcagagacaataaccttgtgttcccagcccctcgtggtggacaactatcagatatgtcgctgttggcagtcttaaagagaatgaaccattcaggattaactcaacatggtttccgttccacttttcgtgactgggatgatgtcacaaccgatcatcaacgtgaagtcattgaacatgcactggctcaccagttagcagataaagccgaagcagcatatcaacgtgggaccttatggcctaagcgggtggcgttgatggatgagtggtcggggtattgtcttgccatgttttag

SEQ ID NO: 372 - DNA, 207 bp, Klebsiella pneumoniae
gcacctcctgggaaacatgaatactccctatatgaggctcatgtttcgtttttcaagttacatgacgcgacaggcaaaccccttcagatacagcccttccgggtaggttgcgatcaccgggtggtcggcagcctgacggaactgttctataaattgtacatcacgcccggcatcaattgcggcatcggcgatgattttctgaaataa

SEQ ID NO: 373 - DNA, 2559 bp, Klebsiella pneumoniae
gcgaaacctggagctatcagctgcctgccaatgaataagataacaaagtacattgacgcattgccgctgtcggacgccgagaaatcggcgctgccggacaccagcctgcaggccgttcatcaggccctggatgacgaccatcagaccttcgcccgcgaagacgactccccgctggggtcggtcaaggcacggcttgcgcacagctggccggattcgctgtctggcgatcagctggtgaaggatgatgaaggccgtactcagctgcatgcgatgcctaaagccaagcgctcctcgatgatcccggacccgtggcgtaccaacccggtcggccgcttctgggaccgtctgcgcggacgcgatgtcacgccgcgctatctctcccgtctgacgcaagaagagcgcgagagtgagcaaaaatggcgtaccgtcggcaccattcgtcgctatatcctgctgctgctgacgctgtcgcagaccgtagtggccacctggtatatgaaaaccattctgccttatcagggctgggcgctgatcaacccggccgacatggtggggcagaacctgtggatctcgttcatgcagctgctgccgtacgtgttgcagagcggcattctgatcctcttcgcggtgctgttctgctgggtttccgccggcttctggaccgcgttaatgggcttcctgcagctattgatcggccgcgataagtacagtatttccgcctcgacggtcggtgacgaaccgttgaacccggcgcaccgtacggcgctgataatgccgatttgtaacgaagacgttgaccgcgttttcgccggcctgcgggcgacctgggagtcggtgaaagcgaccggtaacgccgctcatttcgacgtctatatcctcagcgatagctataaccccgatatctgtgtggctgagcaaaaggcgtggatggagctgattgccgaagtgcagggcgaagggcagatcttctaccgccgccgtcgtcgtcgagtgaagcgtaagagcggcaacatcgatgacttctgccgccgctggggcagccagtatagctatatggtggtgctggacgctgactcggtgatgaccggtgagtgtctgagcagcctggtgcgcctgatggaagcgaacccgaatgccgggatcatccagtcttccccgcgcgcctcgggcatggacacgctgtatgcgcgttgccagcagtttgccacccgggtgtacggtccgctgtttacggcgggtctgcacttctggcagttgggggagtcccactactggggccacaacgccattatccgcgtgaagccgttcattgagcactgcgcgctggcgccgctgccgggcgagggcaactttgccgggtcgatcctgtcgcacgacttcgtcgaagccgcgctgatgcgccgtgccggctggggggtgtggattgcctacgatctgccgggctcctatgaggagctgccgccgaacctgctggacgagctgaaacgcgaccgtcgctggtgtcagggcaacctgatgaacttccgcctgttccttgtcagagggatgcacccggttcaccgggcggtgttccttaccggcgtgatgtcctacctgtcggcgccgctgtggtttatgttccttgccctgtcgacggcgttgcaggtggtgcatgccctgaccgaaccgcagtacttcctgcagccgcgtcagctgttcccggtgtggccgcagtggcggtctgagctggccatcgcgctgttcgcctcgaccatggtgctgctgttcctgccgaagctgctgagtattattctggtgtggtgtaaagggccgaaagagtacggcggatttatccgcgtcacgctttcactgctgctggaggtcctgttctcggtcctgctggcgccggtccgtatgctgttccacaccgtcttcgtggtcagcgccttcctcggctgggaggtggtatggaattcgccgcagcgtgatgatgactccacgccgtggggggaagcctttatgcgccacggctcgcagctgctgctggggctggtgtgggcggtcgggatggcatggctggatctacgcttcctgttctggctggcgccgatcgtcgtctcgctgatcctctcgccgttcgtgtcggcgatttccagccgggcgacagtgggcctgcgcaccaagcgctggaagctgttcctgatcccggaagagtattcgccgccgcaggtgctcaaggataccgatgcgtacctgacgatgaaccgtcagcgttcgctggacgatggctttatgcacgcggtgtttaatccgtcgtttaacgccctcgccaccgcaatggccactgcgcgccaccgtcagggtcatatcctggagatcgcccgcgagcgccatgtcgagcaggcgctgaatgaaacgccggataagctgaaccgcgatcgccgactggtgctgttgagcgatccggtaaccatgtcgcgtctgcactatcgcgtatgggccgcgccggagaaatactcttcatgggtgaacgcctatcagcagttggcgcttaacccgctggcgctgaaaacgaaataa

SEQ ID NO: 374 - DNA, 2532 bp, Klebsiella pneumoniae
ggaaataatggattgctctggaggaaggcgatggctctggtcattgaatttacatgtgatttgcccaacggcgtgcatgcgcgtccggccagtctggtcgaaacgctgtgtaatcgtttttcatcagcgattgagtggcggaacttgcgccgcgggaccggcggaaatgccaaaagcgcgctggcgattatcggcagcaataccctgaagggcgacgcctgccagctgcttatcagcggcgaagatgaagctgaggcattcgccgcgataacggcctttatgcgcgatgagtttcctcactgtgacgcgccgctgcccgctgcgccaacgctggatgtccagccggtgccagagtcgctttcgcggctgaacccgacgctgtttcatgcccacccggtgtgcgccggcagcgcgggagggacgctggttcatctcaaatcacgcgatctgcacgagctgggcgaactgcccgtcgccgtcagtcccgaacaggagcaggcggcgctggataatggcctgcgcctgctggtgaaagatatcgagctgcggctgctggacaatgacggcaccgccagcgcgatcctggaagctcaccgttcgctggcgacggatgcctcgctgcgccagcacctgcttggtggcatcctcaccggcctcagttgcgcccaggcgattgtcgccaccggcgaccacttctgcgcccagttccgcgactccggcaacagctatctgcaggagcgggtactggatgtacgcgacgtttgcttccagctgttacagcatatctacggcgaagctcgtttcccggcgccgggccagctgcgggaagcggccatttgccttgccgacgagctgacccccagccagtttctggaactggataaaacgcatctcaaaggactgctgctgcgcagcggcggcaccacctcgcataccgtgattctggcacgctcattcaatatccctactctggtgggcgtggatttagccgcgctgctgccgtgggtggatacgcaggtgcagattgacggcaacgccgggctgttggtggtggatccgagtccggcggtagcgcgctactatcagcaggaggcctggctacaggcgcaaatccggcaacagcagcaggtatggctggataaagccgggcagacgcaagacggtatccgcgtggaaatcgccgccaatatcgcccattcggtggaagcggtggcggcattcaaccagggcgcgcagtcggtagggttgttccgcactgaaatgctgtatatggatcgcccgagcgcgccgtcggaagatgagctgtacaacatcttctgccaggcgctggaacccgctgccgggcgcagcattatcgtgcggactatggatatcggcggcgataagccagtggcctatctcagcatccctgcggaaaacaatccgttcctcggctaccgcgcggtgcgcatttatgaagagtatcaggcgctgtttcacactcagctacgggcgattttacgcgcctcggcacacggctcgctgaagattatgatccccatgatttcatcaatggaagagatcctgtgggtgaaagagcgactggcggaggccaaacagtcgctgcgcgtcgagcagatcccgtttgatgaaaagatcccgctcggcatcatgctggaagtgccgtcggtgatgtttatcatcgatcagtgctgtgaagaggtggatttctttagcatcggcagcaacgacttaacgcagtatctgctggcggtggatcgcgataacgcgaaagtgacgcgccactacaacagcctgaatccggccttcctgcgcgcgctggactatgccgtgcaggcggtgcatcggcaggggaaatggattggtctgtgcggcgaactgggggccaaaggatcggtgctaccgctgctggtaggcctcggtttagatgaattgagcatgagcgcaccggcgatcccggcaaccaaatcgcgcctggcccagctggacagccgcgcctgccgccaactgctgaatcaggccatgcagtgccgtacctcactggaagtggagcatctgctggcccagttccgcatgcgtcagcaggatgtcccgctggtgagcgccgagtgcattacgctgaatagcgactggcgcagtaaggaggaggtgctgaaagggatgacggataatctgctattggccggccgctgtcgctatccgcgtaagctggaggccgacctgtgggctcgcgaggcggtgttctccactggtctgggctttagcttcgccattccgcacagtaaatccgagcatattgagcagtcgactatcagcgtcgcgcggctggcgcagccggtgatatggggcgatgaagaggcgcagtttgtgattatgctgacgctgaataagcactcggcgggcgatcagcatatgcgtatcttctcgcggctggcgcggcgcattatgcacgcggagttccgtcaatctctggtatccgcggagagcagcgaggctatcgcgacgttgctccagcgtgagctggagctttaa

SEQ ID NO: 375 - DNA, 615 bp, Klebsiella pneumoniae
tgggtagcaggagggagcagggtgtcagaaggaaaagtccagcagaaacagcaggcgcgccgcgcggagatcgttgtcgccgcgcaaaaatgtttcgctgaaaaggggctgcacggcgcttccgtcgccgatatcgcccgggaagcgggcctgagcgtcggtcagctatatcgcatttttgccagcaaggaagcgatcatcgaagcgattgttagcgaaatcgtcaacgccagagtcggggagatgatcgatgagaaccacaatctggcgcgtaaagcggcggttttggctggcaggatcccgacgtcggcagccaccaaaagcgataattatctgctgatggagatcaatgccgaggcctcgcgtaatccccgcttgcgtgagatcctgatgcaggccgatcggcggttgaaagaggagggcggtcgcctgtcgcagcgctaccatcccgggctcagcgatgcgcgacgcaatgccgcatcagagctcatcgccgttctgacagagggggcagcttaccgctgtgagctgagcgcctccaccccggtcgataaggcagatttagaagccctgtacaatatgattttcgaccggctttttgacgagcaggcataa

SEQ ID NO: 376 - DNA, 252 bp, Klebsiella pneumoniae
tcaataaaagggcaatgtatgaaaatagaatttaatacgacagagcagtttatcagtgaagcagcggattcgtataaccgttatatgaataaacgactacggaaccagcctgtgcatttctaccacctactgaaaaataagggggatatgaacgaagtgattgaaaatattatcgataaaacaaagagccgcttttatggggctgaaggtgaacaaaaaagtaacggatctccgggagcgttaactatgtga

SEQ ID NO: 377 - DNA, 618 bp, Klebsiella pneumoniae
tgcaaccgaggagtgatggaaatggctaaaattctggtgctttattattccatgtatggacacattgaaaccatggctcacgccgtcgccgatggggcgaaccgggtggacggcgttgaggtggttgtgaagcgcgtgccggaaaccatgcaggctgaagcattcgccaaagcaggcgggaaaacgcaaaacgcgcccgtcgccacgccgcaggagctggcagagtatgacgccatcatctttggtaccccgacgcgcttcggcaacatgtccggtcagatgcgtactttcctcgatcaaaccggcggtctgtgggcgtccggcgctctgtatggcaaaatcgccagcgtatttagctcaaccggtaccggcggcggccaggaacaaaccattacctcgacctggacgacgctggcccaccacggcatgatcatcgtcccgatcggctatggcgcccaggagctattcgatatctcccaggtacgcggcggtaccccttatggcgcaaccaccatcgccggcggcgacggctcgcggcagccgagcgaggaagagttagccatcgcacgctatcagggtgaacatgtcgccaaactggccgttaaactgcacggctaa

SEQ ID NO: 378 - DNA, 237 bp, Klebsiella pneumoniae
aataagagaggacaaacaatgaaagaaaatactgaaaacaacgtaaagcgatttatccgtgttccagatgttctaaaccgagtggggttcagtcgcactaccttatatgagcgtattaaggaagggaactttcctgacagggtaaaaataggaccaaggtgtgtcgcttttgttgaaagtgagatagatgaatggattgaagctactattcgaaactcacgtcagaacgcagcataa

SEQ ID NO: 379 - DNA, 327 bp, Klebsiella pneumoniae
gacctgccgggatttagttgcaaatttttcaacatgttatacactacgaaaaccatcgcgaaagcgagttttgataggaaatttaagagtatgagcactatcgaagaacgcgttaagaaaattatcggcgagcagctgggcgttaagcaggaagaagttaccaacaatgcttccttcgttgaagacctgggcgctgattctcttgacaccgttgagctggtaatggctctggaagaagagtttgatactgagattccggacgaagaagctgagaaaatcaccaccgttcaggctgccattgattacatcaacggccaccaggcgtaa

SEQ ID NO: 380 - DNA, 1182 bp, Klebsiella pneumoniae
atattcgcgggtgccagcgtgatgaagcttagtgaggactccccgggcaactggggaatcaccgaaccgggcagcgacgataccttgacacgtctaaccctggcgttagatgtcatggggggcgatttcggcccatccgtgacggtgcctgcagcactgcaggcactgaactctaattcgcaactcacacttcttttagtcggcgatcccgacgccatcacgccattactcgccaaagctgacttcgaacaacgttcgcgtctgcagattattcctgcgcagtcagttattgccagtgatgcgcgacccgcgcaggctatccgcagcagtcgcggaagctcaatgcgcgtggcgctggagcttgtgaaagaagggcgggcgcaagcctgcgtcagcgctggcaacaccggcgcgctgatgggtctggcgaaactgctgctcaaaccgatcgaaggtattgagcggccggcgctggtgacggttttaccgcaccagcagaagggcaaaaccgtggtgctggatctcggcgccaacgtcgattgcgacagcacgatgctggtgcagttcgcggtaatgggcgcggtgctggcggaagaagtggtcggcattgccaacccccgcgtcgctttgttgaatatcggcgaagaagagatgaaaggcctcggcagcatccgcgatgctgccgcagtgctcaaaacgctgccttccctcaactacatcggctatcttgaagccaatgaactgttgaccggaaaaaccgatgtgctggtttgtgatggattcacgggcaacgtcacattaaaaaccatggaaggtgttgtcagaatgttcctttcactgctgaaatctcagggagagggcaaaaaacggtcgtggtggctgctgttactaaaacgttggttacaaaaaagcctggcgaggcgattcagtcacctcaaccccgaccagtataatggcgcctgtctgttaggattgcgcggttccgtgatcaagagtcatggtgctgccaatcaacgcgcctttagcgtcgcgatagagcaggcagtgcaggcggtgcagcggcagatccctcagcggatcgccgcgcgcctggaatctttatacccagctggtttcgagctgccggaaagcgacagtgacgtgaacgcccgacagcaaagcgggacgaatggccacgattga

SEQ ID NO: 381 - DNA, 1029 bp, Klebsiella pneumoniae
atgcgatggggctatttttccctgaacgcggctggcgcggtagctgggctggtggtaaaacggttatacgtagcacgtataggcaaaaggaaaatgaaaagacaagagcgtatagaccgcattgagctgatgcgcacctatatccgcatcgtagaggccggatcgctctccgccgccgcagggcagatggacactacccaggcgaccgtcagccgccgcctgcagtcccttgaagggctgctgggggttaagctgatcctgcgcaccacccatgcgatgaagctcactgacgatggcgaacgctgttatcgtcacgcccgtcaggtggtggacgcctggctggcgctggaggatgacctgcgtattgccgacgatcggccggtgggcgttctgcgagtgcgggcgccccacgcgtttggccagcagcaactgctggcgccgctggtagcatttctacagcgccatccgcagctgtcggtggagtggatgttaaacgataataccgtcgacttcctcagcgataatatcgactgcgctattcgcgtgggggcggaggtggatccagcaacggtatccgtactgctggcggaagtgccgcgctgcgtagtggcttctcctgagctgctggcgaagtatccgccgttaacctcgctggaggcgttatcgggcctgccatggatcgccattaataccttttatcagcatgaggtacggctcaggcatcaggcaagcgggcagattgtctctacagcgattactccctgtctgagcactgacagtctttacgtcgcgcgcaacaccgcgctggcggggctgggggtggcgatggtgtccagctggacggtcgtggaggatattgccgccggacggctgattgagctgttcccgcagtggcgacccgcctcgctgccggttcatctggtttatccctgggcgcgctattacccgacacgcctgcgtaagttcctcgacctgatgcgggagatcatgccggatctcgccgggatgcagcgtccgcaaagcgcataa

SEQ ID NO: 382 - DNA, 423 bp, Klebsiella pneumoniae
cgggaccggggagaacgccggtccgctgcccgccgactacagcctggcgacgatggccggggagctgttcagcgctctgcaggcggcggggatcgcccgcttcgcgctggtgggccacgccctgggggcgctgattggcctgcagctggcgctcgatcgccccgaggcggtgagcgccctggcgctggtcaacggctggctgtcgctgtcgccgcatacccgccgctgcttccaggtgcgcgagcgtctgctgcatgccggcggcgcgcaggcgtgggtcgaagcgcagccgctatttctctacccggcggaatggatggccgcgcgcctgccgcgcctcgaagcggaagatgcgcttgccatcagccattttcagggcaaagagaatctgctgaagcggctgcaggccctgaagcaggctga

SEQ ID NO: 383 - DNA, 282 bp, Klebsiella pneumoniae
aagcctattattaatcgtcatactgtgagcaaggcccgggctagcccgggctttgttgtttttgggcatcctcccggcggcgctgcgcttagccgggctacctggcgggtagggtctggtagcccgggagaggcattgctgccgaccccggggatgtctgcggtgccacatgcgaaaaaaaagcccgtacatgcgtacgagctcttcttaaaatatggcggtgaggggggattgactcgcttcccggcggtactgcgcgtggccggactacctggcgggtag

SEQ ID NO: 384 - DNA, 522 bp, Klebsiella pneumoniae
atcgcattcttccggcgcgtatctgctaggatacgcgccatgaacatactcttcgcaatcgcattaacgacaggcatcctctccgggatttgggggtgggtggcggtcgctctcggcctgctgagctgggccggattcctcggctgtacggcctatttcgcctgcccgcagggcggcttgaaagggctggccatctcgtcctgcacggtgatgagcggcgtggcctgggcgttagtgattatccacggtagcgcgctggcgccacaggtgcagatcctcagctatatgatgaccggtgtggtcgccttcctgatgtgcattcaggcgcgacggacgctactgtcgtttgtcccgggcacctttatcggcgcctgcgcgaccttcgcggcagacggcgactggcgtctggtgatcccttccctggcgctgggtctggtctttggctatgccatgaaaaatagtggcctgtggctggcggcccgtgcggataagcataaatcgttcgccaacgacaacgcctga

SEQ ID NO: 385 - DNA, 1074 bp, Klebsiella pneumoniae
ccgcggttctttatatgcagtcgaaaaaaatggcagggttgtaacatgctggaattgtcttctatttcgaaatccttcgctgatgcgctggtcctcgataatctcaatctgaccgtagcgccggggagccggacggccattgttggtccgtccggctcggggaagaccacgttgctgcgcattctcgccggttttgaaacgcccgatcgcgggcggatcgtcatgcacggtaagtctctgtttgccgacggtgtgtttgtccccgcccaccagcgacggatcggctatgttccgcaggaaggggcgctgtttcctcatcttaatgttgcggacaatatcgcctgggggctcgacgccagccgtgaggagaagcgtcgccgcgtgggggcgctaatggagatggtcgccctcgacgctggcctggcgagccactggccacatgaaatttccggtggtcagcagcagcgcgttgccctggcccgtgcgctggctcagcagccggcgctgatgctgctggatgagccgttttctgcactggataccgggctgcgcgccagcacacgcaaagcgacggcggatctgctggccgagacggggatcgcctcgattctggtgactcatgaccagaacgaggcgctgtcgttcgctacgcaggtggcggtaatgcgtcaggggcgcttcgcccaggttggaaccccgcggacggtttactcgcagccggtggatgaagagacggcgttatttcttggcgatgccctgatcctccccgcacgccttagccccggccgggcaagctgcgcgctgggggacctggcgacggacgcactgcatcctgctggcgaaggtagggtgatgctgcgtccggaacagctgagcgtcagtgtgagcgggccgcaggaaagtaccgccattatccgcgatgtcgatttctcaggccagctttccacgttgacgctgtcgatggctgggcacgagcggccgattgtcctgcgaaccgtgagccagccggcgtggcagcccggcgcgatggtgagactgacggtcagcggcaaggcgcgagtgtttagcggctaa

SEQ ID NO: 386 - DNA, 930 bp, Klebsiella pneumoniae
gacaccgctatgcctgaactccatactcctgctaatcgccccggcccggtcgctgtggcccgggtgacgctcctgcctgcgctgctggttatcgtcgctgttgctgtcggctgcgccctggtgtcgcctccggtcggtacacgacacgagatcctgactaaccccggcctctatatcgatctgctggcgttgttgtttctggtgtttatgctgtggagctcggcgaaggtgcggatgagccacattgccgtcaactgggtacgctatgggctgctgttgtggattgccggcggcacctttgacgtgatggatgagatcgtggttcagccgcgctggatgggctattactgcgaagatctgctgcgcctctccgggatgctgctgaccgtggtgggggtctacaaaattattgagcgaatcaatttgctgtacgtcgatgcgcgctcgcaatccctgaaggatgaactgacccagttacccaaccggcgttttttcattgataccattcgcgagaagtccgggcatgcgctgggactcatgattctggatatcgatttttttaagaaaatcaatgatagctggggccacctggtgggggatgaagtgttattttcgctggggaaacagctggcgaaactaaccagcgagcaggtccagccggcgcggatcggtggggaagagttcgccattatcgtcgatggcctgtcggagcccgagctgcacgctctggcgcagtcgatccttgctaacgcccgcaccatcctgatcaatcatcagacgccgctgtcgatcagcattggcgtcggaacctggcggccaggtgaagcgcaggagacgtttatccgtaaagtcgacgaggcgctgtacaaggccaagcataacggccgcggccgcgtggagtgggcgccatctgccggtgcggcaggttag

SEQ ID NO: 387 - DNA, 585 bp, Klebsiella pneumoniae
acatcggctatggcgaccccggcaagctgtacggccgcctgccgcgcctgtcctttgatgaagcctgcctgctggcataaggagtttacgatggagttaacggacaaaacgagtttccgtgacgccatggcccacgtcggcgccgcggttaacattattaccaccgatggcccggcgggccgggcggggttcaccgccagcgcggtctgcagcgttaccgacacgccgccgaccctgctggtctgcctgaaccgctcggcctcggtgtggccggtgttcagcgaacaccacacgctgtgcgtcaataccctggcggccggacaggaggccctgtcgacgctgtttggcggtaaaacggcaatggacgagcgttttgccgccgccgactggcagaccggcgccaccggctgtccgcggctggaggcggctctggtcagctttgactgccgcatcgaccagcgcgtcagcgtcgggacgcacgacattctgttttgtcacgtcgtggccattacccgtcacccggagccccggggactgatgtggtttgaccgcggctatcacacgcttatgcgacccgcttgttaa

SEQ ID NO: 388 - DNA, 336 bp, Klebsiella pneumoniae
tggaacgatattattgaaaccaacctgtcatcggatttgcgtctgtcaaaagcggtaatgcgcgctatgatgaaaaagcgtcatggacgtattatcactatcgggtctgtggttggtaccatgggaaatgcgggtcaggccaactacgccgcggcgaaagcgggtctgatcggcttcattaaatcactggcgcgtgaagttgcgtcccgcggtattactgtaaacgatgttgctccgggctttattgattcggacatgacgcgtgcgctgaccgatgagcagcgtgcgggtacgctgacggcaagtcctgcgggagcgccttggcaccccacatga

SEQ ID NO: 389 - DNA, 231 bp, Klebsiella pneumoniae
gagtcagtcatgtataagaaaaccctcagcctgctgggcgtagcgttggcgctgtctgccttcgccagtcaggctgaaagtgaacgtcaggcgagccgcgagcggatcgtggagcaggtcctcaagccgtgtgaaggcaaaaaggcgggcgataaggtggtgattaccgatcgccgcggcggcgagcacgaggcgatctgtaccctgacggcggttccgctaccggagtag

SEQ ID NO: 390 - DNA, 246 bp, Klebsiella pneumoniae
aaaacacccatccgccagcggcgatgggcgttgattttctgtgcaaactgcctgaaattcagacgaataacacaaaattgtttgtttttaaggcagttgatcaaaatgatgctttacagcatccgccgaggtgtttatagtgcgcctcacaccggaagtgtggccgagcggttgaaggcaccggtcttgaaaaccggcgacccgaaagggttccagagttcgaatctctgcgcttccgccatataa

SEQ ID NO: 391 - DNA, 1242 bp, Klebsiella pneumoniae
ccccatcgcatctatgaggcattgaacatgacaccgacttccctttccacccgcgacgcaggctggattatcttcattctcgcactcggcgccggctttagcgtcgcctctatttactacgcgcagccgctgctgccgttgatgggcgccaatctccacctgactgtagaaggtatgggtctggtccctaccctgacgcaggcgggttatgcgctcggcattctgttcctgctcccgctcggcgaccgccacgatcgccgccggctgatcctggtgaaaagcgcgctgctggcgctcctgctgctcctgtgcagcctcaccggccagctcagctcactgctggtggtcagtctgctgatcggtatggcggcgaccatggcgcaggatatcgtcccggcggcggcgatcctcgccccggcgggcaagcagggaaaaatggtgggcacggtgatgaccgggctgctgctggggatcctgctctcccggacggtcagcggcgtggtgggcgccgtattcggctggcgggtgatgtatcaggcggcggcggtcagcgtcgcgctgattggcctgttaatgtggcgcgtcctgccgcgcttcgctgtgcactcgacgctgagctatccgcagctgatggcctcgatggcgcatctgtggcagcgttacccggcattacgccgcgccgcgctagctcagggcgcgctctccatcgcctttagcgccttctggtcgacgctggcggtgatgctctccgaacactatcacatgggcagcgcagtagcgggcggtttcggtatcgccggggccgccggggcgctggccgcgccgcttgccggcggtctggccgataaatttggcgccggtaaggtgacacagatgggtgcggcgctggtcaccctctcctttgccctgatgtttatgctgccgctgctgccagtgcacgctcagttggcgctgattgccctgtcggcgattggctttgaccttggcctgcagtcaagcctggtggcgcatcagaacctggtatatggccttgagccacaggcccgcggccgcctcaacgccctgctgttcaccgtggtgtttatcgggatgtcgctggggtcggtgctgggcagtaagctgtacgtgctggccggctggaacggagtggtcacgctggcagtgatcactggcgcgctagccctggcgatccgcctgctggagaatgcccgcatcctcgctgccgaacgcagcgcatcataa

SEQ ID NO: 392 - DNA, 1170 bp, Klebsiella pneumoniae
atgcactttttctctactgttttatgcgacgccctttttctaatgttgagccatccatactgtcacgggccctacagcgctcaggagcaagcaatgaacgaactggtgcaaatactaaaaaatacccgccagcatctgatgaccggcgtgtcacatatgatccccttcgtggtctccggcgggatcctgctggcggtgtccgtcatgttgtatggcaaaggcgcggtacccgatgctgcctccgaccccaacctgaagaaactctttgatatcggcgtcgccgggctgacgttgatggtgccctttctcgccgcctacatcggctactccatttctgaccgcgccgcgctggccccctgcgccatcggcgcctgggtgggcaacagttttggcgccgggttcttcggcgcgctgatcgccggcatgattggcggcctggtggtctattacctgaaaaaaatccccgtacataaagttctgcgctcggtgatgccgattttcatcattcccatcgtcggcacctttatcaccgccgggatcatgatgtgggggcttggcgagccggttggcgcgctgaccgctaacctgaccggctggctgcaggggatgcgcgagggcagcatcgtggtgctggccatcattatgggtctgatgctggcctttgatatgggcggcccggtgaacaaagttgcctacgccttcatgctgatttgcgtttcgcagggcgtctacagcgtggtggctatcgccgccgtcggtatcgccgtaccgccgctgggcatggggctggcgacgctgattggccgcaaatatttcaccgccgaagagcgggaaaccggcaaagccgcgctggtgatgggctgtgtcggcgtgaccgaaggggcgattccctttgccgccgcggatccgctgcgcgtcattccggccaatatgattggcgccgccagcggctgcgtcaccgccgcgctgatgggcgcccagtgttacgccggctggggcgggcttatcgtgctgccggtggtccagggcaagctcgggtttgttgccgcgctgctggtcggcgcctgcgtcagcgctgcctgcgtcatcctgctgaaagccttcgccaaaaagaaacccactaacgtcgccactgacgatgaactagaccttgatttcgaaattaactaa

SEQ ID NO: 393 - DNA, 288 bp, Klebsiella pneumoniae
aagctaaaaatggcaatgaaaacatactctatacaaggagccaaaatgattgatgaatttcatgtgatgtatatgtataaaaaaatccaagcagaagctgcaaccaccgacattaaaacacttgaacagcttttgaaaaagttcaggagggtggtcaatgaacgtcgtgaagaatactatcaggaaataggtgagaaaaaagcgcgtaagttgaaaatgaaaagagcacaaagattgcttgagaaaatggtgtgcgaccgagtttcgccagaagatttaagggcgtga

SEQ ID NO: 394 - DNA, 1287 bp, Klebsiella pneumoniae
caaaacagaatgtcgtgcgtcccgacgctgacgcgctggtcgatgcggcagtcaaagctgaccagagccgcctccagccgcggacagccggtggcgccggtctgccagtcggcggcggcaaaacgctcgtccattgccgttttaccgccaaacagcgtcgacagggcctcctgtccggccgccagggtattgacgcacagcgtgtggtgttcgctgaacaccggccacaccgaggccgagcggttcaggcagaccagcagggtcggcggcgtgtcggtaacgctgcagaccgcgctggcggtgaaccccgcccggcccgccgggccatcggtggtaataatgttaaccgcggcgccgacgtgggccatggcgtcacggaaactcgttttgtccgttaactccatcgtaaactccttatgccagcaggcaggcttcatcaaaggacaggcgcggcaggcggccgtacagcttgccggggtcgccatagccgatgttcaccagcaggttgcttttccagccgttgtcggcaaaaaatgccgcgtcgactttttcccggtcaaaaccagacattggcccggtgtcgaggcccagcgcccggcaggcaaaaatcagatacgccgcctgcagggagctgttgcgaaacgcggtctcttccgccagctgcgggctggaggtaaaccagctgcgggcgtcaccgtggggaaacagggtcggcagccggtcgtagaaggcgctatcccacgccacgatggcggtcaccggcgcctgcatggttttctgcagattgccgctggagagcgtcgggcgaagtttctctttgccttccgcgctgcgcacgaacacgatgcgcgctggcgaacagttggcggaagtcggccccattttcatcaggtcccagacggcctgcagctgcgcatcgctcaccggcttatccagccagccgttgtgggtccgggcctgggtaaacagcgtctcgcaggccgtgtggtttatcgcgtcgttcatcgggtctccctggcgaccggcagcatagcggacagcccgtcgcgtaaaatggtattaaaggtatcggcgtcggtgacgttacaggcatggccgccccacggcatttccacgagctggctgccggggatcgccgtctgcagcacgcgggagcaggaggcggggaccagcaggtcgtcagcggcgctgataatcagcgtcgggcaggcgatggccgacgcacggcgtgaaaaatcagcctgcttcagggcctgcagccgcttcagcagattctctttgccctga

SEQ ID NO: 395 - DNA, 843 bp, Klebsiella pneumoniae
gggcaaagaatgattgaagatctgccggatatactgcatcggttaatcggtcaaaaagatcacctacaggtgagatttcctgagccggatatctccgtgcctgccctcgccttcaacgtgccgtttccgcgtctggaaattgtgctggagggccaactgaatgaacagggactgccgctggccgcctcgacgttaaccacgctgcaggtactgtacgtgcaggcggggaagtggacgctgccgcagtggaccggcccggccactaccctgagcattctgtttggtcggcagaaactgggattcagtattcagcgctgggacggaaaaagcctgcacacggaaaaacagagcgtttcccggcttgggccgcgcgtgggttcctacctgttgctgagcctgaatgaagtcagcctgcagcccgatccgctgaccgcgcgactggtgatcgccgcgctgctgagtcattgtcgtgaacagctggtcgggctggagatgcgcgtcagccgcagccgggatctgtttctcgccgtccaggactaccttgaggaaaatctcagtctaccgctgacgcgggaatcggtagccaaacgttttcacatcacgcccaactatctttcgcatatttttcagaaatcaggctcggtgggatttaatgaatatctgacccgtgtccgtctggaaaaggcgaagcagctattgcgcggctatgacctgaaggtgaaagagattgcgcataattgcggctttgtcgacagcaactatttttgtcgggtttttaaacgctacacagaacgctcgccatcggagtatcggcgacactgccgtagcgcgcagcaggcctaa

SEQ ID NO: 396 - DNA, 720 bp, Klebsiella pneumoniae
ggtggcctgatgattacccttcccgctcgcccggaatccctgaccttcgcgccgcagcagagcgcgctgattgtggtcgatatgcagaacgcctacgccagccagggcggttatctggatctcgccggctttgacgtctccgctacccggccggttatcgacaatattaataccgccgtcgccgccgctcgcgccgcgggtatgttgattatctggttccagaatggctgggatgatcagtatgttgaagccggcggcccgggctcgccgaactatcacaaatccaacgcgctgaaaacgatgcgtcagcgtccggagctgcagggcaagctgctggcgaaaggcggctgggattatcagctggtggacgagctgacgccgcaggaaggcgatatcgtgttgccgaaaccgcgctacagcggcttctttaacaccccgctcgacagcattttgcgcagccgcggcatacgccacctggtgttcaccgggatcgccaccaacgtctgcgtcgaatcgacgctgcgcgatggcttctttctcgaatacttcggcatcgtgctggaggatgccacccatcaggccggcccggccttcgcccagcaggcggcgctgttcaatattgaaacctttttcggctgggtcagcgacgtcgagagcttctgccacacgctgtcccccgccaccccgctggctttagccaaggagaaacgttatgcctaa

SEQ ID NO: 397 - DNA, 264 bp, Klebsiella pneumoniae
ggggttatgatggaaaaaaataatgaagtcattcagacccatcccctcgttggatgggacatcagcaccgttgatagctacgatgcgctgatgttgcgcctgcactaccagaaccccactcaagaaaacagtaatgatgctgagatcggccagacgctatggctaacgacggacgtcgcacgtcagtttatttcaatcctggaagcaggcattgcgaaaattgaatctggcgaataccaggaaaacgagtaccgccgacattaa

SEQ ID NO: 398 - DNA, 1497 bp, Klebsiella pneumoniae
ggagtcatgatgaattttcagcacctggcttactggcaggaaaaagcgaaaaacctggccattgaaacacgcttatttattaacggcgaatattgcgccgcggccgataataccacctttgagactatcgaccctgccgcgcagcagacattagcccaggtcgcccgcggtaaaaaagccgacgtcgaacgggcggtgaaagccgcgcgccaggcttttgataacggcgactggtcgcaggcctcccccgcacagcgtaaagcgatcctcactcgctttgctgatctgatggaggcccatcgtgaagagctggcgctgctggaaacgctggataccggcaaaccgattcgccacagcctgcgcgacgatattcccggcgccgcccgcgccattcgctggtatgccgaagcgctggataaagtctatggcgaagtggcccccaccggcagcaacgagctggcgatgatcgttcgcgaaccaattggcgtgatcgccgcggtggtgccgtggaacttcccgctgctgctggcctgctggaaactcggcccggcgctggcggcgggcaatagcgtaatcctcaaaccctcggaaaaatcgccgctcaccgccctgcgtctggccgggctggcgaaagaggccggcctgccggacggcgtgttgaacgtggtcagcggctttggccacgaggccgggcaggagctggccctgcatcctgatgttgaagtcatcaccttcaccggctccacccgcaccggcaagcagctgctgaaagacgccggcgacagcaatatgaagcgcgtgtggctggaagcgggcggcaagagcgccaacattgtcttcgccgattgcccggatctgcaacaagcggttcgcgccaccgccggcggcatcttctacaaccagggacaggtgtgcatcgccgggacccgtctgctgctcgaggagagcatcgctgacgagttcctggcgcggctgaaagctgaggcgcaacactggcagccgggcaacccgctcgatccggacaccaccatgggcatgctgattgacaatacccatgccgacaacgtgcatagctttattcgcggcggcgaaagccaaagcaccctgttcctcgacggacgaaaaaacccgtggcctgccgccgttggcccgaccattttcgttgacgtcgacccggcatcaaccctcagccgggaagagatcttcggcccggtgctggtggtgacccgcttcaaaagcgaagaagaggcgctaaagctcgccaatgacagcgactacggcttgggcgccgcggtgtggacccgcgatctctcccgcgcccaccgcatgagccgccgcctgaaggccggctcggtcttcgtcaacaactataacgatggtgatatgaccgttccgttcggcggctacaagcagagcggcaacgggcgcgataaatcgctgcacgcactggaaaaattcaccgaactgaaaaccatctggattgccctggagtcttga

SEQ ID NO: 399 - DNA, 615 bp, Klebsiella pneumoniae
caggtcatgatgctttgtgtcaggatgaaggaaggtatgagcttgaggaaccccatgaaaaagatattgatcgccgccgcgctaattgtcagcggcctgctgagcggctgtaatcagctgacccaatacacggtaagcgagcaggagattaaccaggccctgcagaagcgaaaccatttcgccaaagatattggtctgaaaggcgttgccgacgcccatatcgaactgcagaacctgaccagcgctatcgggcgcgaggagccgggcaaagtcaccctgagcgggatcgccaacgtcgatcttaactccctgttcggcacgcagaaagcgacgatcgatctgaagctcaaagcgctgccaacctttgaccgagagaaaggcgccatcttcctgcaggaaatggaagtggtcgatgccaaagtggcgccggagaagctgcagtcggttattcaggccctgctcccctacctgaatcagtctctgcgcagctacttcagccagcagccggcttatgtcctgcgtgaggacgccagcaccggcgaagcgctggcgaagaaatacgccaaaggtatagaggtgaagccaggcgagattgtcatcccctttaccaattaa

SEQ ID NO: 400 - DNA, 201 bp, Klebsiella pneumoniae
tggtcaacgatatcgatggtttcaccgctgcgggctttaccttccatgcgggcgacgccgccggagaatatccacggatggcgacgcagcagggatttctcgcgtcctttggctaacactaagcgggggaatagggaatctgtcatggggctacctttaagcaacgggaatgtcggcaccgaaaaatggcgcgtagattag

SEQ ID NO: 401 - DNA, 708 bp, Klebsiella pneumoniae
cgccggacgatagttaagcgccggagaaggctggttggaaccgaacaggaacatgctggtcagcggcgccacgcccagttttcccactttgtcacgcaggtaaactttggactggacatctaccacggtgtcgcgtcccggcatgatgacaaagcgataagcgccggttgcccgcggggagtccagcagcgcatagatagtcagacgtttgtcggtggctttaggacgctcgatccagaactcgcgaaaacgcgggaactcttcgccggacggcagcgcggtatcgatagccaggccgcgcgcggacaggccgtaaacctgaccctgacccagcacgcggaagtagctggcaccgagcatgctgacgatctcatcgttcttatctttgctattgatcggatacagtactttgaagccggcgaaaccgaggtctttcaccgtgtctttatcgtgctgaacgttaccaaagttaaaatagtccgggctatatttaattttgcgcacgctggtggccgtcacttcattgatggtgaccggcgtgtcgaagtacataccctgatggtaaaattcaagcttgaatggggttttctggttattccagtaagctttatcgtgattaaactgaatttgctggtaatccgcgtatttcatgtcgcggaaagcggagggcaggttactcttcggcgcttcatagcctttcccggctaa

SEQ ID NO: 402 - DNA, 186 bp, Klebsiella pneumoniae
acgcgctttttttgcaaaaagttgattgacgggcgatacgtatttccctacattagcgcccgttcccgacaacaacgggaaagacaatatggtgaggtgtccgagtggctgaaggagcacgcctggaaagtgtgtatacggcaacgtatcgggggttcgaatccccccctcaccgccatattttaa

SEQ ID NO: 403 - DNA, 1218 bp, Klebsiella pneumoniae
atggcggccttattgacttgcgaaaagaacaacatgactgcattttttcatttcctgctggcgctggcggtgatcctcgccctggcctggcttgtcagctacgacagacaaaaaattcgtattcgttatattctccagttgattattatcgaaatagcgctcgctttctttttcctgcacgccgaaagcggcctgtggctggtaagaaatatttccggcttttttgcttcgctgttaggctttgccgccgaagggaccaatttcgtctttggcggcatgagcgaaaaaggcttagcctttattttcctgggcgtcctgtgtccgattgtgtttatttccgcgctgattggtattctccagcactggcggatcctgccgatttttattcgcgtgattggcaccctgctgtcgaaagtaaacggcatgggtaagctggaatctttcaacgcggtcagctcgctgatcctcggccagtcggagaacttcattgcctacaagggcgtactgggcgacctctcctcacggcgactgttcactatggcggcgacggccatgtcgaccgtatcgctgtcgattgtcggcgcctatatgaccatgctggacgccaaatatgtcgtcacagcgctgatcctcaatatgttcagcacctttatcgtgctgtcggtaattaacccgacgcggccgggcagcgagcaggaaataaaactcgagaagctgcatgaatcgcagagtttctttgaaatgctcggggaatatattctggccggctttaaagtggcgatgattattctggcgatgctgatcggttttatcgccctgatcagcgccattaacgcgctattccccaccctgtttggtctcagcttccagcagatcctcggctacgtcttttatccgctggcgtggcttatcggcatcccgctgagcgatgcgctaaacgccggcagcatcatggccaccaaactggtcgctaacgaatttgtggcgatgattgagctgcaaaagattgccgccagcatgacccctcgcgggctcggcattctctcggtattcctggtgtcgtttgccaactttgcctcgatcggcattatcgccggggcgatcaaaggcctgaatgaaccgcagggcaatatcgtctcccgcttcggcctgcggctggtgtatagcgccacgctggtaagcctgctttccgccagcttcgccgggctggtgctgtaa

SEQ ID NO: 404 - DNA, 666 bp, Klebsiella pneumoniae
cgctataagatcctcagaggtgaaatctttttcagtggtgataccgctactcttggacatgagcttgccagaacctatacagtaaaccctacgactcgaagccatgcgcaattttacgcgaaaacgctggcattaaccgaagccacccccgaaatttcgtcgttaagccagtccgaattcctgtcagagtatctgaaagagacaccactgaaaaaccttgcccgtatcactgttgatattcatctggaagaggcatcaaccgaagacatcattgaacatctgaaggtgctgatcccgcaatggaagagacggcttaagatgaaggctccagcggatcgagagtatcgtttcggtaaaagcacgttcagaaaagttattgaatatcgccttattccgatgatggatctgattttttggggtgctgataataatgataccaagatcccactttccctgatgtcttcactgcttcatgaggacagtgataatgatcgtgatgaaggaatgctcaaggcaacggattacccactggcaatggcgttcctgacagatgaaagctatctgaagtcgcttgaagattacatcatgcaaaacaatcacttaaaagatacacctgttgataagcatgttgaggatgataagaagaagaaaaaagcagccaagtaa

SEQ ID NO: 405 - DNA, 1536 bp, Klebsiella pneumoniae
atgaaagagataaagcggcgaaatgcatggattgccttttctctggcactggtggtatttcttgctggcgtgtttgtcattaactggcaattgtggcattcagaccaggccacccatgtcgccgccgcccgtcaggcggcgaaaaagatcgcagccattctggatgaggctcgtgaagcgacggccacggcgctgaacgttagccgcagtggttgctccggccagggtcaatttcagctcggaacggaagccgccctgcagccgcacctgcgtaccattctgctgataaaagatggccaggtgtggtgctcgtccctgcccggcaatcgggtcctgacgctcagccctgagtctttgcctgacgaacctctgctgctgctcccggccagaatgatggtcaataaacggccggtactgatctatcaggcgcgcgtagcggcgatccgggtgattgtcactatcagcgacatccatctgcgtgatgcactatatagcgataccgataacaacgggctggcactctgggtgcagaaccaaatgattgccagatatggcgatgttaagccgctggctgctgacccacaccagggcgtctttacctcacctgcctatccatttcgcattacctaccctgattcacttttctttagccccggccgcttagtccataatggctccggtctgttgatctttattttctcagtttcgctgctgttttatttcctgatgcgtaaatatctcaatgtttatacctctgaagaggaaagactgcgctacgccatcaatcagggctatatcgttccctactatcagccgctggtgaatgggaaaaccggagagatatacggcgtggaaattctcgcccgctggcaaaacagcacgacgccatcgcgctcgccagcggaatttattccgctggccgaacgtaccggcttaattattcccctaacccgcagcctgatggcgcaggtcaacgcgcagatgagaccactctttagtaaactaccggatgggtttcatattggcctcaatatcagcgtgtcacacattaacgccccgtcgtttatcgatgactgcctgcactatcagcgcggctttgaggggaaagcggtgaagctgatgctggagatcacggagcaggagccgctgttgctcaacgacgcggtcgtggacaagctcaatacgttacactcccgcgggttttccatcgcgctggacgactttggcaccggctattccgggctttcctgtctccacgagctgattttcgactatatcaaaatcgatcagagttttgtcggccgggtaaccggggaggcgccgtcaagcaagctgctggactgcgtgatagagatggcccggacgctgtcactgcgcatcattgccgagggcgtcgaaacccaggcccaactggaatatcttaatcgccagaatattcatctgctgcagggctattatttctggaagccgatgccctacgtcgcgctggtgatgctcctgctgagcaaaccgaaggcgcggattgtcgaacaataa

SEQ ID NO: 406 - DNA, 243 bp, Klebsiella pneumoniae
aatacgaggatgtggatgcgaatactaccgatcattgccatggcgctgctgctcagcggctgcggcagcattatcagccgtacggtgcccgggcaggggcatggcaatcaatattacccgggcgtacagtgggatgttcgcgattcggcatggcgctatctcaccattctcgacctgccgttctcgctggtatttgatacgcttctgctgcctctggacgccagccacggaccctataactga

SEQ ID NO: 407 - DNA, 663 bp, Klebsiella pneumoniae
ggagagaggatgaaatatcagttaactgcgcatgaagcgcgcgtcattggctgcctgctggaaaagcaggtcaccacccccgagcagtatccgctgtcggtaaatgctgtggtgaccgcctgcaatcagaaaaccaaccgcgagccagtgatgtcgctgagcgaaagcgaggtccaggccctgctggatacgctggtgaaacggcactatctgcgcacggtcagcggattcggtaatcgcgtcaccaagtatgaacagcgcttttgcaactctgaatttggcgatctgaagcttagcgccggcgaggtcgcggtggtcacgacgctgctgctgcgcggtgctcagacgccgggcgaactacgcagccgggcgcagcggatgtatgagttcagcgatatggcggaagtggaaagcgtgctggaagggctgacgacgcgcgaagatggccccttcgtcgcccggctgccccgggagccgggaaaacgggaaagccgctatatgcatctgttttgcgacgatatagacacgctgatcaccacagtggaagctctcgcgccgctggacgatgacggcgatctgcgcgccagggttgaagcgctggagggcgaggtggcggagctgaaagcgcgcctcgattcgctgttacaccatctgggagactaa

SEQ ID NO: 408 - DNA, 228 bp, Klebsiella pneumoniae
gcggagaggattaaatcacagcaaaaaaagaatgataatgaaaacaattatcataaacttaaaaaagcaaaaaataacgtcggcgcaccactctggatgggaaaatgcttaaaaacataccgcaccggaatttatattaagaaaacattaaatttcgattttttattgtcggtggaaaaatctgccgttgttacatgcggtaagcggccttgccagtgggtattgtga

SEQ ID NO: 409 - DNA, 1293 bp, Klebsiella pneumoniae
tgtattgatgttttgtttataatctgtcattttatgcagtacaggatgcactacagaagaatgatgataatgccaaagaaagccagaggactgtctgttcttgctgtttccagacttaaagctgatgggcgttatgctgttggtggggtggatggattatacctgcggattgcagggcgctcccgcgcatgggtcctgagtgtggcaatgggaacccgaattaacaaagcaggtaagacggttccccggcgtctgaacatggggcttggtccctgtcaggaagtttctctggcagaagcgcgtgacaaggcgcgtgaggtgcgtaagcaaattcgtgatggcattgatcccctcgaagaaaaacacgcccgtaaagcgtttcacgaagctcaggcgcgtaaacaaaaaaccttccgtgaatgcgctgaagctgtgctggaaatcaaaggtaatgagttaaagaataaaaagcatgtggctcagtggcgttccacactggaaacctatgcttatcctgttattggtgataaagcggtcagtgaaattaccaaaatggacttgttggcaatcctcgaaccaatatggctaactaaaaacgaaacagccagtcgtgtccggggacgtatcgaaacggtaatggattacgccaaagcaaaagagtatttcgaaggtgataaccctgctgcatggaaaggtgtactaaaacctctgttgccaatgccaagtaaagttcagaccaaaaaacatcatgcggcattgccttacaaagatgcaggctcatttatggcagaactgcgtcaacgggccgggatttcagccagagcactggagttttccatactgaccgttgcccgttcgggtgaaattcgaggcgctgaatggtgtgaaatcgatctggatgcgaaaacgtggattattcctgctgagaggatgaaagcagcgaaagaacatcgcgtacccctgtcagatactgctgttgaacttcttaaagccttaccacgatttacagataacaatcttgtttttccggcacctcgcggtggacaactgtcagatatgtcattaacagcagtattgaaacgcatggggcgtagtgatttaacccagcacggatttcgatccacatttcgtgaatgggcgggggaaaccacatcctaccagcgtgaagtgattgaacacgcccttgctcaccagttagcagacaaggcagaagccgcttaccagcgtggcaccttatggcctaaacgtgttgcgttaatggatgactggacaagctattgttctgtagcgtaa

SEQ ID NO: 410 - DNA, 1590 bp, Klebsiella pneumoniae
ggaagtgatgttgctatgtctgttctgagtttgtcgctcggaaagaaaacaggacgcctgcccgagcgcaggcgtcctgcatttccgatggtggcgttagcgctgctgttttcattgctggcgctgttgccgttagggtttgtggtggcggttgggttcgacaccggctggccgaccattaaagcgctggtctttcgtccgcgggtaggggagctgctcagcaataccctgtggctgacggtggtggcggtccccatcagtattgtgctcggcgtgacgctggcctggctgacggaacgtactgcccttgccggtcggcagctgtggtcggcgctggcggttgccccgctggcgatcccggcctttgtccagagctacgcctgggtcagtgccgtgccttcgctgcatggcctctccgccggggtgtttctctcggtgctcgcctactatccgtttatttatatgccggtggcggccgtgctgcgccgcctcgatcccacccttgaagatgtcgccgcgtcgctgggcacgccgccgtggaaagtgttcttccgggtggtgctcccgcagctgcgtctggcaatctgcggcggtgcgctgctggtggccctgcatctgctggcggaatatggcctgtatgtgatgatccgcttcgataccttcacgaccgctatttacgatcagttccagtcgaccttcagcggtccggccgccaatatgctggcaggcgtgctggccttgtgctgcctggcgatcctgctgctggagagcgcctcacgcggtaaagcgcgttacgcgcgtatcggcgccggggcggcccgcgagcagaagcggcttgtgctgggtaaaggggccgcttttggcgcgcagctactgcttctgctgctggtgatgctggcgatgggggttcccttactggtcctgtgccgctggctatggctgggcggcatcgacaactggctgcatgccgatctctggcattctctgcgccagaccctgctcctgggggcgggcggggcgctgctgacaacggtttgcgcgatccccattgcgtggctcggcgtgcgctatccgcgcccgctgttccgcctgctggaggggtgtaattacatcaccagctcgctgcccggtattgtcaccgcgctggcgctggtgacggtcaccatccactacgcccgtccggtgtaccagaccgaagtgacgctgtttctggcctatctgttgatgtttatgccgcgtgcgctgattaacctgcgcgccggtatcgcgcaggcgccggtggagctggaaaacgttgcccgtagtctcggacgcagtccggcccgcgccctgtggagtatcactatgcggcttgccgcgccgggcgcggccgcaggtgccgcgctggtgttccttggcgtcagcaatgagctcaccgccacgctactgctttcgccgttaggcacccgcaccttgtcgaccggtttctgggcgttaaccagtgagatcgactacgtagcggcggcaccgtacgcgctgttgatgatcgtcatttcgctgccgctgaccgcggttctttatatgcagtcgaaaaaaatggcagggttgtaa

SEQ ID NO: 411 - DNA, 1050 bp, Klebsiella pneumoniae
cccctttgtgtgagctgtctggttagtatgaagaaaatgttacgttttatcctgttgctggtcgtgctgttgggcatcgccgcggcggcaggcatgtggaaggtacgccagctggcggacagcaagctgctgattaaggaagagaccatctttaccctcgaagccggcaccggccggctggcgctgggccaggatctctatcgcgagaaggtgatcaatcgcccgcgcgttttccagtggctgctgcgggtggaacctgagctgtctcacttcaaggccgggacctatcgcttcacgccgcaaatgacggtgcgcgagatgttgcagctgctggccagcggcaaagaggcgcagtttccgctgcgctttgtcgaaggcatgcgcgtcagcgactacctgcgccagctgcgcgatgccccgtacgtgaagcacacgcttgaagacgatagctacgcgacggtggctaaggcattaggtcttgagcatgccgactgggtagagggctggttctggccggatacctggatgtacaccgcaaacaccagcgatatcgccatcctcaagcgcgcgcatcagaaaatggtcgccgaagtggcgaaggtctgggaaggacggatggagaatctgccctatgccgatcagaaccagctgttgaccatggcctcgattattgaaaaagagaccgcggtagcggaagagcgcgaccgcgtcgcgtcggtatttatcaaccgcctgcgcatcggtatgcgcttgcagaccgatccgaccgtaatctacgggatgggcgaaggatatactggtaagttaacgcgtaaggatctcgagacgccgaccgcatacaatacttataccatcagcggtttgccgccgggccctatcgcggtgccgggcgaggcctcgctgaaggcggccgcccatccggcgaaaacgccatatctttatttcgtcgccgacgggaaagggggccatacgtttaccacaaacctggtcagtcataaccgtgcggtgcaggattatctgaaagtacttaaggaaaaaaatgcgcagtaa

SEQ ID NO: 412 - DNA, 186 bp, Klebsiella pneumoniae
tggaggtcagtaatggcaaaccatcgtggcggttccggcaactttgccgaagaccgtgaaagagcatcagaagcaggacgtaaaggtggccagcatagcggggggaattttaaaaatgaccctcagcgcgcctcagaggctggcaaaaaagggggtaaaaacagtcatggtagtcgtgaaagttaa

SEQ ID NO: 413 - DNA, 3981 bp, Klebsiella pneumoniae
atgacaggagttttgagcatgggcaccaccaccatgggtgttaagcttgacgacgcaacccgcgagcgcattaaatccgccgcgagccgtattgaccgcacgccgcactggctgattaagcaggccatctttaattatctggaaaaactggagaacgacgagacgctgcctgagctgccggccctgctctccggggccgccaacgaaagcgatgacgccagcgaaccaacggaagagccctatcagccgttcctcgaattcgccgagcagatcctgccgcagtcggtgagccgcgcggcgatcaccgccgcctggcgacgtccggaaaccgacgcggtaccgatgctgctggagcaggcccgtctgccgcagccgctgggcgaacaggcgcacaagctggcgtatcagctggcggaaaaactgcgcaaccagaaaaccgccagcggccgcgccggcatggtgcagagcctgctgcaggagttctccctctcttcacaggaaggggtggcgctgatgtgcctggcggaagccctgctgcgtattccggataaagccacccgcgatgcgctgatccgcgacaaaatcagcaacggcaactggcagtcgcacatcgggcgcagcccgtcgctgttcgtcaacgccgccacctgggggctgctgttcaccggaaaactggtgtcgacccataacgagaccagcctctcccgctccctgaaccgcatcatcggcaagagcggcgaaccgctgatccgcaaaggcgtggatatggcgatgcgcctgatgggcgagcagttcgtcaccggggaaaccatcgccgaagcgctggccaacgcccgcaagctggaagaaaaagggttccgctactcctacgatatgctcggcgaagccgccctgaccgccgctgacgcccaggcctatatggtttcttatcagcaggcgattcatgccatcggcaaagcctccaacggccgcggcatttatgaaggtccgggtatctccattaagctctccgcgctgcacccgcgctacagccgcgcgcagtatgaccgggtgatggaagagctttacccacggctgaaatcgctgaccctgctggcgcgccagtatgacatcggcatcaatattgacgccgaagaggcagaccgtctggagatctccctcgacctgctggaaaaactgtgcttcgagccggaactggccggctggaacgggattggcttcgtgattcaggcctaccagaagcgctgtccgtttgtcattgattacctgattgacctcgccacccgcagccgccgtcgcctgatgatccgtctggtgaaaggcgcctactgggatagcgaaattaaacgcgcgcagatggaaggtctcgaaggctatccggtatacacccgcaaggtttacaccgacgtctcctacctcgcctgcgcgaagaagctgctggcggtgccgaacctgatttacccgcagttcgccacccataacgcccatactctggcggctatctaccagctggcgggccagaactactacccgggccagtatgagttccagtgcctgcacggcatgggcgaaccgctgtacgagcaggtggtgggcaaggtcgccgacggcaaactgaatcggccgtgccggatctacgccccggtgggcacccacgagacgctgctggcgtatctggtgcgtcgtctgctggagaacggcgccaatacctctttcgtcaaccgtatcgcggacaataccctgccgctggacgagctggtggccgacccggtcagcgcggtagaaaaactggcgcagcaggaaggccaggccggcctgccgcatccgaaaatcccgctgccgcgcgatctctacggcagcggccggagcaactccgccggtctcgatctggcgaacgagcaccgtctggcctccctctcctcttccctgctcaacagcgcgctgcataaatggcaggcattgccgatgctggagcagccggtggccgaaggcgagatgcagccggtggttaacccggcagagccgaaagatatcgtcggctacgtccgcgaagccagcgacgctgaagtgcagcaggcgctgaccagcgctatcaacaatgcgccgatctggttcgccactccgccgcaggagcgcgccgccattcttgagcgcgccgcggtgctgatggaaagccagatgccgaccctgatggggatcctggtgcgcgaggcgggtaaaaccttcagcaacgccatcgctgaagtgcgcgaagccgttgacttcctgcactattacgccggccaggtgcgcgacgatttcgataatgaaactcaccgcccactgggtccggtggtctgtatcagcccgtggaacttcccgctggcgatcttcaccggccagattgccgccgcgctggcggccggcaacagcgtgctggcgaaacctgccgagcagacgccgcttatcgccgcccagggcgtggcgattctgctggaagccggcgtgccgccgggcgttattcaactgctgccgggccgcggggagaccgtgggcgccgcgctaacctccgatgagcgcgtacgcggcgtgatgttcaccggctccaccgaagtggccaccctgctgcagcgcaatatcgccagccgcctcgatccccagggccgcccgacgccgctgatcgccgaaaccggcgggatgaacgcgatgatcgtcgattcgtcggcgctcaccgagcaggtagtgatcgacgtgctggcttccgcgttcgacagcgctggccagcgctgctccgccctgcgcgtgctttgcctgcaggaagaggtcgccgatcacaccttaaccatgctgcgcggcgccatgagcgagtgccggatgggcaatccggggcgcctgaccaccgatatcggtccggttatcgatgcggaagcgaaagagaatatcgaacgccatattcaggcgatgcgcgccaaaggccgcaccgtttaccaggcggtgcgtgagaatagcgaagacgcccgcgaatggcgtcacgggaccttcgtgccgccgacgcttatcgagctcgacagcttcgacgagctgaaaaaagaggtcttcggcccggtactgcacgtggtgcgctataaccgtaacgagctggacaaactggtcgagcagattaacgcctctggctacggcctgaccctcggcgtgcatacccgtatcgacgaaaccatcgcccaggtcaccggcagcgccaaggtgggcaacctgtacgtcaaccgcaatatggttggcgcggtggtcggcgttcagccgttcggcggcgaagggttgtccggtaccggtccgaaagccggcggtccgctgtatctgtaccgtctgctctccagccgtccgcaggacgcggttggcgtgaccttcgcccgccaggatgcagagcgtccgctggacgcccagctgaaaacgctgctggaaaaaccgctgcaggcgctgcagcagtgggccgcgggccgtcctgagctgcaggcgctgtgccagcagtacagcgagcaggcgcaaagcggcacccaacgcctgctgccggggccaaccggcgagcgcaacaccctgacgctgatgccgcgcgagcgcgtgctgtgcgtagcggataacgaacaggatgcgctgatccagctggcggctgtgctggcggtgggttgtgaagtactgtggccggacagcgccctgcagcgcgatctggcgaagaaactgccgcgggaggtcagcgagcgcattcgctttgccaaagcggagcagttgcctggccaggccttcgacgcggttatctaccacggcgattccgaccagctgcgcgagctgtgcgagcaggtggcggcgcgcgacggggcgattgtctccgtgcagggcttcgcccgcggcgaaaccaatctgctgctggagcggctgtatatcgagcgttcgctgagcgttaacaccgcggcggcaggcggtaacgccagcctgatgaccatcggctaa

SEQ ID NO: 414 - DNA, 696 bp, Klebsiella pneumoniae
ctgattgaggtgaatactatgtctactcccgctaactttaacggtgctcgtccggtgattgatgttaacgataccgcaatgctgttgattgaccatcagagcggtctgttccagaccgtcggcgatatgccgatgccagagctgcgcgctcgcgccgccgcgctggccaagatggcgtcgcttgccgggatcccggtgatcacgaccgcctccgtgccgcaggggccgaacggtccgctgatcccggagattcatgaaaacgcgccgcatgcgaaatacatcgcccgtaaaggtgagattaacgcctgggataacccggaattcgtcgccgcggtgaaagcgaccggtcgtaaaacgctgattatcgccgggaccatcaccagcgtctgcatggccttcccggctatcgccgctgtcgccgacggttataaagtgtttgccgtgattgacgcttccggcacctacagcaaaatggcgcaagagatcaccctggctcgcgtggtacaggccggcgtagtgccaatggataccgccgccatcgcctctgagctgcagcgcacctggaatcgcccggacgccgcagaatgggcggaggtgtacaccaaagtcttcccggcctaccagctgctgatcgaaagctacagcaaagcgcaggacgtcgtgaagaataacgaacagctggattcccagcgctaa

SEQ ID NO: 415 - DNA, 351 bp, Klebsiella pneumoniae
gtggtcggggtattgtcttgccatgttttagctgttctgattgaaaacaccacacaggacatctgtggacaaggttttcacacgctggcctgtagtgccttaattgagtcaggtttgtggtcagaagacgctgtaaagcatcaagtggaccataaggaaagcaacagaatccgggttgcttataaccataaaaccaagcaccttaagcagcgacacctgatgctccagtggttgctgatttccttgatgctaacagcaacggtatggtcaggccgtttgaatttgctcatcacaagtaaagaattgaaagccaaggatggcttgcctcccttctttaactcattaatataa

SEQ ID NO: 416 - DNA, 1110 bp, Klebsiella pneumoniae
ttgttttcattatcattctttttttgctgtgatttaatcctctccgctcaggctatttaccgtttattgccctatttcattaaggatgcgttcatgaaatttcgcttatcgcccctccgtacggcagcgctggttgccgcttctctgtttctggcgccgcaggggatggcggctgacgctcagaacgggattgtggtttacaacgcccagcacgaaaatctggtgaagtcgtgggtggatggattcaccaaagagaccggtattaaggtcacgctgcgcaatggcgatgacagtgaactgggtaatcagctggttcaggaaggctccgcgtcgccggccgatgtgtttctgaccgagaactcgccgtcgatggtgctggtcgataatgccaaacttttcgccccgctggatgccgccaccctgcagcaggttccggcgcagtaccgtccgcagcatgggcgctggatcggcattgccgcgcgcagcaccgtttttgtctacaacccggcgaaaatcagcgaggcgcagctgccgcattccctgatggatctggcaaaaccggagtggaaagggcgctgggcggcttcgccatcgggggctgatttccaggctatcgtcagcgcgatgctggcgctgaagggtgagcaggcgactctcgactggctgaaggcgatgaaaaccaactttgtcgcttacaaaggcaatagcacggtgatgaaagcggtcaacgccgggcagatcgacggcggggtgatctaccactattaccgcttcgtcgatcagtcaaaaaccggcgaaaacagcaaaaacacccaactgtattacttcaaacaccaggatccgggcgccttcgtcagcatttccggtggcggtgtgctggcttccagcaaacataaagcgcaggcgcaggcctttattaaatggatcaccggcaagcaggggcaggatgcactgcgcaccaataacgccttcgaatatgccgtgggggtagatgcggcctctaacccgaaactgaccccgctgaaagatctggatgcaccgaaggtagaaccttcctcgctgaacagtaaaaaggtcattgagctgatgacgcaggctggcctgctctga

SEQ ID NO: 417 - DNA, 1446 bp, Klebsiella pneumoniae
ccaaacatttcctttttcagtccccctgacttcactcttgctttcatcactatacctttcctgcacgatagtgtgaaaacagcaacataccattttctgcgccatctcctcttttcgatgaataggctcaatcgatcttgctttttgataaaaaaatattgtcgcaagggtgctgggaaaagcagcagattgcccgcagaatatcctcgcttatctctatttttccctggaggggaaatgtcccgcgtctcgcaggcaaggagcctgggtaaatatttcctgttagtcgataacatgctggtcgtgctgggcttttttgtcgtttttccgctgatttccatccgctttgtcgatcagatgggctgggcagcgctgatggtcggcattgcgctcggcctgcgccagctggtacagcagggattaggcatctttggcggcgccatcgccgaccgcttcggcgcgaaaccgatgatcgtcaccggtatgctgatgcgtgccggcggtttcgcggcgatggccgtcgcccatgagccgtgggtgctgtggttctcgtgcatactctccggactcggcggtacactgttcgatccgccgcgggcggcgctggtggttaagctggtgcgtccgcatcagcgcggccgctttttctccatcctgatgatgcaggatagcgccggcgcggtgattggcgcgctgctgggcagctggctgctgcagtatgattttcgcctggtgtgcagcgccggcgccgcgctgtttatcgcctgcgccgcgtttaacgcctggtatctgccggcatggaagctctcgacggtgaaaacgccgattcgcgaggggctgggccgggtgctgcgggacaaacgcttcgtcacctatgtcctgacgctgaccggctattatatgctggctgtgcaggtgatgctgatgctgccgatcatggtgaatgacatcgccggctcgccggccgccgtgaaatggatgtacgccatcgaagccaccatttcgctcaccctgctctatcctattgcccgttggagcgaaaaacgcttccgccttgagcaccggctgatggccggtctgctggtgatgaccctggccatgctccccatcgggatgaccagcagtttacagcagctgtttaccctgatttgcctgttttacatcggctctatcattgccgaacccgcccgcgagacgctgggcgcttcgctggcggacgcccgggcgcgtggcagctatatgggtttcagccgtctggggctcgccttcggcggcgcgctgggttacgcgggcggcggctggctgtttgatgccgggaaagccgtcggccagcccgaactgccgtggctgatgctcggcgccatcggggttatcaccttcctggcgctatggtggcaattcagtccgaaacgctctgcctccggtatgctggagccgcgcacctga

SEQ ID NO: 418 - DNA, 1059 bp, Klebsiella pneumoniae
ccggagccttccatgacagcacaatcccaggtattgaaaatccgccgcccagacgactggcatatccatctgcgcgatgacgatatgctgaaaaccgtcgtgccttataccagtgagttttatggccgggcgatcgtgatgccgaatctggtgccgcctgtcaccaccgtcgcggcggctatcgcttaccgccagcgcattatggacgccgtgccggccgggcatgattttaccccgctgatgacctgctatctgacagactctctcgacccagcggagctggaacgcggctttaacgaaggggtgttcaccgccgccaagctctacccggccaatgccactactaactccagccacggcgtcaccagcaccgacgccattatgccagtgctggagcggatggaaaaactggggatgccgttgctcgttcacggcgaagtcactcacgccgagattgatattttcgatcgtgaagcgcgctttattgagacggtgatggagcccctgcgccagcgcctgcccggcctgaaagtggtttttgaacatatcaccaccaaagacgccgccgagtacgtgcgtgacggtaatgaactgctggctgctaccatcaccccgcagcatctgatgttcaaccgcaaccatatgctggtgggcggcattcgccctcacctgtactgtctgccggtacttaaacgcaatattcatcagcaggctctgcgggagctggtcgccagcggcttcagccgcgccttcctcggcaccgactccgcaccgcacgcccgccaccgtaaggaagccagctgtggctgcgccggctgctttaacgccccgaccgccctcggcagctacgccacggtgtttgaagaaatgaacgctctgcagcactttgaggctttctgctcgctaaacggcccgcgcttctacggtctgccggtcaatgagagctacgttgaactggtgcgtgaagagacgaccgttgtggacagcattgccctgcctaatgacaccctggtgcccttcctggcgggtgaaaccgttcgctggaccgtgaagaaataa

SEQ ID NO: 419 - DNA, 771 bp, Klebsiella pneumoniae
ggattgtgttccacaggcgggatcgctattctgacgtgccttgtgctgtccgtctcgtccagacataaggaacctgctatgaaaactcctttacgcctcgcccttgtcggcgattatcaccccgatattgttgcccatcaggccattcccctggcgatagacgatgccgccgccgtgctggagcagccggtgaaatatgactggctcgccaccccatcgatcgcctccggcgaggcgctggcggagtacgatgccatctgggtcgttcccggcagcccgtatcgtcacccggaaggcgcgtttaccgcgatccgctatgcccgggaaaacagcattcctttcctcggcacctgcggcggctttcagcacgcggtgattgaatacgcccgcaacgtgctcggctggcaggacgccggacatgcggaaaccgacagcgaagggcggatggtgatcgctcccctcagctgctcgctggtggagacctctgccgtcgtcgagctgcgggcgaatacgctgattgcccgcgcctatggccgggagagcattgaagagggctaccactgccggtacggcgtgagcagcgcgtttgcggcggagctggagcagggcgatctgcgcgtcaccggctgggatgaagagggtgagatccgcgccgtcgagctggtgacgcacccgttttttgtcgccaccttgttccagcatgagcgtcacgcgctggacgggcgtcccgcgccgctggtgcaggcgtttctccgcgccgcggcacaataa

SEQ ID NO: 420 - DNA, 255 bp, Klebsiella pneumoniae
tatagccgttcaccagaggagaagttgatgctcgagttacgtccgaattgcgaatgctgtgataaagatctgccgccagactcacccgaggcgtttatctgttcgttcgagtgcaccttttgccgggactgcatgacgacgcgactgaacggacattgcccgaactgcggcggcgaactggtgcggcgccctgtgcgtcccgaagaggcgctgcggcgccaccccgcctccaccctgcgccgccatgcgcagtag

SEQ ID NO: 421 - DNA, 600 bp, Klebsiella pneumoniae
tttgcgccctcccggctccggttgcaaaattgtatcaacagcaacaaaggaggaactcccgtgaataaatctatgttggcgggtatagggataggcgtggctgccgcgctgggcgttgcagctgtcgctggtctcaacgtgttggatcgcggcccgcagtatgcgcaagtggtctccagtacaccgattaaagaaaccgtgaaaacgccgcgtcaggaatgccgcaatgtcacggtgactcatcgtcgtccggtacaggatgaaaaccgcatcgccggttcggtgctgggcgcggtggcgggcggggtgattggccaccagtttggcggcggtcacggacgcagcgtggcgacggtcgtaggtgcgctgggcggcggctatgcaggcaaccagatccagggcgcgatgcaggacaacgatacctacaccaccacccagcagcgctgcaaaacggtgtatgacaaatccgataaaatgctcggctacgatgtgacctataagataggcgatcagcaggggaaaatccgcatggatcacgatcccggcagccagatcccgctggacaacaacggccagctggtcctgaacaacaaaatctaa

SEQ ID NO: 422 - DNA, 612 bp, Klebsiella pneumoniae
aatgagcctttgaggaagtcagttagtgctggcgagcctcgacgggctgatttcctatgcggcaaaggttcatctcaaagaaaggtacacgctatgaataatccgtcagttattccggccttcgattttcgtgaaatggtcacaaccctcgataacaaggtcatcaccacttccctcaaagtggctaactattttggtaagcgtcataaagacgttctgcgagcaatcagaaaccttaaatgctccgaggatttcacccggcgcaattttgcgcccattgattttattgataaaaatggcgatgttcagccgatgtataacatcactcgtgacggatgcatgatgctcgtgatggggttcactggcaagaccgccgccgcagtaaaggagtgctacattaatgcctttaactggatggcggaacagctaaaccgaagagctgtcatgggagaagaaatgcagcaccggcacgccatcaaagaaactcgctcaaaactgaaaggcacaatcggcagtcggttgatgaatgagcggaagaaggaaaagtgcgtccttaagctcgagtatgagcacatcatgcaggtgacgcagcccgagctgcttattgactga

SEQ ID NO: 423 - DNA, 927 bp, Klebsiella pneumoniae
ttctccagattctgtcagcacctgactgtgctttctgtttcccgctattttgccacaacgcctggacgttctcctaatcgcgaacggttagccgtgtggaaagcgcacaaacgatctactttccgctatgatgttcatctacaaggagaaggagagaaaatgctgttgatagcccgacgaactgctctcgcggcggcgctgctgctggttatgcccctcacggtctggctttccgggtggctgtggcagcctggactgccggttgccatgttgaaaagcctgtggtgggtgacggaaacggtgacccagccgtggggaattatcactcatgtcgtgctttgcggctggttcctctggtgtctgcgctttcggctgcgcgcggcgttgatcctgttccttatccttgccgccgctatcctggcgggacagggggcgaaatcctgggtcaaggcgcgggtccaggagccgagaccgttcgtcatctggctggaaaacacaaggcaggtgccggtgacgcaattctacgcgttaaagcgtaaagaacgcgctaaactggtgcatgaacagctggcgcaggcgcaggacattccgtcatttttacgcaaacactggcagaaggagacggggtttgctttcccgtcaggtcacaccatgtttgccgccagctgggcgttactcgctgcggggctgctgtggccgcgtcgccgctggggcacaatcgcggtgctgctggtgtgggcgacggcggtgatgggcagtcgcctggcgctgggcatgcactggccgctggatctcatcgtcgccacgctgatctcctggctgctggtcacggtggcctgctggctgacgcagcgcctttgtgggccgctctcgccgcccggagaagaggcgcaggatattaaaaaacggatgcctgaagcggaataa

SEQ ID NO: 424 - DNA, 825 bp, Klebsiella pneumoniae
aatgacagattatcgctaatatcggacaatatgatgattggactggggctggatggctatgaaccggacagtggccacgaatcggccattgcctttcgtatccgggtggtggaggcggagcagtatattccggcgcattcccaccgtaaggggcagctgatccttgccctgcacggcgccttgacctgcgaggtggagaacgcaatgtggatggtgccgccgcagtatgcggtgtgggttccggggcagctgtcccacagtaaccgcgctacccccggcgcccaggtatgcttcctgttcatcgagccgggcgccgcgccgatgccggatcgctgctgtacgttaaagatttccccgctggtgcgagagctgatccttactctggcggagcgcggcggagagtccctggccgcccccgccacggcccggctggtgcaggttctgtttgatgagctgccccgccagccgcaggagcacctgcagctgccggtatcaaaccacccgaaaattcgtcaaatggtgacgatgatggctgaggatccggcgcgctggcagaccctgagccagtgggcggcggtgtttgcgatgagcgagcggaatctggcccgcctggtagtgcgcgaaacggggctgagctttcgccgctggcgccatcagctgcagctgatcctcgcgctgcagctgctgatccgcgggcagacggtgcagcagacggctcaggcgctgggctacgattccaccaccgccttcatcaccatgtttaaaaaagggctcgggcagacaccgggccgctatcacggtagcctggctacgacttcccaataa

SEQ ID NO: 425 - DNA, 864 bp, Klebsiella pneumoniae
tgccgatcatcggcgccttccttgacggcgcggcgctgccggtggcgattgagccgctgcaggtcattgttatcgccctggtggcgatggtgctggccctgttgtctacgttgtacccttcctggcgcgctgccgccacccaacccgctgaggctttacgttatgaataatatcctgctgcaatgcgacaacctgtgcaaacgctatcaggaaggcaatgtgcaaaccgatgtcctgcacaatgtcagcttcagcattggtgaaggcgagatgatggctatcgtcggcacctccggctctggcaaaagtacgctgctgcatctgctcggcggcctggatacgcccacctctggcgacgtgattttctccggtcagccgatgagcaagctatccaccgccgcgcgcgccgacctgcgtaaccgcgagctgggctttatctatcagttccaccatctgctgccggactttagcgcactggaaaacgtggcgatgccgctgctgattggcaaaaagaagccggcggatattgaacgccaggcgaaagcgatgctgcaggcggtcgggcttgaacaccgcagccatcaccgtccgtcggagctctccggcggcgagcgccagcgggtggcgattgcccgcgcgctggtgaataaaccgcggctggtgctggcggacgagccaaccggtaacctcgacgctcgcaacgccgacagcatcttccagctgctgggcgaactgaacgtcgcgcagcgcaccgcgtttctggtggtgacccacgacctgcagctggcgaagcgcatgagccgccagctggagatgcgcgatggccgtctgaccgccgacctgaccctgatggggggcgagtaa

SEQ ID NO: 426 - DNA, 912 bp, Klebsiella pneumoniae
gggagacaatctgtgcttgagcaacaaagcatccttgcgctgctgcagacctttgaggtgaccgcccgccacctgagctttacccttgccgcgcatgaaatgaacctaacccagggagcggtcagccatcggatccgcaggctggagatgcacatcgggtttcgcctgtttatccgcatgacgcgtaaactggcgctgacagaggaaggtaagcggctgctggcgacgttaagccattcgctgcgggcgattaacgatgaaattgaggatattcgcgatcaggatctgcgcggcacactgcatattggtattgcgccgacgctggcccatctgtggctgatgccgcgtctgccgcgctttcaggcgcaatggccgggactgaatctgcagtttcgcgtgcgcgccggggtgatggattttaacgaggagcgggtggatctggcaatttactacggcgccacgcgctaccccgatctttatcaacagcggctgatggcggaaagtttgctcccggtctgctccccgcgttatcgccagcagtatcgtccgctgagcggcggcgacccggcggcgctcgtctggatccatgcgtgcgaatccaccgacgtacaggatcaatttgcggaatggcgcctgtggtgccagcacaacggacaggcgttaccttttgaaggccggtattacgcggtgaataaccactcgctggccatcgagatggcgctcaatggactcggcgtggtgatggggcgtaaaacgctgatccagccgctgctcgacgccggcaggctggtggccttgtctgaaaatgaagcgccctcgccctttggctatgacctgatttgtccgcaggagaaccgttcccgcccgcgctttcgcgccttcagcgagtggctggcggcggaatgcgcctaa

SEQ ID NO: 427 - DNA, 1233 bp, Klebsiella pneumoniae
acgacaggatcctccatgagccaggttgcctcagcgatttcgcaaaaagaaacttataaatcaatggcctggcgttattctctggcgggtgaacgcgacctgcgtatcgactttatgcgcggcattgctctcgttatgatggtggtggcgcatacggaagtgatgtcgatatttaatattttcagctgggagcgttttggtttgaccactggcgccgagggttttgtgatcctgtcgggctttatgttagggatgctaaatcgtgccagattacaaaaagctgtattactgacggtgggctggggactttatcttcgcgcatggaaaatatatcaggttaatattattattattgtcacttttcttttgctgagatattttccgtttattaatgcctttgaagtcactcactttaccgatcgtttttccgggaccagctggtcgctctatccactcaccccgcaaataaaagagacgtggtttaacattatcctctatctgcagattggcccacaccaaacgcagatcctcggtctctatatttttctgttgttgctcagcccgttgtttctgggaatgctgcaaaagggtcacgtctaccccttactgggcgtctcgctgctgatctacggctgctggcaacgctggccggtacgggtgacgccctgcgaatttgaattcgcctttcccctgctggcctggcaatttatctttgtgctcggaatgtgctgcggctggtacaaagcggaactgatctctttcgcccgcacgccacccggcaaagtcgccgtcgtggcgctggtgttcatcgcgcttatccttgcgtttgtcgcccagaaccataccaatccttttatgccgcccgcgctactgatgcacgtgatccctccggcggagtttaacgccttttatcatacctgggcggcgaaaaacggcctcgggccggtacggatcctcaatgatatcagtcttatggtcactatttatctgttattgacctggtgttggcgtcccctgaactggctggctggctggttcctgatcccgctcgggcagcgttcgctctacaccttcattttgcatgtttatatcgtgctcgccgtaagccagttggtcaccttcgatctgtggcgccaggcgtggatagtgaacaccttgatccatgccgccgcgctgggcgtactgtggctgatggccaaataccgcgtcgccgcacgctggatacctaactaa

SEQ ID NO: 428 - DNA, 1056 bp, Klebsiella pneumoniae
caggagatgtccatgagcgagcaagccattcgtttaacgcaatacagccacggagccggttgtggttgtaaaatttccccgaaagtgctggaaactatcctgcatagcgagcaggcgaagtttgtcgatccaaacctgcttgtcggcaacgaaaccagcgatgatgccgccgtttacgatctcggtaatggcacctcgatcgtcagcaccaccgatttctttatgccgattgtcgataacccgttcgactttggccgcatcgccgccaccaacgccatcagcgatattttcgctatgggcgggaaaccgattatggcgattgccatcctcggctggccgatcaacaccctggcgccggaaatcgctcgcgaagtggtggagggcgggcgctttgcctgccagcaggcggggatcgcgctggcgggcggccactccattgacgccccggagccgatcttcggtctggcggtcaccggcgtggtgcccaccgagcgcatcaagaaaaacagcaccgcccatgcgggctgcaaactgtatctcaccaaaccgctggggatcggcgtactgaccaccgcggagaaaaaatcgctgctcaagccagagcatcaagggttagcgacggagaccatgtgccagatgaacctcgccggcgccgcgtttgccgccatcgacggggtgaaggcgatgaccgacgtcaccggctttggcctgctcggccacctcagcgaggtgtgccgcggggccggcgtgcaggcgcagctgcgctatgccgatatcccaaaactgccgggggtggaggactatatcgccgccggcgcggtgccgggcggcaccgggcgcaactttgccagctacggccatctcatgggcgagatgccgacggagtggcgggatctgctgtgcgatccgcagacctccggcggtctgctgctggcggtgaccccggaggcggaggcggaagttcaggccgccgcggcggagttcggcattaagctggccgccatcggcgagctggtgaccgcccgcggcgggcgacccatgatcgagatccgttga

SEQ ID NO: 429 - DNA, 285 bp, Klebsiella pneumoniae
tggcgatatccagacgcagatccaacagcgcttcgtagagcatttgcacatccccctgcaccagcgacagctcaatccccggccagtcggcgcgcagccggcgcaggagccccggcagtttactgtcgtacatcgcgctggagacataccccaaatgcagcctcccctgctcgccccgcgcgatgcgctgggcgtccagcaccgcctgatcggccatttccagcgccagccgcgtcttgtgtaaaaaggcctcgcccgcggcggtcagagtcagacggcggttag

SEQ ID NO: 430 - DNA, 798 bp, Klebsiella pneumoniae
tcgctcatgttttcagcagagagaaaaggagaaaacatgaacaatagcgcaaaaatcgccctggtgacaggcggcagccgcggcctgggacgcgcgaccgtcgaagcgctggcacagcgcggcgtaaatgtagtactgacctacaaaacgcgtcttgccgaggcgaacgaggtggttacacgggttgaagcactgggcgcccgggcgatcgcgttgcctttcagcgccggcgaaatcgacacctttgacgcatttgttagcgcttttcagggcgcgctgacggagctgggcgccgataaatttgattatctggtcaataatgccggcaacgccagcggcatgggatttcttaacgccacggaagcggaattcgatgcgctgtatcgcatccacgtgaagagcgttttcttcctcagccaaaaactattgccgctgctggccgatggcgggcgaatagtgaatgtttcgtccggcctcacccgcatcgtgatggcgaaccgggcgccctatgcgatcatgaaatccgcggtggaaaccctgacccgctatatggcgtttgagctgggcagtcgcgggatcacggtgaactgcgtggcgcccggcgccatcgccaccgatttcagcggcggggtggtgcgggataacccgcaggtcgctcaggctgtcgctgcgatgacggccctgggccggcctggcctgccagaggatatcgggcagatgatcgcctcgctgttatccgatgatcatcgctgggtgaatgcccagcgcattgaagtgtccgggggaatgcgcatctga

SEQ ID NO: 431 - DNA, 1179 bp, Klebsiella pneumoniae
tcacaaaccccgcagcggccggaaatttgccgttgcgtctacatgggacagagtcaaaaattgaatatacaaccgcgttcgcgttcgccgctggtgcatctggcgggaattcgcaagagctttgatggtaaaacggtcatcgacaaccttaacctgaccatcaacaatggtgagtttctcactctgcttggcccctctggctgcggtaaaaccaccgttctgcgccttattgccggcctggaaaacgtcgacagcggacggatccatctcgaagatcacgatatcactcatgttccggcggaaaaccgccacgtcaataccgtattccaaagctacgccctgtttccgcatatgacggtgttcgagaacgtcgcctttggcctgcggatgcagaaaaccccggcggcggaaatcaccccacgggtgatggatgccttaaaaatggtgcagctggaggcgtttgcccagcgcaaaccgcaccagctctccggcggccagcagcagcgcgtggccatcgcccgcgcggtggtcaacaaaccgcgtctgctgctgctcgatgagtctctttcggcactggattacaagctgcgcaagcagatgcagaacgaactgaaagcgctgcagcgtaagctcgggatcaccttcgtcttcgtcacccacgatcaggaagaggctctgaccatgtccgatcgcatcgtggtgatgcgtgatggcaaaatcgaacaggacggcaccccgcgagagatctacgaagagccgaagaacctgtttgtcgccagctttatcggcgagatcaatatctttgacgccacggtaattgaacgtctcgacgaacagcgcgtgcgcgcccgcgttgaaggacgagaatgcaacatcaccgtcaattttgccgtggaggccggccagcgtctgcatgtcctgctgcgcccggaagatctgcgcgtcgacgagatccaccataacagcgacgccgatggcctgatcggctatgtccgcgagcgcaactataaaggcatgactctggagtcggtggtggaactggagaacggcaaaatggtgatggtcagcgagttctttaacgaagacgacccggatttcgaccactctcttgaccagaaaatgtctatcaattgggtggaaagctgggaggtggtgctggccgatgaagaacaccagtaa

SEQ ID NO: 432 - DNA, 1392 bp, Klebsiella pneumoniae
atcgccaaccctgacgctgcccgccagcctgagcccgggtctcgactttctggccggggaggcgtcatgaccgcccgcgaagtcaactttgacggtctgcccgggctgacccatcactacgccgggctctcctttggcaatgaggcttccacccggcatcgctatcgggtgtctaacccgcagctggcggcaaagcaggggctgaaaaaaatgaaagccctcgccgacgctggctacccgcaggcggtgatcccgccgcaggagcgtcccaacgtgccgcttctgcgccagctgggctttagcggcagcgatgagcaggtggtggcccgggtggcgcagcaggagccggatctgctgtcggcggtgagttcggcctcggcgatgtgggtggcgaacgcggcgacggtgtgtccctccgccgattcgctggatggcctggtgcatctgacggtggcgaatctgcaggataaattccaccgcgccagcgaagcaccgactacagaggcgctgctgcaggcgattttccccgaccgcacgcgatttgctatccacccggcgctgcccgcctcggcctggtttggcgacgaaggggcggcgaaccataatcgtctcggcggcgagtatggcgctcccggcgtccagctctttgtctatggccgccgccgggggagcgaggaggcgccgcgtcgctatccggcgcggcaaacccttgaggccagccaggcggtagcgcgcctcaatcaggtcaatccccgccagctgatcttcgtccgccagcatccggcggcgatcgacacgggggtttttcataacgacgtcatcgcggtgagcaaccgtcaggtcctgttctgccatgagcaggcctttgccgaccagaccgcgcttctccagcagctggcgcagcgggtgccgggttttacgccgctggtggttcccgccagccgggtctcggtggcagaggcggttgccacctatctgttcaacagccagctggtgagccgggcggatggcagcatggcgcttatcctgcctcaggaagcgcaggagcatgccggcgtgtgggaatacctcaatgagctgctggccggggataaccctatcgccgacctgcgggtgttcgatctgcgcgagagcatggccaacggcggcggtccggcgtgcctgcgcctgcgggtggtgttgacggccgaggagtatcaggcggtcaatccgcacgtcctgatgaacgatacgctgtttgtcaccctcaatgactgggtggatcgctactatcgcgatcgtctcacccaggccgacctcgccgacccgcagctgctgcgggaagggcgcgacgcgctggatcggttgacccagatcctgcagctcggttcggtttatccatttcagcaataa

SEQ ID NO: 433 - DNA, 279 bp, Klebsiella pneumoniae
aactatcgcccgcgatcagcatacagaggacagaagatgtttgtggaactgatttatgacaagcgcaattttgccgggctgccgggcgccagagaggccattcttaacgagctgaccaaacgcatgcagcgcattttcccggaggcggaagtgcgggtgaagccgatgatgacgctgccggcgatcaacaccgacgccagcaagcatgaaaaagagctgatcagccgcacggtgcaggagatgtttgaagaggcggatatgtggctcactgaagagtga

SEQ ID NO: 434 - DNA, 1170 bp, Klebsiella pneumoniae
tctcggcgcccagctgccttcgccggaatggggagccatgctgggcgatgcgctggagcttatctatgtggcgccgtggaccgtgatgctccccggggcggcgattatgctcagcgtactgctggtcaacctgctgggcgacggtattcgccgggcgatcattgccggggtagaataatgccgttactcgatattcgtcacttaaccattgaatttaaaaccagcgaaggctgggtaaaagccgtcgatcgcgtcagcctgacgctgaccgaaggcgaaatccgcggcctggtgggggaatccggctccgggaaaagccttattgccaaagctatctgcggcgtgactaaagacaactggcgggtcacggccgaccgcatgcgcttcgatgacatcgacctgctgcgactgtcgaaccgcgagcgccggaagctgatcggccataacgtgtcgatgatttttcaggagccccagtcgtgcctcgatccctctgagcgcatcggccagcagctgattcagagtatccccggctggacctacaagggccgctggtggcaacggctgggctggcgcaagcgccgggccatcgagctgttacaccgcgtaggcattaaagatcacaaagatgccatgcgcagcttcccctatcagctgaccgagggcgagtgccagaaggtgatgatcgccatcgccctggccaaccagccgcgtctgctgattgccgacgagccgaccaacgccatggagccgaccacccaggcgcagattattcgcctgctgacgcggctcaaccagaacaacaacaccaccatcttgctgatcagccatgacctgcaaatgctcagcaaatgggcggataaaatcaacgtcatgtactgcgggcagacggtggagagcgggcccagcgaagagctgatcactctcccacatcacccctacacccaggcgttaatccgcgcgatcccggatttcggtagcgccatgccgcataaaagtcgcctcaacaccctgcctggagcgatcccgctactggagcagttgcctatcggctgtcggctggggccgcgctgcccgtacgcccagcgcgagtgtatcgaaacgccgcgtcttaccggggcgcgcaaccatctgtacgcctgtcatttcccgttgaacatggagaaagagtga

SEQ ID NO: 435 - DNA, 909 bp, Klebsiella pneumoniae
ggttccatacccatgaaactcccgccgctgaatgcgttgcgctgctttgaggcggcggcgcggctgctcagcctgaagctggccgccagtgagctttgcgtcacgcccagcgccgtcagccagcagattgcccgccttgaggagacgctgaatgtcccgctatttatccgtactccgcgacggttacagttaacggcggtgggagagatctacctgcgggccgttcagccggcgtttcatcagatagccgccgccacccagcgcctgcaggtgcccccgggaccagaaaaggtagctatcagctgtaccagcggcttcgccattcagtggctgctgccgcggctggctgattttgaacgacgctatccgcagatagagatccagatcggcaccaccaaccggcgagtggatttgctgagtgaagggatcgattttgccgtgcgtcatggtgtcggcggctggccggaactgcaggcttaccgcctgctggatgacgatctgatgccggtctgcagtccgcagctgatcgctccgcgccggacgctcaccgatgcgagcgatctactgcagtatccgctgctgcacgatgaacatcgtgaagactgggcgctgtggtgtgaggccgtggggctggcgccgcacttcgcgcggcgtgggccggtgttcactgattccaacggcgtgacggaggcggcgttcgccggtatggggatggcattgctgcgacgctcattcatagcgcctgcgctgacgcaggggcggctggttaatcctctggcgcagcccatcgcctgtccgctggcctatcatctggtttaccacgagaccgcgctgctggcgcctgccaaccgctgttttcgcgactggctgcttggccagcgcccggccgttgctgaggagcgcgcgtag

SEQ ID NO: 436 - DNA, 1431 bp, Klebsiella pneumoniae
cgagacataccttcagggcataacggactggcgatgaagcgactgaaaactgaattgaatgcgctggtcaaccgcggggttgaccggcatttacgtctggcggtgaccggcctgagccggagcggtaaaacggcgtttatcaccgcgctggtcaaccagctgttgaatatccacaccggcgcccgcctgccgctgctgagcgccgcacgcgaagagcggctgctcggcgtcaagcgcgtgccgcagcgggactttggcattccccgattcacctacgacgaagggctggcccagctgtacggccagccccccatgtggccaaccccgacgcgcggggtgagcgagatccgtctcgcgctgcgctaccgttcgaatgactccctgctgcgccattttaaagatacctccacgctgtatctggagatcgtcgactatccgggcgagtggctgctcgacctgccgatgctggcgcaggattatctgagctggtcgcgacagatgaccgggctcctgcagggacagcgtgcggagtggtcggcccgctggcggcagctgtgcgccgggctggatccgctagcccctgccgacgaggctcggctggcggatatcgctgccgcctggacggactatctccacgcctgtaagcgcgaagggctgcactttatccaacccgggcgctttgtcctgcccggagaaatggcgggcgcgccggcgctgcagtttttcccgtggcccgacgtcgacgccgtcggcgaagccaagctggcgcaggccgataaacacagcaacgccggcatgctgcgcgaacgctacaaatactattgcgaaagggtggtgaaggggttctacaaagagcacttcctgcgcttcgaccggcagattgtgctggtggactgtctgcagccgctcaacagcgggccgcaggcgtttaacgatatgcgtctggcattgacccagctgatgcaaagtttccattacgggcagcgcaccttgtttcgccggttgttctcgcccgtcatcgacaagctgctgtttgccgccaccaaagccgatcacgtcacgatcgatcagcacagcaatatggtgtcgctcctgcagcaactgattcaggacgcgtggcagaacgccgcctttgaagggatcagtatggattgcctgggactggcgtccattcaggcgacccagagcgggctgattgaggtgaatggcgagaaaattcccgccctgcgcggcaatcgcctgagcgacggccagccgttgaccatctatcccggtgaggtgccggcgcgcctgccgggccaggccttctggcagcaacagggatttcagtttgaaaactttcgtccgcaggtcatggatgtcgatcggcctttgccgcacattcgtctcgacgcggcgctggaatttttgattggagataaactgcgatga

SEQ ID NO: 437 - DNA, 246 bp, Klebsiella pneumoniae
cgcgcgataccttcaatacccagcaggtggaagtcatcaaagggcccgccggcacggactatggccgcagcgcgccctccggctcgatgcaatatgatcagcaagcagccgcgccttgactccgggatcgacggctcggccagcatccgcagcgcctggtcgcgcccggggcactctcgacctgaaccaggcgtttaccgacaacgcttggttccgtctgaacctgatgggggaaaaaacccatga

SEQ ID NO: 438 - DNA, 480 bp, Klebsiella pneumoniae
acaggccaacctgctgctcaccggctgggccgcatcgctgcccaactggcgctatgtcgatctgcaaaagccggtacgggaagatttttcagttgccaccgagggcgcggagtcgccgtggggcagcgcccagctgacgtttatcgcccgccgcggacaaacgccgcagccgcccaccagcccgcaggcgctgctggccttcgccagagcccatccgggcagcgtaacctacccgcggccgccggacttcaccggtaccgccctgctggagcaactgctgatcgcgctcaccgaccagccagccgccctgcgccagccgccgcagccggcgaccttcgcggcggtcaccgccccgctgtggcgctatctcgatgcgctgcacccggccctgtggcgggcgggcaaggatttcccggcgtcgccggcgcggatggacgccatgctcaaccagggcaccctccgcctgtcgctgacgtttaa

SEQ ID NO: 439 - DNA, 1365 bp, Klebsiella pneumoniae
cccgatgaacccggcctattcgcccatcgtggtcggccgcgaggagacgctcgatattttcggcgtcgtaacctacatcatcaaggcggcgggctgatcatgttcgcgcattgtgatgtgaacgccttctatgccagctgtcagaccgccttccggccagacctgaaggggcggccggtggtggtgctgtcgaacaacgacggctgcgtgatcgcccgctcggcggaggcgaagccgtttgtgaaaatgggggaaccctactttaagcagaaggctgcgtttcttcgccacggcgtcgtggcgtttagcagtaattatgagctgtatgccgacatgtccagccgggtgatggccaccctggaagagctcaccccgcgctgcgaaatttacagtatcgatgaggccttttgcgatgtcagcggtgtgcgtcattgcagagatctgaccgattttggccgcgaaatccgcgccacggtgctgcagcgtacccatctgacgctgggcgttggcatcgccccgaccaaaaccctggcgaagctggccaaccacgcggcgaagcagtggccgcggcagacgggcggggtagtggacttgtcctgcccgcagcggcagcgaaagctgatggcgctgctgccggtgagcgaggtctggggcatcgggcggcggatcggcaaaaagcttgaagcgatggggatcggcacggtactccagctggcggagagtgatatccgctttatccgcaagcacttcacggtggtgctcgaacgaacggtacgggagctgcgcggcgagccttgcctggcgctggaggagtttgcccccgctaagcaggaaattatctgcagccgctcgttcggggatcggattacggcctatgaggatatgcgccaggcgatctgcagctatgccgcgcgggcagcagaaaagctgcgcggtgagcatcagtactgccggttcgtctccgcctttgtcaaaaccagccccttcgcgctgaatgaaccctattacggcaacagcgcctcgctaaagctgctgacgccgacccaggactcccgggatattatcgccgcggcgacgagctgtctggatgccatctggaaagcggggcatcgctatcagaaggccggcgtgatgctcggcgatttctacagccagggcgtcgcccagctgaatctgttcgacgagcttgctccgcgacacaacagcgccagactgatgcaggttctcgaccagctgaatgcgaaaaacggcaggggggcgctctattttgccgcccaggggatccagcagcagtggcagatgaagcgggagatgctctcgccgcgctacaccacgcgatacggggacctgctccgcgtcagataa

SEQ ID NO: 440 - DNA, 555 bp, Klebsiella pneumoniae
ggtatgctgcccatgatggtcccttttcaactttcgacgctccccgtcacgccgtggaaaaacggcggcggagagacgcgcgaaatcatctgcgtaaccgctccagatgccccttttctctggcgagcgagtattgccaccctgcaggcggatggccctttctccccctttcctggcgtcgaccgggtcattactctgctggcggggcagccgctacggctgtgtggcgagaatatcgaccaaccgctggcgctctggcagccgtgggctttccccggcgaatgggcgctgtccagcgtcgggatcgttgcgccagggctggacttcaatatcatgactcagcgcgggcgcgcgtcggcgacagttcaggtcgttagcgacctgcaatgccctgccagcgagggggtcgcttatgttctacaaggcgagtgggatctggccgggcgacgctgcgcggccggcagcggcctctgctggcgcggtggatccccgcggaatctgcgtcccgtgggcagcaatggacgcctgctgctggcggagatcgcgctcaaataa

SEQ ID NO: 441 - DNA, 1314 bp, Klebsiella pneumoniae
cccacgctgccagcccttgcccgggacctgcagcgtctggacctgctggcgaagcgcttcgctccagctattgcggaacagggcgtaccaggcaaaggcggtgcgggtagaggtgatcgccgtttgctccggggtggcactgcgcggggcgaaggcgctctgcggctgccggtccgccagcgcgctggcataatccggcgcgggctcggcgtagtcggtgctgatcggcggcttgctgaccctcaggctatgacggcgctgctggatttgcatgatgcgccaggcgatctccgcactctgcgcgtcaaagcccagctcaagcccggtgagcaggtacggcaggctgatcagcgaaggttgccgcccccacggcgtgcgcagcccctcgtcgggcaccatgatgccgtcgatgtcgatcatctgctgcccctgcggcgggttggtcaccgccagccccgcggcgctgtcgatcagccgcagcgtatggctggcatacagccggtagccaaagctgtcccgcggttcatccgccgccagcgtccagtggtgcatcggcgccgcggcctggctggcggggctgttgctgatgagcgcgccgacccgccactgattaaacagatcccgcaccgcggcggcgtgctgaggatagcgccagagcagcgtttgcagggcggtgagcaggcgtcccataccgatggcggaggagtccgggttgccgaggatctgcagcgtgtcggcatggtactgagcggcgggcaatccctgggcgttgaggggcagttgaccgagcgtaaacagggcggcggcaatgcgctcatcgccttcggcggcggtcacaatatgcagctgctctgcggcgaccacggcgaaaaaatagctgccgacgctccacaggctaagccagggttcgtcatcctgcgcgttggccagaccgtttggctgagtattattcacataatactgccaggccactcgcgcccagatcgcctcgtcaaaggtcagctcgcgcggggcagggagcggcggaaaatcctggctcaacgtcatcccactgctgctctcgacgcgcgcaggcatttgtttttccacccatacgacaatcgcaaaacccagcaggaagccaatgaggatggtgagatagctgcgggcggagagcagggcgtcgcggatcctcatcggctcgcctcctgctcttcggggggcgtccacatggcggcaaagataagcggcagcatggcggcaatattcaccgcgccccagaaaatgttgatgacgtacccggaggggtcgtcaacctcaccgcgcgccacctga

SEQ ID NO: 442 - DNA, 2265 bp, Klebsiella pneumoniae
cagataatgccggggcccattttttcaaatgaaaacccggggtccccgctgctgaaggggctatcaccaccccaggcgcagcagctgacgaaattcagcggcgatatggccgtcacgaatgcggcggtcagtaagaaggccgagcaaagcgctgtcaccgggttgaccacccggatgacgtctgccgagggtaaactggattcgcagtcgcagcagctcaccagtctgcagaacagcctgaccacgatgaatactgagctgggtaaaaaggctgacacgtccgcggtgagttcactgaccggtcgcgtaagccaggtggaaaacaccatcaccagccagtcgcagagcatcacgtcgctgaccagcaccatcaataccatccgcactcagggagctaatccgtgggttgacggtacgtttgaaagctacagcgatggccaggtgctgggcgggaacggcacagccgttgtggtggcgtctcagaaattcaccggcaataagagcctgcaggtgagtcgaggagcgaacaataacggcaacagcgataaacagcttgggagctggcagtcagtccgtgaggatgcgaagttccggtttgagttctgggctatgatgccggcggatcaggcgccatcctccgggtggacaacgctggtcggcattaactcactgaatgctgccggtcaaaactcctggcagtcggcggtcactgtcagcgaagccgctcttggtgcgcgtgataagtgggtgaaatttacgggtattgccagtaacaacgggggtgggagaacacgcgcagtggtctggatctctacccgtggcgcctccggcagcggcacccccggttattcgctgtatatcgacgatctggttatcacggatgttaccgatgcgaaagctgcacaggatgcctctgacgcgacggcgagtgccgtgagcggtctgacggctcgcgtaacggatgccgaagggaaaatcaccgcccaggcgcagcagcagacggcactggccacgaaagtggataatgccaactcccgcgtcgataacatggcgaagacgctaagcgacagccagagcacacaggccagcctaaatacctcgcttcagtcgcagattgacgcgcaggcggccgccaacatcaaaaaccagacgacgctggacaacacgattaaatcggtggccagtatcaccagtacccagcagacgcatgcaacggcactggaggcgctggcaacgcagcagacgaccctgacatccagtgtcggggatctcagtgcttccgttcagaacaccgccaaaaccgtggcggatgtgaatggtacggtgagttcgctgtggtcgatgaaggttgagacggttaacgggaagaatgttggcgcggggattacgctgggcagcaatggtgaaacgagcgacatgatcctctacgctgaccgcttctcgctgtttaaccgtaataatgcgacggctgttccggtgatggttgccgaaggcaatgagctgtatatcgatacggcacgtatcaaaaacagttccctgacctcaaccaaaatcgcggacggttccatcacgaacgcgaagatcggccacgagatccgctcgaatgactttgttgacgggtcacgcggctggcgtatcgctaaggatggctcttcgcagttcaacaacgtgatcgttcgcggtgcggtttatgcgactgacggctggttccagggtacggtatatgcgaaccacatcgagggcgacatcgggtcatttgcgatcaacatcgctcagcaccgcacgcgcaaggtgccgaaggctacatggcagtggtttgagctggcccggttccggcggcagaatttcgaccaggtgatcaatattcgcggtggactcctccagacggatagcatcactatcgacggcggcgcgaaactcagagcggggatgtcctacgcgccaggggctgacggcggactgaatcctggctatctgtcgtatgcaatgcttcttcgtggcacaggcgctacgtctggtggcggcagtatggagctaggcattgagcttatgtatgaaacaggtggagcaacacgcctgttaacggcgcaagagtcaatgaacgtagacaacatgtcatttgtcgtccctgccggtactggcgacgctgttctgcgatatggctgttacctggaccgtaacggacagatggtattaaccatcctctcaagattcgacgccttcgccgcgcgcaataacaacgtaattcgcggttcatcaacctga

SEQ ID NO: 443 - DNA, 267 bp, Klebsiella pneumoniae
ccccactcgcctgcagcatctgccccaccagcggctgaaccgcgccgttccagtcataatgacgcacgcgcggcgccggctgacccgactgctgatcctgatgctcaatcggcccaggctgcgccgggacagagggcaccgccggtacggtcggcaccgtgggctgcggctgcgcaggctgctgcggctgcggtttggcctcttctaccggcgcgggctgctcccgcaaccccgcacagcctgcgaggaatatcgccagtgctgtga

SEQ ID NO: 444 - DNA, 2742 bp, Klebsiella pneumoniae
gtatctgcgccgccaggcggagctccactatcagaccgcaggtcactgatcatgcatgccgctaaccgtgccgacctcaacgtcctgccttcggcggtgatgatctacgatgagcgcgaacgactgcaggcctggaatgataaggtggcgctgttttatccaacgatcgcgccctggctcgccgtcggcgcttctcttgagagcctggcggagaagtttatcgatgccggttataacattgaccctggccggcaacagacgctacgcgagacgattatccgcaactgccgccaggcgaaccattgcgaagtccgccagtcgggcaaccgccagatttacgttcagcatcagcggctggcggatggtggaattgtcagtctgcataccgacatcaccgagcttgacgaggcccgacgcgcacgtcaccagcttcacgacgattttttattcactgcggagtcgatccagatcggtatctgggactggcaggtctcccacgacaacctgcaggtgaatgacaccctgctggcgatggtcggccagtcgcgggcccagtggcgctatccgctgcgttttatactcaatctggtccacgaggacgatcgcgctaccctgcagcaggcgatgatcgcctcgcaaaacgagcatatgccggtttttgaatgtgaacttcgcgtccagcacccgacgcagggctggcgctggatgctgctctccgggcagattgtcaccctcaatatgcagcagcaggcagagcgggtgatcggcacgttgcaggatattacccggcgcaaagccgcagagctgctggccattgaggcagcgaaggaggcccgcgaggcgaacgaagcgaaaagcgccttcctcgccaatatgagccacgaaatccgcaccccgatgaacggcattctcggcatgacgcagctgtgcctcgacacgccgctgaccgcggagcagcgggagtacctttcgctggtgatgagttcagcccagtcgctgctgcacattattaacgacattcttgatttctcacgcattgagtcgggcaagatgcaggtggacgaagagccgctggagatccgcccctttatccagtcgctgatccgcccgcatatgcccgccgccagcgaaaagggtattgagctgctggtggatatctcccctgcggtaccggaggtgctgatcgtcgatggcccccggctgcggcaaatcctgactaacctgttgggtaatgcgctgaagttcactcatcagggggaagttctgctggcaatagcgccggccgacgacgaaagccgctggcgctttcgcattcgcgataccgggattggcatcgccccggaaaagcaaaaggcaatcttcgaagccttcagccaggccgatagctccaccacccgccgctacggcggcaccgggctgggattaaccatttcggcccgcctggtcagcctgatgggcggcgagctgacggtggagagccagcccgggacgggcagtgaatttgccttcaccctgccgctggcaggtctgcacaccgcctccgctaacgccccgccgggccgcttcaacaatgagcgggtgctggtggttgacgacaacagcaccaacctgcgcctgctcgacaccatgcttcgccagatgggactgataccgatctgcgtggacaacgccagcgaggcgttacgtcgggccgccgaagggccgccctggccgctgatcctgctggatgcacagatgccggatatggacggcgtatccctggcgctggagctttccgccctgcctgaagcccggcaaagccagattattatgctcagctccatgagccgccattttgacgccaatatgcttaagcgcatcggtatcgcccactatctgcataaaccggtggcgcagcgcgaactgcatcaggttatcgccggtattctccttcccacgccggtggtggcgacagcgccagcccccgttgcggaaccggtcagggaccagaccgggctgcatatcctgctggctgaggacaacctggttaatcaaaaggtcgccagacggctgctggagcagttgggtcaccgctgcgaggtggtgagcaacggccgggaggcgctggagcgctggcgcgcagcctgctgggatctcctgctgatcgatctgcaaatgccggagatggacggtgaaaccgccatccgtctgctgcgcgaagagacgccggcgctgggcaggcaacatcagcccgcgatggccatgaccgcccatgccatgcagggcgatagagagcgctgtctggcgatgggcttcgacggctatatcgccaaaccagtgagtcttgaggcgctacgggaagccatcgcccgcgtcggcgcagcggaagatagcgatttggaggaagagaaaggcctgccggacgaggcccacctgctaaaacagtgcgcagacgatcctgagctggtcgaggagctgctgggactcttcgctgaagggcttgatgctgcgatcatcgccctcacccacgccattgatactaatgacagggagacgtggcgccgtaccgcccacaaactgcgcggcgaggcggtcaccctcggctttcaacgccttgccggggtgctccagcaaatggagagccgggcgaagtcgcccggccagaccgtgccagatgacctgcgcgacgcgctggccgaggcaaccacaggctgccaccggtggctacatcgcagatcgcaggaggtcctccgtgatcgttaa

SEQ ID NO: 445 - DNA, 909 bp, Klebsiella pneumoniae
gcgcgcgcgccacggcgatgccgggggaatgcgcggtgcggccttccttcacctgacccattaatcacagaggtagctatgcagtcgcgccgtttacatcgattgagccgttttcgtcgcaataaacgtcggttgcgtgaccgtctgcgtcagcggattttctttagggaggacaggatgaagcctgaagcgatggcaaaaccgagagtggtggtgttaaccggcgcgggcatctcggcagagtcggggatcaaaaccttccgcgcggccgatggcctgtgggaagagcatcgggtggaagatgtggcgacgccggaaggcttcgcccgcgatccggcgctggtgcaggcgttctacaacgcccgtcgtcgtcaattgcagagtccggaaatcaagccgaacgcggcgcatctggcgctggcgcgtctggaggatctgctgggcgaccattttctgctggtcacccagaatattgataatctgcacgagcgcgccggcaaccgccgggtgatccatatgcacggcgagctgctaaaggtgcgctgttcgtggagcggccaggtgctggagtggaccggcgacgtcaccgccgaggacaagtgccactgctgccagtttccggcggcgctgcgtccgcacgtggtctggtttggcgaaatgccgctggggatggatgagatctacagcgcgctggccgacgcagatatttttatcgccatcggcacctccggccatgtctatccggcggctggctttgtgcacgaggcgcgactgcacggcgcccataccgttgaactgaacctggagcccagccaggtgggcagcgagtttgccgagaagcactacgggctggcaagcgaagtggtgcctgcctttatcgataagctgctgcaggaaaacgcgctgtaa

SEQ ID NO: 446 - DNA, 936 bp, Klebsiella pneumoniae
ttaatgtttacaggaaaaatcatggcctgcgtatttaataaacaacttttacacccgcgtaactggctgacctggttcgggctcggcatcctctggttaatcgtgcaactgccttatccgctgctgcattttatcggcaccagcgctggtcgcctttcccgtcgctttcttaaacgccgcgaacatatcgcccggcgtaatatcgaactctgcttcccggacatgtcgccagcggcgcgcgagacgctgatcgatcaaaactttatgtcgctgggaatggggcttatcgaaaccggcatggcctggttctggagcgacgagcgggtcaaaaaatggtttgatgtcgaggggttcgccaaccttaatcacgcgcttagcggtgggaaaggggtaatggtcgtcggcgtgcactttatgtcgctggagctgggcggccgcgcgatggggctgtgtcggccaatgatggccacctaccggccgcacaacagcccgctgatggagtgggtgcaaacccgcggtcgcctgcgttcgaacaaagcgatgatcgatcgcaacaatctgaccggtctggtgcatgccttgaaatccggtgaagcggtgtggttcgcgcccgatcaggattacggtcccaagggcagcgtctttgcaccttttttctccgtcccgcaggcggcgaccaccaacggcacctatgtcctgtcccgcttatcgggcgcgaaaatgttgagcatcagcatggtacgtaagctggatcgccggggctatagcctgcatatcagcgaggtgatgaatgactatccgggtgaggataagcagatcgccgccggctatatcaacaaggttattgagcgcgagatcctgcgcgctcccgagcagtatctgtgggtacaccgtcgttttaaaacccgcccgctgggcgaaccttccgtctattaa

SEQ ID NO: 447 - DNA, 393 bp, Klebsiella pneumoniae
ccggatgttaccagtcttaccggctctcagcggttactgaaggccctggtctcacacattgaggaagcgttcatggaaaagaaacacatttatctcttctgctcggcaggcatgtccacgtcactgctggtctccaaaatgcgggcgcaggcggaaaaatatgaagtcccggtcattattgaagcctatcccgaaaccctcgcgggcgaaaaagggccggaagccgacgtagtattattagggccacaaattgcgtatatgttaccggaaattcagcgcctgctgccgaataaaccggttgaagttatcgactcccttctctatggcaaagttgatggtttaggggtattgaaagccgccgtcgcggctattaagaaagctgcagcacaataa

SEQ ID NO: 448 - DNA, 198 bp, Klebsiella pneumoniae
ggcatgaataccctgtttgcccttgtcatcagcgtttgtgctctcactggtgaatgctctgatgttctgatcggtgtttatccatcagaggccagttgcaacagcaacgccgatgaacaaaaagtacagggccagtgcctcccctaccgaaatgcacaaaacatggctgacgaccaacagcctgcagtgagtttttga

SEQ ID NO: 449 - DNA, 954 bp, Klebsiella pneumoniae
attcaatggttaagtgacgaatatcgagtaacggcattattctaccccggcaatgatcgcccggcgaataccgtcgcccagcaggttgaccagcagtacgctgagcataatcgccgccccggggagcatcacggtccacggcgccacatagataagctccagcgcatcgcccagcatggctccccattccggcgaaggcagctgggcgccgagatcaagaaagcccagcgcggcaatatccagaatggccatcgacagggcgcgagtgatctcggtcaccaggccggaggcgatattgggcaggatggcgaacagcagaatattcagcgtcgaggcgccatcgaggcgggcggcgatgatgtactctttctccagctcatcgtggaccatgctgtagacggagcgcaccatgcgcggcagcagcgccagccagacggcgaacatcgcatggctgagatgcggcccggcaaaggcgacgacgataatcgccagcagcagcgaggggatggagagcagggtgtcgaggatatggttcatcaccgccgagcgcaggccgtgggtcgatccggcaatcacgcccagcaccagaccaaacagcgtggcgccgagggtgacgacaaaagcgccgccgacggtgggcgccgcgccgctcagcagtcggctcagcacatcgcggccgaggtcatcggttcccagaaagaaggagacttcgccatagcgcgaccacgacggcggcaacagctggtagccgaggaactgctggtcgatgccgtagggggcgaaccagccgccgaagacgcagagcagcagcaggcccgcgcagccgtacagaccgatcatcgccgtggtgtcgccatagaacttacgccatacggtgcgcagcgcgccgggcggacgcttttccagataaacgctatcgtagggcataccattccttatgtttcagtgggttag

SEQ ID NO: 450 - DNA, 228 bp, Klebsiella pneumoniae
atctctcccaccgccgttaactgtaaccgtcgcggagtacggataaatagcgggacattcagcgtctcctcaaggcgggcaatctgctggctgacggcgctgggcgtgacgcaaagctcactggcggccagcttcaggctgagcagccgcgccgccgcctcaaagcagcgcaacgcattcagcggcgggagtttcatgggtatggaacctcagttaagaaaaacttaa

SEQ ID NO: 451 - DNA, 246 bp, Klebsiella pneumoniae
ggcagttgcacgattaaccagaggatgccgagcccgaaccaggtcagccagttacgcgggtgtaaaagttgtttattaaatacgcaggccatgatttttcctgtaaacattaattatgtggtaacgcttaaggaaaacagaatccatttatcatcattaggcggtacgtacagcaagttcgacaatactaatccgctgaaattccctccggcaagtaaaaaacagcaagctgacaaaaaaacataa

SEQ ID NO: 452 - DNA, 735 bp, Klebsiella pneumoniae
cttatgtgcacatacgcgagagagcattcatgtaaacagtcagcacaaccacaaaccacgccttacaggatagttgttcacgaatacggacgctatccggtcatcacgggcaacaaatttttccataacggctacccctatcccgtcaacactacagccgaatccggtgtccggttagatatccttaccccgatagccgcagagcttgacgcaatactgagttcttacagtcgtgtttacctcacccgctttgattttcgcttgccagcaggcacacccgtagacaccgccaacgaatgggtaagccagctattcaagaaactacgcgagcggctgaaatcgaaatttcgtagacctgaaggaattgccgatccgatcctcaacttcgcttacggctgggtgcgggaaaaagaaatggcaaaacaggtgcattaccattgctggatagcccttccgcaccggcaggtaaaacgacttggaacgcctacaagtggcattgctggcgctattacggaaatctgggcgaagctatcaggaggtgaaccaacgctggtggagttcccaaaaccaagcgacaggtacacgaagtactatgttatcgaacgaggtaaaccggaaacccttaaggggccgatcctctggttgtcatatctggcaaaggagcgcgggaagtatcagacgggaaaaggtgacaaggttcattcgacctcgcaacttcgaaacaaaaaaccatga

SEQ ID NO: 453 - DNA, 306 bp, Klebsiella pneumoniae
tttttgagcaccttacccgtggcgctgaccggcagcgcatcgacaaatatcacccggtccgggatctgccatttaggcacccgcttctcaaaccagctcagcagatcggtctcctccacttcgcccccttccgcacggacgcacagcagcaccggccgctcgtcccagcgcggatggcgggcggcgatggccgccgcgctgcgcacccccggatgcgcgatggcgatattctccagctcaacggtggagatccactcgccaccggacttgataatatcctttgcccgatcgctgatcaccagataa

SEQ ID NO: 454 - DNA, 933 bp, Klebsiella pneumoniae
cctccagtaaccaggataaagcgaataatggaccggttttcagctctcaaagccttcacccgcgttgtcgaagccggcagctttacccgcgccgcggactcgctgaatatgcccaacgccaccctcagcaaaaccattcagcaactggaagcgcatcttggggtttccctcctgcagcgcaccacgcggcgtattaccgtgacgccggaaggacgggagtactatgaaaaagcccgctgtctgctggaagacctggaagagatcgacgcgtctttcaataccgcccgcaataagccgaagggccatctacggatcgccatcggcgggtcgaccgcgtgcgatgtgctgatcccgctgctggcggactttatgacctcctggccggatatccgtatcgatttgcaggtggccgataagcccgcggacctcatcagcggcaatattgactgcgccatccgcggcggtccgatggaagactcgacgctgatcgcccgtaaaatcggcgaggcgacgctggtcacctgcgccaccccgggctatcttcagcgctacggcacccccgcctcgccggatgaactacatcatggccaccggctcatcagctatctgtcgccggccagcggcagagcgtttccgtttcgctttacgcgtcacggcgtcagcaccgagctgaagacagagccccatctcggcatcaatgagagcaacgcgcatattgccgccggcgaggcgggcttaggcattgtgcagacctttacctattcgctgaaaccggcgctggcgagcggcgaactggtggagatcctcagcgcctggcgcccggccccctatccttttcacgttgtctatgcccggcaccggcacgtcccgccccggctccgcgtctttattgactggctggcggcggtttttccggccgcggtgcagggatag

SEQ ID NO: 455 - DNA, 552 bp, Klebsiella pneumoniae
cgcataccaaccgcgccagcgaacccttacgcccatttactaccgatacggagacccagtatgacaacaaagaaaaaactctctaaccagattacccctgaattgcagagttttatcgataagatcgcagcgaaataccaaccaaacgcagaagttttgcaacgtcgaattgataatgccgaggccagatacaaccgatatcagcaattttccgatatcccggcgcgtttggtgagcacacttcaaaagctgatccttgaaggctggcggttttgccccggtgctaacgcttcagtttttgccaacgcagcgatggtttccgttactctgcaaaagcccgcccaactgatcgcagcggaactaaaagagctacgctcgaaggcctccgactcctataccaatgaactgttctcagcgatggagcgcgagatcgatgaattgatgcaacaagccgccgaggactcccagcggaaagccgaggaacaagcagaagcagaacaggctgcaatgcgggatcgcttacgcactctcctgaacggagctaaagcatga

SEQ ID NO: 456 - DNA, 651 bp, Klebsiella pneumoniae
caaccgccaaccctgctggagaccttcgtgcttgatagccacctgcatccgcgccttaaacccctgctaaacgctgtcgccggcgcccttgaccgccccggcatctcaccggacgggctgacgctggtcggttttgccatcggcgtgctggctctgccctttctggcgctggggtggtatggcgcggcgctggcggccattctccttaaccgcctgctggatggcctggacggcgctctggcgcggcggcgcgggctaacggacgcgggcggctttctcgatattgcgctggattttctcttttacgccctggtgccgttcggctttattctgtcggatccgctgaacaatgccctggcgggcggctggctgctgtttgcctttatcggcaccggcagcagctttctcgcttttgccgccctggcggccaggcaccagatcgccaatcccggctacgcccataaatcgctgtactatctcgggggactgacggaggggacggagaccatcctgttgtttgtccttggctgcctgtttcctgcgcatttcgcctggctggcgtggctgtttggcgcgctgtgctggctgacgacggcgacgcgcatctgcagtggctaccagaccttaaagcgggtaacgaccacagcgtaa

SEQ ID NO: 457 - DNA, 2364 bp, Klebsiella pneumoniae
caaaaaacaaccggttgttttttgtctacagaggagagtcatgtggagcagcatgcaggcgactttagcgtcaccgtacgcgatgtgcgtcagctgacccagccggaaagcgatctgctgacgctgctgtgggtgctggagggaagcgtaaatctggcggtggcggaaggtgcgtcgcagccgctcgtcgccgacgggctggcgatcgttaaccgcaaccgtcgctggagcctgcgcagcgccggggccaacgccgtgatgatcctcaccctctccgccagctggctggcccgcctcgataatgccttttttgccgtcgattaccagataacgccgcgcacccgggatgccgatgacggcctgcgtcgcctgatgcgccagctgctggtgagcggcctggtcaatcatcctggccattaccgactggaggccaaccgctggctgagtgagatagcgctgctgctggccacgcgctttagccagcccatcgcctccacgccccggcgcgataccgaaaaatggagccggagaatagccagcgtggtggcgcggatcgacgctaactatcagcgtcgcctctcgttgcaggaggtggcggccgcggaatttgtctccgaggcctggctgtcacgcttatttcgcaaagaggtcggggtaagttttgtccagtacctcaccgcgctgcgcctgcgccacgccgccgaccaggtattaaccacccgcaaaaccgtccagcaaatcgcccgcgaacagggattcgccagtacgcgaatgatgagcgatttgtttaagcgccagcacggcgtgacgccgcgccagtatcgtgaacagcatcctctggagcttgcccgaccgcgcccgccgcaggccgatcgctggcagccggtggcggccgaccggctgtatgcgcgactcaatgagccggaaccacgcgaccgggaaagtccccccctgccgatcaacccaccgcagacccgggagatcaatctgcgcgatcgtccagcgcgccccgcagcgctgcgccatacccggatggtggtgaccgtgcgcgaactggacgatctgctgcgcgcagatgtgcgccgggaactcgaacagctgcaccacgccctgccggtgtatgccatcgatatcaacgatccctttctcagcagtcggctgttcggcaccggctgggacgatccgcagatggccggctacgcctgctggtacaacctgcagcagatttttagctggctggcggcgatgggctggcaggtgatcctgcacaccggcgtcaccacccgcagtgacctgctgcagcgcttcctgcagctcgccgccaaccattttccgccagccacgctcaacagctggcgctttgtctggcactggtcgccgcaggccagcgaagctgcgcgccaggccgcctggcggcagcagcgcggggtccttcatcgcctgctgccgcagccgcagctggggatctggcaccgctttgctcccagcgatcccgggaacgatccgctgttccactcgccgctgctggcagaggcggattttctcgcctgccaggcagatgccaacgaacagctggatctggcccaggcagacagcagccgcctggcctccagcgaacattacccgctgcacaagctgcggcagatccacagcgccctgcgccagcgtcagctcaacctgccgctgtggctgctctcctggaatacgctgaccggcgatacgcgggataccaacggccgcttttttcgcggcgcgctgctgatggataatctgctgggggtggcggaccaggtctggctggcaggcttctggttaaattcaggcctccagggcgaagctcgcgccaacggcaagctcgatacctccagcctggcgctgcactatctgcacggcctgccgcgcccggtttactgggtactctggctctggcggcggctgcgcggcgagatcctggttcacgataaaaacctgctgctgctccaccaccagggtcactaccagctgctgctgcgcaatacggtggtctacaatccctggctctccagcgaagcggcctttatccagcgcttcagccagctctacagcgtgcggctgcagggcctggatggcagctggcgcatcaaacagcacctgttcgatcagcaccacggcgcgttgttcccgctggtggacgcctttcgcagccgcagcggccctgacgccgaggattatcagtggctgatgcatcaggcccgtccggcgctcagcgtggatgaagccaggctcgatggctattggctgcggatcgactcgctgcagagcaatgcgctggtgctgtatgaatttacccctcagctctcctccggcgcggatcccgccccctga

SEQ ID NO: 458 - DNA, 402 bp, Klebsiella pneumoniae
agcatgacaacaacagatctcgccccaaagggcgaaatggttttacgcaccctggcaatgccggcggataccaatgccaacggggatatttttggcggctggctgatgtcgcagatggatattggcggcgccattatggccaaagagatcgcccagggtcgcgtggtgaccgtgcgggtggatgggatgacctttttacgcccggtcgccgttggcgacgtggtgtgctgctacgcccgctgcgtgaagcgcggcaacacctcggtgacaatcaatatcgaagtgtgggtgaaaaaagtttcttcagaaccgattggccagcgctacaaggcgacggaggcgctgtttatctacgttgccgttgataatcagggaaaaccacgtcctctgccagcggaataa

SEQ ID NO: 459 - DNA, 1179 bp, Klebsiella pneumoniae
tatcttgcaacgatttcagccgcgcgaaaaaaaacggaatccgctgcgcagagaacacaaagcacaaagacttctcgccagcggctgaggtacactgtgcagcaacgtcagtgctttacacaaggtgaaaacgtggaattacttgctcagtacggcttatttttagccaagatcgcgacggttgtcgtcgccatcgcggtgattgccgctattatcgtcaacctcgctcagcgcaagaagcagcgcggcgagctgcgggtgaccaatcttagcgagcattataaagagatgaaggaatcgctggcggtggcgctgctggacggcccgcagcagaagcagtggcataaggcgcagaagaaaaagcaaaaacaagaggcgaaggcggccaaagcgcgggcgaagctgggtaatgccgagccggaaggcaagccgcgcgcctgggtgctggatttcaaaggcagtatggatgcccatgaggtcaatagcctgcgggaagagatcaccgcggtactggcggcggcgaaagcgcgcgatcaggtggtgattcgcctggaaagccccggcggggtggtgcacggctacggtctggccgcctctcagctgcagcgcttgcgcgacaagcagatcccgctgacggtggcggtcgacaaagtggcggccagcggcggctatatgatggcctgcgtggcgaacaaaattgtctcggcgccgtttgcgatcctcggctctattggcgtggtggcgcagatcccgaacctgcaccgcttcctgaagaataaagatatcgatatcgaactgcacaccgccgggcagtacaaacgaacgctcaccatgctgggcgaaaataccgaggaagggcggcgcaagttccgcgaggatctcaatgagacacatcatttgttcaaggattttgtccaccggatgcgtccgggacttgatattgagcaggtagctaccggcgaacactggtacggggtgcaggcgctggaaaaaggtctggtggatgcggttgaaaccagcgatgagctgctgctggggctgatggagagccacgaggtgatcggggtgcgttatcaacagcgtaagaagatgctcgaccgcttcaccggtagcgcggcggagagcgccgatcggcttctgctgcgctggtggcagcgcggtcagaaaccgctgatgtaa

SEQ ID NO: 460 - DNA, 1725 bp, Klebsiella pneumoniae
ctgatggcaacctatccgaacgtcaatgcagcgaaccagtatgcgcgggatatcgttggcgggaagattctggcgtgtcagttaacgatacttgcctgtcagcgacatctggacgacctcgaacgagcaaaggatccccactggccctaccgcttcgataaaaacaaagcagaacgatttcttcgttttgcccagaaaatgcctcatacctcaggggaatgggcccggcgtaaactccggattgaatttgaagcctggcagaagttcgctcttggcgtaccgtttggatgggtacacaagaagacaggcctgcgtcgtttctctgaaatctatatcgaggtgcccagaaagaacgggaaatccgctattgccgctgctgtaggaaattatatgttttgtgcagatggcgagcatggtgcagaagtctattgcggcgccacgactgaaaaacaggcatggaaggtattttctccggcgctgcaaatggtgaaaaagctgccggcattgcggcaaaaattctcgataaaaccctgggcaaaaaaaatgacgcgccctgacggttcggtttttgcgcctgtgatcggtgacccgggggatggtgattcgccatcatgcgccatcattgatgaatatcacgaacatactactgatgcgctttacaccaccatgaccaccggtatgggggctcgtgaacaaccgatgacactgatcatcaccaccgccggctatgacattacatccccttgctatgaaaagcgtactcaggttgtcgagatcctgcggagaacccgtaatggcgaggaaaatgaaaccatatttgggctgatttatggccttgatgatgatgatgactggacgactcctgaggcattaatcaaggcaaaccccaactatggcatttcggtaaaagcagattttctccgggcgaaacaattattgggtatgtcgacgcccgggcagacaaacaagattctgaccaaacatttcaatcgctgggtaagtgcaaaatcagcttattacgacctgagaaaatggatggatgcggccgataaaacccttaagttgtcagattttgaaggggaggaatgctggctgggtatcgatctggcctcgaaagttgacctcaatgccgtggttccggtttttcgtcgtgaaatagacggaataacacatttttactgtgtttctcctctgttctgggcaccggaagaaaccatttactcgcaggagaccgcgctgaagagtaccgcagaacgttatcagtcctttgtccggcaggggaagttgatcccgaccgatggcggtgaagttgattacagactgatatttgaaacgatcctgaaattgcggaataccgtaaaaattgcccaatgccccattgacccttatggcgcgacttcattacgtcacatgctcgaggaagaggggcttgagcctgtcgagataagacaaaattttacccatatgagtgatcctatgagagagattgaggctgcgctcatctcggggagattccatcatgacggacaccctgtcatgaactggtgtatttccaatattgtcggccagtatcttcccggaagtgacgatattgtgcgtcccgggaaggaagggcggcagaacaagatagatggtgcggttggtttaatgatggggctggggcgcgccatgcttaacagttcagtgatgacatccgtatatgatgaggaagatatagcatgctaa

SEQ ID NO: 461 - DNA, 1362 bp, Klebsiella pneumoniae
agaatgcaaaccgttttagcaaaaatcgttgccgacaaagcgatttgggtggaagcccgcaaacaacaacaaccgttagccagttttcaaaatgagatcgttccgacgcagcgcaatttctatgacgcgctggccggcacccgcaccgcgtttattctcgagtgcaagaaggcctcgccgtcgaaggggttgattcgcgaggatttcgatccggcagcgatcgccagcatctacaagcactacgcctcggcgatctcggtgctgtgtgatgagaaatatttccagggcagcttcgatttcctgccgatcgtcagccaggtcgcgccgcagccgatcctgtgcaaggacttcaccatcgacccttaccagatctacctggcgcgctactatcaggccgacgcctgcctgctgatgctctcggtgctcgacgatgaacagtatcgtcagctctcggcggtggcgcacagcctgaatatgggcgtgctgaccgaagtcagcaatgaagaggaactggagcgcgccatcgccctgaaggcgaaggtggtgggcattaacaaccgcgacctgcgcgatatgtcgattgaccttaaccgcacccgtcagctggcggcgcgtctcggcccggatgtcacggtgatcagcgaatccggcatccatacctatgccgaagtgcgcgagctgagccacttcgccaacggcttcctgatcggctccgccctgatggagcaggcggatctggaagcggcggttaaacgcgtgctgctcggcgagaacaaagtgtgcggcctgacgcgcccgcaggatgcccaggtggcctgggagtccggcgccatctacggtgggctgatcttcgtcccgacctcgccgcgagcggtaaatgacgcccaggccaaagcggtgatcgccgctgcgccgctgcagtacgtcggcgtcttccgcaatgcgccgctggaggaggtggtcgcccgcgcgcaggctctggggctggccgccgtgcagctgcacggtgatgaagaccaggcctatatcgacgcgctgcgcgacgccctcgcggacaacgtccgcatctggaaagcgctgagcgtcggcgaaaccttcccggcccgtacgctccgccatgtcgacaagtacctgctcgacaacggccagggcggcagcggccagcgctttgactggagcctgctgcagggccaggatctgcgcaacgtcatgctggcgggcggcctcggcgccgataactgtgtggaagcggccaaaagcggctgtgccggactcgatttcaattcaggcgtagagtcgcaacccgcgattaaagacgccagcaagctggcctcggtattccagacgctgcgcgcatattaa

SEQ ID NO: 462 - DNA, 417 bp, Klebsiella pneumoniae
acaatgaaaactccaatccaaatgcttgaagtgtttgtatcagacataatagaaaacactgttcttctggaggagatctataaaaaaagtaacgagaattacgaaacggattgttctataaacagcctaattcgttcaatgcgaaagaccgtagataacatgaacggatatattaagagtcatattaattcagtcaaaccctgcatacctgtagcggccagaaacgatctgactgatgatatattcgatgtgattcttactgctaaaaaacttgaagcagtcgcgcaaacttatagtgagtctttttttactgacgaggacaatgacaaccccgcgtgccatatgtcagctgtgatatttgactatgctcgtgaactttgcactgatcttaaggctatcgagaataaaataggctaa

SEQ ID NO: 463 - DNA, 1197 bp, Klebsiella pneumoniae
gtacagaaaactaacatggcaatcagtgacacaaagctccgctctatctatggtaaaccatattccgggcctgctgaaattacggattcagacgggcttggaattcgcataacccccaaaggcgtgatcagctttcagtttaggttccgatgggaagggaagcagaaccgaatggggctcgggcgttacccagcgctgaccctgcgcgatgcccgcaatatcgttgcagacctgagggagtcggcagacaaaggcattgacccccgaacgctggctggtggcaacaaatccaagagtaagccaacggtaaaggattgcctggattactggaaagaaaattacgtggacgtaacgctaagagctaagacgatagcgctttataaatcaacggttataaagcatatgcgcgacgcttttcccggcattccggttgaggatatccctgtccgcttgtgggtagagaggtttaccgaagaggagaaaatcaaccctcgccgagcccggcatttattgatacagctcaggtctgccattggttggtgtacgcgccgacaattcattagcacaaccgaactcatgcttttgcagccgaaagatatcggtgttaaaccggtgattggggagaccacgctcagctataaccagcttgccaaaatctggatggctatagaaagaagtcgtgggtcaacttctaaccgattgcttcatcaactgctaatgctgtacggcgccaggaatagcgaacttcggctggctataaggggggagtttgaccgagaggaggggttatgggttgtgccggcagagaaaagtaaaaccaacaaaattatcaggcgccccattttctccgccgcagatgatttgctgaaaaaagctgaaatgacgtatggggatatacttttccctggcgaggatctgaaaagccccattactatttctggtgcaaataaatttctcagaagaatcaaggactcgttggggtttggtgagtttacttcacatgattttcggcgcacattggcaacccggctatccgaagagggtgttgctccgcacgtcatcgaaaagatgctggggcatgaacttggcggcgtgctttctgtctataacaagcatgactggattgccgaacagaaagacgcctatgatctgtatgctgaaaagatattctggcatatcaggatgatttctggttga

SEQ ID NO: 464 - DNA, 702 bp, Klebsiella pneumoniae
atgcctgaaaccagaactatgaggattgaaattatgggtattttttctcgttttgccgacatcgtgaacgccaacatcaactccctgctggagaaagcggaggacccgcaaaagctggtgcgtctgatgatccaggagatggaagacacgctggttgaggtgcgttcgacatcggcccgcgcgctggcggaaaagaaacagctgtcccgtcgtattgagcaggcggtcgcccagcaggcggaatggcaggaaaaagccgagctggccctgcgcaaagagaaagaagatctggcccgggcggcgctgatcgaaaaacaaaagctgaccgaccttatcgctcagctggatcatgaagtgcagctggtcgatgaaacgctggcgcgcatgaagaaagagattggcgagctggagaacaaactcagcgaaacccgcgcccgtcagcaggcgctggcgctgcgccatcaggcggcgagttcgtcccgcgatgtgcgtcgccagctggacagcggtaaactggatgaggcgatggcgcgctttgaatcctttgagcgtcgcatcgatcagatggaagcggaagcggagagccatcgctttggcaagcagcagacgctggatcagcagtttgccgaactgaaagcggacgatgaaatcagcgagcagctggcggcgttgaaagccaaaatgaatcagtccaaccagtaa

SEQ ID NO: 465 - DNA, 312 bp, Klebsiella pneumoniae
aaaccccgaactgctggccgcagtggaaaaagtgaagcaacacgcaatcggcaagctggaggaagcggaaaaaaactgagtgactcgccctggctggagctgattttctggctggccgaccgctggggcgagcctgacccatccaaaattgccgcgttgccggcaaacactctgtaccactggcgagcctacttcctgaaacagggcactttccgccgtcctggcgatgaaaacgcgccaccaaccgaaaccacacctgcgccatcccgggtcgatgatgaatgcgcggcagtcatgagggcattaatgtaa

SEQ ID NO: 466 - DNA, 354 bp, Klebsiella pneumoniae
aaaagaggaaccaaaatgaacaaaagcttagcaggaatactgggcgtcaccgtcgcgttaaccttactggcgggctgtaccgcttacgatcgtaccaaagaccagtttacccagccggtggtgaaagatgtgaagaaagggatgtcgcgtcagcaggtgatgcagatcgccggcaaaccttcaacggaagtcaccatggtccatgcccgcggcacctgccagacctatatcctcggtcaacgagatggtaaagttgaaacctactttgtggccctcgacgaaacgggtcacgtcatgaactccggctaccagacctgcgccgagtatgataccgacccgcgcaacgccaggtaa

SEQ ID NO: 467 - DNA, 852 bp, Klebsiella pneumoniae
gccatcgcgacgatgaggcagcccagaatgatgaccaccgagatcagtaccgccagagaacaacagctgttcaacgggaagaactttcatgtggtcatctataacaaaacggaaagcgtgagcgggcttcaccagcatgattactacgaatttaccgtggtgttaaccgggcgctattaccaggagatcaatggcaaacgggtgctgctggagcgcggggatttcgtctttatcccgatgggctcgcaccaccagagcttttacgagttcggggcgacgcgcatccttaacgtcggcatcagcagacgcttctttgagaaacactacctgccgctgctgccgtttggtctggtggcttcgcaagtctacgccgtgcagagcgcttttctcggctacgttgagtcggtcatcgcctcactcaattttcgcgaaacggaatttgacgaatttatcgagctggtctccttttatgtcattaaccgtttacgccactatcgtgaagagccggttgccgacgtgacgccgcaatggttaaaaaataccgtggaagccatgcatgataagctgaaattcggtgaaggcgctctcgaaaatatggttcgcttatccggaaaaacgcaggaatatttaacccgggcgacccagcgctattatggtaaaacgccgatgcagataattaatgatatccgtatcaactttgccaaaaaacagctggaaattaccaattattcagtgacggatattgcgtatgaatcaggttacagcagcccgagtttgtttattaaaacctttaaaaaactgacgtcgtttacgccgagcagttatcgcaaacatttgaccagtattaattaa

SEQ ID NO: 468 - DNA, 1074 bp, Klebsiella pneumoniae
caaaaaattgctcaaaccgattcgcactacaggcaggaaggcgacacggacgcgatagctccggttagcgggaagacccggtacgccgaagctggccgactcagccaacaccaggctcgcgtgaagagggaagagcagaaccagaagcgctcgaaggagaggttaatggaaagcaaagtagtagttccggcggaaggtcaaaaaatcaccctgcaaaacggcaaactgaacgtccctcacaatccgattatcccgttcattgaaggtgacggtatcggcgttgacgttaccccagcgatgctgaaagtggttgatgccgccgttgagaaagcctataagggcgagcgtaaaatttcctggatggaagtttacaccggtgagaaatcaacccacgtctatggccaggacgtctggctgccagctgaaaccctcgatctgattcgtgactaccgcgttgctatcaaaggtcctctgaccaccccagtcggcggcggcattcgttctctgaacgtggcgctgcgccaggagctggacctctacgtctgcctgcgtccggtacgttactaccagggcaccccgagcccggttaaacacccggaactgaccgacatggttatcttccgtgaaaactcagaagatatctatgcgggtatcgagtggaaagccgactctgcggaagcagacaaagtgatcaaattcctgcgcgatgagatgggtgtgaagaaaattcgcttcccggaacattgcggcatcggcatcaagccgtgctctgaagaaggcaccaaacgcctggtgcgcgccgcgattgaatacgcgatcaccaacgatcgtgattccgtcactctggtgcacaaaggcaacatcatgaagtttcaccgaaggcgcgttcaaagactggggctaccagctggctcgcgaagagttcggcggcgagctgatcgacggcggtccgtgggtgaaaatcaagaacccgaacaccggcaaagagatcgtggtgaaagacgtgatcgccgatgcgttcctgcagcagatcctgctgcgtccggcggaatacgacgttatcgtcctgtatga

SEQ ID NO: 469 - DNA, 483 bp, Klebsiella pneumoniae
tcagtttatttcgatagtgtcaaatcattcgatatgaggcctgaagaaaaaatctgtataatctttctcatgtgtttgtttgggtggatgaagatgaactttggtgttcgactgcaacgagtcttagatgagataggaatgtctcaatcagaactggggcggaggatcggtgcgacatcccaatcagtgaatggctggtgtcaggctggaatccttcccaggaaagaaatgcttgagcaacttcctgatataacaggaaaacctttgtattggtttttcatgacagatgaagacgaagagacgctgcagccgccaagatcggaagatatctatgtccttaccccggagaccaaaaagctcatagaaatttacgatcagcttcctcaagtggagcaagaacgattcgtcgggttaatgcagttaaggctggaagaactcgatgctttcatgaacgaatatttaatgaaacgaaagaaagactag

SEQ ID NO: 470 - DNA, 363 bp, Klebsiella pneumoniae
tgcggccctgcacgccttgtcggcggcgcgccagcgctgggcggaaacctcagtgaaccgtcgtctggcgctcctgcgccagatcaaggatgccctggccggcattgccccggcgtgggtggccgcggcagcggcggccaaagggctgccggcgggcgatccgctggcgggggaagagtggctggcgggcccctgcgcgctaatggtcggctgcaacgggcttatcgccaccctggagcaactggaggagaagacctttctgcggcggatcccgctgcggacgctggcggacggccgcctggcgctgcgggtggtgcccggcacgctctgggatcggctgcttctgtctggtgttcgcgctga

SEQ ID NO: 471 - DNA, 480 bp, Klebsiella pneumoniae
tcgtcaactgcaaccgccacggcggccaggaagtgtaccatatccatatgcatctgctgggcggtcgtccgcttggcccgatgctggcgcacaaaggctaacgtcatgctcaggacccttttgggcgcgtgtctggcggcggggctactcgccgggtgtagttcacacccggaaatcccggtttctgaccagcaggcgctggtgatggagtcgagcgtgctggcggcggggatcagcgccagcgagcctgccgtcgtggcgacagagattcaggctaccgcctcctcaacgctatataacgagcgccagcagccggttaccgtgcactatcgttttttctggtatgacgcccgagggctggagatgcatccgctggacgcgccgcgcaccatcgtggtaccggcccgctcctcggtcacgttatatggcagcgccaatatcctgggggcgcataaggcccgcctttatctttatctgtaa

SEQ ID NO: 472 - DNA, 615 bp, Klebsiella pneumoniae
acgatggctgccagaccacgtaaaaataatatatctattccaaatttatacccgctcttcagcagaaaggttaataaagtatactggcgttataagcacccgataactggtaagtttcatagtctaggaacagacgaagcagaggccacggcaatagctattgaagcaaataaaagactggcggaacaacaaacccgccagataatggcaatcactgacagaatttccaccagctcaggaaaatcaatatcaactaacacctggcttgaacgttactggaagattcagcaggaaagattgaagtccggagatattaaagaaaacactatcaaacaaaaagcaaaaccagtatctctgcttaaggagcgggtaggaatgaaattaatatccgctgtcaatgttcgagatgttgcgcaaattcttgatgaatatttagcggagggacaacccagaatggctcaggtcattcgctctgtcctaatagatgtttttaaagaagctcagcatgcgggagaagtacctcctggttataaccctgcactagcaactaaacaacctcgtagaaagatcactcgccagcgcctcactcttgagggaatggcaaaagatttttga

SEQ ID NO: 473 - DNA, 819 bp, Klebsiella pneumoniae
tcgcattattttgaacctggtcggggagtgcgaagaatgaaactggaagcctccctcaaacactttagccctcagggcatgcacatcagcgacgacgtgaaaagcacatcgccgaatcgcctgaatggcacagacattatgaccgggatcggtgtgaccagcagcagggcacgcttcggcctggccgctttcttcggaaaggctggtatcagcaaaacggatgaacagcttgcaattcaggcgctggcgcagtttgccatcaaaaacgctcctaaaaatgtccgcaaagccgccggtgacaagctcggcgcctgcatgttgacgctggcacaatttgcctttgcggagtactcacgttcggcggacaccagcgcaacgtgtcacagctgcagcggaaccggctttatttccagccatgaagatgtaattaagcaccctggtattttcgatgctgacggtgtcgaagtgaaggccccaaagattagaaatgaactggtgaaaagggtctgtggagtgtgcggaggaaagaaagtgatccatgcgcgatgcaggtgtagtggtaaaggggaggtcttagatcgcaaagcgaccaaagaacttggcgcaccggttttcaaaacatgtgaacgctgctctggtaatggcttctctgttgtaccctctgcgacggtacaccgcgccattctgaagcgtctcccggatctccatcagtcttcgtggtcacgcaactggaagccgttctatgaagggctggtggatatgcttcacaaaggagagagacaggcagcggctgaatttgagaaggcgaccatttattga

SEQ ID NO: 474 - DNA, 861 bp, Klebsiella pneumoniae
gggtcttgtgcttaccgtaacgaaggaaaagaaatgaaaaaagcaattatggcttcaattatcgcactctctgccatcggccttgttggttgcgatcgagttgagcccggcaacgtgggtatcaaggtgaataagttgggcgacgataaaggcgttggtgaagtcgtcggagtcggccgctactggaccggctggaatacagaggtttatatctttccgaccttcaagcagatgaaaacgtatgatgacgctttcaacttccagatgagcgatggcaccaccatcggctaccacatcggggtcgcgtacaaggttgatccgaccaaagttacaaccgttttccagacctaccgtaaaggcgtggacgacatcaccgacaccgacctgcggcagaaaattgctgacgcccttaatcgtctcgcaagtcggatgagcaccgataaattcattgacggcgggaaagctgagctgcttgaaaacgcactgaaagagatccagtccgatatggggccggttggtatccaggtgatcagcctttcttacgttggccgtccggaatacccgccgacagtgatcgaaagcatcaacgccaaagttacggccaaccagaagacgctgcagcgcgagcaggaagttaaacaacgtgaagctgaagccaacatgttgcgagccgaagccgatggccaggcggatgcaaagctgaaattggctgaagcagaagcaaagtctatccagatccgtgggcaggccatgcgtgagaaccctgaggtactgcaactggaggccatcaacaaatggaatggcaccctgccccagtacatgagcagcggaacaaacaccccgtttatccaggttaaatga

SEQ ID NO: 475 - DNA, 1275 bp, Klebsiella pneumoniae
atctcctgtgccggagacatccccaaagccgccacgcgcctgcgggcggctttgtcttgtcggagagaaataatgtctgcattaggtcacacccgggcacactggagcggcgtcctggcgatgacgctctgcgtatttgtgctcattgcctcagaatttatgccggtcagtctgttgacacccatcgcgggtgatttacacattaccgagggattagccggtcagggcattgcgctttctggcgcgctggcggtactgaccagcctgacgatatcccgtcttaccggatcgctggaccgtaaatggctgctgctggggctcacggcgttgatggcagcctctggggtgattattgccctggcgtccagtttcccggtttatatgctgggcagagcgctcattgggatcgtcatcggcggcttctggtcgatgtcggcggcaacggccattcggctggtgccgcaacgccaggtcccccgcgcactggccatctttaacggcggcaacgcgctggccaccgttgtggcagcgccgctgggcagctacctgggggctaccgtcggctggcgcggcgcctttttatgtcttgtcccgctggcggtgctggccttcgtctggcaatgcattagcctgccgtcgatgaaaagtccgcgcgcaccacagcggcagggatcggtgctgcgtctgttccgtctttctacgctatccctgggattgctggcctgcggactgttctttatgggacagtttaccttatttacctatgtgcgaccgtttctggagacggtgacccaggtcagtccttctggtctgtccctgatattgctgacaatgggtatcgccggttttatcggcacgctgcttattacgaccgttctgaatgcccgattttatccgacgctggtggctatcccgttgttaatggccgcaattgccggaacgcttctgctggccggacaccacacgggatcggtcgccgtactgttaagcctgtgggggctgctggcgacggcggcgcccaccggctggtggacatggattgcgcggacgctgcccgaggatgcggagacgggcggcgggctgatggtcgccgtgatccagctatcgatatccctcgggtcaacggtaggcggcctggtgtttgatagtctgggatggcacagcacttttgcactgagcggtctgttactgctgggcgcggcaggggtgacttttctgctctctgtcaaaatcagatcatctcagcgcactgcgattaatgaattgaatgcataa

SEQ ID NO: 476 - DNA, 1617 bp, Klebsiella pneumoniae
cgcatcctcgcgaccaccggcgggttactgcggcggcggcgcggtatcgtctgccgcttttttgcctttcggcttccctttacctttgctgaacgacttcttcgccccgcccggcgccaccaggccgcggaactgacgcaccggcgtgctgcgcgcctgatcgatcagttgatacagcgtccccaccagcggctgcataaagtcctgatagcggcactgtttctcgctgatctgcgtcaacaccgactcccagtgggcggtcatgtccggtcgcccggccatctccggcagggaatgaatgagcgccctgccggcctccgaagagtggatatagcgcccctttttgctcaggaaaccacgcttgaacagcagctcgataatccctgcgcgggtcgcttccgtgccgaggccgtcggtggcgcggaggatcttcttcagatctttatcctgcacgaagcgggcaatcccggtcatcgccgacagcagcgtggcgtcggtaaagtggcgcggcggctgggtctgacgctccaccacctcacccctctcgcacagcagttcatcgcctttggccaccaccggcagcggcgtgccgtcgttctcttcatcgcgctctttgctgccaagcagcgtccgccagcccgcctcggccagaaaacgcgccttggcgacaaacttgccgttggcgatctcaagatcaatctggcatttgcggaacactgcgtcagggcagaactgcatcagatactggcgggcgatcagggtgtacaccttcgcttcgttatcggtgagcttcacctggctgctgcgggcggttgggataatcgcatggtgcgcgtcgacctttttatcatcccagcaacggttgcggatctccggatccactaccggctgcggcagcaggtccgccgcatggacggcaatcgcattcaacaccgcatggcggccagcgaagtgctcttccggcagatagcggctgtccgaacgcggataggtgatgagtttgtgggtttcgtacagcttctggcagatatccagcacgttctgcgcgctgaagccgaaacgtttggccgcctcaatctgcagcgccgacagcgagaacggcagcggcgcgggttcggaatcgcgcttatcgttatagccggtcacgattgccggctggccttcgatgcgcttaaccacatgctcggccagcggacgatgcagcaggcgcccttcttcatcctggtaaggttcgcaggcttcgctcggcacccaggtggcgacaaaacgctcctcctgcggcgtgacgatatgcgccttcacgtcgaagaaatctttggcgacgaaattttcaatctcttcatcgcgacggaccaccaggccaagtaccggggtctgcacccgccccaccgagagcaccccctgatagccggcgttgcgccccagcagggtgtaggcgcgggtcatattgatgccgtacagccagtcggcgcgggcccgcgccagcgccgacacgcagagcggcacgaactcgctgttggcgcgcagacggttgatcgcccgctccaccgcctgcgggttgagatcgttaatcagacagcgctgcacctgctgacgcttctccggcgccagctgtag

SEQ ID NO: 477 - DNA, 573 bp, Klebsiella pneumoniae
gagatcgtcgccatgagcttacccccgctggattccgtccccctgatccttcgtccgcaggcctggctgcaccgccggcattacggccaggtgctgagccccattcgctggtggggacggatcccatggctgttttacctggtttcgctgttcgtgggctatattgaacgccgccgctcgccgctggatccggtgctgcgctcgctggtcagcgcccgcatcgcccagctgtgccactgcgaattctgtatcgatatcaccagcatgaccctcgcggcgcggagcgggagccaggacaagctgctggcggtcgccgactggcgcagcagtacgctgttcagcgaaaaagagcgcctggcgctggcctatgccgaagccgccacccagacgccgccggcggtggatgatgccctgcgtagcgcgatggccgcgcattttgacgcccgggcgctcaccgagctgaccgccctgatcggcctgcaaaatttatcagcgcggttcaatgccgcgatggcgatcccggctcaggggttgtgccagatacccacctcttcctcgcagaataaggagtaa

SEQ ID NO: 478 - DNA, 957 bp, Klebsiella pneumoniae
ttatttcccgccgcgcgggatgacctggaagacaacatgacaacgaaattaattaacctgccgcacctggcagatatggtctttggcgtgccgcattacgtgacgcggcaaacaatggactccgtgaaagcggtgctcatcccccgtattcaggggatcaccgaagatgccgtcattcagatggcgctgaatccgggtaaatcacctgcagctgagcaggttcagcccaccggcggggtggcagtgatccccgttcacggcattcttgttccacgccgggggcagattacggcgatgtgctccgagctgaccagctacgagcggatccgcgggcagctgcaggcggcattaaacgacccctcaatcagcgaaatcgttctggatattaactccggcggcggcgcagcggtggggtgcaaggagctggccgattacatttatcagtctcgcgacacgaaacccatcacggcgattgtgaactacagcgcgtattccgccgcgtatttcatcgcatcggcctgcagcaaaatcatcgtcagccagaccagtggcgtggggtcgattggtgtgatcatggagcacctcgatacgtcgaagatggaagaaaaaatggggctgacgttcaccaccatttaccggggagataacaaaaataacggcacccaacatgaaccactgagtgaagagtcgctgggtatgttccagggcatgatcgacgaaatgtacgagacgtttacggggtcggtggccgaatatcgcggcctgaatcagcaggccgtcattgatacgcaggcggggctgtattttggccctggcgctgtgtccgccggcctggcggatgaagtctctgacccccaggcggcgatcaatgctatcgcggcaaagtatcagcaaccccgtcaaaaaacctccattcagatgcaggcagccgcgatggatctgcaaaccaaaatgtaa

SEQ ID NO: 479 - DNA, 198 bp, Klebsiella pneumoniae
gcaatagccgccggtaaacggcggcatttttccatgccgcgcgatcctgagcggatggcgcaggcaggattaattgatcgcagcggcgagatcttttttcaccagctcgcgcagctcagaaatcagcacctggcttacgtcgaaatggcgatcggggcgttacgcatgggggtatttacagggaatgatccttcataa

SEQ ID NO: 480 - DNA, 189 bp, Klebsiella pneumoniae
ggcgaagccgccatccggcactttgtggtttcgatggcggcaatgtcttacccgagcattatcgcctctcgcctgcatcaaattcgcttacctcacccgcccaatccgacggataccatccccggcgcacatcgcgatgaaaggtcgaatacggccaatcctgcacccgacggacatgaccgtgcttaa

SEQ ID NO: 481 - DNA, 219 bp, Klebsiella pneumoniae
tcaaaacacgctccccctgtatcacacccgacgggtacggctagtcgcccgtcgggtcatcggctttctccccgctatactgaatctattctagcgtccgcacgccgtcgccgtttggtcaaccgcggccaaacagagctgactggcgatatcggcgataaaaagttaccatgtttcaccatacagactcggttccggcgactttttttaatcaattga

SEQ ID NO: 482 - DNA, 1752 bp, Klebsiella pneumoniae
aagagcggcgcactagcaaactggtacacggtatcccggcaagaggtcaggaatgtttcttcctggaagagtagaactcaaaaagggctgacaatgcttaacatcacaccgaactttgcacaggaacgtgggcttaacatgctgcggcgcacctggaaggcgcacgattccttcatggtctacgcaccgaccggaagcggcaaaacaggcctggctgcgtttatcgccgccggcctggttagtcgtggtatgcgtgttctgtttgtcgccccgtatacgatcctgattaaccagaccgcccagcgctttacagaatacgggttgccggaagaccagattagttttatctggcgtgatcacccgaactacgaccctaatctgctgatccagattgcgagcgctgacacgctcattaggcgtgaatttcccaaaaacatcgatctgcttattgtcgacgaggcgcacctacgtaaacgccgtatcctgaaagaaatcgaacggatcacagcggagaaaaaagcgaaggttatcggtttatctggtaccccttttgcgccgttcctaggccattactatcaacacctgattaagccaacgacgattggcgaattgatccagcgtggtgacctcagtaagtacgaatttttcgccccaacaaaaccagatcttagcggggtagaaacaaagccatctatggagttcggtactgattacgacgagtcccagctggcggaaatcatgtgcggttctgacctggtgggcgatatcgtcgataactggcttcgtcatggtcgtgaccttcctacggtggcgttctgcgttaacaaggctcacgcaaactttgtaaccatgcagtttaacaaggcgggtattaatgctgaggtcatggtcgcagaaacaccccacgaagaacggcaggtgatgattcatcgcttcgagactggcgccacaaaaataatcgtcagtgttggtgttttggtagccggttttgatagcgatgttcgctgcattatctacgcccggccgacaaagagtgaaatccgctggttgcaggcgcttggccgcggactgcgaactgcacccgggaaagatgcctgcctgatttttgatcacagtggcactgtgcatcgcctcggcttccctgactccatcgaatacgacgatctgccatccaaaaacgacggcatgaaagcggccgctgccggcgcaactaaggaacgcgaagaaaaacttccgaaagaatgccccgaatgtcatttcatgaagccatccggcgtttacgtctgcccaaagtgcggatttaaaccgctcgttggtcaggacgtcgagactgacggcacccgcaacatcaaaaaaatgagcaagcacgaaacggtttataccaaaagcgacaagcagtcctggtggagtcagatcaagttttaccagcgtcatcgtgcggcgcaggggaaacctgtcagcgatggctggtgtgctcatacctttcaggagaaattcggcgaatggcccaacggcttaagcgactttccaatggagatcacaccggaggtcagcaatcacatcaaacacaaacttatcaaatttgctaaacgccgcgaacgcctgcagcagatggggaagaaacctgaccaggatctatttccacctccgagcgccagtatcaactatgagcctcctgagggcagcgacgggcaattaattatcgaagcaaaacgaaaactccagaaaaacgtaaatagtgcgagtcagtga

SEQ ID NO: 483 - DNA, 1401 bp, Klebsiella pneumoniae
aggacaatagcgtgcaaacctgcgttaccgcaaagaaatcggcgcctggcgagcggagaatacgccctccactttttaccgtcgggcatttcgatgaaacgtgtttctcaattgaccgcactcgccctgctcatggggcttgctgcttccactacctgcgccgctgaaaccatgccagcgctcactctctcccacctgcaacagcagcacggcgtggccatcgacacccggctgagcgcttattacaacggctggccgcagcgcgccaacggcccggaaggccatgagccgcaggccctcaatctttccgcccactggctcggcgccatgagcgacgatcagctgcgcgcctgggctaagcagcaccagctccagtccgatacccccatcgcgctgtacggcagcccggaggataacgtcagcgtcgcggcgcggctgaaacaaacgggtttcacccggctcagcaccctgagcgatgcgctgagccagaccgaccgtctgcaaaagctgccgcactttgaacagctggtctacccccagtggctgcacgacctacagcaagggaaagcggtcgccgccgccccggcaggcgactggaaagtgtttgaagccgcctggggagcgccgaagctctatctgctgagccatatccctggcgcgggctatatcgataccaatgaggtggagagcgaaccgctgtggaataaagtgtccgacgcgcagctgaaggcgatgctggcgaagcacggcatccggcatgacaccacggtgatcctctatggtcgcgacgtctacgccgcagcgcgggtggcgcagatcatgctgtacgccggggtcaaagacgtgcgcctgcttgacggcggctggcagacctggtccgacgccgggctgccggtagagcgcggtatgccgccggcgcagcagccggcgcctgatttcggcgcgccgatccccggccagccgcagctgatgctggataccgaacaagcccgcgggctgctgcatcgtcaggacgcctcgctggtcagcgtccgctcgtggccggagtttatcggcaccaccagcggctacagctatatcaagccgaagggcgacatcgctggcgcccgctggggccacgccgggagcgactccacgcacatggaggatttccataacccggacggcaccatgcgcagcgctgacgatatcgctaccctgtggcgccagtggaacattctgccaagccagcaagtggcgttctattgcgggaccggctggcgggcctcggaaacctttatgtatgcccgcgccatgggctggccgcacgtcgcggtgtacgacggcggctggtacgaatggagcagcaacccgcacaatccggtggcccgcggagagcgcggcccggaaagcagtcagtaa

SEQ ID NO: 484 - DNA, 477 bp, Klebsiella pneumoniae
cctgctgcagcgcttcctgcagctcgccgccaaccattttccgccagccacgctcaacagctggcgctttgtctggcactggtcgccgcaggccagcgaagctgcgcgccaggccgcctggcggcagcagcgcggggtccttcatcgcctgctgccgcagccgcagctggggatctggcaccgctttgctcccagcgatcccgggaacgatccgctgttccactcgccgctgctggcagaggcggattttctcgcctgccaggcagatgccaacgaacagctggatctggcccaggcagacagcagccgcctggcctccagcgaacattacccgctgcacaagctgcggcagatccacagcgccctgcgccagcgtcagctcaacctgccgctgtggctgctctcctggaatacgctgaccggcgatacgcgggataccaacggccgcttttttcgcggcgcgctgctgatggataa

SEQ ID NO: 485 - DNA, 555 bp, Klebsiella pneumoniae
gcccggcaagcgcagcgccgccgggcaaaagcgataaggctaatactgaggagggaacctcacatgtctgattatcgtcgcagttatatccctggcggctgctggttcttcaccgttaacctgcaaaatcggcgcagcgatctcctgacgcggcatattgttcatctgcgtgccgctacagcgtctgttaaaagcaaaaaaccttttctgattaacgcctgggtggttttaccagagcatatgcactgcatctggaccctgcctgagggggataccgattattccggtcgctggcgggacattaaaaaaatgtttacccgagcgctggcgcagcgccatatctggcagccgcgattctgggaacatgccatccgtaatgaagaagattaccggcggcatatggattacgtttatatcaatcccgttaagcacggtcatgtccgtcgggtgcaggattggccgtattcgacctttcatcgcgatgtgcgccggggatggtatccgtcggattgggcgggtgaggtaagcgaatttgatgcaggcgagaggcgataa

SEQ ID NO: 486 - DNA, 291 bp, Klebsiella pneumoniae
cgcgacaaagcgctggcatgggtggatcggaatatccatgtccctttgacccttccacaaaaagtaggcattgcctcgttctgtccatacaacatcgggcccggaaaatgcttcccgtctacgttctatcagcggattaacgccggtgatcgtaaaggcgcatgtgaagcgattcgctggtggataaaagacggagggaaggattgccgggtgcgctccaataactgctatgggcaggtaacacgccgagatcaggaaagtgcgctgacatgctgggggatagatgaatga

SEQ ID NO: 487 - DNA, 471 bp, Klebsiella pneumoniae
aaaggaaaagcgatgtttaaacctcatgtcaccgttgcctgcgtggttcacgcccaggataaatttctcatcgtcgaagaaaccattaacggcaaagcgctgtggaaccagccggcgggccatctcgaggccaatgaaacgctgctgcaggccgccgaacgtgaactgtgggaagagaccggcattcgcgccacgccgcagcacttcatccgcatgcatcagtggctggctcccgataacaccccgtttctgcgcttcctgttcgccatcgaacttagcgatctgtgcgccactgaaccgcacgacagcgatatcgatcgctgcctgtggctcagtgctgaggaaattcttaacgcgccgaacctgcgctcgccgctggttgccgaaagcattcgctgctacctgcaggacccgcggcagccgctgtcgctgattggcgcatttaactggccgttcacagggggtgaatga

SEQ ID NO: 488 - DNA, 951 bp, Klebsiella pneumoniae
tttatgaaagcagcagtggtttttgatctcgcagaaggcccggtttgggccgattttatcgacccgcagcccgcgcccggccagacgctcattgacgtccgcgccgccgcgataagccatgtggttaaggcccgcgcatccggacgccattacagcttcgacggcaatctgccctttgtgcccggtatcgatggcgtcggcaccacacctcagggccagcgcgtctacttcgccttccccaccgcccccttcggcagtatggcgcagcgggcgccggtcgccctgcagaattgtctgccgctgccggatgcgctcgatgatatccaggcggcggcaatggccaaccccggtatgtccgcgtgggcatcgctggtgacacgcgcccagcttcaggccggcgaaacggtgctgattaatggcgccaccggcagcgccggtcagttggcggtacagattgcccgctatctgggagcgaaaaaaatcattgcaaccggacggaatgcgcagacgctggcggcgctggacgccgatgagtgtattcagttaaccgctgatgataaaaccttgagcgggcaattttcagcggtcagcgccgcgcagatcgatgtggtcatcgattacctgtggggacacagcgcggaattattattgccggcactggcgaaatatacccctgccggcagtccggtgcgctatgtgcaggtgggttccctggctggcgccgatatcgcgttaaatggcgcagtgctgcgttccgccccgctcctgctgatgggcagcgggatcggtagcctgtcggtatcgcaactgctggcggcgaccggtgaaatgctgcaggcggcggtgccggggaaattgaccatcgccaccaccccgcggccgctgcaggagatcgcggcggcctggccgcaggacgacagccagaagcgcacggttttcaccctcggataa

SEQ ID NO: 489 - DNA, 1551 bp, Klebsiella pneumoniae
cgcgctggagcaggaatggctgcgccgctacggtacccactgatcctgctggcctggggggcgatggcggcgatctatctgccgctgctccccgccgccggggaactggtgggcgctgcgcgctccccggcccactggcgggcgctgttcgccgacccgcagctgggccaggcgctggccgccacgctcgtctccacgctgttgtccgtcggcggcgcgctgctgatcgccctgaccatcgtcgccgccctctggccttcggcccgctggcggcggctggcttcccgtctgccgctgctgctggcggtgccccatctcgccctggcgacggcggcgctgctgctgttcgccgaagggggctggctctggcagcagttgccgtttctgacgccgccggtcgaccggtacggcattgggcttggcctgacgatggccctgaaagagagcgcctttgtgctgtgggtgatctatggcctgctgggagagaaacgcctcgccgaccaggcgaccgccctgaagagcctcggctacggccgctggcagtgcctgcgttggctggtgctgcccgccctgctgcccgccctcggcatggtgctgctggccaccaccgcctggagcctgtcggcggtagacgtcgccctggtgctggggcccggcaatccgcccaccctcgccgtgctggcgtggcaatggttaagccagggcgatgagctgcagcaggccaaaggggcgctggccaacctgctgctgatggcgatcctcggcgggctggcgctggtcgcctggggcgtatggcggctacagcgccagtaccagcccgatctgcgcggtgttcgtcacccgcatcctcatgccctgcccggccgcctgctggcggcgctgctgccgctgagcggtctgctgggcgcgctattgctggcggggctggcgcgctcggcgccgccgcagatggatgccctcggcaacagccttgggctggcgctggcggcctgcgccctcggcgcggctgtctgcctgctgtggctggcctgcggcccggcgcgaggcgatggctgggtctggctaccgctggtcctgccggccctgccgctggccgacggccagtaccggttggcgctgtatgcctggcttgacggtgactggtggaccgtcctgtggggccatctgctgtgggtggtgccctggatgctgtttattttgcgcccggcctggcgccagcgcgatccgcggctgacggttgtcgcccgcacgctcggctggggatccacgcgtattttctggttgctgaccctgccttcgctaactcgcccactgctgaccgccctggcggtgggcttctcagtgagcatcgcgcagtatctgccaacgctatggctgggggctggccgaattccgacgctcaccagccaggcggtggcgctcagcagcggcggcgaggcgcagacgctcgccgctcaggcgctgtggcaattactgctgccggcggtatgctttaccctgacggctctgctggcctggctggcaggccgctatcgacgaggacttcgctag

SEQ ID NO: 490 - DNA, 801 bp, Klebsiella pneumoniae
aaaggtggagctggaatgatcggtcgactgctgcgcggcggctttatgaccgccatctacgcgtatctctacatccctattattattctgatcgttaactcgtttaaccggtcgcgcttcggcatcaactggcaggggttcaccaccgactggtatagcctgctgatgaacaacgatagcctgctgcaggccgcccagcactcgctgaccatggcggtgctgtcggcgaccttcgccacccttatcggctcgctgaccgccgtggcgctgtaccgttaccgctttcgcggcaaaccgtttgtcagcggcatgctgtttgtggtgatgatgtcgccagatattgtgatggccatctctctgctggtgctgtttatgctgatcggcgtccagcttggtttctggtcgctgctgttttcgcatatcaccttctgcctgccgtttgtggtggtcaccgtttactcccgcctgaaaggctttgacgtgcggatgctggaggcggcgaaagatctgggcgccagcgagatgaccatcctgcgcaaaattatcctgccgctggccctgccggcggtagccgctgggtggttgctgagcttcaccctgtcgatggatgacgtggtagtctcctcgttcgtgaccggtccggggtatgaaatcctgccactgaagatctattcgatggtcaaggttggcgtttcgccagaggtgaacgccctggccacgattttgttggttctgtcgctggtgatggtcatcgccagtcagttaattgcacgtgataaaactcaggggacgttaaaatga

SEQ ID NO: 491 - DNA, 681 bp, Klebsiella pneumoniae
gtatatttggccgcgctgaaaaaccataatgaggaagtggatatgaagaagttagcagcggcggcattgattcttggcacgctttctaccggcagcgtctgggcgcatgaggcgggggagtttttcattcgtgccgggaccgccaccgtccgaccgacggagggctctgacaatgtgttaggcagccttggcagtttcaacgtcagtaacaatacccagctgggtttaacctttacctatatggcgaccgataacattggcgtggagttgcttgccgcgacgccgttccgccataaggtcggcaccgggccaaccgggactatcgccaccgtccatcagctgccgcccaccctgatggcgcagtggtactttggcgatgcgcaaagcaaggtgcgcccgtacgtgggggccggtatcaactacaccaccttctttaatgaagactttaacgacaccggcaaggcggccgggctttccgatctgagcctgaaggactcctggggcgcggcggggcaggtcggcctcgattatctgattaaccgcgactggctgctgaatatgtcggtgtggtacatggatatcgataccgatgtgaaattcaaagccggcggcgtggaccagaaagtcagcacccgtctggatccgtgggtgtttatgttctccgcaggctatcggttctaa

SEQ ID NO: 492 - DNA, 381 bp, Klebsiella pneumoniae
cccgcgatggccggctgggcaaatggatctggcagcaggcggaagaagatagcctgccgctggaagagatcgcccacgagctggcgtgtcagtaccatcgttttgtcgaactcttcggccatgagccgacgcatatcgacagccatcaccatgtgcatatgttcgcccagatttatcccatcgtcgcggcctttgcccgcgagaagggcattgcgttacgcattgaccgccaggtggcggcgcagagtgggctcgaccagcaggcggcgcgcagcagcgccggcttcagcagcgagttttacggcgaagcggtctctgaggaactgtttctgcagacgctggatgcctccatcgcccgcggggagcgctccctggaggtga

SEQ ID NO: 493 - DNA, 297 bp, Klebsiella pneumoniae
ggtccagtggcttgcctggtttattttgaggatttggctgtgagtaaaaaacaagaaatgccgaacaccggctacgcaattatcagatgcgacgatggggtgatcgttgctcgtctgacatcctttcctgtgtgtgagcgcgctctgatgtaccggcgcggcgacactgtttcgtttatgcctttgcagccggatgagatcgtggggactctctctcttttttcacagatgattgaaaaggctaagtctggagttggttaccaggttcccccaggttctgttacaatcccgtcatag

SEQ ID NO: 494 - DNA, 459 bp, Klebsiella pneumoniae
agatatccggctggctattcagtttctggtcagcgatgcgtatctgaatggccataccggacagtggctggaaaccgctgcggtgaggcatcttcttttccccctgcaggagcatacgctatgagcctgaaaccgggtgatatgaactgtcgcattgcaattagctacgttcagtccggtcgtgggccgctgggcgaaccgctcccggaaaagcaggttgaatcgggaaaagcgtgggcaaaacgggagctggtatcggggcgaaaagtccgcacgctggatcagcagcaggtggtggaaacctgcctgtttacggtctatccgggcgtgctggttgatattgactggaaaatcacgacgaaaaatctggtttataccgtccggaatatcgaccgcaaaacagaccggatcattatcacgggggaggctgacgggcggcatgatagagctggcgattaa

SEQ ID NO: 495 - DNA, 576 bp, Klebsiella pneumoniae
gtacgcccggcaaaatcctctcgttatcctggtgggaagatgaagcatcggtggccaactggcagcaaaatgagcggcatctggctgcccagcgcgaaggcaaagcatcgattttttcatattacagaatacgcgtcgcccgcgtgttccgggattacgcatcggatcggggagcacagtcagatgtatgacattcacgtgattctcagcaactcgccgggctcgcttggcgcaatgggtatggcgctgggtaacaacggcgtggggctcgaaggcggtggcgtattcaccacgcctgatgccggacatgcgcattttctggtggaagacggtgagacagcccgcagggtgctgaccgaggccggctttacggtcagcaatgtatgccgtcctctgatacgaaagttacctcaggaacgacctggggaactgggagacatcgcggacaccctggcccataatggtattaatattctggtacagtacagcgaccactgtaaccggctcattctccttaccgatgatgacgcccgggcagcggaagtgaccaaaaaatgggccatactttctgaatga

SEQ ID NO: 496 - DNA, 1158 bp, Klebsiella pneumoniae
tacgcagcggctgccccgtctcccggggcagcctttttccctctcctgccaacactgccacaaagcccgcgaccgacgctgtattttttcctgcgtctctttatactgcgcctgtctacgaccaacctaagcgatgctatgcaaaaaaaatcgatttacgttgcctacaccggtgggaccatcggtatgcagcgctctgaacacggctatgtacccgtttccggccatctgcagcgtcagctggcgctgatgccggagttccatcgtccggagatgccggacttcacgatccatgaataccatccgctgatggattcatccgatatgacccccgaggactggcagcacatcgccgacgatatccgcagccattatgaggagtatgatggctttgtgatcctccacggaaccgacaccatggcgtttaccgcttcggcgctgtcgttcatgctggaaaaccttggcaagccggtcattgtgacagggtcacaaatcccgctggccgagctgcgttccgatggtcagattaacctgctcaacgccctgtacgtcgccgccaactatccgattaacgaagtggcgctgttcttcaacaatcgactgttccgcggcaaccgcaccaccaaagcccatgccgacggcttcgacgctttcgcctcgccaaaccttgccccgctgctggaggccgggatccatattcgccgtctcggtactccgccggcgccgcagggcagcggagatcttatcgtgcaccccatcactccgcagccgattggcgtggtgacgatttaccccggcatctccgccgacgtggtgcgcaattttctgcgccaaccggtgaaagcgctgatcctccgctcctatggcgtcggcaatgccccacagaatggcgagtttattcaggtgctggcggaagccagccagcgcggtattgtggtggtcaatctgacgcagtgcatgtccggaaaggtgaacatgggcggctatgccaccggcaacgccctcgcccaggcgggggtcatcagtggtttcgatatgacggtggaagcgacgctgaccaagctacactatctgcttagccagcagctggacattgacgccattcgcgcggcgatgcagcaaaatctgcgtggcgaactcacccccgacgaggcttaa

SEQ ID NO: 497 - DNA, 1584 bp, Klebsiella pneumoniae
tacgaacaggcgagaacaataatgcaaacatccaaaccggcactcgagcttctcaccagcgacgccatctaccgggagaacccgacggcgttattccaccaactgtgcggcgcccgtccggcgacgctgctgctggaatccgctgacatcgacagcaaagatgacttaaaaagcctgctgctggtcgatagcgcgctgcgcattacggcccttggtgacactgtcactattcaggccctctccgccaacggcgcggcgctgctggaactactggacggcgcgctgccctccgggatcaacaatcagcgccagcccaacggccgcatcctgaccttcccggccgtcagcgccctgctcgatgaagacgcccgtctctgctcactgtcggtgtttgacgccttccgtctcctgcaggagctggtgagcgttccggacaacgagcgcgaagcgatgttcttcggcggcctgttcgcctatgacctggtggccggttttgaagatcttccccagttgcaaagcgacaccgcctgcccggactactgcttctatctggcggaaaccctgctggtcatcgaccatcagaccaagcatacccgcattcaggccagcctgttcaccccgcaggagagtgaaaaacagcgcctggagcagcgcctgagccagttgcgtcagcagctgaacgagccgccggcgccgctaccggttaccaccgtggccgaaatgcgctgcgacgttgaccagagcgatgaagagtacggcgcggtggtgcgcaaaatgcagcgcgcgatccgcgccggggaaatcttccaggtggttccttcccgccgcttctcgctgccctgcccatcgccgctggccgcttatgatgtgctgaagaagagcaaccccagcccgtacatgttctttatgcaggacaatgatttcaccctgttcggcgcctcgccggaaagctcgctgaagtatgatgccgtcagccgtcagattgagatctaccccatcgccggcacccggccacgcggccgccgcgccgacggctcgctggatcgcgacctcgacagccgcatcgagctggaaatgcgcaccgatcataaagagctttccgaacacctgatgctggtggacctggcgcgtaatgacctggcgcgcatctgcaccccgggcagccgctatgtcgctgatttaaccaaggttgaccgctactccttcgtgatgcatctggtctcccgtgtagtaggcgaattgcgtcaggatctcgacgtcctccacgcctatcgcgcctgcatgaatatgggcaccctcagcggcgcgccgaaggtccgcgccatgcagctgattgccgccgccgaaggtaaacgccgcggcagctacggcggcgcggtgggctatttcaccgcccacggcgacctcgacacctgcatcgtcatccgttccgcctacgtgcaggaaggtatcgctaccgtccaggccggagccggcattgtgctcgactcggttccccagtcggaagcggatgagacccgaaataaagcccgcgcggtgctgcgcgccattgcccaggcccatcacgcgaaggagattttctga

SEQ ID NO: 498 - DNA, 408 bp, Klebsiella pneumoniae
ctgatgcaggcatttcaccagcgcggaatccaccactacatcgccgaccgccccctcattgcgcatcaacaggacggttttcgcagacgacaaatctaccggctgacggcgtcggcgatcccagagtgctttcgccacccccacccgcagggcattacgtactttcttagtaaagtaattccgccgtctgttgagctcccttattttattaaatttcttgcgtggggaaccctgcatggttgcatcgtgcatcatcctaacctcattacggcaattattaatattctgtgtcgtccgatagagactgagcgaaataaaaaaagttcgattgaaaatgaaaatcattcttttttttatttacaaaactcatctgcgcctgcgggattgcaccacagcactgtgaagtaa

SEQ ID NO: 499 - DNA, 1128 bp, Klebsiella pneumoniae
cgcagcagggcattatcctcaaccacgagtacgcgcatggctgttctccctagcattttcgatagtagtctgacgctcattatatacgcaaaatataaacggctgttaaataaagctttttataaaaagggcccctggtgcccccgggctggccagcattcggcggcgccctttgcgcatactgcatggaactccttcattctatgcgtaatttcagtaaacgcccagcggcaggatgcgaacggcgagcgggttggtgatgttaattttttgtgtaatagtgctggaataacccctcaagaacgtcgcaggttatccattatgtctcagcagcagagcgcggactgggtcaggctggcgcaatcgcccagccggacggaacgcatcgaagccttcttcggcggccacggctacgaaccgcaccggcatgatacctacgccatcggccagacgatcgccggcgtgcagagctttcactatcgcggcggactccagcacagcctgcccggcggaacgatggtgcttcatccggacgaaatacacgatggcgaggcgggcaccgaggcggggtttcactaccgtatggtttatatcgaaccggcgctgatccagaagatactcggcggcaggccactaccgtttatccccgacggcctgtcggcggatccacggctacgtcgcgccgcgcagccgctgttgaaagcggtcacggataccttcgagccgctggaggaagaggatgctctgtacgacctggcgcagaccctggccgttgtcggcggccaacgttcccgtcgccaggcgtttgattatcaggcggcggagagggcccgggagtatattcatgcctgttttatgcaggatatgaccctcgacaccctgtcgcaggtcagcggccgggaccgctggagcctgagccgggatttcagaacgctgtacggcaccagcccgtggcgttacgtcatgatgcgtcggctcgatttttgccgccagcggatgcgcgccggggaacgtctggtggatattgccgccgacgcgggctttgccgatcagagccacatgacgcgccagtttatcagccgctttggtctctctccgggccgctggctgcgggcgatccgcggctag

SEQ ID NO: 500 - DNA, 213 bp, Klebsiella pneumoniae
gcctggagggctgagtcgatgattgcttacttacgcgttgttctatcggtggtgattgtcgccagcgtttatgggctgttcgttccgatcctcatttcgatgaaggacacgacagcagttatatccggttttgccctggcgattctgaccccgccgtgcatctacgccatttgtaagggtcttgtgcttaccgtaacgaaggaaaagaaatga

SEQ ID NO: 501 - DNA, 684 bp, Klebsiella pneumoniae
aggttccttttcccgtcaggagttaagggattcagcccgttggaaaacggtgagtgcccagctggagcagcttcatgcgcgctggcaagaggcgaagtccgcgtaacgctctacggggcgttgttgtctggtgaggatgcgatgattatctatttacacggttttgactcgaacagccccggtaaccatgagaaggtgatgcagctgcagtttatcgacccggacgtgcggttgattagctacagcacgcggcatcccaagcacgatatgcagcatttgctgaaagaggtcgataaaatgctgcagctcactgccgatgaccggccgctgatctgcggcgtcggccttggcggctactgggcggagcggattggttttctgtgcgatatccgccaggcggtgttcaatccaaacctgtttccgcatgagaacatggaaggcaaaatcgaccgaccggaagagtatgctgacatcgccaccaagtgcgtgaccaacttccgcgagaagaaccgcgatcgctgcctggtggtgctttcccgccaggacgaggcgttggacagccagcgttccgccgatctcctgcaccactattatgaaattatctgggatgaagagcagacccataagtttaaaaatatctcgccgcatctgcagcggctgaaagcgtttaaaaccctcggctaa

SEQ ID NO: 502 - DNA, 204 bp, Klebsiella pneumoniae
atccgtaatttcagcaggcccggaatatggtttaccatagatagagcggagctttgtgtcactgattgccatgttagttttctgtactcaccattttggtattttatgtacttattctgtactcaatatcgcatgaacgaacataaacaacaatatcaaatcatgtacaaccatgttcataacttgacagaaaaaaagaaataa

SEQ ID NO: 503 - DNA, 927 bp, Klebsiella pneumoniae
gctttttcttatcaatttgtagggaggagtccgaccatgtccttgcgagcgttacgccattttgtggtcgttgccgaagagttgcatatgcaccgggcggcggagcggttacatatcgcccagcccgccctcagtcagcagattaagcagcttgagcagcgcctgggcgtggtgctcttttcccgcgctaaccgccgtctgactctgaccgccgcgggcgaggcctttttacacaagacgcggctggcgctggaaatggccgatcaggcggtgctggacgcccagcgcatcgcgcggggcgagcaggggaggctgcatttggggtatgtctccagcgcgatgtacgacagtaaactgccggggctcctgcgccggctgcgcgccgactggccggggattgagctgtcgctggtgcagggggatgtgcaaatgctctacgaagcgctgttggatctgcgtctggatatcgccatcatccgcgcgccgctggcctcgccgccggacgcgctggtggtcaggccgtttgtacgtgaaaagctctgcctggcgctctatcaacagcatccgctggccggcgtgggcgcgcttaatctggcctcattgcgcactgacaactggatctcgcttgacgatccgcagggcaccggactggagcaggtttttatggatgcctgtcgcgtcgcgggctttacgccgcaggtggcgcagcggattaacgacgttacctcgatgattagcctggtctccgccggggtgggagtggcgttggttccgctctcggcgcgggccttacgccttgataacgtggtgtatatcgatctccaggatcggctggcggagagtgagctgagcatggtttaccaccgccatattcgttcggcggtggtaaggaaagttatctcgctgcttaataccgctgagcgatag

SEQ ID NO: 504 - DNA, 690 bp, Klebsiella pneumoniae
ccacttacatattttggagttatggtaatgagaaaccgtttccccgtgacgctttggctgacgctagtcgcgttagtcgccgcgctggccctgcccgcgcgcgctaacacctggccccttcccccgccgggcagccggctggtgggtcagaatcagtttcatgtggtacaggatgacggcggttcgctggaagcgattgccaagaagtacaatgtcggcttcctggccctgctgcaggccaatcccggagttgacccctatgttccgcgcgccggcagcgtgctgaccatccccctgcagacgctactgcccgatgcgccgcgcgaagggctggtgattaacctcgccgaactgcgcctctattattacccgccgggcaagaatgaagtgaccgtctacccaatcggcatcggtcagctgggcggaaccaccatcacaccgacgatggtcacaaccgtgtccgacaaacgggccaatccgacctggacacctaccgccaatattcgcgcgcgctacaaggctatggggattgagctgccggcggtggtgcctgctggtcctgacaatccgatgggccatcacgccatccgcctcgccgccctatggcggagtctatctcctgcacggcaccaatgccgatttcggcatcggtatgcgcgtcagttccggctgcattcgtctgcgcgataa

SEQ ID NO: 505 - DNA, 1140 bp, Klebsiella pneumoniae
aaggctgcatatttccacgatttgcaatttcaagcgataaacgcgttttcgtctggtgatgctccacgctacgagcaaataatggatctcttttccaaagagaaagctcgcataacagctgaactgtctcctttcgaaccttcagcgcaaactacctccctgctcctatcagaagcatgggggatgttcaccgcagaaaagggtaaaggctgggctgctaccattgccaacgagaatcagcgttattacgacgttttgatatatgttgttggtgaccttcctgtttcttcaatcagtaagcaaaatattcgacagacattggaagtcgtcaaaaacctcccacgtagaaataaaaaaccttactcagagtggacgcttgagcagtgtgttgaagctgatatcccggaagatgatctgatcagtagtgccaacgtaaaaaaacacctcaagatctattcctcatttttcaaggtgttccttaaagatgaaaaggacattttggaaaaagcgccaactgaggggatcaagtatgaggtgcaggaaaacaagagcggtcattactcgcggcctgagatgaggcgcttcgtcgaacggctgaacaccttcacggattggcggcgggattacttcctaactttgatttatacgggagcacgacgaggtgaaattgctgccattcgtaaagagcagttccgtaaagatgaggagacggggcgttattacatttttatcgctgatggtaaaactgaacatgctcagcggcagatacctgtgagtagaacacttgaggcccttttggttgagcgagttaaaaacatcaaatcttctgcactcgttttcggtgacttgccaccatacgaacagatcgggattgaatggtacagcttaatggagtcctgccaggtgctgaaatacaacgaattcggacaacggcgggttatccatgcactacgccacaccttcatatctgaagcgatagccaaaacacataacgccgcgcttgcgcaatttgttgttggtcatagtcgtacccaatcactaggtatcacggcgagatatgctcacaggccgctgcttaaggatcttctccctgttgtggactgcattcaatggtacacagcaactagtatttcctcctga

SEQ ID NO: 506 - DNA, 2070 bp, Klebsiella pneumoniae
atggaaaaatatgtgatgtattttcatataagggatatctttatgtcaaagatagattttgagaagttgtccgaagaatgcaaaggatataaagtcacgagcttactggatgccttgccagattatgctgaaaacccttcgttaagaaatttgattgaatatgaaacggtgaatattaaaaacttacagatacataatacaaaaaatagaaaaaaaagagatgattttttcgatgcattaatttccaacattaacaaccaagaggctacggatagattaaagaaaatattatcagtgtgccatatatctgaaatctatattgacagcatcaaagaagaattaaagtcatccccgctcatgtcgcaagactttaaaatacagtgttgggctgtaattgaaaaagccttagatgaaggttactatcttttagaccaaataaataaaagcattgattattatggtgagaacgcaaaacatttgactttaaataatagaaatattttaaatgaaaatggtgagtcattttcacctgactcagccttagataaaattgttaattatttaacattaactatcaaaatgctatcccacgaacatggcttttcggcttcaggagaaattataattccagagcgtattgatgttgaagaatctgccattgctggagcaaaccaagtattctattattcgttactctggaacgaactgctaacctgtgcggaaagttgcattttatttgataatgaaatccagattgctggattagaggatctgaccgacgagtttaaagaagatggtgtggaacagggggttttattcaatagaaccaaagatgaatttgaacggtatgatacaatatctaacgaaaggctctctaggcgcataagtcaaaattattgggaggccatggcagattacaatttagaacgcagaatacctaaatatgtaactgactggtcaggaactttaaatcaccctattacttttgaagagttaccattcctggtttcacttatggaagccattgcaagtcatgatccagaacaaatagttttaggacttagtctgcgcgaatgggttagaggttattctgttatatcctacctggctaaggaaattaaaaataaagttctttacaccaaaggcgaactgatgagtatgctgctgctgggtggatttaaggagaaaaaagctgaagagtttattaaacacatcaccttcggtgtcgatagtcgagatatttatgactcaccacttgtgaaaacatccaactctttatttttcctgtatacgccagcacacatctccccacttatcagtaatataatactttcgaaattctcatccaaacaagcagacctcacaaaaaaaggatacgggtttgaaagagatatcatcgagaaattaaacgaaaacaatctagaaaatagaagttttaaattcaaacgtgatgccgatgagtttgaatatgatgctattttcttgctggatgataaagcctttatattagagtgtaaaaacaccaatttatcgggaggatcagtagcaagagcctatcaaaagaaaatttttattaatgaaacaataaaacaagtcaaaagactcgtttgtggtctaacttctcacccggaagtgtttaaggaacattttgataaagatatcagtaattatgagttggtaccagttataatgaataatttgccgttttcaatacctggaaaggtgaatggtgtttacgtaacggattcatctgcgtttgggaggcttataaaatcgagatatattaactcaggcttaataagtcatcaaggtaggtttaaaattacagataataagcctgctttttcaatgtggaagagtgatgttctaacagcttcagacatcattaaccacttcaacgaaccagtgcaattacaggattttctaaaacaccaaaaaaccaaagaatatctattaagaataaataaaagcaaggtctttttaaatgtggtaaatgaaactgattacgatacaatgagtgctgagcatagtgagttttttattaatgcacaaacgactcagaaagcatag

SEQ ID NO: 507 - DNA, 1953 bp, Klebsiella pneumoniae
ccacgaaaatacctaattatgtttcaggataacccgctgctagcgcagcttaaacagcaactgcattcccagacgccgcgcgcggaaggggtcgttaagggcacggaaaagggctttggcttcctcgaagtggacgctcagaagagctacttcattccgccgccgcagatgaaaaaagtgatgcatggcgaccgtatcgtcgcggtgatccattctgaaaaagaacgcgaaagcgccgagccggaatcgctggttgagcccttcctgactcgttttgtcggtaaagtccagaagaaagacgatcgcctcgctatcgttcctgaccatccgctgctgaaagacgccattccctgccgcgccgcccgcggcgttgagcacgattttaaacagggtgactgggccgtcgccgagatgcgccgtcatccattaaaaggcgaccgcggattttacgcggagttgacccagttcatcacttttagcgacgaccacttcgtcccatggtgggtaaccctggcgcgccataatcttgagaaagaggcaccggacggcgtcgccaccgagatgctcgacgaggggctgacgcgccgcgacctaaccaccctcgacttcgtcaccattgacagcgccagcaccgaagatatggacgatgcgttgtatgccgagtccactgctgatggcaaactgctgctgacggtcgccattgccgacccgaccgcctggattgccgaaggcagcaagctggataacgccgcaaaagtgcgcgcctttaccaactatctgccgggcttcaacattccaatgctgccgcgcgagctgtcagacgatctctgctccatgcgcgctaacgaagtgcgcccggtgctggcctgccggatgactctgggggccgatggcaccatcgaagacaatatcgagttttttgccgccaccatcgaatcgaaagccaagctggcctatgacgacgtctctgactggctggaaggccgcggcagctggcagccggacagcgaggcgatcgcgcagcaaattacgctgctgaaggacgtgtgccagcgtcgtagcgaatggcgtcagacccatgcgctggtgttcaaagaccgtccggactaccgttttgttctcggcgaaaaaggcgaagtgctggatatcgtcgcggaaccgcgtcgcattgccaaccgcattgtcgaagagtcgatgatcgccgccaacatctgtgccgcccgcgttctgcgcgacaagctcggcttcggcgtttataacgttcataccggtttcgacccggcgaacaccgagcagttggccgccctgctgaaaacccatgatgtgcacgtcgacccgacggaagtgctcaccctggaagggttctgcaagctgcgccgggaactggacgctcagccgaccggtttcctcgacagccgcattcgccgcttccagtcgtttgcggaaatcagcaccgagccgggcccgcactttggtcttgggcttgaagcctatgccacctggacctcgccgatccgtaagtatggcgacatgatcaaccaccgtctgctgaaagccatcattaaaggcgagaccattgcgcgtccccaggatgaagccaccgtgcagatggcggagcgccgtcgtctcaaccggatggccgagcgcgacgtcgccgactggctgtacgcccgtttcctcaacgataaagccgggaccgatacccgcttcgcggcggagatcatcgacgtcagccgcggcgggatgcgcgtgcgtctggtggacaatggcgcggtcgcctttattccggccccgttcctccacgccgtgcgcgacgaactggtgtgcagccaggagaacggtaccgtgcagatcaaaggtgaagtagtctataaagtgactgacgttatcgatgtcactatcgctgaagttcgcatggaaacccgcagcattattgcgcgtccggcggtctga

SEQ ID NO: 508 - DNA, 1008 bp, Klebsiella pneumoniae
ctggtggaatatatgactatcaaagtaggtatcaacggttttggccgtatcggtcgcattgttttccgtgctgctcagaaacgttctgacatcgagatcgttgcaatcaacgacctgttagacgcagagtacatggcttacatgctgaagtatgactccactcacggtcgtttcgacggtaccgttgaagtgaaagacggtcatctggtcgttaacggtaaaaaaatccgtgttaccgctgaacgtgacccggctaacctgaagtgggacgaagttggtgttgacgttgttgctgaagcaaccggtatcttcctgaccgacgaaaccgctcgtaaacacatcaccgctggcgcgaaaaaagtcgttctgactggcccgtccaaagacaacactccgatgttcgttcgcggcgctaacttcgacgcttacgctggccaggacatcgtttccaacgcttcctgcaccaccaactgcctggcgccgctggctaaagttatcaacgacaacttcggtatcgttgaaggcctgatgaccaccgtccacgctaccaccgctactcagaaaaccgttgatggcccgtctcacaaagactggcgcggcggccgcggcgcagctcagaacatcatcccgtcctctaccggcgctgctaaagcagtaggtaaagtactgccagaactgaacggcaaactgaccggtatggcgttccgcgttccgactccgaacgtatctgttgttgacctgaccgttcgtctggaaaaagcagcgtcctacgaagaaatcaagaaagccatcaaagccgcttctgaaggcgctatgaaaggcgttctgggttacaccgaagacgacgttgtttctaccgacttcaacggcgaagtttgcacttccgtgttcgatgctaaagcgggtatcgcactgaacgacaacttcgtgaaactggtttcctggtacgacaacgaaaccggctactccaacaaagttctggatctgattgcccacatctccaaataa

SEQ ID NO: 509 - DNA, 435 bp, Klebsiella pneumoniae
gcaatgatgtataaacgcacggatctgacgctctccatgttctatgcatccagcgctgatgcagacgggaacaaagtggctacgttgacaatgcaggttattgcggcagaggctggagccgtccagaccagccaactgctatgcatcaccgatagcgcgaagaaaaaaacgtatagcgtaggtgaacaatctgtcagtaatggttccgatccgttgctggtcgcgattgagaattactggcgtcagagtacggatactgccgttaaaggtttgatcgccgaggtgaccgacttcatcgcggggaacatcaactcagtgagcacctggatcggtcagtttgggatgaaggtgttcgagaatcagccattagatgaacggctaccagaaagcgtactgcaggccgatggaggctccgctacagcgacaggatcctga

SEQ ID NO: 510 - DNA, 252 bp, Klebsiella pneumoniae
gatagtcagtacacaaatggcagcacccggtcacatgcttttgtaagtatccctgcaaaacaaaccatcatttttttcaggatctctggcgcaccagattccgctcttggcacacaggggacgtcctgggcccgggaggactcccctggacgcatgggccatattgaccatcatgattttttatggttttgtgaagataaaaacaacgacagagccaaaaagactaaaattgaagaggagcactaccattag

SEQ ID NO: 511 - DNA, 1536 bp, Klebsiella pneumoniae
gatatggattttgaaaatgaattgaccagtaagatccttgatcccattcacggcactattcgtttgacgacactcgagattgcctctatcaatcaccccctgttccagcgcttacgcaacattaaacagaactcttttttatataaggtgtttccctctgcggtgcacagccgcttcgaacactctctcggggtgctgcatttatcaagtgaaatactcaataatttacgcctgaatgcgatacggtatcaaaagaaatatgatgatggccatgtgtttggtcatatcgatcagataccaaaacacaacattcaggagttgagactcgctgccctgatgcatgacatcgggcacgggccggtatcccaccagtttgagagttttatgcctggtaagcacgaattctccgatgttctccccacggcctaccattcaatcattgatgtattaagcaagccagaacagaaagttgaacatgaacagctttcgctgttgttcagcctgatgatttatcatgatctgagaaaacaaggtaaggtcgatgacgaaataaatatcgaaaatgtgttaaaaatcatcgaaaaaagatacggtgaccaacagatcattgaggaaattaatggaaaggcaacagatatcctgccgttaatgacctcgatcatctcttcctgtccgatcgatgccgaccggatggattacttgctcagagatggctatttctccggcgtcaagtgtggcatctacgattacaatcgcttgtttatgtcaattgtcccggtcgaggaacagggaaaattgtaccttgcttacaaagagagtgggattgattcgatcgctgagtttattggggcgcgctccagccttttctcgcaggtgtattaccataaaacaaaccgcgcctttgcgacgatgttgagcacattatgtgagattatgcaaagcaaggatccacaaaatgtcattatcgctgacgttaccgaccgtatcgttgaccatagcgatgaaagcttcatcgacgcgctgaaggatttttatttggcgtgcagtgatgattattttttgaatgacaaggttggtgaatggatagatatcagcgatatcgaggcggttaataaaaaaataattgatgacattattaaccgacacccatggtcgaaggtctatgaggccaaacactctgtgtataaagctaacatcgctgacaaggaaaataaggcgtggaagagtcaactcaccgggttattgacttctgtattacagcctcatttcaaaccacatgaatttgccgttgatattgtctccgactgcgcctttaaagacctggataaaaccgaagttaagcttttggtgaaagatcttaagaaccgctacgaaataaaaccgttaattgaatgtggtgataagttaaatcagtatcaaatcatcaaatattgcattcgggtatttgttgaccgcgatatcaaagaacgcgtaactcctgaaataatctataaaatcaatgaaatagtggtcaagcagatcgcgttgctgaattga

SEQ ID NO: 512 - DNA, 240 bp, Klebsiella pneumoniae
actttccatctagcccctcttaatcatcccgctaatcgtatgctcagcaatcacaccacagcatcattacaaaataaatattttttaactgcaacttttcttatccagcgcacaaggtcattgccgatatcttcttatacgcaggccacaactatacgtcacgctcttctgctacttgagccttacattccacctcagtgctgctacgctatctctgagaaaatggcgaaggagatataa

SEQ ID NO: 513 - DNA, 552 bp, Klebsiella pneumoniae
ctgcctaatctgcttcaaacattcgcgcgatcgtcagcgttgaactgtttctactctcaggagcctgctatgacccctttttatcaattgacggctacccgcctgcgcggccagcccctctccatggctgactatgctggcaaggtggttctggtggtgaatacggccagccattgtggcttcacaccgcaatacgctggcctggaagcgctctacaaaaagtacgcggctcaggggctggtagtgcttggtttcccgtgcaaccagtttggtaagcaggaacccggcggtgcggatgaaatcgagcagacttgtcacgttaactacggcgtgagcttcccgatgtttgagaaagtggacgtcaacggccccgccgcacacccgctgtttcgttatctgaaacaagcgttgcccggcgtgctcggcggacggatcaagtggaatttcaccaagttcctcatcggtcgcgacggcacacccctcacgcgttttgcgccgttcacgacgccggagaaaatggaagcctccattgtcgcggccctcacgcgctga

SEQ ID NO: 514 - DNA, 1122 bp, Klebsiella pneumoniae
gcttttgttcattttggttcctcttttctactgtgtaacgataagcctggaataaatagtgttatttttcaagccgaacagcgaaatcatgtcaggttatgttattgcgtaaacaggattgatctgccgacgtcggacggcggcgcaatgcgcggtacagcatctataatgaaaacctatgtcattgattgccttcttttccggcagtcaaaaccccggtccttgtcgtttcagcggcaaagaggtagctttaagccaacagcttgccaaacagattcactttcggagggcgcgatgacgctacaacaagagattattcaggcgctgggcgcaaagccgcagattgatgtcgcaggcgagatccgccgcagcgtcgatttcctgaagtcatacctgcagacctacccgtttattaaatcgctggtgctgggtatcagcggcggtcaggactccaccctgacgggaaaactgtgccagatagcgattaacgaactgcgtgccgaaaccggcgacagtagcctgcagtttatcgccgtccgtttaccctatggcgtgcaggctgatgagcaggactgccaggacgccatcgcatttatccagcctgaccgggtgttgacagtcaatattaaagctgcggtgctggccagcgaacaggcgctgcgcgaagcaggcatcgaactgagcgacttcgttcgcggaaatgaaaaagcccgtgagcgaatgaaggcccagtacagcatcgccggaatgaccaaaggagttgtggtcggtaccgaccatgcggcggaagcgattaccggctttttcaccaaatatggcgacggcggcaccgacatcaacccaattttccgcctgaacaaacgtcagggcaaacagctgctggcccatctcggctgcccggaacatctgtataagaagctgcccaccgccgacctggaagacgatcgcccctccctgccggatgaagtggccctgggtgtcacctacgagaacatcgacgattatctggaaggcaaaacgctggacccgagcatcgccaaaacgatcgagggctggtatctgaaaaccgaacacaagcgtcggccgccgatcaccgtctttgacgatttctggaaaaaatag

SEQ ID NO: 515 - DNA, 1677 bp, Klebsiella pneumoniae
gatagagttcagctctataatcaaacagaaaatatgcgcctgaaattgtcatctctcctggcagccgtttccctgctgtgtgggccagcttttgccgcccctgcgctccccgaccgcgccgatatccgcgatagcggtttcgtctattgcgtcagcggccaggttaatacctttaatccgcagaaagtcagcagcggcctgattgtcgatacgctggccgctcagatctacgatcgtctgcttgacgtcgatccctatacctaccggctggtccccgagctggcggagagctgggaagttctcgataacggcgccacctaccgctttcacctgcgccgccacgtcccgtttcaacgcacggcgtggtttaccccaacgcgggactttaatgccgatgacgtcatttttacctttggccgtatttttaaccgcgaccatccgtggcacaacgtcaacggcagcagcttcccctacttcgacagtctgcagtttgctgacagcgtggagagcgtccgcaagctggataatcagaccgtggagtttcgcctcaagcggccggacgcctcgttcctctggcatctggccacccactatgcgtcaattacctctgccgaatatgccgcccgcttaacgcaggatgaccgccaggagcaactggatcgccagccggttggcaccggcccgttccagctatccgattaccgctccggacaatatgttcgcctgcagcgccaccccggctactggcgcggcaaaccgttgatgccccaggtggtggtcgaccttggctccggcggcaccggccgcctgtcgaaactgctgaccggagaatgcgacgtgctggcctggccggccgccagccagttgacgatcttgcgtgacgacccgcgcctgcgcctgacgctgcgcccgggaatgaacatcgcctggctggccttcaacaccgccaagccgccgctggataaccctgaggtgcgccatgccctggcgctggcgatcaacaaccagcgcctgatgcagtctatctactatggcaccgcggagacggcggcgtccatgctgccgcgggcctcgtgggcctacgataatgacgctaaaattaccgaatataatccgcaggaggcccgcgcccgcctgaaagccctggggctggaaaacctgaccctcaagctgtgggtgcccaccagctcgcaggcgtggaatcccagcccgctgaaaacggcggagcttatccaggcggatatggcgcagattggcgttaaggtgattattgtgccggtagagggacgtttccaggaggcgcgcctgatggacatgagccacgacctgacgctctccggctgggcgacggacagtaacgatccggacagtttcttccgaccgctgctgagctgcgcggccatcgcctcgcaaaccaactttgcccactggtgtaacagggagtttgacgacgtgctgcaaaaagcgctgctctcgcagcagctctcctcgcggatggacgcttacaaagaggcgcagcggatcctcgcccgcgaactgccggtcctgccgctggcctcgtcgctgcggctgcaggcctaccgctatgatatgaaaggcctggtactcagccctttcggtaacgcttcgttcgctggcgtatcgcgggaaaataccgaagaggtgaaaaagccatga

SEQ ID NO: 516 - DNA, 339 bp, Klebsiella pneumoniae
gacgtttatcaccacaggagaacgcaaatgattgtcaggacctggcacggctgtgtgccattgcaacatgttgaggggtttgcccgccacctcgagcggaccggcgtggaacacgctcagagcatcgccggcaaccggggggcgctggtgcgccaggaaaaccagggcgaatgggcgcatttctttcttgccacctactggcaggatctcgcggcggtcaaagccttcgctggcgaagactatcacgtcgcggtcacctatccggacgacgaagcattcgaactcctctccgatccctatgtgtttcagcatgaagtcgaggccgtgtcgccgctgtag

SEQ ID NO: 517 - DNA, 1260 bp, Klebsiella pneumoniae
aggtacgatcagccttatctggttcttgccgatttaggaggcgcgatgtcggcacagcacgtcctgattgttgaagattcgctggtttatcgtcggttgctaagccggatgttgacgcagtggggctatatcgtcagtgaggcggaaaacggcgtcgccgcgctggcgatcctggagaaccagcccgtcagcctggtgattagcgactgggaaatgccggagatgaatggcctgatgctgtgccgggaagttcgccgtcgccagtttggtcactacgtttatctgatattgctcaccgctcgcgaagatccgggcgatttaacgcaagggtttgcggcaggggccgatgattttctcagtaagccggtggagcagagtgaactgcgggcgcgactgcacgccggggcgcggatcctctcccttgaagccgacctcgccgcgcgcaatacgcggctaagtgaagcgctgcggcagattgaacaggatctggagctggcggcgcgcattcagcaatcggttctcccggctcatcagctgtgctatcagggttttttctccgactggattttcctgccgtcggcctgggtatcgggggatatttttaatgttttcccgctgggggagcatctcggattttactgcgtggatgtctccgggcacggcgtgggggcggcgatgatgtcgcttgccgtcgcccgccagtttctacatggcagggcggttgagcgttttcttttctctgctgataaccagccggcatcacctgccgaggtagtgcagatcctgaatggtcgtttttgtagcgacgaggcagagattgtcagctatttcaccctgatctatggcgtcatcgacctcacaaccggtgaggggaaactgtgtcaggccgggcatcccacgccgtttatcgtcaccgtggatggaggtgtgcgctcggtcggcagcggtggggcgccggtggggttgataaaccatctctcatgggcagatgtcagtttctcgctggcgccgggagagcggctttgcctgttcagcgacggtatcaccgaatgtgaaaaccggagcggtgaacagtttggcgaagtccgtttacaagcgtggctgcaggacagtgtgacgcagccgctgcccgcgctgctgccgcggtttgcccggcacttgatccactggcgcaatggcgacgcgcaggagacccagtcgatggccgatgatgtttcactcttgattattgaacgtacaggggacagtgatgaaaattga

SEQ ID NO: 518 - DNA, 1863 bp, Klebsiella pneumoniae
cagacctgtcactcaaactcagcgcggaatcaggatatccttgctatggatttttatttttcccgttttgaacatcgtcgaccgcctgagccgctcagcactccgagctgggtaagaatgatctggcaggtattcgctgtggccgccctggttcttggtgccaattatatttactggcgctggaccgcgtccttaaacactgacgcactgtggtatgcaatccctctggtgctggcggaaaccctggcgtggattggcacagttctgttcaccattaatttatggcaggaaaaagatcctccgccaggcgtccccccgacggagatcaacgactgtctgcgagcggatgaagcggtggagtcgaggccgattaaagtcgatctgtttatcgccacctattccgaagacgtggaactggtcaggctgtcgatccgtgacgccatgcagatgacctatcccggtccgctcgactataaggtgcatgtccttgacgacgggcgtcgcccggaaatgaaggcggtctgcgagcaggagggggcgaactacatcacccgtcagagtaatatcggctataaagccggtaacctgcgcaacgggctggaacataccgatggcgactttctgatcatctgtgatgccgatacccgcgttttcccaaccctgctgagccacacgctcggctactttcgcgatccggacgtcgcctgggtgcagaccccgcagtggtttttcgatctccctgagggggaggatctggcatgctggctgcggcgtaaagctggcggcgcaggctatggcgtgggctggctggcgcagaaaatcgtcggtccggtgaccatcggtcgcgatccgtttttcaacgatccgcgcatgttctacgacgtgattttacggcgccgtaactgggctaacgccgcgttctgctgtggcgccgcctccgttcaccgacgggaagcagtgatgcaggcggcactgcgcagctacgtctggagcgttgatgccgagatcgaccgtcatacgcgggatattcgcgacccggtaacgcgggaagcgctgcaggacgccatgcgcccccacgtggcctttgatactgaactgacgccctataagttccacgtctcagaagatatttatacctccatcctgctgcacggcgacgctgctcgccgctggcgctcagtaatgcacccgcggatcgagtccaaaatgctctctccgcaggatatgttgacgtggatgatccagcgctttaagtatgccgccggatcgctggatatcctgttccatgacaacatcttcagccgacgccgctttaaactctcgctgccgcaaacgctgatgtacgcgaccaccttctggtcctatctggcctgcgtgtggaacaccgtgttcctgatctcgcctgttatctatctcttcaccggcattcccccagtgtcggcgtggtctacccctttctatctgcactttttacccttttttattgtctccgaactggcctttatgttcggcacctggggcatttctgcctgggacggccgggcctcttacctctcctttttctcgatgaatctgcgggcgctggacaccgttttgcgcggggagcagattaaatttcacgttacgccgaaagagcgacagacgggccgttttctctatctcgtcaagccgcaaattgccatcgttttgctcaccctgacggggctgatatggggcggcattcaggtggcgcgcggtgaggttgacgacccctccgggtacgtcatcaacattttctggggcgcggtgaatattgccgccatgctgccgcttatctttgccgccatgtggacgccccccgaagagcaggaggcgagccgatga

SEQ ID NO: 519 - DNA, 1455 bp, Klebsiella pneumoniae
ccttgccgtcataagagctggttatccaccagcccaggttataaaaatatcaggagaacggggatgaactttccattaatagcgaacgtagtcgtgttcgccgtattactgtttgcgctggggcaaacacgtcataaacagtggagcctggccagaaaagtgctggtcggtctggcgactggcgtggtatttggtctggcgctgcagctgatctacgggtctgacagccaggtgctgaaggattccatccagtggttcaatatcgtcggcaacggttacgtccagctgctgcaaatgattgttatgccgctggtcttcgcctccatccttagcgcggtggcccgcctgcacaatgcctcgcagctggggaaaattagcttcctgagcatcggtactctgttgttcaccaccctgatcgccgccctggttggcgtgctggtgaccaatatgttcggcctcaccgccgagggtctggtccagggcagcgcggagaccgcccgtctgaacgccatccagagcaactatgtggggaaagtagcggatctcagcgtcccgcagctgatcctttccttcgtgccgaagaacccgtttgctgacctgaccggggctaacccaacctccatcatcagcatcgtcattttctcggcgttcctcggcgtcgcagcgcttaagttgctgaaagaggatgtggaaaaaggccagcgcgtgctgaccgcgatcgataccctgcagggctgggtaatgaagctggttcgtctggtcatgcagctgaccccttacggtgtgctggccctgatgaccaaagtggttgccgggtcgaatttgcaggacatcatcaagcttggcggcttcgtggtagcctcgtacattgcgctgggtattatgtttgtcgtccacggcctgctgctggcgattaacggcgtcagcccgctgaagtacttccgtaaagtctggccggtgatcaccttcgcctttaccagccgctccagcgccgcctccattccgctgaacgttgaggcgcaaacccgtcgtctcggcgtaccggagtcgattgccagcttctccgcctcctttggcgccaccatcggccagaacggctgcgccggtatctatccggcaatgttggcggtgatggtcgcgccgaccgtgggcatcaacccgctggatccgatgtggattgccaccctcgtgggcatcgtcaccgtcagctcggcgggcgtcgccggggtgggcggcggcgcgaccttcgccgcgctgatcgtcctgccggcgatgggcctgccggtgaccctggtagccctgctcatctccgtcgaaccgctgatcgatatggggcgtaccgcgctgaacgttaacggctcaatgaccgccgggacgctgaccagccagtggctgcgccagaccgacaagtcgatcttcgatagcgaggaagaagccgaactggcgcatcgctaa

SEQ ID NO: 520 - DNA, 597 bp, Klebsiella pneumoniae
ccgtctacccaatcggcatcggtcagctgggcggaaccaccatcacaccgacgatggtcacaaccgtgtccgacaaacgggccaatccgacctggacacctaccgccaatattcgcgcgcgctacaaggctatggggattgagctgccggcggtggtgcctgctggtcctgacaatccgatgggccatcacgccatccgcctcgccgccctatggcggagtctatctcctgcacggcaccaatgccgatttcggcatcggtatgcgcgtcagttccggctgcattcgtctgcgcgataacgatatcaaggcgctgtacaacactatctcgccgggcacgaaggtgaacattatcaacacgccgatcaaggcgtcggttgagccggatggccgccgtctggttgaggtccatcagccgctgtctgagcatatcgatgacgacccgcagaccctgcccattacgcttaatgcggccatgactgcgttcaaacaggcgccgcagaccgacgggacggtgatggagcgcgcgatgaattatcgctcgggcatgccgattgacgtcacccgtcatgctgagcctggaccgcagtcgctgtag

SEQ ID NO: 521 - DNA, 1665 bp, Klebsiella pneumoniae
cggcgataccaacgcgatcgtgctggaaagcctggcctacatttcccaggggcagatgctgtgtctggcctgcctgagccctgcccctctaccctcgtcctcagcaggagcaacgccatgaagctgacctatttttcccgttttcctctgctggccggactcatggcgctgtggctctcactctccggcgcgcaggccgctaccggtctgccggctgcggaatacgccccgcgtagcggggagctgacgccgagggagatgactatcgccagaaatgcctggcaatatttcgtcgccaactttcagcccaccaccgggctggtcaatgcggtaaacaaatacccctcgaccaccatgtgggacagcgcctcctatctggccgccatgaccgcggcccgtgagctggggattattgataaggcggagttcgaccgtcgaatgctgaagtttctcgccacgctgaataagctcgatttattccgtaacgaattgcccaacaaagcctataacaccgtgagcggacaaaaggtgaactaccagaacaagccgggtgaaataggctattcggcgctggatatcggcagaatgctgatctggctgaaggtgatcaaggagcgctacccggaatacagcaacagcatcgataacgtggtgctggggtgggacttcagccatgttgtcgacccctgcggcacgctgtatggggcttatctggaaaacggccagcccaaatacgttcaggaaggacgcctcggctacgaggagtacggcgcggcgggctttcaactgtggggatttaatacctgtcaggccagccggccccagccttatgagctggcggaaatttactgcgtgatggtcccctatgattctcgcgacccgcggcaaaccagccagcataactatgtggtcagtgaatcttacgtgctgtatggcatggagtttggctttgataatcctggtgaccggaacgatagcccgcgcgagtactcccatccatggatgaaaaactttgccgaccgggtctaccaggcccaggagaatcgctacgccatcaccgggatcctcaccgctcgctccgagcatcagctcgataaatccccgtactttgtctatgacaccgtgttcagcgacggttttaactggaacaccataaccgacaaaggccagttcgtaccgaacagcgccgcggtgtcgctcaaagcggcgatggggatgtgggtgctgtggaactcgccctataccgatcgtttgctggacgccattgaaaatgcgaacgaagcgggaaaaggctattacgagggactgtatgaaaacggcgacgggccaatcaatgagttcaccgccaacaataacggcatcatgctggaagcgctgctgtttaaaaaagaaggcaaactgctgcagttttccagcgacaatccgaaaaaccgcgatttcgcgccgtcgctgtgggacaaaaagctggtggatctctttgagcccaataacggcccgcgcaaccgccccttcctgagcaatacccctgccgtcaagacatggtgcgaacagaccggaaccacgcagcgcacccaacccgcctgccaggcctgccagtgcgccgcctgcaaggctgacgagcccgttaaacttccgccggtgaccgcgcaatgcttaaaaccctag

SEQ ID NO: 522 - DNA, 627 bp, Klebsiella pneumoniae
atgatccaccagcccggcgacaagccgggcacatatgagaggttcgcaatgcttcagaacatgcttaacccggaaccaacctcaacagggatccggtctggaaaccgggtgattggctactccgctgctattcgcctgctggataacggtcgctatgacaaacaccttgccgatggaatggaaattctggcctgcatcatggaagcggtagaaagcaactggatcacgctcaatatcgaaaaagagttgatcctctggcgctggttactggctgccgtgttcatcactgaggagctggagaaaaacggaactgtcgacgttccgaatgatactggcggtgttgatactgctgttatctattccagcaagcatggcgccattagcgtctatccgggacctgaacgctttgcactcgccaaccatattgagctgggggcaatcgagaaatatgggccagaggttggccagcagctggcgctgcggatgtatcaggacatggttattgctgacgaagaatttgggttcaggttatcagcacttggccgggaggggtttaacctcctccacgacagctttatcgaacacatccagatcgaaggtgtgccagaagcgccgattatgcattga

SEQ ID NO: 523 - DNA, 591 bp, Klebsiella pneumoniae
atagctaaccatgttcatctttggccgtacagtatcaacaatgtacaaagaccacaccttgccgaagattacgaaacaatggttccttttcaggcgctgcagatgattggccaccaggtcgatgccgtctgcccggataaagccgctggcgactatgtcatgaccgcaatccatgactttgacggcgcccagacttatagcgaaaagccgggccatcgcttcacgctgaacgctgacttcgccgcagtaaaggccgagaactacgatgcgctagtgatccccggcggccgggcgccggagtatctgcgcctgaacgaggaggttattaaactggtacaggcattcgacgccgcgcgtaaacctatcgccgccgtctgccacggcccgcagctgctggccgccgccggtattctgcagggacggacctgcagcgcctatcccgcctgcgctccggaagtgcgcctgagcggtgggcactatgcggatattggtatcgaccaggcgcatgtggacggtaacctggttaccgcccccgcctggccggctcatccacagtggctggcgaaattcgccgccctgctggcggaataa

SEQ ID NO: 524 - DNA, 198 bp, Klebsiella pneumoniae
gccgcagaccatgctcgacgagctgaaagccttcgtccagagcctgaaggcagcgaccaaaaccgcctgaccatcagccgcctggcatcgcgccaggcggcgatttccacgcgttaccttcctttccatgtcatcttgcacgccaacacatcagacggaccgatgatcgacaccttgacgccaggcgatgcgctttag

SEQ ID NO: 525 - DNA, 306 bp, Klebsiella pneumoniae
aaagtccgccatctgacacaaaacccggcttaccaccaactaaaatcagccgcgttaattttcctgaaaacgaccattgtcttttcaacagaacatcacccatacaaggtttacattatgatcgaacatatccattttagatgcccatgctgccatggctcccagtacagaacgtcccagtttgacgtcactgaaaaaaacccttttggtgcgaaatgcattttctgcaaatcagccatgatgacatttgatgctatccgccctcgtcatctgggcgcgcagtctactgcgcaggcacaacaataa

SEQ ID NO: 526 - DNA, 1065 bp, Klebsiella pneumoniae
caggacctacatacagaagatgtggagggactgatgcgagctttgcttaacgtggatattgcacgccatcttggaattgtgctgcttaagccgggtagtgaattaatgccgttattcggtgccggccgagttcttgttgaaataccgccggcaagcatgaaaaagatacccagtggacgtcttcctgatgcccggcagccgttgcgggatgatatggggatcagaccttttttcatgaagaaggcagttatcactgcagctggtggggttagtgccctcgagtcatggttgcgtaggcaggttaaaaactgtcagtggacacattccgattaccatcaccatgagctcgtcccgtttcgccattcgacgggtgtaataatcgcatgctggcactgtgataatgagctgaaaaaccaaacggaacaaaccctcgatcaactggtaggagttaataacgctgactgggtaatcgacactgcccgcatcgcgcttggtctggacgctcagcgctcattgtcactggcggagctatgctggtgggcggtaggcgccgggattggcgatgaaattacagaagaaatggcgcgccgatccctgcgtattaaagacgatggcattaaatctgtttacagggagagtgagatcgttccgtcggtaccggccaccagcattctttctccccgtatcgaaaaagcaatcaggccaacggcaaaaacaacgccgggcaaacctctggttcctgtgaacgtcgatcctgttgcaccggcgacactattcgcgagacctaagcggagccgatggttatcagctgactttatctcatgggttaaaaaacagccgtgtatgtgctgtgggcagcctgcagatgatgcccatcatcttattggctgggggcagggcggcgtaggcaccaaggcccacgatatttttacgatcccattatgccgcaagcaccaccgtgctttgcaccatgaccctgccgcttttgagcgtgaatacggcacccagccggtattgattattaaattgctggaccgggcatacgcgctcggcgttctggcgtag

SEQ ID NO: 527 - DNA, 249 bp, Klebsiella pneumoniae
aaaagtaaacatggcggttattcacacgttgtggggaaaaagttgtcggcggtagttgttaactggctgccgtcaccgggaggcacccggcgccgcattgcaaaaccacatcctaatactgagttaactggagataactatgaaggattttgcccgagtacctaccgggaaccaggcgacccgcctgaactggttcgaggtgagactacgccagctgtgttacttgctggcgcagaaaggaaaccctga

SEQ ID NO: 528 - DNA, 1266 bp, Klebsiella pneumoniae
acgtccgtgcaccgcacggaacgctcctttcctaaggatacgcctgatatgaaagagattgctttacccctccacccggcgccggcgcgcgtctggattgccgtcgttgcgctcgggatctgcgccttttcgatcgtcaccagcgaactggcgccggtgggcatgctcagcgccctggcggcggattttcaccagacggaatccggcgtgggcctcgccgtcaccgcctatggctgggtaggcgccctggcggctctgctttccggcgcaatgccgacgcgtatttcccgcaaggcgctgctggtcgggctgatgctgatcctcgcgttttcctgcctcgccgcaacccggtcttattcgatgttcgccctgatgagcgcccgcatgattggcgccctggcgcatggcgccttctgggccttaattggcattgtcgccgcgcagctggtgccgccgcaccggctggggctggccacggcgatcatttttggcggcgtgtcagcggcaagcgtagtgggggtgccgctggcgagctttatcgccaccctggcgggctggcgactcgcgtttatgtcgatggccttgctgtcactagccgccgctgctgtgctgtgctcgacgctgcccccgctggccgcccctgcccccgtcaggctgcgtgtttatcgcgatatcttccgcaatccgctgctcggtggcctgtatggcgccacggcctgcatcattaccgctcactttgccgccttcacctacattgaaccgctgctgataaatctgcagggagtcccggcgaccgccctctccggcctgctgctgctgtcaggggtttccgggctgctgggtaacgttatcgcgggtaagctgatcgatcgtcatttgaaggggctgattttcgctgcgctgctgctgagcgggggcgcgctggcgctccttggcgccgcccgtcttgcgccactgccgttctgttttagcgggctactgttagccctgtggggcgccggcatcgcgattgtgttcgtcggcttacagacctggctgctgcgcagcgcgggcgcggtcgcccagccggcgtcagccatttacgtggccatttttaatgccgccatcggcaccggggcgtttgtcggcggccagctgatcgcctcagctggcctgtcgggaatggtgtggctggcggcggggatcatggtgggcagtacgctgctgatcgccctgctgaaagcgcctctgcccggtcagatcagtgcggcgacggcaggcgcttag

SEQ ID NO: 529 - DNA, 1359 bp, Klebsiella pneumoniae
actctctcgcagtttcaacaggttattgctgctagtctggcaaggctgttttttcgccacgccatttccgtggcgtggttatttttatgtcaaagaggaaccactatgaaacgtttgcccttgctggcagccttgcccttgctttgcgcttccgcgctctctgcccaaccgctgatgtccgtcggctattttaacggcggcggcgacgtgaccgccgggccgggcggtgatatcgataagctggacgtccggcagatcacccatctcaactactcgtttggccttatctataacgatgaaaaagacgagaccaatgcggccctgaaggatcctgctcatctgcacgagatctggctgtcgccgaaggtgcaggcggatctgcaaaagctccccgccctgcgtaaacagaatccggacctcaaagtcctgctgtcggtcggcggctggggcgcgcgtggtttctccggcgcggcggcgaccgcagaaagtcgcgccgtctttattcgttccgcgcagaaaatcatccagcaatatggtctggacggcattgacctcgactgggagtttccggtcaacggcgcctggggactggtggccagccagccggctgaccgcgacaacttcactgccctgctgaaatcgctgcgtgaggcagtcggtgagcaaaagctggtgactatcgccgtaggcgccaatgccgagagcccgaaaagctgggtggacgtcaaagcggtggccccggtgctgaactacatcaacctgatgacctacgacatggcctacggcacgcagtacttcaactcgaatctgtatgactccagccactggccgacggtcgccgcagcggataaatacagcgccgattttgtggtcaacaattacctggccgccgggcttaaacccagccagatgaacctcgggattggtttttatggccgggtaccgaaacgggcggtcgagccggggattgactggacgaaagcggatgcgcaaaacaatccggtcacccagccctattttgggccacaacagatcgcgctgtttgcctcgctgggctatgacctgagcaaagacacctacgtgaaatacaatgatatcgtgggcaaactgctcaacgatccgcaaaagcgttttaccgagcactgggacgatgaggcgaaggttccgtggctgtcggtgcagtccgcggagggcaagccgctgttcgccctctcctatgagaacccgcgctcggtagccattaaggcggactatatcaaggcgaagggcctcgccggggccatgttctgggaatatggcgccgatgaccagaatcagctggcccgtcagctggcggaatcgctggggatcaaacactaa

SEQ ID NO: 530 - DNA, 2511 bp, Klebsiella pneumoniae
aacagtgcgcagacgatcctgagctggtcgaggagctgctgggactcttcgctgaagggcttgatgctgcgatcatcgccctcacccacgccattgatactaatgacagggagacgtggcgccgtaccgcccacaaactgcgcggcgaggcggtcaccctcggctttcaacgccttgccggggtgctccagcaaatggagagccgggcgaagtcgcccggccagaccgtgccagatgacctgcgcgacgcgctggccgaggcaaccacaggctgccaccggtggctacatcgcagatcgcaggaggtcctccgtgatcgttaaacgccttctgctgctgatggtttgcctgccgctggcgcacgccggttctgcgccggtgacctggtcactggccggacaatggcgggtgcatgacgccaacgacagcgccttcgacggcgcgcaggcttcggatggcgactggcgcacgctgcgagtaccggcaaactggtacagcgctggatacgatcatcagggcgccctgtggtatcgccatcagtttaccctgcatggcctgtcgccggatgccatggctaccctggtgtttgacggcgtcgattactttgccgaggtggcgctcaacggcaagacgctggcccgacacgagggctattttcagcgcttcccggtggacatcagcggggccgtacgccgccataatcagctcgccgtgcgggtcgacagccccaatgaagacccgcaaaagatctggccgctgcacaagacgctgatgaaagggatcctcaatcagcacgatacccgtccgggcggcgcctggtcggttcaggggcaggatgccaactccggggggatctgggcgccggtgaggctccatctgagccgcggcgtcaccatcgacgaggtgatcctgcgcccggactggcaacaggggctggagcagcccatgctgcgtgccgaaatccgctatcgggctgtgacgcccggccccgtcacgctacgcctgacggctaccccggacaatttttccggcccacgttttcaccaggccttcgcggtcactctggagaaaaccgcaggcgtcctgcacgtctcgctgcccatgccgtccgcgaagctctggtggcccgtgggcgcaggcaagccgaacctctaccgggtgcgcgccaccctaacggatgaccgggggatgatggataccgccgtcacccgcaccggattacgtaaggtggaagcgctggcggacaatcagggctggcgcatcaacgacagacggctgttcattaagggcagcaactatattggctccccatggctaagcaccatgacgcggaaaaagtaccgtcgggatttcaggcttgtcacggcgatgaacgccaacgccatccgcgttcacggccacgtggcgggccgcgcgctgtatgaagtggccgatgagatgggactgatgatctggcaggatgtccccctgcaatggggttacgatgacagcgccgccttcgccgagaacgctgtgcgccagacccggacgatgatggaccagttcggcaattcgccggcgattattgtctggggcggccacaacgagccgccgtggaactcgccgtggatggaaaaacgcttccccgactggcgtaaaaccttaaatcagaccctgacgcagcgggtgggcgatgcgcttgcggaagatacctcccgcatcgtgcatcgcttttccgctgtcgaagagcactactgggcaggctggtatttcggcaccctgcgcgacctgctcgccccggcgaaaaccgggattattaccgagtttggcgcccaggcgctgccccggctctccaccctgaagaccattatcccggcccgtctgctgtggccgaaaaccaccgctgccgacgaccccggctgggtgcgatggaagtaccataattttcagcctttccagacctttaaatttgccggtattccacgaggcaacaatattcaggagatgattgaaaacacccaagcatatcaggcccggctggtggcgctggcggcggagagctatcgccgccagcgttatcagccggtgaccgccctgttccactttatgtttgtcgagacatggccctccatcaactggggggtggtggattatctgcgccagccgaaggccggttactatgccctgcagcgcgcctatcagccgatcctgccgtccatcgagccggtgaccgccagctggcgtcagggaagcccggcgacggtgcgcctgtgggcgattaacgatacctgggcagcctgcgaggattgccgcctgacctggcaggtcaggcaaaatggccagatgctcgctcagggagaaacctcgctgaccctgccgcccgacgctggccaaatggtcagggagttgaccgtcacccccgccggcccgcagcccgtgacgatcgtctaccgcattgacaaccgtcgcggcaaacacgtgggtgctaaccagcataccgagcccgtcgccgcggcgcaggcggggagatga

SEQ ID NO: 531 - DNA, 183 bp, Klebsiella pneumoniae
gatacccggcagctgatggcagccgccctggtggtggtcattggtcaaaactcgattccggaaagctttggtcggctgaccgggtacttaacccgccttgcgcgggttttgtgctttatggggctggcgaatcgccccgcagcagctgtgatacgcgaacgtcgtcaagcgctcgcaggatag

SEQ ID NO: 532 - DNA, 234 bp, Klebsiella pneumoniae
cgaatgaggcaacgcatgaatagcaaatggcaacgcgccgggcagcaggtgaagcccggtctgaaaatcgtcggtaagctggcgctgctgaccgcgctgcgttatggcccggcgggcgttgccggctgggcggttaaatcggtcgcgcgtcggccgctgaaaatgctgctggcggtggcgctggagccgctgctcagccggctggccaaccgcgtcacgcgcgggatgaaataa

SEQ ID NO: 533 - DNA, 567 bp, Klebsiella pneumoniae
ctaaccgggcatccgcccagatttccgccgcatggcgtaaaaatcctgtttattcacgccacgatgcgtagagtaagcgggatatttttggcattcttattttggcaaggacctctgtacatgtttgataccaccctgttgatcctgctgggtctggcggcgctcggctttatcagtcataacaccaccgtggcgatctccatcctcgtgctgattatcgtgcgcgtcacgccgctgaacgccttctttccctgggttgagaaacagggactgaccgtcgggatcattattctgaccatcggcgtgatggcgcctatcgccagcggcacgctgccgccctcgacgctgatccactcctttatgaactggaaatcgctgctggcgattgcggtcggggtgtttgtttcgtggctcggcgggcgcggcgtctccctgatgggctcccagccgcatctggtggccgggctgctggtcggtacagtactcggcgtcgccctgtttcgcggcgtcccggtcgggccgctgattgccgccgggatcatctcattgtttattgggaagtcgtag

SEQ ID NO: 534 - DNA, 1344 bp, Klebsiella pneumoniae
cttttatttaacaattggttaataattttaggggtacacatgactacgccattgaaaaaaatcgtaattgtgggtggcggcgctggcggactggaactggcaactcagctggggagaaagttagggcgccataagaaagcgaaaatcaccctggtggaccgtaaccacagccatctgtggaagccgctgctgcacgaagtggccaccggttctctggatgaaggcgttgatgcgctgagctatctggcccatgcccgcaaccacggtttccagttccagctgggctcggtggttgatatcaaccgcgaagggaaaaccatcaccctcggcgagctgcgcaatgaaaaaggcgagctgctggtggctgagcgtaaactgccgtacgacacgctggtcatggcgttgggcagtacctcgaatgactttaatacccctggtgtaaaagagaactgcattttcctcgacaacccgcaccaggcgcgtcgcttccatcaggaaatgctcaacctgttccttaaatactctgctaacctcggcgctaacggtaaagtaaatatcgccatcgtcggcggcggcgccaccggcgtggagctctccgctgagttgcacaatgcggtgaaacagctgcacagctacggctacaaagggctgaccaacgaagcgctgaacgtcacgctggtcgaggcgggcgagcgcattctgcctgcgctgccgccgcgcatttccggggcagcgcataatgagctgactaagctgggcgtacgggttctgacgcagaccatggtcaccagcgcggatgcgggcggcctgcacactaaagatggcgaatatattgaggcggatctaatggtctgggcggcggggatcaaagcgccagatttcatgaaagagatcggcggcctcgaaaccaaccgtatcaatcagctggtggtcgagccgacgctgcagactacccgcgatgcggatattttcgccatcggcgactgcgcctcctgcgcccgtccggaaggcggctttgtgcctccgcgggcccaggcggcgcaccagatggctacctgcgcgctgaacaacatcctggcgcagatgaaaggcaaaccgctgaaggcatacacctataaagaccatggctcgctggtgtcgctgtcaaattactccaccgtcggcagcctgatgggtaacctgatgcgcggttcgatgatggtggaagggcgcattgcgcgcttcgtgtacatctccctgtaccgtatgcaccagattgctctgcatggttacttcaagaccggcctgatgatgctggtcgggcgcatcaaccgcatcattcgcccgcgcctgaagctgcactaa

SEQ ID NO: 535 - DNA, 1461 bp, Klebsiella pneumoniae
ggtgatattaataacttgagtgaggaacctatgtcttcgttttcgtctacagacgggcagtcaaagagcaattatgctggaatgagtgaaaggcggtcgattgattacatcccggaaagcgaacggcatggacacccttttagccagttcaccctttggtttggcggcaatctgcaaattacggcgattgtcactggcgctttagccgttgtgctgggcggcgatgtagtgtggtctctggtcgggcttctggtcggtcagatgctgggggcggcggtgatgtctctgcatgcgctgcagggaccgcgactgggacttccgcaaatgatccttagccgcgcccagtttggggtttttggcgcggtggtgccgctggtgctggtttgcgtcatgtatatcggtttttctgccagcggcaccgtattggccgggcaggcaatggccaaactactgaatatcagccacgtagccgggatgctgatattcagtgcgattattatcgttatcgccgtcctcggttataaggtgatccacaagctgggcagactggcgagtatcgtcggaattctcgccttcgtttatatgttcatcacgctgctactttcggccgatctcagtgcgctcgcgcacaataaccatttttcgctgccgacgtttttattagccgtatcgctctcctcatcgtggcagatcgctttttgcccctatgtatccgactattcgcgctacctgccacgcgatgtttccgccacgaaaacgtggtgctcagtgtttttcggcaccgtattgggtacccaaacgtcgatgacgctcggggttctgacagcggccattgccggcagcgcgttccctggtcacgaggtgagctatctggtgggattaggtaagagtcaggcgatggccatggttatctatttcgccatctgttttggtaaaattaccttcactaccctcaatgcgtacggcagctttatgtcgctgaccaccattgtttccgccttccgccggcaaaccgtgctgtcgcaaaagtgtcgcattgcattcgtggtgctgatggtgacggcttcctgcattatcgcgttgcttagcgaacccgctttcttaaagcatttcacgcattttcttctgtttctgctggcgttcttcgtgccgtggagcgccatctgtctgacggattattatcttatctcgaagggcgccatcgatattccggcgctaagcgacccgcagcaacgctacgggttctggaacctgtacgcgatcaccctgtatatcgtcggtgtgcttatccagttgccgttcattgagaacccgttgttccatggttcgctcacgtggatcttcgccggtaacgatgtctcatggataataggctggtttggcaccggggttctttactacgcgctgcgccgctttgaccgccggtcgctgccggcgcagagtcttttcccttccacctga

SEQ ID NO: 536 - DNA, 195 bp, Klebsiella pneumoniae
gggagagttaaagcggtactgtcgaagggaaactgtgaaaagggcagcgatgagcatgacaatccgtcacactcaatcgccaccagcttctcgtctatgtatgcaatttttaagttcttcatcgcgttaccttttgcgaataaaaaagccccgcagatgcgaggctatacagttgatatccccacaaagggataa

SEQ ID NO: 537 - DNA, 1242 bp, Klebsiella pneumoniae
ataatgttcctaccccagatgttcaggggccgacaatactcgggtaatagcttctgggaagccatgctgggcggggttcgttcaagccagagcaaaactggcatcataatcacgccggaaaccgctcttggactttcagcggtccgggcctgtgtcaccctcctggcggagtcagtcgcgcagctgccgtgcgaactctaccggcgggataaaaatggcgggcgccagcgtgcgacggaccacccggtttatgacctgattcactcccagcccaacaggaaagacacctcattcgagtatttcgagcagcagcaggggttgctggggcttgagggaaattgctactcgatcatcgaacgggacggaaaaggctacccgaaagagctgatccccattaacccgaaaaaggtcattgtgctgaaagggccggacggtatgccgtattacgaactcccggaagtcggtgaaattctgccgatgcgcatgatgcaccatgtgaaggtcttttctctggatggctatatcggcagttcccccattcagacgaacgccgatgtcttggggctgaatctggccgttgaggagcatgcggcagcgacatttcggcgcgggacaacgatgagcggggtgatagagcgtccgaaagaggctgcgaccattaaaagccaggatgctattgatcgcctgctggcgaaatggaccgaacgccattccggtattcacaatatgttctctgtggcactgctgcaggagggcatgagctacaaacaactgtcgcaggataacgaaaaggcgcagctgctacagtcgcggcagtggggcgtggaagaggtctgccggctctataaaatcccgccacatatggtgcagatgctggcgaaagcgaccaacaacaacatcgagcaccagggcctgcagttcgtgatgtatacgctgctggcctggctgaaacgccatgagggtgcgatgcagcgcgatctacttctgcccagcgaacgccgcgatttgtacatcgagttcaacgtttccgggctgctgcgaggcgaccagaagtcacgctatgaatcgtatgcgctgggccgccagtggggatggctatccactaacgatatccggcgtatggagaatctaccgccaattgctggcggggacaaatacctgacgccgctcaatatggtcgacagcgcgaagatccttcctggcgataagtcgccgacagcaaaacagctggccgaaatataa

SEQ ID NO: 538 - DNA, 714 bp, Klebsiella pneumoniae
atgaatctcctgaaaccgcagcaagacagtgagccagaggaggcgctggaaaccgctatggcgatggtggcctccgccctctctgactcgtcaagggtcagtattctgtgcgcgctgatggacgggcgcgcatggacggcaaccgaactcagtacggtcgccgaggtgtccgcctccaccaccagcggccatcttgcccggctgctcagcaacgggctggtggtgtgtctcgcgcaggggcgccaccgctattaccgcctggcgggctcgcatattgccgggctgctggaaaacctgatgggcgtctctatgcaagcgcataaggcgcttctccccagcacgccggttaatcttcgctacgctcggacctgctacgatcatctggcgggcgagctggcggtcaatatttatgaatttatgctgagggaaaaatggctggcggcagatggcctggccctgacgtcagccggtaaaacccagcttgaacgccttggcgcagtgtttaacgcccgcccacggcgtaagccttgctgcccctgtctcgactggagcgaaagacgttttcatctgggcggcgatgccggctcggcgctaatgacgctgttcctgcaaaaaggatggataacccgcgcgccgggatatcgggaagtacaagtgacggatagcggcaaagcggcgctgtcccggctgtttaatctgaaagtgagcggatag

SEQ ID NO: 539 - DNA, 183 bp, Klebsiella pneumoniae
aaaataaataacttactgttttgcagagaaattatggagagtataaaggaggggagattaaaaacaaagcattttaccaggaataatctgcaaatttacactggggcacgaaaaaataagatggcgaaaaaagacgcgcgcaataaagcaggccgcccggcggacggcttgccctcaggataa

SEQ ID NO: 540 - DNA, 393 bp, Klebsiella pneumoniae
ctctccctcaactcatgctcgaggatgcttatgccgccacgagctaaacgaccttgccggcacagaggatgcgcgactgtgaccaatgatgtcggtggatactgtgagatgcatcggcagcaacacgctggtgatggctggcgtaactaccagcccggaaaaactcggcaggaacgtggttatggtcgaccgtgggaaattaaacgggcccgtatcatgaagagggataaatacctttgtcagaactgcaggcgagacggtattgccacgaaagcctcaagtgtcgaccacatcattcctaaagctcatggcggtaccgatgatgactttaatctggagtcattgtgctggacctgccacagcaagaaaacagcaacagagagaacccgatga

SEQ ID NO: 541 - DNA, 588 bp, Klebsiella pneumoniae
caactaaacaacctcgtagaaagatcactcgccagcgcctcactcttgagggaatggcaaaagatttttgatatagccgatgaaaatcacaaatacatggggaacgccatgcttttagccatagtaacaggacagcgactaggtgatatatcccgtatgaaattctcggacatctgggacgatcatctacacgttgagcaagagaaaaccggaagcaaaatcgctataccattagctctgcgttgcaacgcaatcaactggagcctccgagatgtaatcagtcgttgccgggattatgcagtaagcccttatttggttcatttctttagaaccacctcacaggctgagcgaggagcacaggtgaaacccagaacactgaccatgaatttcagcaaggcaagagacagtgcagatattgactggggacaaggtacaccggcaactttccatgaacaaagatcgctttccgagcggttatataaagcccaaggtataaacacgaaagatttacttggacataaaactcaacaacaaacggataggtaccatgatgatcgtgggaaggggtggacaacggtggccttatga

SEQ ID NO: 542 - DNA, 189 bp, Klebsiella pneumoniae
acaaaaaacaaccggttgttttttgtcataaccgatatgtatgaaaaacactcattgatttttcgtcaatataaaacaaaaaagcgcgcctgcaagctgagccacccgcataaactcgaaagtgtcgtgcaaacacaacacaggaataacaaaaatgacacatccgttgctagaagcattgcaggttaa

SEQ ID NO: 543 - DNA, 1239 bp, Klebsiella pneumoniae
acgagggacaaagccgctatcgtaacccccctcgttagttaccttgagaatgatatgtcttctgtgatctcctctaccggccgccgccccgcgctgctgattgccggtatcctgctcatcgccaccaccctgcgcgtggtctttaccggcgcggcgccgctgctggacgcgattcgtagcgactatggcctgaccaccgcgcagaccgggctgctcactaccctgccgctgctggcctttggccttgtctcgccgctggcggcaggggttgcccgccggttcggcatggaacgcagcctgctgctggcgatgctgctgatctgcgccggcattgccctgcgctccctgccctccgctgcgctgctgtttatcggcacggcggtaatcggctgcggcattgcgctgggtaacgtgctgctgcccgggctgattaaacgggatttctcgcaacatgtcgcgcggatgaccggcgcctattccctgacgatgggcggcgcggcggcgcttggttcggcgctggtggtccccgtggcgatggccggattcggctggcgcggggcgctgctgctgctgatggtcttcccgctactggcgctcctcagctggctgccgcagtcccggcgccgggcggagacgccattgaccggctcaggcgctatgcataaccgggggatctggcggtcggcgctggcctggcaggtgacgctgttcctcggcatcaactcgctggtctattacgtgattatcggctggctgccgtcgattctgcagagtatgggctatagcgaagcgcaggccggctcgctgcatggcctgctgcagctggcgaccgccgcgcccggcctggcgataccgctgatcctgcatcggctgcgcgaccagcgcgggatcgcggtgctggtcgccctgatgtgcgccatcagcgccgccgggctgtggctgttgcctgagctggcgatcggctggacgctgctgttcggctttggctccggagccactatgatcctcggcctgacgtttatcggcctgcgcgccagctcggcgcatcaggccgcggcgctgtcagggatggcgcagagcgtcggctatctgctggccgcctgcgggccgccgctgatgggcaggatccatgatgccaatggcgactggcatattccgctgctggcggtggcgctgatttcgctggtgatggcggtctgcggcgcgctcgccggacgtgaccgggaaattcacccctga

SEQ ID NO: 544 - DNA, 843 bp, Klebsiella pneumoniae
ttctgcataaacgatccgcggaacggcggttcgccacataccgaacaaggaaagcccatggagccacgccgcgtgaatggcaaaaatcactggtatcacgaaacccagtcaacaatctgcccggtggatgtcctgccgctcgtccctgaagccgcccatgttgaagaccgctttttgctggacctgacgctgccggccgcctggctacgtgcccacgctgactggctacaccccgcacgccagctggccgaactgctgtttcccgaccaggtggcggtgagtcgcctgcagacctttaccgcttacgatcgactcagcaccgcgctcaccgtcgcccaggtctacggcgtccagcggctgtgtaaccactacgccgcccgccttgctcccctgccaggccccgactcctcgcgcgagagcaaccgtcgtctggcgcaaatcacgcaatatgctcgtcagcttgccggttcgccctcggttattaacgctctctcccgtagccagctggacgaagtgggcttaaccagtcgggacattattctgttcaaccagattatcggattcgtcggcttccaggcgcggacgattgccgtcctgcaggcggcccagggcttttcccggtgcgctggatccccggtatgccccagcaagaggaggcacccgcggagctgttcgccccgccgccgggagcatggcaggcagacattgcggatcccgacctgcagtatgccgatgatgagcgtcagcggcgcatcgccggctggcagtcgctgcccggtctgggcgagctggcgccgctgctggcctgcgacccacagttattcgcgcctctggagaccttga

SEQ ID NO: 545 - DNA, 531 bp, Klebsiella pneumoniae
ctatatgtaaacaggaagataaccatgtcacaaaccgtgcatttccagggcaaccccgtttctgttcagggcaccattccgcaggcaggcgctaaagcgcagccgtttacgctggtcgccaaagatctctctgacgtcgcgctgagccagtatgccggcaaacgtaaagtactgaatattttcccgagcattgataccggcgtgtgtgccgcatcagtgcgtaaattcaaccagctggccgctgaactggacaacaccgtagtgctgtgcatttccgctgacctgccgttcgcccagtcccgcttctgcggcgcggaaggcctgagcaacgtggtcaccctgtccacgctgcgcggcgcgtccttcctcgctgactacggcgtcgccatcgccaccggtccgctggctggcctggctgcccgtgcggtggtcgttatcgatgaaaacgatcaggtcctctacagccagctggtgaacgaaatcaccgaagagccggactacgacgccgcgctggccgccctgaaagcctga

SEQ ID NO: 546 - DNA, 597 bp, Klebsiella pneumoniae
cattcacaaaataaatattttaaaacgcagtttcatttttatgaaaaacaacttccggcacatgggtgttatttgtacaatgaattacgtatgaagattaattcacaacaagcagagggacttatgcagcaatataccaacgaaatcacacccgaaattaatgaggcccaatcacaaccgccttacgacgaagagcttttgtcactctgcgatgacaaaatccggaaagaacttgaggaaattaaaaaacagcatctaagccgcccgttagcttacattttccggtttgcagtcgttggaagtctgacccgtcgcggtggagtcattcgccatgcttcaggcggtgcgactaccggaggattacaagttgctcgggtaggtgacaaggttgtatatgctgatggcagcgagtccactattatttccggtgctggcaaggcccgaatcatgcagggcgcatccgctgcactcgttggcagtatgcttgataatggtgatgaaataatctctaccccacaatcgtgcagcaaactggtttttcgtgaaggccgcgaactcccggaaggattcttgaccgtgtcagggagtaagcactga

SEQ ID NO: 547 - DNA, 183 bp, Klebsiella pneumoniae
cacgcgcaaaacggtctggaggttgtaatccagggcgggtcggataaaggggtctgcaacctgtttaaccgtgccaagctcctgcgccagcgccttcatatggtgttgcttgctggggccaacacggagcgttacaaccgcgttccctttacccttgcgggtggaagagcggattttgattga

SEQ ID NO: 548 - DNA, 918 bp, Klebsiella pneumoniae
aagcgaaaaaataacccaggaggcaggcctatgtttcgtcatgtgaaacaactgcagtataccgtacgcgttgctgaaccgaatccggggctcgcgaatttactgctcgaacagtttggcggccctcagggcgagttggccgccgcgtgtcgttatttcacccagggattaagcgatgacgatcccggccgcaaagatatgctgatggatatcgcgacagaggagttgagccatctggagatcattggcactttggtcggcatgctgaataaaggcgccaaaggagccctggcggagggcaccgagagcgaggcggaactctatcgttcgctcaccgccaacggcaatgacagccatattacatccctgctgtacggcggcggtaccccgctgaccaactcggcgggcgtgccgtggacggcggcctacattgatactatcggcgaacccaccgccgacctgcggtcgaatgtcgcggcggaggcgagggcgaagatcgtctatgaacgcctgatcaacgtgaccgacgatcctggcgtgaaagacgcgctggccttcctgatgacccgcgaagcggcgcatcagctctcttttgagaaggccctgcagtcgattcgcaacaactatccaccgggcaaactgccgcccattagcgagtacgctaacacctactacaatatgtctgaaggtggagaagtacgcggcagctggaacagtgacaagcacttcgattatgtcaaggatccacagccgggcgtagacggcggagatggcagtgcttctgtcggcctgacgccagagcaggaagcgctgtgcaaagcgatgctgaagcgaacgcagtctgacccgcagggcgatcctttgaccggcgccgaactcggcgccgggaagcaaaacacttcatcatcggctaagtga

SEQ ID NO: 549 - DNA, 1608 bp, Klebsiella pneumoniae
cttcccgaaaacctattcctggcctattattctcccgtcattggcacttttagggtgaacactcccatgcgtcttgaagtcttttgtgaagaccgtctcggtctgactcgtgaattgctcgatttgctggtgctgcgtggtattgacctgcgcggtatcgatattgaccctattggccgaatttacctcaatttcgccgaactggaattcgccacgttcagcagcctgatggctgagatccgccgtatcgccggcgtgacggacgtgcgcaccgtgccgtggatgccgtctgaacgtgaacacctggcgctcagcgcgctgctggtagcgatgccggagccggtgctgtcgctggataccaaaggtcgggtggaactggcgaaccccgccagctgcctgttgtttggccaaagccaggcgaagctgcgtaaccacccggtggcccagctgatcgccgattttaacgttcagcgctggctggagagcagcccgcaggagacgcatgcggagcatgtggtggtgaatgggcagaactacctgctggaagtgactccggtctatctggaaggcgagcataacgagcgagtgctgaccggcgccgtggcgatgttgcgctcaaccgtgcgcatgggacgccagctgcagaccatgaccagccaggataccagcgctttcagtcagatcctcgcggtggggccgaaaatgcgccacgtggtggagcaagcgcgcaagctggcgatgctcagcgcgccgctgctgattgtcggcgacaccggcaccggtaaagatctgctggcccatgcctgccatctggccagtccgcgggcgggcaaaccctatctggcgctcaactgtggctccattcccgaggacgcggtcgagagcgagctgtttggcgacgcgctgcagggcaagaagggcttcttcgagcaagccaacggcggctcggtgctgctggatgaaattggtgagatgtcgccgcgcatgcagaccaagctgctgcgctttctcaacgacggcaccttccgccgcgttggcgaggatcatgaagtgcacgtcgatgtgcgggtgatctgcgcgacgcagaaaaacctgatcgagctggtgcagaaagggcttttccgcgaagatctctactatcgcctcaacgtcctgacgctgtatctgccgccgctgcgcgattgcccgcaggacatcatgccgctgacggagctgttcgtggcccgctttgccgacgagcaggggatcccgcggccgaagctctctgccgatctcagtacggtgcttacccgctacagctggcccggcaacgtccgccagctgaagaatgccgtctatcgcgcactgacccagctggaaggatttgagctgcgtccacaggacattctgctgccggaccatgacgtcgcctcgctgccggtgggcgaggaggccatggaagggtcgctggacgacatcacccgccgctttgagcgctcggtgctgacccagctctatcgcagctaccccagcacccgtaagctggcgaagcggctgggggtgtcgcataccgccatcgccaataagctgcgtgaatatggtctgagtcagaaaaagggcgacgaataa

SEQ ID NO: 550 - DNA, 1302 bp, Klebsiella pneumoniae
aaagagagaaataaaatgccacatattgaagaattgcgtcgtcagcgtgcgggtatcaacgaacaggttcaggccctggcaaccattgacgccagcggcagcacgctgactgcggagcagctgacggagtttgcgaacctgcagcagcagttcactgatatcagcgccaaaattgaacgcctggaagccgccgaacgtgctgcggcgctggtcgcaaaacccgtgaaagcgactcagcaggcccccggcattattgttaagcaggagccgaaacagtacaccggtgctggcatgacccgactggttatgtctgtcgccgcaggcgcagggaatctgcaggacgcggcaaaattcgcttcagaagagctgaatgaccagtccgtatcgatggccatttccaccgcagcggcgtccgggggtgtgcttattccgcagaacctccacagtgaggtgatcgagctactgagcgaccgaaccatcgtccgcaagctgggtgcccgtcccgttccgctgcctaacggtaatatgacgctaccacgcgtggccggtggagcaacggcaagctacacaggagaaaacaaagacgccaagacatcagaaacacgctttgatgatgtaaaactgacggcgaaaactctgattgcgatggtgcctatttccaatgcactgattggccgcgccggattcaacgtcgagcagttggtcctgcaggatattctgaccgccatctcagtgcgtgaggataaagcctttatgcgcgatgacggtaccggcgatacaccgattggtatgaaggcgcgcgcgactcagtggaaccgcctgctgccgtgggaagctgatgcagcgatcaacctgaatacggttgacgagtacctggacaagatcattttgatggcgatggacggcaacagcaacatgatcagcagcggctggggcatgtcgaaccgtacctatatgaagttgtttgggctgcgtgacggcaacggcaacaaagtctatccggaaatggctcagggattacttaaaggatatccggttcagcgtaccagcgcgatccctgcgaatctggggaccgggggtaaggagactgagatttactttgctgacttcaatgatgtggttatcgctgaagacggcaatatgaaagtcgacttctcgaaggaagcctcttatatcgatgccgatggcaccctggtatctgcgttttcccgtaaccagtcgctaatccgcgttgttactgagcatgatattggcttccgtcatccggaaggcctggtgctgggtaccggcgtcctgttctaa

SEQ ID NO: 551 - DNA, 828 bp, Klebsiella pneumoniae
acatggagaaagagtgaaatggtcgaaacattgctggaagttcgccaactcagtaagacctttcgctaccgcaccggctggtttcaccgtcagacggttgaggcggttaaaccgctgagttttaccctgcgcgaacggcagacgctggcgattatcggcgagaacggctccgggaaatcgaccctcgcgaagatgctggcgggcatggtggaacccaccagcggcgaactgctgattgacgatcatccgctgacttttggggattactcctaccgcagccagaagattcgcatgatctttcaggatccgtcgacctcgctgaacccgcgtcagcgcatctcgcagatcctcgattttccgctgcgactgaataccgatctcgacgccgaggcgcggcagaagcagataatcgacaccctgcgcatggtcggtctgctgccggaccacgtcagctactaccctcatatgctggcgcccggtcagaagcagcgtctcggcctcgccagggcgctgatcctgcgcccgaaggttatcgtctgcgatgaggcgctggcctcgctggatatgtcgatgcgctcccagcttatcaacctgatgctggagctgcaggagaaacagggcatctcctatatctatgtcactcagcacctgggaatgatgaaacacatcagcgatcaggtgctggtgatgcataacggcgaagtggtcgagcgcggcagcactgccgatgtgctggcctcgccgctgcacgacctgacccggcgcctgatcgccggccacttcggggaacccctcaccgccgacgcctggcgcaaagacgggaaatag

SEQ ID NO: 552 - DNA, 651 bp, Klebsiella pneumoniae
tggcggagaaagtactggggaccggggaaaaaccgggcctggcgcttcacgccggacgtgacggcgggcttcaccccccagccgtcacagtttgagagcatgaatcaggctgagcttaatgcccaggcgaaagccctgctggctgccgctggctatggcccgaatcgtccgctgaagctgacgctgctgtataacacctctgagaaccaccagaaaattgccatcgcggtggcgtcgatgtggaagaaaaacctcggcgtggaagtgaagctgcagaaccaggagtggaaaacctatatcgacagccgtaacaccggcaatttcgacgtgatccgcgcttcgtgggtgggagactacaacgagccgtccaccttcctgtcgctgctgacctccacccacagcggcaatatatcgcgctttaacgatccggcgtacgacaaaatcctcgcccaggcggcggtagagaattcggccaaagcgcgtaacgacgattacaacgcggcggaaaagatcattatggtcaaagcgccgatcgcgccgatctaccagtacactaacggccgattgattaagccgtggctgaaaggctacccgatcaccaacccggaagatgtggcctacagccgtaccatgtatatcgtgaagcactaa

SEQ ID NO: 553 - DNA, 3465 bp, Klebsiella pneumoniae
gagatcatgaaaccgtctatgcctgaacaatatcgatactcattgccggtcaaagccggcgatcagcgccagcttggcgagttgaccggcgcagcctgcgccaccctggtggcggagatggccgaacgccacagcggcccggtggtgctggtggcgcctgacatgcaaaacgcgctgcgtctgaacgacgagatcaggcagtttaccgacagcatggtgatggggctggcggactgggaaacgctcccttacgacagcttctcgccgcatcaggacatcatctcctcccgtcttgccaccctttaccagttacccaccatgcagcgcggcgtactgatcgtcccggtcagcaccctgatgcagcgcgtctgtccgcacagcttccttcacggccacgcgctggtgatgaaaaagggccagcgcctgtcgcgcgatgcgctgcgcgatcagctggagggggccggctaccgccatgtcgatcaggtgatggagcacggcgaatatgctacccgcggcgcgctgctcgacctgttcccgatgggtagcgatcagccctaccgccttgatttctttgacgatgaaatcgacagcctgcgcctgttcgacgttgacagccagcgcacgctggaggaagtggcggccattaacctgctgccggcgcacgagttccccaccgaccagaccgctattgagctgttccgcagccagtggcgcgaccgctttgaggtgaagcgcgatgccgagcacatctatcagcaggtcagtaaagggacgctacctgccggtatcgaatactggcaaccgctgttcttcagcgagccgctgccgccgttattcagctatttcccggccagcacgctgatcgtcaacaccggcgatctcgaggccagcgcggaacgattccagaatgaagcccgcgcccgctttgaaaaccgcggcgtcgacccgatgcgcccgctcctgccgcctgagctgctgtggctgcgcagcgatgagctattcagcgaactgaaaaaatggccgcgcgtgcagctgaaaaccgaacgtctggcggacaaagcggcaaatactaatctgggctaccagacgctgccggacctcgccgtccaggcgcagagcaaagcgccgctggataatctgcgccgcttcctcgagtcctttaccggtccggtgatcttctcggtggaaagcgaaggccgccgtgaagcgctgagcgaaatgctggcgcggattaaagttgcgccaaaacatgtgctgcgtctggaggaagccaccggcaacggccgctatctgatgattggcgccgccgagcacgggtttatcgacagccagcgcggcctggcgctgatttgcgagagcgacctgctcggcgagcgggtggcgcgccgtcgtcaggattcgcgacgcaccattaaccctgacactctgattcgcaacctcgccgaactgcatatcggccagccggtcgttcacctggaacacggcgtgggccgctacgcgggcatgactaccctggaagccggcggcatcaccggcgaatatctgatgctgacctacgccaacgatgccaagctatacgttccggtatcgtccctgcatcttatcagccgctacgccggcggggcggaagaaaacgcccccctgcacaagctgggcggcgatgcctggacccgggcgcgacaaaaagcggctgagaaagtacgcgacgtggcggccgagctgctggatatctatgcccagcgcgcggcgaaggcgggttttgcctttaaacacgaccgcgaacagtatcagctattctgcgacggcttcccatttgaaaccacgccggatcaggcgcaggcgatcaacgccgtcctcagcgatatgtgccagccgctggccatggaccgcctggtatgcggcgatgtgggcttcggcaagaccgaagtggccatgcgcgccgccttcctcgccgtggagaaccacaagcaggtggcggtgctggtgccgaccaccctgctggctcagcagcactatgacaatttccgcgatcgtttcgccaactggccggtacgcatcgaaatgctctcccgcttccgcagcgctaaagagcaggcgcagatcctcgagcaggccgcggaaggcaaaatcgatatcttgatcggcacccacaagctgctgcagagcgaggtgaagctgcgcgatctcgggctgctgatcgtcgacgaagagcaccggtttggcgtgcggcataaagagcgcatcaaagcgatgcgcgccgatgtcgatattctgaccctcaccgccacgccgatcccgcggacgctgaacatggcgatgagcgggatgcgcgatctgtcgatcatcgccacgccgccggcgcgacgtctggcggtgaagaccttcgttcgcgaatatgacgccctggtggtgcgcgaggcgatcctgcgcgaaacgctgcgcggcggccaggtctactatctgtttaatgacgttgagaacatccagaaagccgccgacaagctggcggagctggtgccggaggcgcggatcgccatcggtcacggtcagatgagggagcgcgaactggagcgggtgatgaatgacttccatcatcaacgcttcaatgtgctggtgtgcaccaccatcatcgaaaccgggatcgacattcccaccgccaacaccatcatcatcgaacgcgccgaccattttggcctcgcccagctgcaccagctgcgcggccgcgttggccgttcgcatcaccaggcctatgcctggctgctgacgccgcatccgaaagcgatgaccaccgatgcgcaaaagcgcctcgaggccattgcgtcgctggaagatctcggcgccggctttgcgctggcaacccacgatctggagattcgcggggccggggaactgcttggggaagatcagagcggtcagatggaaaccatcggtttctccctgtatatggagctgctggagaacgcagtcgatgcgctgaaagccgggcgtgaaccctcgctggaagatctcaccagtcagcagacggaggttgaactgcgcatgccttccctgctgcctgatgatttcatccctgacgtcaatacgcgcctgtcattctataagcgcattgccagcgccaaaaacgaacaggatctggaggagatcaaagtcgagctgatcgatcgttttggccgcctgcccgatgccgcccgcaacctgctggatatcgcccgtctgcgtcagcaggcgcaaaagttagggatccgcaagctggaaagcaacgaaaaaggcggcgtgatcgaatttaacgagaaaaacaacgtcaatccggtgtggctgatcggcctgctgcagaagcagccccagcacttccgcctggacggtcccacgcgcctgaagttcatgcaggacctggaggagcgtaaaacgcggatggactgggttcgccagtttatgcgccagctggaagagaacgccgtcgcctga

SEQ ID NO: 554 - DNA, 210 bp, Klebsiella pneumoniae
tcagccatgaagaaaagttggtttttacacgagcaactttcagaggctgaggctacagagctggtggagcgataccgtaaaaataactgtgtggttgagaaaagcttgtccagagactttgcatcgtgggagatccgcgtgttgttgccggaatcgaagaagccgccacggattgacaggacctacatacagaagatgtggagggactga

SEQ ID NO: 555 - DNA, 195 bp, Klebsiella pneumoniae
agggcagtgaaaagaaaatacatgattccactggcgctaatgctcctcatgctcatcgccagcgcatggctggaaccggccccgcggcctgtcgccagagggctgtgcgtctggttcgacggggcaatggtcaactgtctgcagaggcaacggctgggcgaaaggttgccgattcactcgctggccaggcggtaa

SEQ ID NO: 556 - DNA, 2610 bp, Klebsiella pneumoniae
gtaaaggtgaatatgggtaaagctctcgttatcgttgagtccccggcaaaagccaaaacgatcaataagtatctgggtaatgactacgtggtgaaatccagcgtcggtcatatccgcgatttgccgaccagtggatcagcttccaaaaagagcgccgactctaccgccaccaaaggggctaaaaagcctaaaaaggacgaacgtagtgctctggttaaccgtatgggcgtggacccatggcatgactggaatgcgcactatgaagtacttccgggtaaagaaaaggtagtttcagaactcaaacagttggcggaaaaagctgaccacatctatctcgcaaccgaccttgaccgcgaaggggaagccattgcctggcacctgcgggaagtcatcggcggcgatgaacagcgttacagccgcgtggtgttcaatgagatcaccaaaaacgctattcgtcaggcctttgaaaagccgggcgaactgaatatcgatcgggttaacgcccagcaggcgcgtcgttttatggaccgcgtggtgggctatatggtttcgccgctgctgtggaaaaaaatcgcccgtggtctttctgccgggcgcgtgcagtccgtcgcggtccgcctggtggtggagcgtgaacgtgaaattaaagcgttcgtcccggaagagtactgggaagtcgacgccagcaccaccacgccgggcggtgacgccctgccgctgcaggtgacccataaggacgataagccgttccgtccggtcagccgcgatgagaccatggcggcggtatcgctgctggaaaaagccagctacagcgtactggagcgtgaagataagccgaccagcagcaagccgggcgcgccgttcatcacctccaccctgcagcaggcggccagcacccgtctgggcttcggcgtgaaaaagaccatgatgatggctcagcgactctatgaggcagggcacatcacctatatgcgtaccgactccaccaacctgagtcaggacgcgctgaacatggttcgcggctacatcagcgacaaatttggcaaaaaatatctgccggatagcgcgaaccagtacgccagcaaagaaaactcgcaggaagcgcacgaagcgattcgtccgtctgatgtgaacgtgctggcggaaacgctgaaagatatggaagcggatgcgcagaagctttatcagctgatctggcgccagtttgtcgcctgtcagatgacgccggcgcagtacgactccaccacgctgaccgtggctgcgggtgatttcaaactgaaagcgcgcggtcgcactttacgtttcgacggctggacaaaagtcatgccggcgctgcgcaagggcgatgaagaccgaacgctgccgctggtcaaacagggcgaccgcctgagcctggtggagctgacgcctgcgcagcactttaccaagccgccggcgcgtttcagcgaggcctcgctggtgaaagagctggaaaaacgcgggattggccgtccgtcgacctacgcgtcgatcatttcgaccattcaggatcgcggctacgtgcgggtggaaaatcgtcgtttttacgccgaaaaaatgggcgagatcgttaccgaccggctggaagaaaacttccgcgatctgatgaactacgattttaccgcgcagatggaggatcgcctcgaccaggttgcgaaccaccaggccgagtggaaagaggtgctgaaccacttcttcggcgattttaccacccagctggcgacggcagagaaagatccggaagagggcggcatgcagccgaacccgatggtgctcaccagcatcgactgcccgacctgcggccgtaaaatggggatccgtaccgccagcaccggcgttttcctcggctgttcgggctatgccttgccgccgaaagagcggtgcaaaaccaccatcaacctggtgccggagaacgaagtcctcaacgtgctggaaggcgatgacgcggaaaccaacgcgctgcgcgccaaacgtcgctgccagaagtgtgggacggcgatggacagctaccttatcgatcctaagcgtaagctgcacgtctgtggtaataacccgacctgcgacggctacgagattgaagagggcgaattccgcatcaagggctatgacggcccggtggtggagtgcgagaagtgcgggtctgaaatgcacctgaaaatggggcgtttcggtaagtacatggcctgtaccaacgacgagtgtaagaacacgcgtaagatcctgcgcaatggcgaagtggctccgccgaaggaagatccggtgccgctgccggagctgccgtgtgagaagtctgacgcctactttgtgctgcgcgacggggcggcgggcgtcttcctggcggccaacaccttcccgaaatcacgggaaacgcgtgcgccgctggtggaggagctgtaccgcttccgcgatcgtctgccggaaaaactgcgttatctcgccgatgcgccgcagcaggatccggaaggcaataaaacgctggtacgctttagccgtaaaaccaagcagcagtacgtggcgtccgaaaaagagggcaaagcgaccggctggtcagctttctttatcgacggtaagtggacggaagccaaaaagtaa

SEQ ID NO: 557 - DNA, 363 bp, Klebsiella pneumoniae
ccgccgccgaaggcgatgagcgcattgccgccgccctgtttacgctcggtcaactgcccctcaacgcccagggattgcccgccgctcagtaccatgccgacacgctgcagatcctcggcaacccggactcctccgccatcggtatgggacgcctgctcaccgccctgcaaacgctgctctggcgctatcctcagcacgccgccgcggtgcgggatctgtttaatcagtggcgggtcggcgcgctcatcagcaacagccccgccagccaggccgcggcgccgatgcaccactggacgctggcggcggatgaaccgcgggacagctttggctaccggctgtatgccagccatacgctgcggctga

SEQ ID NO: 558 - DNA, 222 bp, Klebsiella pneumoniae
aactttgcgaatttgtcggctgggccattacccctcatcaggttcgccctgacttgtatccaagcgagcttgatgggatgccacgagctgcagaggtgtgacatgtcacaacagtcaaccgctaagcctgatcctcgctacttccagaagctgctaccacgcagcatcaggtatgacccaataagcgggattttttacctcattgcgaagcgggcagagtaa

SEQ ID NO: 559 - DNA, 984 bp, Klebsiella pneumoniae
tcctctgcgaaatttatcgtagctatttgcccttttttggcgcggcatgcccgcaaaaggggcacccacggcacgctcatgcgcagcgattggcagaatgacgcatccggtggcagccagcctggcgaatttctgctaccatccctgcactattcaccttgcacagtggcagcgactatgaaattcgtctcttttaatatcaacggcctgcgtgcccgcccacaccaactggccgccatcgtcgaaaaacaccagccggacgtgattggcctgcaggaaaccaaagttcacgacgacatgttccctctcgaagaggtcgccaggctcggctataacgtcttttatcacgggcagaaaggccattatggcgtcgcgctgctgaccaaagagacgccgattgccgtccgccgcggtttcccggacgatggcgaagaggctcagcgccgcatcattatggcggagatcccgtcgcccttcggcaacgtcacagtgattaacggctatttcccgcagggtgaaagccgcgatcatgaaaccaaattcccggccaaagcggcgttctatcagaatctgcagaactatctggagaccgaactcaacaaagagaatccggtgctgatcatgggcgatatgaacatcagtcctaccgatctggacatcggtatcggtgaagagaaccgcaaacgctggctgcgcaccggcaaatgttccttcctgccggaagaacgggaatggatggaccgcctgctgggctggggcctggtggatacctggcgccaggctaaccccgacaatcatgagcatttctcgtggtttgattaccgctccaaaggcttcgacgataaccgtgggctgcgcatcgatctgctgctggccagccagcctctggcgcagcgctgcgtggaaaccgggatcgattacgagatccgcgggatggaaaaaccgtccgaccacgcgccggtgtgggccaccttccggccataa

SEQ ID NO: 560 - DNA, 660 bp, Klebsiella pneumoniae
tcgtgcgcgaaggagtgcagagtgttcgctgagtttggtgttctgaattatttaacctatctggtcggggcggtgtttatcatcctcgttcctggccctaatacgtttttcgtgctgaaaacgggtattgcccacggggtgaagaaaggctatctggcggcggcgggcgtctttattggcgacgcagtgctgatgtttctggccttcgccggggtggcgacgctgattaaaaccacgccagtgttgtttaacgtcgtgcgctatctcggggcaatttacctgctgtggctcgggggcaaaatgctctatgcggtgctgacccagcgcgacggccagtccgacgccagcgcggagccggcgagcgcgatcctcaagcgctccctgaccctgagcctgaccaatccgaaagcgattctgttctatgtgtcgtttttcgtgcagtttatcgatgtcaacgccaaaacccccggcgtggcgttctttatcctggcgctgaccctcgaggtgattagcttctgctatatgagctttttgatcctctccggctcgtttgtcacccgctacgtcaaaacccgcaagaagctggctaaacttggcaacagcctgattggtctggttttcgtcgggttcgccgcgcgcctggctaccctgcagtcctga

SEQ ID NO: 561 - DNA, 486 bp, Klebsiella pneumoniae
atgatgaagaaactcactgcactgtttgttgcctctactctggctctgggcgcggctaacctggcacacgccgccgataccaccaccgcgccgagcgacagcaagccgatgatgatgcatcataaaggcggcccgggtcagcatgacatgatgtttaaaggcctgaacctgaccgatgcgcagaagcagcagatccgcgacatcatgaagagccagcgcgaaaatatgaaacgtccgtcccttgaagaacgccgcgcgatgcacgatctgatcgccagcgacaccttcgataaggcgaaggcggaagcgcagatcgataagatggaagcgcagcataaagcgatggcgctgtcccgcctggaaacgcagaacaagatctacaacattctgaccccagagcagaaaaaacagttcaatgctaattttgagaagcatctgacagaacgcaacgcgccggcaggtaaaatgcctgcacctgctgaataa

SEQ ID NO: 562 - DNA, 219 bp, Klebsiella pneumoniae
ccagtggagaaacagccgtttactggcgggatttgcttttgcatgctaataaagttgcgtaacgaattttatcaggtacagtgtgacgctttcggcgatctggcaacagatttgcttgacattcggccaaaaattcttcgtgctatgtcacctgacgagaaaaagtcagcaaactcaagcgcctggttttacggagatgaaacgggtgttcagggttga

SEQ ID NO: 563 - DNA, 2439 bp, Klebsiella pneumoniae
ccaggctggaatacatcgctgaagcaacaggcaacacggggagccaatgtactgccggacggcagttttgaatcctatgccgtcggcgatgttctcagtaatgcccgcgctgttatcaccagtgaagctgcgcacagcgggaccaaaagcctgcgtgttacgcgcagtacggagtacaacccgaacgcgacggataataacgatacccatatcttttctggtatgcaggttcgcgataatgcggtctattacgtggaggcgtgggttaagttgccggctggctcgaccgccgatccgaccgtttatatggtgctaggattttccttccaggattctgccaatggctggtcgtggcctggcctgaacgtgaaagtctccgagttgtcggtggacaactggacaaaggtcagtggctatctgaccaacaaccgaaccgcactgaaacaggcaatggtgaggatctccatcccgaatacaccaaaagttcgcctgggtgacgccttcctgattgatgatctgatcatcactgacgtgaccgatgcgaaagcggcgctcgatgccgccgatgcgaatgcgcaggcgctttccagtctgtccgcgtcagtcacgcagaacgggaagaatattacgtctcagggcagcgcgatcacgaagctgcagtcggatgtgacgcaacttggtaaggatatcagcggcaaggccgatgccagcgcgctgacgaatctgacgacccgcgtgacggctaccgaaggcagcctgaaatcgcagggagacagcctgaccaacctgcagaacagcctgaacaccaccaacaacaacgtggcacaaaaggccagcgcgcagtcggtgagtgatctcaccagccgggtcaccagtgcggaaggcaaaatcacctcccaggggcaggctatcacgaagctgcagggcgatttgagcagcaccaccgataaggtcaacaccaaagcggatcagacggcgcttaacgcgctgactggccgggtggagaaaaccgaggcaggcctcacggcagccaacagcaacatcgtcagcctgacggcggcggtgaacgccgggaatgctgccggggatgattacatcccaaacccgtcatttgatccggcgtatgaccgcatgggttatgacgtggtggagaccactgctgcaggtgtgccggctgactgcccgttcaggtatgccgtccggctggccgggcgagaccatgtgccaaaaatcaacaacatcgctgtgacgccgggcgacgtttacgaaatgtctgctctggtagcgtgtggtaccggcagcgctgactttaatttctacatcggtcgggccaccactgctactggtggtattggggcgagagcgtccgggggaaacaccaagaccaccaccgcgtggaaacgagccacctggcgctttactgtgccggcagacacgaacttcctgcgaccgttcctgcaggttaatcagagcagcccgttcggcactgtctggtacgctgccgactggcatatgcgtaacgtgacggcggcgaacagtgcgcagaaaaccgcagatgcgaccgcaaaagcggtggattcactgaccaccacggttagccagcagggcgatacgctcagcagcatcggcacgcggaccacctcgctggagaacagcctccggtcgacaaacgatacggtgagtaaaaaggctgacacgacagcggtgacgcagttgcagggcacggtgacgcagcaggggaatgacatcgcggcagccaacagcgcgctgacaaaactcagcagcgatctggccacgacgaatgcgaatgtgaacaaaaaagcggacgcaagcgcgatgaacaccctgcagaaccaggtcactgagcagggcaaaacactcagtgcgcaaggggattctctaacgcaacttagtaacagcctgagccagacggcagcggatattgacgccagcgggaaaatgccgggcaacctcattgtcaacggcagttttgagcgcggcgcggcgggctttaccggctggagcagtaccgcgacggtggccgatttacaggttccgcattcgggtaacaaggcgctgaaaatgtccgccggccagtcgaacctggtcgggcaggaaatcagtatcacgcagggtcgtacctaccgcatgggggtatgggcgaagcaggacccgggaaccacgattaaagatgcgggtaacacgaagtttcgtgtggccgacagcactggcctgctggtcggctcaaactacggaccgtttagttctggctggcaactggtaacgtttgactggaaagccacgaagaccacgacggccagtttccagctgacgaccttcctcagcgcgggggcaatgtatttcgatgatttccatgtcctcgatgttacggatgaaaaggatatagcagataatgccggggcccattttttcaaatga

SEQ ID NO: 564 - DNA, 183 bp, Klebsiella pneumoniae
tgggtgtggaatatgtttgaattcgacgcgtttcatctggcccgattgcaattcgcctttaccgtatccttccatatcctctttccggccatcaccatcggccttgccagctaccttgtggtgcttgaggggatgtggctgcgaacccgggataatgtctggcgttcactctacaatttctag

SEQ ID NO: 565 - DNA, 906 bp, Klebsiella pneumoniae
aacataaggaatggtatgccctacgatagcgtttatctggaaaagcgtccgcccggcgcgctgcgcaccgtatggcgtaagttctatggcgacaccacggcgatgatcggtctgtacggctgcgcgggcctgctgctgctctgcgtcttcggcggctggttcgccccctacggcatcgaccagcagttcctcggctaccagctgttgccgccgtcgtggtcgcgctatggcgaagtctccttctttctgggaaccgatgacctcggccgcgatgtgctgagccgactgctgagcggcgcggcgcccaccgtcggcggcgcttttgtcgtcaccctcggcgccacgctgtttggtctggtgctgggcgtgattgccggatcgacccacggcctgcgctcggcggtgatgaaccatatcctcgacaccctgctctccatcccctcgctgctgctggcgattatcgtcgtcgcctttgccgggccgcatctcagccatgcgatgttcgccgtctggctggcgctgctgccgcgcatggtgcgctccgtctacagcatggtccacgatgagctggagaaagagtacatcatcgccgcccgcctcgatggcgcctcgacgctgaatattctgctgttcgccatcctgcccaatatcgcctccggcctggtgaccgagatcactcgcgccctgtcgatggccattctggatattgccgcgctgggctttcttgatctcggcgcccagctgccttcgccggaatggggagccatgctgggcgatgcgctggagcttatctatgtggcgccgtggaccgtgatgctccccggggcggcgattatgctcagcgtactgctggtcaacctgctgggcgacggtattcgccgggcgatcattgccggggtagaataa

SEQ ID NO: 566 - DNA, 1275 bp, Klebsiella pneumoniae
ttagtgtttgatccccagcgattccgccagctgacgggccagctgattctggtcatcggcgccatattcccagaacatggccccggcgaggcccttcgccttgatatagtccgccttaatggctaccgagcgcgggttctcataggagagggcgaacagcggcttgccctccgcggactgcaccgacagccacggaaccttcgcctcatcgtcccagtgctcggtaaaacgcttttgcggatcgttgagcagtttgcccacgatatcattgtatttcacgtaggtgtctttgctcaggtcatagcccagcgaggcaaacagcgcgatctgttgtggcccaaaatagggctgggtgaccggattgttttgcgcatccgctttcgtccagtcaatccccggctcgaccgcccgtttcggtacccggccataaaaaccaatcccgaggttcatctggctgggtttaagcccggcggccaggtaattgttgaccacaaaatcggcgctgtatttatccgctgcggcgaccgtcggccagtggctggagtcatacagattcgagttgaagtactgcgtgccgtaggccatgtcgtaggtcatcaggttgatgtagttcagcaccggggccaccgctttgacgtccacccagcttttcgggctctcggcattggcgcctacggcgatagtcaccagcttttgctcaccgactgcctcacgcagcgatttcagcagggcagtgaagttgtcgcggtcagccggctggctggccaccagtccccaggcgccgttgaccggaaactcccagtcgaggtcaatgccgtccagaccatattgctggatgattttctgcgcggaacgaataaagacggcgcgactttctgcggtcgccgccgcgccggagaaaccacgcgcgccccagccgccgaccgacagcaggactttgaggtccggattctgtttacgcagggcggggagcttttgcagatccgcctgcaccttcggcgacagccagatctcgtgcagatgagcaggatccttcagggccgcattggtctcgtctttttcatcgttatagataaggccaaacgagtagttgagatgggtgatctgccggacgtccagcttatcgatatcaccgcccggcccggcggtcacgtcgccgccgccgttaaaatagccgacggacatcagcggttgggcagagagcgcggaagcgcaaagcaagggcaaggctgccagcaagggcaaacgtttcatagtggttcctctttgacataa

SEQ ID NO: 567 - DNA, 288 bp, Klebsiella pneumoniae
aatgcgtttgataaccgctatgcgtccagcttgttggtacgtcatgagttccccttgttaaagacgcgttggtggttcgcctgctgcctgttgcgtggcgctggcttccctcgctcccccgagtatgtcgggtataagtctatctgccacggcgagtttcacccaataatgcgcggtatgatataccatgattgccgattcgtttatctgattacgcaacaggagaaggacatatgtcagcgaagcgccgcattgaggccgcgatatttgatatggacgggttgctga

SEQ ID NO: 568 - DNA, 1188 bp, Klebsiella pneumoniae
atatggtctgagtcagaaaaagggcgacgaataatcccgccaggccggcgactcacgtcgccggcatcccggcctgcaaagcgggccaaacctgtatatactggttttttaatcctttttccggggtggtgcatcttggcgtcgcgtcgcgcgatcgggcactggctgatattgctgctgctctctgttctcttttcctcgctgctgttacgaatacacctgccggcagcgctgctgctggggccgctgatcgccggtctcattttgagcctgcgcggggtgaagttgagcatccctcgcccctgttatctggcggcgcaggccatcgtcggctgcatgatcgcccgggcgattaatccctctgtttttggcgtgctattcaacaactgggcgctggtgctggcgatcctgttgaccaccctggcgataagcggccttaccggctggctgctggtccgctacagcgcgctgccgggcgccactggcgcctggggaagctctcccggcggcgcgtcggcaatggtggtgatggcccaggagtacggggccgatgtgcggctggtggcgctgatgcagtatctgcgggtgctgtttgtcgtcggcgcggcggcgctggtggtgcgctatgccctgggcaatgaagcacaggagatgactcaggatattgtctggtttccatcgttgaccctgaatttccctttcacgctgctgctgacggcggtggcctgttggctgggcatgcggctgcgcatcccctccggggccatgctgctgccgatgctgcttggcgcgctggcccagggcggcggctggctgatgctggagctgccggagtggctgctggcgatggcctatgcggtgctgggctggacggtggggctccagtttaataaagccatttttctgctggccctcaagacgctgccgcagattatcgcctccatcctcggactgatcctgatgtgcgccctgatggcccttgccctgacccacattctgcagatggactttatgaccgcctatctggccaccagccccggcgggctggacacggtggcgattatcgccgccggcacccgggcggacatgtcgtttattatggcgctacagacgctgcggctgtttaccattttgctgaccggcccggcgatggcgcgggctatctcccgctatgcgccgcggcaataa

SEQ ID NO: 569 - DNA, 309 bp, Klebsiella pneumoniae
tgcaaaactgattttgtattttcagatactggcccagcaatgggccatgatgaggtaaaacatatgctccagatgttaacccttgaagagtgggcaaacgagaaatacagaagcaatcctccaagtgtttccactctcaggaattatgctaaacagaatatgttttctcccccagccaaaaaagaaggtcgattctggcgcgtcagggaggatgctgagttggtcggtacattgaccactcctgtagtaaagaaaagcgaccctgttcttttgcagaggattttgaacgatggctgccagaccacgtaa

SEQ ID NO: 570 - DNA, 477 bp, Klebsiella pneumoniae
aaaccagctgacgaatcgtcgcattcagtatcgcctgacccgcgatttcatcattcactacgtggaggactcctcgtgatccgaatggaagttaaagggctggatgagctggagcggcagttaatggccctgggcgaaaaagtggcgacgaaggtattgcgggatgccgggcgcgaagcgctaaaggtcgtcgaggaagatatgaagcagcatgccggctttgacgaaacgtctgccgggccgcacatgcgggactcaatcaaaatccgctcttccacccgcaagggtaaagggaacgcggttgtaacgctccgtgttggccccagcaagcaacaccatatgaaggcgctggcgcaggagcttggcacggttaaacaggttgcagacccctttatccgacccgccctggattacaacctccagaccgttttgcgcgtgttaaccgtggaaatccgaaacggcattgaaaacaggtag

SEQ ID NO: 571 - DNA, 723 bp, Klebsiella pneumoniae
tcaggagctgatatgcgtcagaaaacgattaaggccatccaggaacatgcggcggcagaatatccgcgcgaggcctgcggcctcgtcgcccagaggggccgagcggagcgttatttcccctgccggaacctggccacagagtcgaaagataattttgtgctggcgccggaggattatgcggaggttgaggaatggggaacgatcaccggtattgttcacagccatcctgatgccaccacccagccgagcgaactggataaagcgcaatgcgacgcgacccttcttccctggcatattatcagctggccagaaggcgatctccgtaccatccacccgcgtggtgagttgccgctcctcgagcgaccattcgtgctgggccactacgattgctggggcctggtgatgagctattttcggcaaacccacggcatcgagctgcacgattaccgcgtcgattatccgtggtgggaaaaggagtatccggacaatttttatcaggactgctggtatgaatgcgggttccgtgagtttgatggtccaccacaaccgggtgatatggtgatcatgcaggtgcaggcggataagtggaaccacgccgggattctgctggaagaaaatatgctcctgcatcatctgtatggccatctcagcaatcgcgtgccgtatggtggatactggatggaaaggacgatgaaaatcgtgcgacatcattcactattttaa

SEQ ID NO: 572 - DNA, 213 bp, Klebsiella pneumoniae
aagtggtatgaggtgggttatatggtagacattgaaatgattgacgaggaagaggcaatgcggatgatccgagtatcttcacgcgtgaccatccgcaaatacaccgagcgctataatttccccaaaccggtccggacctatcctaagcaatatctgcgctctgctattgtggagtggatcttaaacgggggaatcaaccagaaatcatcctga

SEQ ID NO: 573 - DNA, 1272 bp, Klebsiella pneumoniae
tttatcggtgacgatagcagccgttcaccaggccgaagaaccgcatgctgtcaacctttctctcgaggagaatattctatgaaagcactcacttatcacggcccgcatcatgtcagcgtcgacaacatgcctgacccggctcttgaggcagcggacgatattattctgcgcgtcaccgcgacagcgatttgcggttccgatctgcatctgtaccgcggaaagatccccggcacgcaccatggtgatattttcggccatgaatttatgggggaagtggtggaagccggttccgaggtcaccgcggtccgcaaaggcgaccgggtggttatcccgtttgtcatcgcctgcggagactgcttcttttgtcgcttgcagcagtatgccgcctgcgaaagcaccaatagcggccagggagcgacgctcaatcgaaaaggcatttcgccaccggcggcgctgtttggctatagcgatttgtacggcgggatcccgggcggccaggcggaatatgtacgggtccccaaagccaataccggaccgtttaaagtgccagacaccttacccgatgaaaaggtgctgtttctgtcagatattctgcccaccgcctggcaggcggttaaaaacgccgaggtcaaacccggcagtagcgtggctatttttggcgccggcccggtaggcctgctctgcgcctcctgcgccaggctcaatggcgcagaacagatatttatcatcgatcataacgattaccgactcgatttcgcgcaacaacgctatggcgcgatcccgataaactttgaccaccatgacgatcctgcgcagtggattatcgataacacgccgggccatcgcggcgtcgactcggtgatcgacgccgtgggcttcgaggcgaaaggtagccttacggaaaccgtcctcagcaccctgaaaatcgaggggagcagcggaaaagccctgcgccagtgcatcgccgccgtgcgccgcggcggcatcgtcagcgtacccggggtttacgccggtttcatccacggctttatgtttggcgatgcctttgataaaggactgaccttcaggatgggacaaacccacgtccacgcctggctgccggatctgctggcgcttattgagcaagggctgcttaccccggaggagattgtcactcaccatatgccgctggaggaggccgcgcgcggctaccagatctttgagaaacgtgaagaggcgtgccgcaaagtgatcctcgtaccgggaatgcagcccgggaaggcgaccctctga

SEQ ID NO: 574 - DNA, 1167 bp, Klebsiella pneumoniae
atgaacggtgagcgcgtgctagaatacgccgcctcgaagttcaatgtagcgagtatttccatgtcagaaagccagaaaaaagtgatcgtcggcatgtccggcggcgtcgactcctcggtctccgcgtacctgctgctgcagcaagggtataaggtggaaggcctgttcatgaagaactgggaggaagacgacggcgaggaatactgcaccgccgccgccgaccttgccgatgcgcaagcggtctgcgataagctgggcattgaactgcacaccgttaactttgccgccgaatattgggataacgtctttgagctcttcctggaagagtacaaagccggccgcacgccgaacccggatattctgtgcaataaagagatcaaatttaaagccttcctcgagtttgctgccgaagacctcggcgccgactacatcgccaccgggcactatgtgcgccgcgccgatgtcgacggtaaaagccagctgctgcgcggcctcgacggcaacaaagatcagagctacttcctctacacccttagccacgagcagattgcccagagcctgttcccggtgggtgagctggaaaaaccgcaggtgcgtaagatcgccgaagagctggatctgatcaccgcgaagaaaaaagattccaccggcatctgctttatcggcgagcgtaaattccgcgatttccttggccgctatctgccggcgcagccgggcaaaatcctcaccgtcgacggcgaggagatcggtacccatcaggggctgatgtaccacaccctgggccagcgtaaagggctgggtatcggcggcaccaaagagggtagcgaagatccatggtacgtggtcgataaagacgttgagaataatattcttatcgtcgcccagggccatgaccacccgcgcctgatgtccgtcggtctgattgcccaacagctgcactgggtaaaccgtgaaccgctgcagggcaccctgcgctgcacggtgaaaacccgctatcgccagaccgatatcccctgcaccgttaccgcgctggatgaagaccgtatcgaagtccgcttcgatgagccggtcgcggcggtgaccccgggccagtccgcagtgttctatttaggggaagtgtgcctcggcggcggaattattgaacaacgactgcctctgcagtcctga

SEQ ID NO: 575 - DNA, 1104 bp, Klebsiella pneumoniae
agaagaggtgaacagcgggctggatcgcgtcgagcgggcctgcgcgcgtttcgtggcaggagtctcatcatgatggttattcgaccggtggagccgggcgatttgcccgggctgctgaagctggcagcggagaccggcggcgggctgacctcgctgccggtggatgaagcgaccctcgcggcgcggatcgcccgctcgcagcagacctggcgcggcgagctaccgaaaagcgagcagggctatgtctttgtgctggaggagagcgaaagcggcgcggtggtgggcatctgcgcgatcgaggtggcggtggggctcaacgatccctggtataactaccgggtcggcacccaggtccatgcctcgaaggagctcaacgtctatcaggcgctgccgacgctgtttctcagcaacgatcataccggcagcagcgagctgtgcaccctgttcctcgacccgcagtggcgcaaagagggcaatggctatctgctgtcgaaatcacgcttcttatttatggccgcctttcgcgagcgcttcaatgagaaggtggtcgccgagatgcgcggggtgattgacgagcagggctactcgccgttctgggagagcctgggcaaacgctttttcgccatggagttttcccgtgccgactacctgtgcggcaccggacagaaggctttcattgccgccctgatgcccaagcatccgctgtatatcgatttcctttcccctgaggcacaggcggtgatcggcaaggttcatccgcagaccgccccggcccggacggtgctggagaaagaggggttccgctacctgaactacatcgatattttcgacggcggcccgactctggagtgcgacatcgaccgggtgcgggcgatccgcaaaagccgtctggtgaccaccgaggccggcgaaaccccgcccggtgactggccgctgtgtctggtggcgaatgaacagtatcaccagttccgcgctctgctggtacatgccgatccggatggcgacaccctgaccctcagcgcccgcgaactggatatgctgaagtgtcatgccggcgaccaggtgcgcatggtgcgcctgatccctgaggagaaaactgcatga

SEQ ID NO: 576 - DNA, 495 bp, Klebsiella pneumoniae
gaaacacgtttcatcgaaatgcccgacggtaaaaagtggagggcgtattctccgctcgccaggcgccgatttctttgcggtaacgcaggtttgcacgctattgtccttcattgccagcgctccatcgccaggcagcgccccgtcggcgggcagtcctcgcgatcgtgggtcaccaggatcgccggaatggcctggcggtccagttcttcaaagacccagcggcggaacccggcgcgcaggctggcatccaggcggctgaagggctcatcaagcagtaatgcctcggggcgcgccagcagggcgcgcagcaggctcacccgcgcccgctgcccgccggagagcgtggccggatcgcgcggggcgaagcccgccagcccggcgcggctaagcgcttcctccaccgcggtttttcgcgcctcgccgcgcacgttctccggcagcgccagctgtaaattttgcccgacgctgaaatggtcgaacagtaacggatcctga

SEQ ID NO: 577 - DNA, 1209 bp, Klebsiella pneumoniae
attgaaatcgagtccggcacagccgcttttggccgcttccacacagttatcggcgccgaggccgcccgccagcatgacgttgcgcagatcctggccctgcagcaggctccagtcaaagcgctggccgctgccgccctggccgttgtcgagcaggtacttgtcgacatggcggagcgtacgggccgggaaggtttcgccgacgctcagcgctttccagatgcggacgttgtccgcgagggcgtcgcgcagcgcgtcgatataggcctggtcttcatcaccgtgcagctgcacggcggccagccccagagcctgcgcgcgggcgaccacctcctccagcggcgcattgcggaagacgccgacgtactgcagcggcgcagcggcgatcaccgctttggcctgggcgtcatttaccgctcgcggcgaggtcgggacgaagatcagcccaccgtagatggcgccggactcccaggccacctgggcatcctgcgggcgcgtcaggccgcacactttgttctcgccgagcagcacgcgtttaaccgccgcttccagatccgcctgctccatcagggcggagccgatcaggaagccgttggcgaagtggctcagctcgcgcacttcggcataggtatggatgccggattcgctgatcaccgtgacatccgggccgagacgcgccgccagctgacgggtgcggttaaggtcaatcgacatatcgcgcaggtcgcggttgttaatgcccaccaccttcgccttcagggcgatggcgcgctccagttcctcttcattgctgacttcggtcagcacgcccatattcaggctgtgcgccaccgccgagagctgacgatactgttcatcgtcgagcaccgagagcatcagcaggcaggcgtcggcctgatagtagcgcgccaggtagatctggtaagggtcgatggtgaagtccttgcacaggatcggctgcggcgcgacctggctgacgatcggcaggaaatcgaagctgccctggaaatatttctcatcacacagcaccgagatcgccgaggcgtagtgcttgtagatgctggcgatcgctgccggatcgaaatcctcgcgaatcaaccccttcgacggcgaggccttcttgcactcgagaataaacgcggtgcgggtgccggccagcgcgtcatagaaattgcgctgcgtcggaacgatctcattttgaaaactggctaa

SEQ ID NO: 578 - DNA, 231 bp, Klebsiella pneumoniae
agtttcaccgaaggcgcgttcaaagactggggctaccagctggctcgcgaagagttcggcggcgagctgatcgacggcggtccgtgggtgaaaatcaagaacccgaacaccggcaaagagatcgtggtgaaagacgtgatcgccgatgcgttcctgcagcagatcctgctgcgtccggcggaatacgacgttatcgtcctgtatgaacctgaacggcgactatatctctga

SEQ ID NO: 579 - DNA, 246 bp, Klebsiella pneumoniae
tccagtgccgaaagagactcatcgagcagcagcagacgcggtttgttgaccaccgcgcgggcgatggccacgcgctgctgctggccgccggagagctggtgcggtttgcgctgggcaaacgcctccagctgcaccatttttaaggcatccatcacccgtggggtgatttccgccgccggggttttctgcatccgcaggccaaaggcgacgttctcgaacaccgtcatatgcggaaacagggcgtag

SEQ ID NO: 580 - DNA, 237 bp, Klebsiella pneumoniae
tttatgaacgaagagattcgggtgaaattgtgtgccattacttcccaaagagcgattgctcaaggcttgggagtaactccccaggcagtgaatcagtggtttgctaagtctgtaatccctgctcgctttgtattgaaactttgcgaatttgtcggctgggccattacccctcatcaggttcgccctgacttgtatccaagcgagcttgatgggatgccacgagctgcagaggtgtga

SEQ ID NO: 581 - DNA, 903 bp, Klebsiella pneumoniae
aaatcgtgcgacatcattcactattttaaggtgcctgtatattatgctcctaattcaatttacaggagcatgcgaatgaatgagccaatcactgagcagttatacaataaagttgtaaatttcgttaataaaatggatgggagtgtgcgctttgattatatttctaagtccttgcgcattcctcctgacactcttgatgaaattgtggacaggatgattgctgatggagtcgttgttaatacaggaacggtaggtgaatatttaccagtaaaacacgcatcttccaaaaacactgataaagataatcgatgctgtacatctcaaaaaaacaatgatagtagtggactaaaatttcttgttgggagagtagcattagttatagccataatattttttattataacctgcttttatgcttacagagcaccgatatcgtttgtttttctaatcccagccataatggctgcatttgtttttacaaaccaaaatcatggtggagaaggtttcctagggttgagttcaatctctgcatgtttaatctttttgctccttactaatgcgcagacaccaatatttggagaagcatatgaattaagaaagcagagggatgaaattaaaaatgaagttactaggaaatcaaaggaagaagatcagcaacagctaaatgatatccttaacgccagagagcatataaaagggatgctaaaagacccctcctcagctaaattttttggtgaattcattggaaaaaatggtgctatctgtggccatgtcaacgctaaaaatagttttggtggttacactggggagtctcgttacatattttctgtcaatttttctgcaatagatgaaggcaccacctcctttaataaggagtgggagagacagtgttatcttaattga

SEQ ID NO: 582 - DNA, 408 bp, Klebsiella pneumoniae
gaaaatggcgaaggagatataatgaaagtcctcaatatcctgatccgtcgatgcgtgctgattgcccgctttgaagagaccgtttcgttttatgaacatctcatttcgcaaaaggcaaggttacgttttgactatcccgaatacgatctcaaactggcgcaggtgggttccgtgcttttaattggcggaaccgagcaaagcctggctccgtttcgcgccaccgaggccactttcctggtcaacgacattaccgcctgggagaaacatctgccttccaccggggcaacgattatcaacccggtgaaggccgtgcccaccggctggaacatgctggttcggcatccggatggcatgattgccgaatacgttgagcatcatgataaaaacccggcggatgagatcttctga

SEQ ID NO: 583 - DNA, 267 bp, Klebsiella pneumoniae
gcggatagcctgagtttaggctacagcacattttcgccgaacggccccggtttaagccggtcgggccatcagtatgacgcctggcgtgcaatccgttttcatgcgagctcttacggcaaatggatctctccctgtcatgaggtatatagctttgttgaacgttgcgctgcgggacattcgccatcgcctaatgcttcaagcgtccggcagattaattgtctgaaggcgaaaaaaaacgggagcccatcggctcccgcttttacttaa

SEQ ID NO: 584 - DNA, 759 bp, Klebsiella pneumoniae
accatgagccttaacgcgaattatcagaagttagagccaggcgatgaggttcgtctcctggagatcgatggccaggcgtttggcctggacgaggttttgtatttccacggctataacgtcccccatactgcagccgaaatcctcgccgctgacggcgacctggataagctgcctgcgaaaagcatctggtggcaggggcgggagtataaagcctggccatgtgtaatcgaagggatcgagtcatccaccactggcagcgacgcgcagccaacgctgcgggtagggaacatcgacgggaaaatatccgcgctctgtcttcattacgacgatctggctctggcgcgggttgtcatccacgacacgcaaaaacagtatctcgatgcgaagaactttccggacgggaatgcctcagctgatccgacgcaggagaaacggcgccttttcttcattgacgtaaagcattatgaagacgatgagaaggtggaatttactctctccagcccgtttgccctgcaggggatgatgatccccactcgccagctgcatgcgatttgcacctggtgtatccgcaatcaataccgcagcggtaacgggtgcgactatgccggcacccggtattttgacaggaacaatcagccagttgatgacccgtcgcaggatgtctgcaacggaacgctcacggcctgcaaattacgtcatggtgagaatagtgaactgccgtttggcgggttccccggcacctcattaatcaggagctga

SEQ ID NO: 585 - DNA, 459 bp, Klebsiella pneumoniae
cgttgcgcagatcctggccctgcagcaggctccagtcaaagcgctggccgctgccgccctggccgttgtcgagcaggtacttgtcgacatggcggagcgtacgggccgggaaggtttcgccgacgctcagcgctttccagatgcggacgttgtccgcgagggcgtcgcgcagcgcgtcgatataggcctggtcttcatcaccgtgcagctgcacggcggccagccccagagcctgcgcgcgggcgaccacctcctccagcggcgcattgcggaagacgccgacgtactgcagcggcgcagcggcgatcaccgctttggcctgggcgtcatttaccgctcgcggcgaggtcgggacgaagatcagcccaccgtagatggcgccggactcccaggccacctgggcatcctgcgggcgcgtcaggccgcacactttgttctcgccgagcagcacgcgtttaa

SEQ ID NO: 586 - DNA, 189 bp, Klebsiella pneumoniae
aatatggcagagcatcgtggtggttccggtaattttgctgaagaccgtgaaaaagcttctgaagcaggtcgtaaaggtggtcagcacagcggcgggaactttaaaaatgatccgcagcgtgcgtccgaagcgggtaaaaaaggcggacagaatagccacggcggtggccgcaagtccgataattcctga

SEQ ID NO: 587 - DNA, 219 bp, Klebsiella pneumoniae
cacggtcaagaatccttccgggagttcgcggccttcacgaaaaaccagtttgctgcacgattgtggggtagagattatttcatcaccattatcaagcatactgccaacgagtgcagcggatgcgccctgcatgattcgggccttgccagcaccggaaataatagtggactcgctgccatcagcatatacaaccttgtcacctacccgagcaacttgtaa

SEQ ID NO: 588 - DNA, 462 bp, Klebsiella pneumoniae
tatatgcaagatgcacataatgactacgacattaccgactttcacggcgcgctgctggatatcatcagcgtaatgaaccagccgctgcgcgatgagcagatcctgcaggcagccggcgtccagctggaacagatgctgtttccgctgcttgtggcggtagggcgccatggcccggtgggggtggttgagctggcggatcatttagggcgcgattacaccaccgtcagccgccaggtgaaaaaactggaagcccagggactcgcctgtaagcaaccgaaccgtcatgatcgacggatcagcgaagtgacgcttagcgccagcggacaacagatgatcgacagtattgcggtagcgcggcggcagttaatgaatcaggtgctggcgcagtggccggaagaggaggtgcaggcgctgtttcgcttaacgcgcaaatacgccgacagtttgcagcaaccaggataa

SEQ ID NO: 589 - DNA, 597 bp, Klebsiella pneumoniae
agcatgcaagaaaccatgacgagaatagaactgtctggagtcctgggtaaaacctttgggaaggttcattatcgtttaataaagaacatcaatgaagccggagaggcattatctgcgacgatccctggatttgaaaggttcatgatatccagtgaggagcgtggattgacctatgcagtatttaaagggaataagaatatcgggcatgatgatttaggattccctgtaagtggcgaaattatccgcatagtccctgttatcattggcagtaagaaggcaggaattctccaaacaatccttggtgcagttattgttgcggcaagtgttgcctatggttttttcacagaggattgggctaatgccgcgtatggtattcaagctggcggcgccatgatgctcggcggtgtcgttcagatgctctccccacagccagctggcctggcacgaaaagaatccgctgacaataaagcgtcctacgcctttgggggcgtgacgaacactgcctctcagggatacccggtccctttgctttatggcaaacggcgaattggcggcgccattatatctgccggtatttacgtagaagaccagcaataa

SEQ ID NO: 590 - DNA, 687 bp, Klebsiella pneumoniae
atggttgaagaaaacgcgaaaaatacctcctatcgcttcgtattggagcccgctattagcgatgatggcagctgctactcgtgggaattgctcactaaagatattatagcacccgcacgaaataacgcctcagcgcccgcgttttctttctccacgcttaccgaaagcgataagcttgcactatttacccgacaaatcgagttgctttccgtatttgatttttccctggtcgataataagccgatctcgctcaatatcgatgatttattaagccattttattctgacggaccgctatctctgcgattttctgcgctcgtgtaagcatattgctttggagataaatgagaattttcatgagtttatcgccggccgcgagctgacggcgctaagcacgctggcggcgctttgtccggtctggctggatgattttggtcgcgggcgaacctccttcccgctgctggagagattccgcttcgattgcgtcaaagtggataaggattacttctgggataaagaaaacgaccccgctttgcccggtctgttgcagtctattcataccctgaccggccatgtgatcgttgagggtatcgaaaccgaaaagcaaaaacggttaatcacttctgccggggacatcataggtcagggccgctactggaaggaagaatatatttttctttgcggttga

SEQ ID NO: 591 - DNA, 1281 bp, Klebsiella pneumoniae
cattgccgagaccgcataaacatgaataacgaacaggctgcagagatcctgcaggatatctttcaacatgcggtcaacagtgcccgcgccgggccggtgaccctggctaacctgccggaaaaacctcgcggccgttgtgtggtgatcggtgcgggtaaagcgtccgcggcaatggcggctgccgtggatgcggcctggccggatgtggcggtgtcgggcgtggtggtgacgcgttacggttacgcggttcctgcgggccgcatccgcattattgaggcggctcatcccgtatcagatgccatgagcgaggttgccgcaatgctgattgtggagacgctgcgcggtttaactgccgatgatctggtgctggcattgatttcagggggagggtcggcgctgatggcgctgcccgccccggggttaacgctggcagataagcagaccatcacccgggccctgctccatagcggggccagcatcaaagagatgaatctggtacgtcgtcatctctcagcggtgaaaggcggaaagctggcgaccatggcgcaaccggcgcgcatcgtatcactgattatcagcgatgtgcctggcgataatccgacggacgtagcgtctggccccaccgttgccgataacagcgcaccacgtgatgcgctccgggtattgcagcggtatggcattgcgatcccgaagcccgttagcgaacggctaaaccagccggccggcccggtggaaaacgccgcgacaggcgaggtcaggcttatcgccacgccggcgatggcgttagcggcggcggctctggccgcacgacaacatgggttcaccccccttattttgggggatgctatagaaggtgaaagcagggaagtggcggtggtcatggccggtatggcgagatcggcgaagcagtatggtcacccgatttcagggcctgctgtgctgttgtcaggtggcgaaaccacggtgacagtaaacaacactcagcctggaaaagggggccgcaataccgagtttttactcagtctggcctgtgcgctccagggggaacacggtatctgggccatggcgggagatagcgatggtattgatggcacagaagatgccgcaggtgcgatcgtcttcccggatacgcttgcgcgcggcaagctgagcggtcttaatgcagtgcaatatctggatggccatgatagttactgctattttcacgcgcttaatgatttgctgatcaccggcccgacgttaaccaacgtcaatgatattcgggcaatattgattgcctga

SEQ ID NO: 592 - DNA, 1041 bp, Klebsiella pneumoniae
aggataagagaggtcagtgtgggcccagtgatgttggatgtcgaagggtatgagctggatgcagaagagcgagaaattctggcgcatccgctggtgggagggttgatcctctttacccgaaattatcacgatccggcgcagctgcgcgagctggtgcgccagatccgcgacgcctcccggaaccacctggtggtggcggtcgatcaggaaggggggcgggttcagcgtttccgcgaagggtttacccgtttaccggcggcccagtctttcgccgcgctgctggggatggaagaggggggcaaactggccgccgaagccggctggctgatggccagcgaaatgatcgccatggatatcgatattagttttgcgccagtgctggacgtcggccatatcagcgccgcaatcggcgaacgttcttatcatgaagatccgcagaaagcgctgacgatggcgcgtcacttcattgacgggatgcacgccgcgggcatgaaaaccaccggcaaacacttcccgggacacggggcggtgactgccgattcgcacaaagagacgccgttcgatccgcgggcggcatcggttatccgcgaccatgatatggcggtgttcaaaagccttatcgccgagcagcgtctggacgccattatgccggcgcatgtgatttacccggagctcgatccgcgtccggccagcggctcggcgtactggctgaaaacggtgctgcgcggcgaactgggctttgacggggtgattttctccgacgatctgtcgatggaaggggcggcgatcatgggcagctatgccgaacgcggtcaggcatcgctcgacgccggttgcgatatgatcctcgtctgcaataatcgtaaaggcgcggtcagtgtgctggataacctgtcgccgatcaaagcagagcgtgttacgaaattgtatcataaaggttccttttcccgtcaggagttaagggattcagcccgttggaaaacggtgagtgcccagctggagcagcttcatgcgcgctggcaagaggcgaagtccgcgtaa

SEQ ID NO: 593 - DNA, 621 bp, Klebsiella pneumoniae
cagaatctggagaatcacatgcagcttaaacgtgtggcagaagccaaactgccaaccccctggggcgatttcctgatggtgggttttgaagaactggcaaccggacaggatcatgtcgcgctggtgtatggcgatatatcagggcagtcgccggtcctcgcccgcgtacattcagagtgtttgacgggcgatgccctgtttagcctgcgctgtgattgcggctttcagctggaagcggctctgtcgcatatcgctgaagaaggtcgggggatcctgctctatcaccgccaggaaggacgcaacattggtttattgaataagatccgcgcctacgcgctgcaggatcagggctacgacactgtcgaagcgaaccatcagcttggcttcgccgccgatgagcgcgatttcaccttgtgcgccgacatgttcaaattgctcaacgttgagcaggtgcggttattaaccaataacccgaaaaaagtggaaattcttaccgaagccgggatcaacattgtggagcgggtgccgctgatcgtcgggcgtaacccgaaaaacgctcactatctggacaccaaagccgccaagatgggccatctgctgaacagcaagccgacagaataa

SEQ ID NO: 594 - DNA, 543 bp, Klebsiella pneumoniae
ggtatactggaaaaagcgcgtaagggagagagaatgaaaaataagcttttggtcagcgcctgcctgatgggattccaggtgcggtataacggtagtgagaaggcacagctggcggcgacactgtcccgctggcagcaggcggggcggctggtgatccactgcccggagctggcggccggtctgcctacgccccgactgccggcggagatcctcggcggtaccggcggcgatgtgcttgccggacgggcgcggatcgtggaaagcgacggccgcgacgtcaccggacattatcagctggccgcctggctggcgctcagcgccgcccgggaagcgggctgtcaggcagcgttactcaccgacggcagccctacctgcggcagccagtttgtctatgacggttcctttcgcggacggcgcaaagcgggcgccggcgtggccgccgacctactccgcgcccacggcatcacggtattttccgacgggcaaatcccgcagttgctcgcctggatggcacagaaggagcaggatgatgattcagtgtaa

SEQ ID NO: 595 - DNA, 438 bp, Klebsiella pneumoniae
cgcgaagcggatgcgcgaacgcattcaggcgctggaagcgatcctggacgccgaacatccgaactggagggacaaataatggccgggctggatctgaataaaaaactgtggcgtatcccgcagcgcgggatggtaaagggcgtctgcgcgggcattgctcagcatcttgatgtcccggtgaagctggtgcgcctgattaccgtgctggcgatgattttcggcctctttttctttgtcctggtggcctacatcattttgacttttgctctggatccgataccggacagcgagctgtacggtcataaagcgccgagcaatggcgatctgctggccgccgtggatgccgaactggcctccggtgaacagcgtctgcgtgaaatggagcggtatgtgacctccgacacctttacgctgcgcagccgctttcgccagctgtaa

SEQ ID NO: 596 - DNA, 927 bp, Klebsiella pneumoniae
aaaagagcggaaaacggagagccgttttccataaacggaaaagagatgacagcagaatttcattgggatgatgcgcgcatcttcctcgccatcgcccgggcgggaacgctgagcggcgccgccgacaagatgaacatggggattgccacggtctcccgccggctggatcggctggagcaggcgttgaacgttccgctcttcagccgccatcagagcggctaccgcctgaccgacgatggtgaagccctgctcgcgcgggcggaggcgctggaatacgctggcctggcgttcggcgaagcggcgcaactgcaggggcatgtcgccggggttgttcgcctggccacctcggataacctggccacgcattttattctgccctccctgaaagggctcctggaccattatcccgagctgcgggtggaggtgctgagcggcgtgcagccggtgaacctgcaccgtcgggatgccgatctggcgatccgcatggtcaagcctgaggccgggcatctgacgttaaagcggctggggacggtggggtttggcgtctatggcgccgccgactgtctggtcggcgaggacggcctgtcgctgagcgaggcggactttgtggggtggccggaaactcaccagcacctgccggccgcccaatggatcacgcgcaccctgcgcggccggccgtgtaaagtcgaagccaatacgctcgtggcccaggtttccgcagtatccgcgggcctcggattgggcgtcctgccgcactttatggcgcgggccagcggtctgcagtgcctgcagccggagatcggtgcggatcagaccctctggctggtgatgcattctgacctggccggatccagacgcgtgcgggttctcgccgaccatctcatcgctctctttgcggaccatcaagatcggctggcgatgccctga

SEQ ID NO: 597 - DNA, 651 bp, Klebsiella pneumoniae
ttcagaaaggaatgcgcggtggccgggagaattgattacgatattgaaaaataccagtttaccgaagccggtgagacgccacggctccgggagcagtggcgcgaagtatacctggagtgtcgtcagctgcgggccggggcagaggagcgcctgcgcattgcgttactgaacgtcgactatgtcaccagcttcgagctgccttttcgcctgctgctggtgcgcgcgccgcagctaatcgccgatgttcgcgagacgttgcagcttagccgtaaagccgccgttttcaacggcaaacgttacggctgcgtctatagtttgaaacaggatttacaggctgtcccggaagcctttcattaccgcctggcaaaccgcattcgtcgcgtcgatgcaaccgggctgacggcggccccgtaccagcagattgcccgggagataaagccggcccgggagcggctccgccaggcgctgaacgccggcctgccggtcaccgctctcgacgccttgttctggttcggcagtcagcgagtggcggcggacatcgcgcagttgcgccggtccggcatggcgattgtcacgacggaggtggaggtcagcgacaatttgttcaataccacccgacgagtgcccgtttaccgcctggccagcgagtga

SEQ ID NO: 598 - DNA, 516 bp, Klebsiella pneumoniae
tgtcaggaggacgctatgcttgaagcagtagaaggtaatatccaccagcggctgtgcgcgctgctcgacgagcaccgggcccgctaccgggtgatggcgcacgaggcggtcggtcagtgcgaagccgtctcggcaatccgcggcaccgcgcttggccagggcgcgaaagcgttagtctgtaaagtgaaaggaaacggcgtcaaccagcatgtgctggcgatcctcgccgccgatcggcaggccgacctcgccagcctggcccggcatatcggcggcagcaaagcctcgctggccagcccggcggaggtggaggccctcaccgcctgcgtgttcggcgccattccccccttcagtttccatccggcgctgcggctggtggcggacccgctgctgtttgaacgctttccacaaatcgcctttaacgccgggcgcctggaccggtcgatcattctcgacaccgaagactatttacatatcgcccgaccagagatcgcgacctttcgccgtcttagctaa

SEQ ID NO: 599 - DNA, 243 bp, Klebsiella pneumoniae
agcctacgggaggtaattatgggtatgcagggccgccaagatattcagtgcgtcaccattaaggctgagcaacttaacttccttatgcagacaatttttacacatcataaggactttgactgccatcaacttgatggggttttaggtcttgcatatgaccttgctggcgaggtctattcatggatggaaaaagaggaaaagattgtacagcaaaatgaagaacacaaaagaaggggtaattag

SEQ ID NO: 600 - DNA, 1065 bp, Klebsiella pneumoniae
aactcaggggacgttaaaatgaaaaaatggtcacgccacctgctcgcggcgagcgctctggcaatcggcatgggcgctgcgcacgcggacgatagcaaaacgctctatttctataactggaccgagtatgtgccgccgggcctgctggagcagttcaccaaagagaccggcatcaaggttatctattcgacctacgagtcgaacgaaaccatgtacgccaagctcaaaacctataaagacggcgcgtacgacctggtcgtcccgtcgacctactttgtcgacaagatgcgcaaagaaggtatgctgcagaagatcgataagagcaagctgactaacttcagcaacctcgatccgcagatgctgaataaaccgttcgatccgaataacgactactccatcccctatatctggggggcgacggccatcggcgtcaacagcgaggcgattgacccgaaaactatcaccagctgggccgacctgtggaagccggaatacaaaagcagcctgctgctgaccgacgacgcgcgcgaagtgttccagatggcgctgcgtaagctgggctattccggcaacaccaccgacccgaaagagattgaagccgcctataacgagctgaaaaagctgatgcccaacgtcgcagcgtttaactctgataacccggcgaacccgtatatggaaggcgaagtgaacctcgggatggtatggaacggctcggcttacgtcgcccgccaggcaggtactccgctggaagtgatctggccgaaagagggcggcatcttctggatggacagcctgtcgatcccggcgaacgccaaaaacgtcgacggcgcgctgaagctgattaacttcctgctgcgcccggatgtcgccaaacaggtcgctgaaaccatcggttatccgacgccgaaccttgcggcgcgcaagatgctcagcccggcagtggccaacgataaatcgctctatccggacgccgcaaccattgagaaaggcgaatggcagaatgacgtcggcagcgccagcgccatttatgaagagtattaccagaagctgaaagcgggccgttaa

SEQ ID NO: 601 - DNA, 615 bp, Klebsiella pneumoniae
atcgacagtttagggtgtgttatcatgacggcggaaggccatctcttcttttcaatcgcctgcgcagtatttgccaaaaacgcagagttaacgccggtgctggcgcagggcgactggtggcatattgtgccctcggcggtattgacctgcctgctgccggacatcgatcacccaaagtcgtttcttggccaacggctgagctggatctcaaagcccgtggcgcgggcctttggccaccgcggcttcacccacagcctgctggccgtctttggcgcgctgacgctgttctatctgaaagtgcctgacagctggattgtcccggcagacgctctccagggcctggtgctgggctatctcagccacattctcgccgatatgctcacccccgccggtgtgccgctgctgtggccctgtcgctggcgctttcggctgccgatccttgcgccgcgcaagggcaatcagctcgaacgcgccttgtgtatggcgctgttcgtctatgccgtctggatgccgcagacgctggcggataacagcgcgatacgctggtcatccggggtgatcaattccctgcagatcaccttcaatcgctttataagtcaccagagtgggcgataa

SEQ ID NO: 602 - DNA, 834 bp, Klebsiella pneumoniae
atggaaagtttaatttcttcgatatggaattttgatggactgataaatagcgcgttaatttttgttacttttggtttattaggagtgtttatctggaaacgggcaggatccgcatattctttattgaaccggctatgggagttctgcctgggagggaaaacgtttcacgacggtaaaataaatgcatatttcaatgagagaaatgatgttgaacgttttaatgttttatttaatgtcggcgcaagaaataaagaagagatcaagtcactgattaactggacgaaaaagaaaaatatagatattcgtcatgtcacagccgcgaaaggatggtttgaaatatcaacgcttaaggcaataaaaccattatttatcgctaatgttggtgtatttgtctcttgtgtgttaactatgctgctattatcaaattttatgttgctggcattgaagccatccgcactagtacgattaggcgacgacaagtcatgggtttggattaatgatcatattgctgagagttcgatctggaccaataattaccttcccctgaactggactgagtggaagctcgataaaaaacagtgtgaaagtgaagatttcgataaaacggttttctcagaaaaagcggggataagtgtgcgctcggttgacaggatttgtgagaacttttcaagtggttcgttgagtgatactataaataatattattaaaaatcaaaaactggcatgggttttggctatttaccccttcatctttacgattatttgcttttttagcttgttacgcagaggtgctgcttctaaactttataatgaagtacataactcacaaaattaa

SEQ ID NO: 603 - DNA, 765 bp, Klebsiella pneumoniae
gcaaacggtttgcccgcgcccgtcgcgtggcggcgtgcagtgaggaggtgcgccatgacccaacctgatcgccgtcacctgcgccgcgcccggctggcccttgccgtcgtggtcgccgccgctctggccgcctggctgtggtttcctggcgggcgtacctttctgcagcagagtctgacggcgttagcctccctggatccgcagcaggtcagagggtttatcgccgcctgggggccgcaggccgcgctggtctcatttgcgctgatgatcctccaggcgatcgtcgctccgctgccggctttcctgattaccctggcgaacgccgccctgttcggcgccttctggggcggggcgctgtcgtggttcagcgccatggctggggcagggctttgcttctgcatcgccagagcgctggggcgcgaagtggtggagaaactcaccggccgcgcggtgctgcgcagtgccgacggctatttcacccgctttggcccgcagacgatcctggtctgccgcctgctgccgtttgtcccgtttgacccggtcagctatgccgccggactaacctcgctgcgcttctggccctttatgctggccaccggcgtgggccagctcccggcgactatcgtttattcctgggccgggagtctgctcaccgggggtaccttctggctggccaccgggctttcgctgctttttgccctggcggtggtcatctctatcgccaaaaatatttaccgtgaacgtcataagagatcgtcgccatga

SEQ ID NO: 604 - DNA, 222 bp, Klebsiella pneumoniae
ctggtggcactgacagcaatacgaattcctgagagggttcacctgcaggcgctgcaggtcctgctgcggtatcggcgccggcggatattcccgcggcgaatgcgccgcaccggctacctcagcctgaaggttaacccacgctggcgcctgttatcgaaagacgatggccggaactgggaaattatgagtcatgaaacctataaccgggagaaagacaaatga

SEQ ID NO: 605 - DNA, 1293 bp, Klebsiella pneumoniae
cgcaatatttgtcttttctggcttatgaataatgttgtcacaaaagaagagggtggctacatggataaattgcttgagcgttttttgcagtacgtttctttggacacgcagtcaaagcctggcgttcgtcaggtccccagcacggaagggcagtggaagctgttacgcctgttgcaggcgcagctggaagaaatgggactggtcaaggtaacgctgagtgaaaaagggacggtaatgggaactttgcccgctaacgttgagggcgatatcccggccatcggttttatctcccacgtcgacacctccccggatttcagtggtaaaaacgttaatccgcagattgttgaaaactatcgcggcggcgatatcgcgctgggtatcggcgatgaggtgctctccccggtgatgttcccggttctgcatcagcttttgggacagacgctgatcaccaccgacgggaaaacgctgctcggggcggacgacaaagccggcattgccgaaattatgaccgcgctggcgaccctgcaggcgaaaaatattcctcatggcgatatccgcgtggccttcacccctgatgaagaggtgggtaaaggggcgaagcatttcgacgtcgaggcctttgacgcccgctgggcctataccgtcgacggcggcggggtcggcgaactggagtttgaaaacttcaacgccgcctcggtgacgataaaaattgtcggtaataacgtgcaccccggcaccgcgaaaggggtgatggtcaacgcgctgtcgctggccgcgcgcattcatgccgaagtaccggccgatgaagcgccggagaccactgaaggctatgaaggtttttatcacctcaccagcatgaaaggcagcgtcgatcgggccgagatgcattacatcatccgcgattttgaccgtaagcacttcgaggcgcgcaagcgcaagatgatggagatcgccaaaaaggtcggcaagggattgcacccggactgttatattgagctggtgatcgaggacagttattacaacatgcatgagcaggtgatcgcccatccgcacgtggtcgatattgcccgccaggcgatggtggactgcgatattgaaccgcagatgaagccgatccgcggcggcaccgacggcgcgcagctctcatttatgggactgccgtgcccaaacctgtttaccggtggctacaactatcacggcaaacatgagtttgtcaccctggaaggaatggagaaagcggtgcaggtgatcgtgcgtatcgccgagctgacggcggcacgcaaagggcattaa

SEQ ID NO: 606 - DNA, 309 bp, Klebsiella pneumoniae
gttaatgcttgcgaccctactataaaattcatctgcacaggtataataatcatgaaaaccgttaatactctggctattgccgccgttttaagttccctttctttcgccagctttgccgctgtagaggtgcagtccacccctgcaggacagcataaagtaggcaccatctctgcttctgccgggactaacctgggctcgctggaagaccagctggcgcagaaagcggatgagatgggcgccacttcataccgtattacttcggtaaccggtccgaatacccttcacggtaccgccgttatctacaagtaa

SEQ ID NO: 607 - DNA, 666 bp, Klebsiella pneumoniae
ttattaaattgctggaccgggcatacgcgctcggcgttctggcgtagtaaggagaagaacagaatgacaccacgtcaacgccgtctgcaccgtgcaggattagcaacagtggccgccgccccgcgcaaaagctggctgggccgattcactccccttaatggcattcagtccgcctggataaaatctctgcttactgtttggggggaagggatgagaggaggtgctgccccgcgtaaaccatcaggacattcatgctggcgaggcatgaagggtgatcactggtcagataaagcattagaacgctttacggcagcaattgagcaggcaagaagtgaagggtatcgcgggcggcaggcattaagcagggcacatgccattttgtggccgaaacctgcaactgtcgccattgacgctgcgatcactgaggatgatgttgaatttgttgagcgatgtgtactggcgatctttgaaacgggtgatccggtttatctcgttggcgttaactattacaccacccgcaaaaaaatctcagacataacacgggaaatacagctggtggctccatggttaacagacagtgaggcccggaaaagagtgcgctggtgccttgaaatattcagagcaaaagctttcctttctgttcataaggcgattcatgcggattag

SEQ ID NO: 608 - DNA, 549 bp, Klebsiella pneumoniae
caaggggaactcatgacgtaccaacaagctggacgcatagcggttatcaaacgcattttaggatgggttatctttattcccgccgtgctgtcgacgctgatttctgtgctcaaatttatgtatgagcacagtgaaaagaaacccggcattgatgcggtaatgatggattttgcgcacgtgatgattgagatgatgcgctttaacacgccgttcctgaactttttctggtacaactcgccgctgccggattttcaccatagcctgaacatcggtttctggatcatcttcattctggtgttcgtcggcatggccctgcaggcttccggcgcgcgaatggcgcggcaggcgaaatttctccgcgaggggattgaggatcagctgatcctcgagcaggccaaaggcgcagatgggttaacccgcgagcagctcgctgaacgcattgtggtaccgcgccatacgatcctggtgcagtatttcccactgtacgtgctgccggtgatcgtgattgtcatcggttacttcttcttttcgctgctgggctttctgtaa

SEQ ID NO: 609 - DNA, 606 bp, Klebsiella pneumoniae
accaggaattgcccaatgagtgatgaacgctaccgcgaacgccagcagcggctgaaagataaagttgacgcccgggtggcggcggcccaggacgagcgcggcattgtgatggtctttaccggcaacggcaaaggcaaaaccaccgccgcctttggcaccgcgacccgcgccgtcggccatggcaaaaaagtcggcgtgatccagtttatcaaggggacctggcctaacggcgagcgtaatctgctggagcctcacggcgtcgaatttcaggtgatggccacaggtttcacctggaacacccaggatcgcgacagcgacaccgccgcctgccaggcggtctgggagcatgcccgccgtatgctcgctgacgaccagctcgatctggtgctgctggacgagctgacctacatggtggcgtatgattacctgccgctggagtcggtgctgagcgccctgcgtgagcgccctgcccatcagtcggtgatcatcaccggccgcggctgtcatcgcgatattattgaactggccgataccgtcagcgaactgcgtccggtcaagcatgcatttgatgccgggattaaagcgcagatggggatagactactga

SEQ ID NO: 610 - DNA, 1256 bp, Klebsiella pneumoniae
  unsure (28),(37): Identity of nucleotide at the above locations are unknown.
ctatgcgttggatccttcggctgctccntggagacanatataacgagggcgtatccgcactggctgcagtcgtggcttacggcatcatggtgaaaaccatggcggttgttgcgccgctggtgctgcatttacctgctgacgagattgcggcaaaacaccttgctgataccggcgtgcttggcggtattatctccggtgctatcgccgcctacatgttcaaccgcttctatcgcatcaagctgccagaatatctcggcttctttgcgggcaagcgttttgtgccgattatctctggtctggccgctatcttcaccggcgtgatcctctccttcatttggccgccgatcggctccgcgatccaaaccttctcccagtgggctgcttatcagaacccagtggtggcgtttggtatctacggtttcatcgaacgttgcctggtgccgtttggtctgcatcacatctggaacgttcctttccagatgcagatcggcgaatacaccaacgcggctggtcaggtgttccacggcgatatcccgcgctacatggcaggcgacccgacggcgggcaaactgtctggcggcttcctgttcaaaatgtatggtctgccggcagcggctatcgctatttggcactctgctaaaccggaaaaccgcgccaaagtgggcggtatcatgatctccgccgcgctgacctcgttcctgaccggtatcaccgagccgatcgagttctcgttcatgttcgtggcgccgatcctgtacgttatccatgccattctggcgggcctggcgttcccgatctgtatcctgctgggtatgcgtgacggtacctcgttctctcacggcctgatcgactttatcgtgctgtccggtaacagcagcaaactgtggctgttcccgattgttggtatctgctatgcgatcgtgtactacatcattttccgtgtgctgattaaagccctggatctgaaaacaccgggtcgtgaagacaccaccgaagagagcaaagctggcgccaccagcgagatggctccggctctggtcgccgctttcggcggtaaagagaacatcaccaacctcgacgcatgtattactcgtctgcgtgttagcgtggcggatgtagcgaaagttgaccaggctggcctgaaaaaactgggcgccgctggcgtggtagtggcaggttctggcgtacaggccatcttcggtaccaagtccgataacctgaaaactgaaatggatgagtacatccgtaacagttaa

SEQ ID NO: 611 - DNA, 357 bp, Klebsiella pneumoniae
tctgttctctggtcagttcgagaacagggctactctacgggggaaaagtgcaggcaagatggagaaaacgtggagattcaggctaaaatccccgggcattcaggaaagggaggaacaatgaaaaagctactggctattctgccactggtattagccggctgtgcccagccgcagcccactgcgccgacgaaaaccatcggcatgcccaaccccgcggcggtatactgtcagcaatccggcggcacccgggtgccggtgcaaacgccgcagggcgtcagcacccagtgcaaactacccagcggcgaaaccctcgacgagtgggcgctgtggcgccgggatcatccggctaaatcgtaa

SEQ ID NO: 612 - DNA, 1107 bp, Klebsiella pneumoniae
ttatcgctctgttggcggtatttttttcattttaaaggggatcttatgaagtatcctgtcgctttgacatgcggcgcgctgtggttagccagcgtatcttctctggcctgggcggctgacctaccgccgggcacggtactggcggaaaaacagctgttagtgcgccatatcaaagatgaacccgcctcgttagatcccgccaaagcggtgggcctgccggaaatccaggtgatccgcgatctgtttgaaggtttagtcaatcaggatgcgaaaggcaacctggttccaggcgtagcgacccgctggcagagcaacgataaccgcgtctggacctttaccctgcgtgataacgcccgctggtccgacggcacgccggttaccgccgaagatttcgtctatagctggcagcgtctggtggatccgaaaaccacttcgccgtttgcctggttcgcggcgctggcggggatcgctaacgcgcagaacattattgacggcaaagccgcgccggagaccctgggagtcaccgccgtcgacgcccacaccctgcgggtgcagctggataaaccactgccgtggttcagcaacctgaccgccagctttgccttctatccggtgcaaaaggcgaatgtcgacagcggggcgaactggacgcggcccggcagcctggtgggcaacggcgcctatgttctgaaagaccgcgtggtcaatgagaagctagtggtggtgccgaacacgcactactgggataacgccaaaacggtgatccagcaggtcacctttgtgccgattaaccaggagtccgccgccaccaagcgctatctcgcaggggatatcgatatcaccgagtctttcccgaaaaatatgtaccagaaactgctgaaggatattccggggcaggtgtataccccgccgcagctgggtacctactattacgctttcaatacccaaaaggggccgacggcggatgagcgggtacggctggcgctgagcatgaccatcgatcgccgggtgatggcggagaaagtactggggaccggggaaaaaccgggcctggcgcttcacgccggacgtgacggcgggcttcaccccccagccgtcacagtttga

SEQ ID NO: 613 - DNA, 204 bp, Klebsiella pneumoniae
cctcgcatctgcggggcttttttattcgcaaaaggtaacgcgatgaagaacttaaaaattgcatacatagacgagaagctggtggcgattgagtgtgacggattgtcatgctcatcgctgcccttttcacagtttcccttcgacagtaccgctttaactctccctcaactcatgctcgaggatgcttatgccgccacgagctaa

SEQ ID NO: 614 - DNA, 1560 bp, Klebsiella pneumoniae
ccattagcctgcgaagcatactgtgcgcatcgatacgctaaggagaacatcatgaccgcaccgattcaggatctgcgcgacgccatcgcgctgctgcaacagcatgacaatcagtatctcgaaaccgatcatccggttgaccctaacgccgagctggccggtgtttatcgccatatcggcgcgggcggcaccgtgaagcgccccacccgcatcgggccggcgatgatgtttaacaatattaagggttatccacactcgcgcattctggtgggtatgcacgccagccgccagcgggccgcgctgctgctgggctgcgaagcctcgcagctggcccttgaagtgggtaaggcagtgaaaaaaccggtcgcgccggtggtcgtcccggccagcagcgccccctgtcaggaacagatctttctggccgacgatccggattttgatttgcgcaccctgcttccggcgcccaccaacacccctatcgacgccggccccttcttctgcctgggcctggcgctggccagcgatcccgacgacgcctcgctgaccgacgtcaccatccaccgcttgtgcgtccagggccgggatgagctgtcgatgtttcttgccgccggccgccatatcgaagtgtttcgccagaaggccgaggccgccggcaaaccgctgccgataaccatcaatatgggtctcgatccggccatctatattggcgcctgcttcgaagcccctaccacgccgttcggctataacgagctgggcgtcgccggcgcgctgcgtcaacgtccggtggagctggttcagggcgtcagcgtcccggagaaagccatcgcccgcgccgagatcgttatcgaaggtgagctgttgcctggcgtgcgcgtcagagaggatcagcacaccaatagcggccacgcgatgccggaatttcctggctactgcggcggcgctaatccgtcgctgccggtaatcaaagtcaaagcagtgaccatgcgaaacaatgcgattctgcagaccctggtgggaccgggggaagagcataccaccctcgccggcctgccaacggaagccagtatctggaatgccgtcgaggccgccattccgggctttttacaaaatgtctacgcccacaccgcgggtggcggtaagttcctcgggatcctgcaggtgaaaaaacgtcaacccgccgatgaaggccggcaggggcaggccgcgctgctggcgctggcgacctattccgagctaaaaaatattattctggttgatgaagatgtcgacatctttgacagcgacgatatcctgtgggcgatgaccacccgcatgcagggggacgtcagcattacgacaatccccggcattcgcggtcaccagctggatccgtcccagacgccggaatacagcccgtcgatccgtggaaatggcatcagctgcaagaccatttttgactgcacggtcccctgggcgctgaaatcgcactttgagcgcgcgccgtttgccgacgtctatccgcgcccgtttgcaccggagtatttcgcccggctggaaaaaaaccagggtagcgcaaaataa

SEQ ID NO: 615 - DNA, 279 bp, Klebsiella pneumoniae
caagtatactgtttatttatacagtatttgcatgaggagctagttatgaaagtggaaatcacaattgatcgccaaaaaaaattgccggatggcgctgtgcctgctctggagaaggagctactgcggcgattggataaaaactttaataactgcagtcttgtgattcgtcgggccagctctgatgggttgaccgtgcttggtggaatggacggagataaaaaacgtgtagaggaaatcctgcaggacacttgggaaagcgctgatgactggttttgttaa

SEQ ID NO: 616 - DNA, 1491 bp, Klebsiella pneumoniae
ggagaaaactgcatgagtctgtggattaacggcgagtggcggcccggccgtgggccaggtttcagtaaacaggatccggttaacctgaaggttgtctggcagggagaagcggcggatgccgggcaggttgccgaggcggtggcggctgcccgccaggcattcccgtcctgggcgcggctgccgtttgccgcccgtcaggcgatcgttgaaaagtttgccgctctgctggaagccagtaaggcggagctgacggcggttatcggcgccgagaccggaaagccgcgctgggaggcggccggggaagtgacggcgatgatcaacaaggtggcgatctcggtgaaggcctaccacgtccgcaccggcgaacagcacagcgacctgcccgacggcgccgccacgctgcgtcaccggccgcacggcgtactggcggtgtttggcccctataactttcccggccatctgccgaacgggcacatcgtgccggcgctgctggcgggcaataccgtggtctttaaacccagcgaactcaccccgcgcagcggcgaagcggtggtgaaactatggcagcaggccggcctgcccgccggggtgctcaacctggtgcagggcggtcgggaaaccggcgaggcgctcagcggtcaggcggatatcgacgggctgctgtttaccggcagctcaaccaccggttttcatctgcatcgccagctggccgggcaaccgcagaagatcctcgcgctggagatgggcggcaataacccgctgatcgtcgacgatccgcgggacgtggatgccgcggtgcatctgaccatccagtccgcctttattaccgctggccagcgctgcacctgcgcccggcgtctgctggtccgacgcggagaggcgggcgatgccttcctctcccggctggtgacggtgagccaacggctgatcccggcggcgtgggacgccgagccgcagccgtttctcggcgggcttatctctgaacaagccgcgcagaaagtgcatcaggcctggctgcagcgggtcgccgctggcgcggtcaccctgctggagccgcggttattgcaggccgggacgtcgctgctaacgccggggattgtcgacatgagcgacgtggccaatgtcgaggatgaagaggtgtttggcccgctgcttggggtctggcgctacgacacgttcgaggaggcgattgccttagccaacgctacccgcttcggcctctcctgtgggttaatctccccggaacgggagaagttcgatcgactgctgcttgaggcgcgggcagggatagttaactggaacaaaccgctgaccggggcggcgagtaccgcgccgttcggcggcaccggggcgtccggtaaccatcgtccgggggcctggtatgccgccgattattgcgcctggccgatggccagccttgaatcgccaaccctgacgctgcccgccagcctgagcccgggtctcgactttctggccggggaggcgtcatga

SEQ ID NO: 617 - DNA, 408 bp, Klebsiella pneumoniae
cgcgtgggctgttctttttcagcggatctattcaaaggctgcgcatttgcgtggcctttttcatttcaggctcacgggaatcatcatcgatacggcttgttgttaaatcagcccgatgggcctgttcctatcaaacacacgcacagcacccgcacacagcgaggtgagagtatgtatcgcatggacaaactaacaaccggcattgcctatggcgcatcagctggaaacgccgggttctggatgcttcaggtgctagataaagtcagtccatcacaatgggcagccattggcgtgcttggcagccttctttttggtctgcttacgtacctgacgaatctgtatttcaaaattaaagatgaccggcgcaaagcggcacggagtggtgatgggaaacagagcgaaacttag

SEQ ID NO: 618 - DNA, 654 bp, Klebsiella pneumoniae
caaggagtatgtgtggcgaagaattactatgacatcaccctggcgctggctggcgtttgccaggcggcgcgactggttcagcaactggcgcatcagggacattgcgacagcgatgccctgcatgtgtcgctgaacagcatcatcgacctcgatcctgagtcgacgctggcggtgttcggtggcagtgaagccaatcttcgcctcggccttgaaacgctgctcggggtgctcaataccagcagccgtcagggcctcaatgcggaactcacccgctataccctgagcctgatggtgctggagcgcaagctcgccgccagtaaaggggcgatggacacgctcggcaaccgcatcgccggcctgcaccgtcagctggaacactttgacctgcagtccgaaacgctgctcagcgccatggcgggcatctatgtcgatgtgataagcccgctggggccgcgtattcaggtgaccggctcccctgccgtgctgcaaagcccgcaggtgcaggcgaaagttcgctcagcgctgctggcgggtattcgcgccgcggtgctctggcatcaggtgggcggcggacgtctgcagcttatgttttcccgtaatcgtctggttaaccaggcaaagcaaattcttgctcatttaaccccggagttgtga

SEQ ID NO: 619 - DNA, 1404 bp, Klebsiella pneumoniae
ttgagttcatgcataggccgatttaattcgtttgttaggccagttttgccggttttaaatagttatatcgtaactaaaccgaggtataccatgtcaggactcaaaattgtggtgattggcggtggctccagctacaccccggaactgattgaaggtttgctcaaccgctatcatgaaatgccagtcgcttcgctatggctggtggacattgaagagggcaaagagaaagtcgagattatcgccggactggcgcggcgaatgatcgccaaagccgggctgactattgaagtggtggccacccttgaccgggaaagcgcgctgcgcgatgccgatttcgtctgctcgcagtttcgcgccggctgccttgacgcccgcatcagcgatgaacgtatctcactcaagtatggcttgatcggccaggagaccaatggccttggcggcttcgccaacgcctgtcgcaccattcccatcgccctggagatcgctgccgatatggagcgactgtgtcccgacgcctggctgctgaactttaccaacccgtcggggatggtgaccgaagcgatcctgcgccacagccgcatcaaagccgtcggcctgtgtaacgtgccggtgattatgcaaaaagggataaccactctgctgcaatgcgctgacgaaaaagaggtggtgatccaggtcgccggcctgaaccactttatcttcgtgcgccagatcctgcacaaaggtaaagaatggctgccggaggtgatagccgagatcaacgccggtcgggatccgctggtgccgcgcaacattccgccgttccgttggccgtcgcatctgctgcagggcttaggcatgatcccctgcgcctatctgcgttattactacatgaaagacgatctgctgcgccaggagctggcggaggcgggcggcgaaggaacccgcggggaagtggttaagcagctggaaaaaatcttgtttgaccagtaccgcgacccgcacctggcggtcaaaccgaaggcgctggaagggcgcggcggccagtactattccgaggcggcctgcgagctgatgaatgccatctacaacgacaagcggattatcatgcacgtcaacacgcgtaataacggcgccatcaatggcctgccggatgactgcgcggtagaggtcagctcgctgattaccgcttctggtccgctacctctcaatgtggcgccgttcccggaagataccctgcgtttgctgcagctgatgaaatcatttgaacggctgactatcgaggccgcgctcaccggcaaccgccacaccgcatggcgtgctctgatgctgaatccgctgatcgtcagcggcgagatgctcgaactggcgttggatgaggtgatcgctgagaaccgtcagtggctgcctgctttccacgcctga

SEQ ID NO: 620 - DNA, 765 bp, Klebsiella pneumoniae
ccaaggaaatgcaccatgagcaaaaaacttgcggataaagtggcgttagtcaccggcggcagcgccgggattggcctggcgtcggcgaaagcactggcggagcagggcgcgaaggtgtacatcaccggccgccgtcaggaggagctggatgcggcggtaagattcatcggacccgccgcccgcgcgatccgcgccgacgccgccgtgttaagcgaccttgacgcggtatttgcgaccattgccgaagagtccggccggctggatgtgctgttcgccaatgccggcggcggggatatgctgccgctgagcgccatcaccgaagcgcacgtcgaccggattttcgccaccaacgtgcgcggggtggtgttcaccgtgcaaaaagcgctgccgctgctcgccgatggcgcctcggtgattttgaccggctctacggcggcggtaaaagggacggctaacttcagcatctatagctccagtaaggccgcggtacgcagcctggcgcgctcctgggcgctggaggttagcgaccgcgggatccgcatcaatgtggtcagcccggggccggtacgtaccccgggtctgggagggctggtggcggaggcggaccgccagggcttgttcgatgctctggcggccggcgtaccgctcgggcggctgggcgagccggaggagattggccggacggtggtatttttagcgtcggatgagtcgagctttattaacgccgcggagatctatgtcgacggcgggctggcgcaaatctaa

SEQ ID NO: 621 - DNA, 222 bp, Klebsiella pneumoniae
tcttcgagatggatccgtccgctgtcgacgttttccaggccggcaataaggcgcagaacggtggttttaccgcagccagaggggccaagcagagtgagaaactcaccattgttgatggtcaggttaaggttgtcgatgaccgttttaccatcaaagctcttgcgaattcccgccagatgcaccagcggcgaacgcgaacgcggttgtatattcaatttttga

SEQ ID NO: 622 - DNA, 552 bp, Klebsiella pneumoniae
aacattggatgtcacaagatgaccaacaaacgactgtacaacaatccgaaatataccaccaagcgtggcaatactttttacatcaactttcgtcttccctctggcgcattctttcgtcaatctctcggtactgattccttgaaagctgtagaggttacaatgtcacgtttgataccctttattcccttagtacaaagtggggttatgaacgtggacgattttaaattgcggcttaacgggatgcgtgaaatgactcgggatggtctcaacaaacttctgctgaacgtcttggaaataacaattgaagatgcttctttttcttcatcaaactcacgatattaccagagaacccaacctcttgacgtccaagccaatcatgccaaggctatggcagaagcaatgcgccgtaagatgatgagcattgatgcggaagaagccttaaaattttgggggttagatatggaatatattatccccgaagacctaaaaccagctctccttgagaacgctaaaaggctgcatatttccacgatttgcaatttcaagcgataa

SEQ ID NO: 623 - DNA, 429 bp, Klebsiella pneumoniae
cggaacctgtgcgtccgcgtttatctgcagaagcaggccagcgcacgggataaaacttataaggaatcagtcatggcagaagaaacgattttcagcaaaatcattcgccgggagatcccgtcggatattgtctatcaggatgagcttgtgaccgcttttcgcgacatctccccgcaggcgcccacccatattctgattgtcccgaatgttctgattcctaccgtaaatgacgtcaccgctgaacatgagctggcgctgggccggatgatgaccgtcgcggcgaagatcgccagcgatgaaggtcttgccgacgatggctatcggttgatcgtcaactgcaaccgccacggcggccaggaagtgtaccatatccatatgcatctgctgggcggtcgtccgcttggcccgatgctggcgcacaaaggctaa

SEQ ID NO: 624 - DNA, 726 bp, Klebsiella pneumoniae
gtctgcgcgtggggccgttgcgccccaccttttagagagaacaccgcgatgatgtatcacattcctgacgtgctatcgacagaccaggtggcggaatttacccggcagctggcgcaggccgagtgggtcgacgggcgggttacggtgggtagccagggggcggccgtcaaacagaaccagcagatcgatacccgaacgccgctgtatgcccgcctgcaggccgctgtgctcgatatgctgcgcggccatccgcagtttttttccgccgcgctgccgcggacgatttccgcgccgttgtttaaccgctatgggccaggggagacctatggttttcacgtcgatggcgccgttcgccagaacggcgaggcgggctggatgcgcactgatctgtcagcgacgctgttcctttgcgatccggagagctatgagggtggcgaactggtgattgaagacacctatggccaacatcgggtgaagctcccggccgggcatctggtgctctatcccgccagcagcctgcactgcgtcaccccggtcacccgcggcgtacgccaggcctctttcctgtggatccagtcgatggtccgtgacgataagcagcgtgcgatgctttacgacctggaccgcaccatccagtctctgaaggcccgctttggcgacggagaagaggtcctctccctgctcaacatgtatcacaatctgctgcgccagtggacggaagtgtga

SEQ ID NO: 625 - DNA, 372 bp, Klebsiella pneumoniae
aggcggtggtggaatcgtagcccagcgcctgagccgtctgctgcaccgtctgcccgcggatcagcagctgcagcgcgaggatcagctgcagctgatggcgccagcggcgaaagctcagccccgtttcgcgcactaccaggcgggccagattccgctcgctcatcgcaaacaccgccgcccactggctcagggtctgccagcgcgccggatcctcagccatcatcgtcaccatttgacgaattttcgggtggtttgataccggcagctgcaggtgctcctgcggctggcggggcagctcatcaaacagaacctgcaccagccgggccgtggcgggggcggccagggactctccgccgcgctccgccagagtaa

SEQ ID NO: 626 - DNA, 327 bp, Klebsiella pneumoniae
actggcgggtgcgcgccagatattcagctgcgtagagcagcgtggtggtgtgcccgtcatggccgcagccgtgaaagcgcccttcaacctggcttgcccacggcttaccgctccgctcctgcatcggcagggcatccatatccgcccgcaggccaaggcgttttttcccctcgccgacgcgcagcgtgcccaccactccggtgcccgccaggccgcggtgaacctcgtatccccactcgccaagcagtcgggcgacctcgctgctggtctggtgctcttcaaagccgatctccggctgctggtggaaccgacgacgcagagcgataa

SEQ ID NO: 627 - DNA, 198 bp, Klebsiella pneumoniae
cctctccttcgagcgcttctggttctgctcttccctcttcacgcgagcctggtgttggctgagtcggccagcttcggcgtaccgggtcttcccgctaaccggagctatcgcgtccgtgtcgccttcctgcctgtagtgcgaatcggtttgagcaattttttgttaataatttgtaatgagcatgtcaatactacctga

SEQ ID NO: 628 - DNA, 198 bp, Klebsiella pneumoniae
tcggtgcttcgctggcgcggtggaatttatcctgcagattcgccaccgtcagatgcaccaggccatccagcgaatcggcggagggacacaccgtcgccgcgttcgccacccacatcgccgaggccgaactcaccgccgacagcagatccggctcctgctgcgccacccgggccaccacctgctcatcgctgccgctaa

SEQ ID NO: 629 - DNA, 711 bp, Klebsiella pneumoniae
ttgccgattcgtttatctgattacgcaacaggagaaggacatatgtcagcgaagcgccgcattgaggccgcgatatttgatatggacgggttgctgattgactcggagccgctctgggatcaggcggaggtcgaggtcatggagagcctgggagtggatacccgtcgccgcgatgaactgcccgacctgctcggtctgcgaatcgacctggtggtggatctgtggtacgcgcagcagccgtggcacggcgtaaaccgggcggaagctaccgcgcgcattattcgtcgcgccattgagctggtggaagcctcacgcccgctgctgccgggcgtacgcgaggcagtggccctgtgtaaagctcagggcttaaaggtgggcctggcctcggcctcgccgctgatgatgctggagaaagtgctcgatatgtttgaactgcgcgaccagtttgatgctctcgcctccgcggagcatttaccctggagcaaaccgcacccgcaggtctacctcaactgcgccgctgccctgggagtcgacccgcagcgctgcgtcgcgctggaggattcggtcaacggcatgatcgccagcaaagccgcgcgcatgcggtctatcgtggtgccggaagcggagaacagccgcgacccgcgctttgcgctggcggacgtcaagcttccgtcactgctggcactcactgctgagaacttgctcggctaa

SEQ ID NO: 630 - DNA, 1017 bp, Klebsiella pneumoniae
cgcttcgttcgctggcgtatcgcgggaaaataccgaagaggtgaaaaagccatgattatttttaccctgcgccgtctactgctgctgctgatcaccctcttttttctgacctttgtcggtttcagcctgagctatttcacccctcatgccccactgcagggcgcttccctgtggaatgcgtggctgttctggtttgaaggggtgctgcactgggatttcggcgtctccagcattaacggccagctgatttctgagcagttgcgcgaggttttcccggcgaccatggagctgtgcatcctcgccttcggctttgccctgctgataggcattccggtggggatgatcgccggcgtaatgcgcaataaatggcccgataccctgataagcgccgtcgcgctggtcggtttctcgatcccggtcttctggctggcgctgctcctgaccctcttcttttccctgaccctcggctggcttccggtctccggtcgcttcgatctgctgtatgaggtgaaaaatgtcaccggtttcgcgctgatcgacgcctggctttcggactcgccgtggcgccatgagatgatcgtcagcgccgcccggcatatggtgctgccggtattgaccctggcggtcgcccccaccactgaagtgatccgcctgatgcgcattagcaccagcgaggtgtatgacactaactatgtaaaagcggccgccacccgcggcgtgtcgcgacgcaaaattctactgcgccatgtgctgcacaacgccctgccgccggtgatcccgcgtctcggcctgcagttttccaccatgctcaccctggcgatgatcactgagatggtgttcagctggcctggactgggccgctggctgatcaacgccattcgccagcaggactacgcggcgatctccgccggagtgatggtgattggcgcgctggtgattattgtcaacgtgatttccgatattctcggtgccatggctaacccactgaaacataaggaatggtatgccctacgatag

SEQ ID NO: 631 - DNA, 927 bp, Klebsiella pneumoniae
gaacttgctcggctaagaccgctggcgggtgcaacaatcgctgtcacgccgccagcaataaaatcaaaacattgtttcattttaattgtaattttgttttcctccctctatgctggtcacaggtggcgtcatcgtacgccagtagatcagctgacagaggtgaatatggtactgaacgccttcgacctgacgggtaaggtcgccatcgtgaccggttgcgataccggcctgggacagggaatgacgctgggcctggcgcaggccgggtgcgatatcgtcggcatcaaccgtaaaattccccatgatacggccgcccaggtgctggcgctgggccgccgctttcacgccattcaggcggatctcagccaagagaatgatatgagcggtctggtcgaccaggcggtggcggcgatgggccgggtcgatattctggtcaacaacgccggaattatacgccgccatgatgccctgaccttcacggaaagcgactgggacgcggtgatcgacctgaatctcaaagcgattttctttctcagccaggcggtcgccaggcagttcattcgccagggggaaggcgggaaaatcattaacatcgcctcgatgctctcgtttcagggcgggatccgcgtcccctcctacaccgcctcgaaaagcggcgtgctgggtttgacccgtctgctggccaacgaatgggctggccagggtatcaacgtcaacgccatagcgcccgggtatatggccaccaataacacccaagcgctgcgcgaagatgaagagcgtaaccaggcgatcctcgagcgcattcccgctggtcgctggggagcgccgaaagacctgcaggggccggtggtgtttctcgcctcatcagcggccgactatattaacggctatacgctggccgtcgatggcggatggctggcgcgctga

SEQ ID NO: 632 - DNA, 975 bp, Klebsiella pneumoniae
cgcgtttgtcgcacgctgcacgtgggttctacagttgacttccttcgtgactacaaggagtcaatcatgcgtgttatcgactatggccgcctgctgctgctcgccgccctctggggcgccagctttttgtttatgcgcatcaccaccccggccttcggggcgttgaacagcgcttttcttcgcgtactgttcgccgctatcgcgctcgggctgttactcggcgtgcagggtaaatggagcgggtatcagggaaaattcacatccactctgcagctgggggtcattaattcaggccttccttttctcatgtactgccttgccgcgcaatggctgccggcagggtactccgccacgcttaacgccacggcgccgatgatgggggtgctgatcggcgcgttatgctttgcagaaccgttaaccctgcgcaaaggcggcggcgcgatactgggcgccattggcgtggcggtgatcgcgcgcccgacatctggccttagcgccgccctgctgctgccggggattggcgcctgcctgaccgcgaccgcctgttacggtctggccggctttctgacccgccgctggatccagcagcgaggcggcctcgaggctgaacgcgtcgcgctgggtagccaggtcggcgccacgctgtttctgtttcctttctttctctggtcctgctggcatgggccagccgtagactggcggcagagtctgccgtggatagcgatagtcatgctgggcgtggtctgcacggcggcagggtatattctctacttccgcttgattgcagatatagggccgctgcgttcgctgtcggtgacctttttgatcccaccttttgcggcgctgtggggctatctctgcctcggagagacggtggaggaaggattgattctcggcgcgctgctggtttgtgtagcgctatggatgattatcgtgccgtcggggcgaaaacgcggggtaccggacggcgcatga

SEQ ID NO: 633 - DNA, 1176 bp, Klebsiella pneumoniae
cctcttatgctggagttgttgtttctgcttttacccgttgccgccgcttacggctggtacatgggacgcagaagtgcacaacagtccaaacaggacgatgcgagccgcctgtcgcgagattacgtggcgggggttaacttcctgctcagcaaccagcaggataaagccgtcgacctgttccttgatatgctgaaagaggataccggtaccgttgaggcgcacctgacgctcggtaatttgttccgttcgcgcggcgaagtcgaccgcgcgatccgaattcaccagagcctgatggaaagcgcgtcgttaacctacgatcagcgcctgttagcggtgcagcagctgggacgggattatatggccgccggactgtatgaccgcgcggaagacatgttcaaacagctggtggatgagaccgatttccgcctcggcgcgctgcagcaactgctgcagatttaccaggcgaccagcgactggcagtcggctattgaagtggctgaacggctggtgaagctagggaaagagaaacatcgtggcgaaatcgccaacttctggtgcgaactggccctgcagcagatggcagccaacgatctggataaagcgatggcgttgttgagaaaaggcgccgccgcggaccgcaacagcgcccgggtatcgatcatgatgggccgggtgtggatggaaaagggcgactacgccaaagcggtggagagcctcgagcgggttatcgatcaggataaagagctggtgggtgaaacgctggagatgctgcagacctgctaccagcagctcggcaaaaccgatgaatgggaagtttttctgcgccgctgcgtggaggagaacgccggggcgaccgccgaactgatgctggcgcagatccttgagcagcgggaaggcgtcgaagcggcgcaaaactacgtcacccggcagctggaacgccacccgaccatgcgcgtcttccataagctgatggactaccatctcaacgaagcggaagaagggcgggcgaaagaaagccttggggtgctgcgaaacatggttggtgagcaggtgcgcagcaaaccacgctatcgctgccagaaatgcggatttaccgctcatacactctactggcattgtccatcctgccgctcgtgggcgaccattaaacccattcgcggtctcgacggccagtaa

SEQ ID NO: 634 - DNA, 1446 bp, Klebsiella pneumoniae
cgacccctccgggtacgtcatcaacattttctggggcgcggtgaatattgccgccatgctgccgcttatctttgccgccatgtggacgccccccgaagagcaggaggcgagccgatgaggatccgcgacgccctgctctccgcccgcagctatctcaccatcctcattggcttcctgctgggttttgcgattgtcgtatgggtggaaaaacaaatgcctgcgcgcgtcgagagcagcagtgggatgacgttgagccaggattttccgccgctccctgccccgcgcgagctgacctttgacgaggcgatctgggcgcgagtggcctggcagtattatgtgaataatactcagccaaacggtctggccaacgcgcaggatgacgaaccctggcttagcctgtggagcgtcggcagctattttttcgccgtggtcgccgcagagcagctgcatattgtgaccgccgccgaaggcgatgagcgcattgccgccgccctgtttacgctcggtcaactgcccctcaacgcccagggattgcccgccgctcagtaccatgccgacacgctgcagatcctcggcaacccggactcctccgccatcggtatgggacgcctgctcaccgccctgcaaacgctgctctggcgctatcctcagcacgccgccgcggtgcgggatctgtttaatcagtggcgggtcggcgcgctcatcagcaacagccccgccagccaggccgcggcgccgatgcaccactggacgctggcggcggatgaaccgcgggacagctttggctaccggctgtatgccagccatacgctgcggctgatcgacagcgccgcggggctggcggtgaccaacccgccgcaggggcagcagatgatcgacatcgacggcatcatggtgcccgacgaggggctgcgcacgccgtgggggcggcaaccttcgctgatcagcctgccgtacctgctcaccgggcttgagctgggctttgacgcgcagagtgcggagatcgcctggcgcatcatgcaaatccagcagcgccgtcatagcctgagggtcagcaagccgccgatcagcaccgactacgccgagcccgcgccggattatgccagcgcgctggcggaccggcagccgcagagcgccttcgccccgcgcagtgccaccccggagcaaacggcgatcacctctacccgcaccgcctttgcctggtacgccctgttccgcaatagctggagcgaagcgcttcgccagcaggtccagacgctgcaggtcccgggcaagggctggcagcgtgggttaaatctcaaccgcagcgtcaacgacgttgttgacggcgataccaacgcgatcgtgctggaaagcctggcctacatttcccaggggcagatgctgtgtctggcctgcctgagccctgcccctctaccctcgtcctcagcaggagcaacgccatga

SEQ ID NO: 635 - DNA, 1179 bp, Klebsiella pneumoniae
gtttttccccgtcgcccccgacggggctttttttcccaccgcgtggacaagtattccccagacagatgtgataaatttaaaaatatcactgtttatttgacgctgatgtccgtttgcagcccaatatgctggggtgacgtttggcgtgctggagctgtattattcatgtcagattttattcttgcccgggtgtcgcaaaccctcgctgcggaacaatccctggaaaccctggtgcgccagctgctggagatgctggaggcggtgacgcgaatggagtccacctacctcacccgcattgatatcaacgcccagcggcagcagatcatgttcgcccacaacagcagcgaaatgcagatcccggaaggattttccgtcccctgggatgaatccctgtgcaaacgcgcccttgaggatcagtgtacgtttagcaatgacgttgccaaccgctggcactcctgcatcgccgcccaggagctgggaatcgctacttttttaagcattcccgtccgcctggccgacggctctctgttcggcaccctctgcgccaccagccggcaacaacagccttataacctcgaaggcgaacaggtcatgggcctgttcgcgaagctcatttcccactacgtggaaaaagacaccctggtgcaacagctgcaggcggcaaacgtcgcgctggagctgcactcgtctaccgatgagctcacccagcttcccaatcgccgcgcgctgtttaagcagctggcgttacgctttgcctccgcccgcgcccagcagcagcaggtctcgcttatttttatcgatctcgatggtttcaaagccattaacgatcggttcggccatccgtgcggcgacagctttctggtgcaggtcggcaaacgactcaccgctgtcgcgcgccgggaagatatcgttggccgccttggcggcgatgagtttttgatcgtcggtagcgcccagcagcctgccgcacagcaggcgtatgtcacgtccctgcgtcaggctctgtgcggcgtctacttcctcggcgaacagcgtatcgactatgagggcgccagctttggggtggtcacctgcgatccgcagagtatcgatgttgaagcggccttacgcgctgccgatgaggcgatgtaccaggataagaagtcccgccgccaggagaatttcattcatattgactaa

SEQ ID NO: 636 - DNA, 732 bp, Klebsiella pneumoniae
tccactgcccggagctggcggccggtctgcctacgccccgactgccggcggagatcctcggcggtaccggcggcgatgtgcttgccggacgggcgcggatcgtggaaagcgacggccgcgacgtcaccggacattatcagctggccgcctggctggcgctcagcgccgcccgggaagcgggctgtcaggcagcgttactcaccgacggcagccctacctgcggcagccagtttgtctatgacggttcctttcgcggacggcgcaaagcgggcgccggcgtggccgccgacctactccgcgcccacggcatcacggtattttccgacgggcaaatcccgcagttgctcgcctggatggcacagaaggagcaggatgatgattcagtgtaaacgggtgtatgacccgcaggaaagcagcgacggctatcgggtgctggtcgaccgtctctggccgcgggggattaaaaaagaggcgctggcctgtgatgagtggtgtaaggagttaacgccttccgctgagctgcgcaaagcctttcacggcgaggcgatcgatttcgcccacttcagccagcgctatcgtcaggagctcgacgcccatcgcgaaacgggcctgcggctggcggcgctggcgcaacgccagccgctgacgctgctgtacgctgcgaagaacaccgagcagaatcatgcccgggtgctggccgcctggctggcggccctgccggttacgatttag

SEQ ID NO: 637 - DNA, 213 bp, Klebsiella pneumoniae
tcagtataccgattggttacgtgtaaaagtacgattttccgtggtcggtattatttttctattcatgatgttatcagttttctatttaccatcattcatttaattgaaataaatagccaagagcaaaacttggctattttattcactcccaatcagtatcatcaattacataagaaactgaggataagggaaacgtatgcaattagcgcatag

SEQ ID NO: 638 - DNA, 204 bp, Klebsiella pneumoniae
ggcagtgaccgcagccgcttcggctttcttcgccagcgcggcatttgtcgtgcccaaatcgctcgtcagtttcgtgatggactgaccctggctggttatcctgtcgccctgctgggtaacaacagactgcagcccgctcagtgcctcattcgtaccagccaggcccgtttccgtctggccaacccggttagtgagcgatgttaa

SEQ ID NO: 639 - DNA, 1044 bp, Klebsiella pneumoniae
ctggtggaccgtcctgtggggccatctgctgtgggtggtgccctggatgctgtttattttgcgcccggcctggcgccagcgcgatccgcggctgacggttgtcgcccgcacgctcggctggggatccacgcgtattttctggttgctgaccctgccttcgctaactcgcccactgctgaccgccctggcggtgggcttctcagtgagcatcgcgcagtatctgccaacgctatggctgggggctggccgaattccgacgctcaccagccaggcggtggcgctcagcagcggcggcgaggcgcagacgctcgccgctcaggcgctgtggcaattactgctgccggcggtatgctttaccctgacggctctgctggcctggctggcaggccgctatcgacgaggacttcgctagtgctaaccgtaaaccatctgaccctgagcgtgagacgccagccgctgctgcgagaggtcgccttttcggtagccccgggggaggtgctgacgctgatgggcccctccggtagcgggaaatcaacgctgtttgcctggatgattggcgccctgtccggcgattttcgcgcccgaggcgaactgtggctcaacgaacggcgttgcgatacgctgccgacagagcatcggcgcatcggcattctgtttcaggatccgttactgttcgaccatttcagcgtcgggcaaaatttacagctggcgctgccggagaacgtgcgcggcgaggcgcgaaaaaccgcggtggaggaagcgcttagccgcgccgggctggcgggcttcgccccgcgcgatccggccacgctctccggcgggcagcgggcgcgggtgagcctgctgcgcgccctgctggcgcgccccgaggcattactgcttgatgagcccttcagccgcctggatgccagcctgcgcgccgggttccgccgctgggtctttgaagaactggaccgccaggccattccggcgatcctggtgacccacgatcgcgaggactgcccgccgacggggcgctgcctggcgatggagcgctggcaatga

SEQ ID NO: 640 - DNA, 1209 bp, Klebsiella pneumoniae
tgcccctgccgccctggttcatcacccaccgggggcaggaagcggtggcgcagcggctggtggatttttaccatcggccgcgctggcgcaaattgccggcgctcctctggcgcgcgctgcggggctaaggtgagagcaaaaaaaagggcggaaccgcggttccgccctgcgggattaacggcccgctttcagcttctggtaatactcttcataaatggcgctggcgctgccgacgtcattctgccattcgcctttctcaatggttgcggcgtccggatagagcgatttatcgttggccactgccgggctgagcatcttgcgcgccgcaaggttcggcgtcggataaccgatggtttcagcgacctgtttggcgacatccgggcgcagcaggaagttaatcagcttcagcgcgccgtcgacgtttttggcgttcgccgggatcgacaggctgtccatccagaagatgccgccctctttcggccagatcacttccagcggagtacctgcctggcgggcgacgtaagccgagccgttccataccatcccgaggttcacttcgccttccatatacgggttcgccgggttatcagagttaaacgctgcgacgttgggcatcagctttttcagctcgttataggcggcttcaatctctttcgggtcggtggtgttgccggaatagcccagcttacgcagcgccatctggaacacttcgcgcgcgtcgtcggtcagcagcaggctgcttttgtattccggcttccacaggtcggcccagctggtgatagttttcgggtcaatcgcctcgctgttgacgccgatggccgtcgccccccagatataggggatggagtagtcgttattcggatcgaacggtttattcagcatctgcggatcgaggttgctgaagttagtcagcttgctcttatcgatcttctgcagcataccttctttgcgcatcttgtcgacaaagtaggtcgacgggacgaccaggtcgtacgcgccgtctttataggttttgagcttggcgtacatggtttcgttcgactcgtaggtcgaatagataaccttgatgccggtctctttggtgaactgctccagcaggcccggcggcacatactcggtccagttatagaaatagagcgttttgctatcgtccgcgtgcgcagcgcccatgccgattgccagagcgctcgccgcgagcaggtggcgtga

SEQ ID NO: 641 - DNA, 369 bp, Klebsiella pneumoniae
ccggcccgccgtctcttattctgccctgtaacaaaaacccttcattttttattgcattggtgttacatatacagccgtttatcgctcagcaaaaaggaagcccctatgattctgcaaaaactcctcagcaataaaaactgcaaaaaatactgtctgtcgctcgcggtggtgtttgctatcgcgctggcggttgtggggcgggcgaccttcgggggcgtggtgagcgagtacaatatgccgtactcagagtggacgacgtccatgttcttcctgcagggggcgatggtgacggtttacagcattgtctttaccgcgctcttcgctatccccctcggctttattttcctcggcgccgatcgtcaggattaa

SEQ ID NO: 642 - DNA, 342 bp, Klebsiella pneumoniae
aaccgaagccgggagacagcgattttgatactgacattggatgatgtgaaaacccagctacgcctggaactggacttcacggagcatgatgccatgctcacgcaaatggtgaacgccgcgcagcggagcatcgagcgtgattactactgcaagctggtcaccagtgatgaagagctgcaggcgctcccggagaccgtccgcggatttatcgcggatgaagatatccggctggctattcagtttctggtcagcgatgcgtatctgaatggccataccggacagtggctggaaaccgctgcggtgaggcatcttcttttccccctgcaggagcatacgctatga

SEQ ID NO: 643 - DNA, 1200 bp, Klebsiella pneumoniae
gatttttcacggcgcctgcatcgccagggcgccgcatccgttataatccctgtcagacacctgcagtggaatatcaatatggattatcaattaacgcttaactggcccgactttatcgaacgctactggcaaaaacggccggtggtattgaagcgcggcttcgccaattttatcgaccccctaagcccggacgaactggcaggactggccatggagagcgaggtcgatagccgccttgtcagccatcaggatggaaaatggcaggtcagtcacggtcctttcgaaagctacgatcacctgagcgaaaacaactggtccctgctggtgcaggcggttaaccactggcatgaaccgtccgcagcgctgatgcatccgttccgtgccctgccggactggcgtatcgacgacctgatgatctccttctcggtgccgggaggcggcgtcggcccgcatctggatcagtatgatgtgtttatcattcagggcaccggccgtcggcgctggcgcgttggggaaaaggtgccgatgaaacagcactgcccgcatccggacctgctgcaggttgaccccttcgaggcgatcatcgatgaagagatggagcctggcgatattctctatattccgccgggattcccgcatgagggttattcgctggaaaactcgcttaactattcggtcggctatcgcgcgccgaatgcccgcgagctgtttagcggctttgccgactatgtcctccagcgcgaactgggcagccagcgctacgccgatccggacgtgccgtcccgcgaccatccggcggatattttaccgaccgaactcgaccgcctgcgcgagatgatgctgggtctgattaaccaaccggagcactttaagcagtggttcggcgagtttatcacccagtcgcgtcatgagctcgacgtcgcgccgccggagccgccgtatcagccagatgagatttacgatgccctgcagcagggcgataccctggaacgcctgggcggcctgcgggtgctgcgcattgacggcgaggtattcgttaacggcgagaagatcaactccccgcaccgtccggtgctggacgccttagccacccatctgacgctgcgcgccgaccattttggcgatgcgctggaagatccttctttcctcgccatgctggcagcgctggtcaacagcggctactggttctttggcgactga

SEQ ID NO: 644 - DNA, 462 bp, Klebsiella pneumoniae
ccaagtaaacgagttttgaccatgaccaaacaatcaaaaaccaaagtaaccaaagcacagattgtgcttgccatcgttagccggacgccagaatgcgtcctgcaggatgtctgcgatgcgctcgacttgcaagccagtacagcaggtaacttgctgcggcagctccatgccgcgggaaaactccatcgtacccataacggctaccagtatgtctatcgagtggttgcaggcgttgaggttcccgttattgccctgccgcagactgcaacaccattatctgaagaggatgtgaaaaaagtccaaaacgcactgtccctggcgaagacgctggaagacaaaaagctttggcgccgggctgcgactgtttatacatcgatgcttggaatgacaacaacagcaaacgagctctggttgcttgccaaaatgcgtaaccgctgcctgcgcaatgcggcgaggtgctga

SEQ ID NO: 645 - DNA, 762 bp, Klebsiella pneumoniae
caaatggaacgcgtattgatcgtcaatgccgacgacttcggcctcagtaaagggcagaactacggcattatcgaggcctgtcgcaacggcgtggtgacatcgaccaccgcgctggtcaacggcgcggccattgaccacgccgcccagctgagccgcagtactccggagctggcggtcggtatgcactttgtactgacgctgggcgagccgctgtcggccatgccgggattaacccgcgatggccggctgggcaaatggatctggcagcaggcggaagaagatagcctgccgctggaagagatcgcccacgagctggcgtgtcagtaccatcgttttgtcgaactcttcggccatgagccgacgcatatcgacagccatcaccatgtgcatatgttcgcccagatttatcccatcgtcgcggcctttgcccgcgagaagggcattgcgttacgcattgaccgccaggtggcggcgcagagtgggctcgaccagcaggcggcgcgcagcagcgccggcttcagcagcgagttttacggcgaagcggtctctgaggaactgtttctgcagacgctggatgcctccatcgcccgcggggagcgctccctggaggtgatgtgtcatccggcttatgtcgatcggatcattatgggcagcgcctactgctatccgcgactggatgagcttgatgtgctgacatctgcttcactgaaagcggcggtggccgaccggggttatcgtctgggaacctaccgcgacgtgtaa

SEQ ID NO: 646 - DNA, 801 bp, Klebsiella pneumoniae
gacctacgacggtacactgcacgggctgattatttgacaacgggaatatggattgtgactaaaatcaaacttctggcactcggcgtgctgatagcgacgtccgccagcgcggcgcatgccgacgggaagttcactcttggggctggcgtaggggtcgttgagcatccgtataagcaatatgatgcggatgtctatccggtgccggtcattagttatgagagcgaaaacttctggttccacggtctgggcgggggttactacctgtggaatgacaccaacgataaactgtcgattacggcctactggtcgccaatgtacttcaagccgggcgacagcgacagcgagcagatgcgtcgactggataaacgtaaatcgaccgtgatggccggtctttcttatgtccacaacacgccctatggcttcctgcgcacgacgattgccggcgatacgctggataacagcaacggtattaactgggatctcgcctggctgtaccgttacaccaacggtaacctgacgctgacgccgggtattggcgtggagtggaacagcgacaatcagaacgaatactactatggtgtctcccggcacgagtcgcgccgcagcggcatgcgcagctatgacccggacagtagctggaacccgtatctggaactgtcggctaactatcgcttccttggtgactggagcgtttacggcgtggcgcgctacacgcgtctgtcggatgaaattaccgacagtccgatggtggataaatcctggagcggtctgatctccaccgggatcacctacaccttctga

SEQ ID NO: 647 - DNA, 1209 bp, Klebsiella pneumoniae
tcggtgcgacggaaatggctggatagagaggaaagaagcagcggttcccgcaggaaccgctgtgaaggggcgtcagaccgccggacgcgcaataatgctgcgggtttccatgcgaacttcagcgatagtgacatcgataacgtcagtcactttatagactacttcacctttgatctgcacggtaccgttctcctggctgcacaccagttcgtcgcgcacggcgtggaggaacggggccggaataaaggcgaccgcgccattgtccaccagacgcacgcgcatcccgccgcggctgacgtcgatgatctccgccgcgaagcgggtatcggtcccggctttatcgttgaggaaacgggcgtacagccagtcggcgacgtcgcgctcggccatccggttgagacgacggcgctccgccatctgcacggtggcttcatcctggggacgcgcaatggtctcgcctttaatgatggctttcagcagacggtggttgatcatgtcgccatacttacggatcggcgaggtccaggtggcataggcttcaagcccaagaccaaagtgcgggcccggctcggtgctgatttccgcaaacgactggaagcggcgaatgcggctgtcgaggaaaccggtcggctgagcgtccagttcccggcgcagcttgcagaacccttccagggtgagcacttccgtcgggtcgacgtgcacatcatgggttttcagcagggcggccaactgctcggtgttcgccgggtcgaaaccggtatgaacgttataaacgccgaagccgagcttgtcgcgcagaacgcgggcggcacagatgttggcggcgatcatcgactcttcgacaatgcggttggcaatgcgacgcggttccgcgacgatatccagcacttcgcctttttcgccgagaacaaaacggtagtccggacggtctttgaacaccagcgcatgggtctgacgccattcgctacgacgctggcacacgtccttcagcagcgtaatttgctgcgcgatcgcctcgctgtccggctgccagctgccgcggccttccagccagtcagagacgtcgtcataggccagcttggctttcgattcgatggtggcggcaaaaaactcgatattgtcttcgatggtgccatcggcccccagagtcatccggcaggccagcaccgggcgcacttcgttagcgcgcatggagcagagatcgtctga

SEQ ID NO: 648 - DNA, 717 bp, Klebsiella pneumoniae
ccagctggacgaagtgggcttaaccagtcgggacattattctgttcaaccagattatcggattcgtcggcttccaggcgcggacgattgccgtcctgcaggcggcccagggcttttcccggtgcgctggatccccggtatgccccagcaagaggaggcacccgcggagctgttcgccccgccgccgggagcatggcaggcagacattgcggatcccgacctgcagtatgccgatgatgagcgtcagcggcgcatcgccggctggcagtcgctgcccggtctgggcgagctggcgccgctgctggcctgcgacccacagttattcgcgcctctggagaccttgatccgccagctcagcacggatgatacctttggcccgcaggtcgccttactcacggcgcgcaccaatggcagccccacctgttttgacgcctggctcccccactggcagggtgaagaggagttcgccagccatctgcgggagggcgaccaggccctccatcactggctccagcagcatcctcaggcccggtctctcgtgaacgcggtgcagctgttaacccgctcgcctgaccggtttagcgccgcccagttaacgcccctcgcggaatatcgactctctgagcaacaagcaatcgatctgttgatctggagcgggctgtgcggatggatgaatcgtctgaaaatcgccctcggcaatgtgcgtcagcagacgtaa

SEQ ID NO: 649 - DNA, 381 bp, Klebsiella pneumoniae
aacattacgctgtctgcgcccggcgagggggcagggagttatcctaaaatgcgcatcggcggcgaaggggcgacgaacggggccacaatcggctatgatagaggtttctgtttcccgctatgtttagtgaatccatttgttatgaaaccattgcgccaacaaaatcgccctgtcattagctacgtgccgcgcgtggagcctgcgcctccggaacatgccgtgaaaatggaccattttcgcgatgtctggattttgcgcgggaagtatgtcgcttttctgctgatgggggagcatttccgtcgctcaccggcattcagcgtgccggagtcggcgcagcgctgggctaaccaggtgcgtcaggaaggtgagattgaagcctga

SEQ ID NO: 650 - DNA, 351 bp, Klebsiella pneumoniae
agggcaacgctaatggctattgagatattcacctggagtccgcgggttaatccccagcagaccgttaactttcgtgtccggaaggcgcagttcggtgacgggtatacgcaggtatccggcgatggtattaacacccgatcacaggactgggagctgagttttgtcggtacggaggactatatccgtccgattaagcagttcttcgaccgtcatgcaggcacccgcgcgtttcagtggaccccgcctctggaagaggtggggctttaccgctgcgaacaatataaaccggtgccgctgggcggcggaaattactcactttcagccacttttattcaggcatttaaaccatga

SEQ ID NO: 651 - DNA, 657 bp, Klebsiella pneumoniae
gctataatgcggcaattgataaagcctgaaaataccatgcagaaaacttcatttagaaaacatcgcgttgagcgattcagcacacaacaagtcaccagacaacgtaaagaacgccagccaaaaactgtgatcttgttcaataaaccctatgatgtgttgccgcaatttaccgacgaggccgggcgcagcacgctaaaagattttattccggtggcgggcgtctacgccgcaggtcggctcgatcgcgacagcgaaggcctgctggtgctgaccaacgacggcgcgctgcaggcgaagctgacccagccgggtaagcgcaccggcaagatctactatgttcaggtggaaggcgaacccacgcccgaggcgctgaccgccttgcgcgacggcgtcacccttaacgacggccccaccctgcctgccggcgtagaacttgtcgaggaacccgtctggctgtggccgcgcaacccgccgattcgtgagcgcaaatcgattcccacccgctggttgaaaatcacgctctacgagggacgcaaccgccaggtacgccggatgaccgcccacgtcggcttccccaccctgcggctgatccgctacgccatgggcggctataccctcgacggactggccaacggcgactggcgcaaagccgaataa

SEQ ID NO: 652 - DNA, 411 bp, Klebsiella pneumoniae
tcgccgatgcgttcctgcagcagatcctgctgcgtccggcggaatacgacgttatcgtcctgtatgaacctgaacggcgactatatctctgacgccctggcggcgcaggttggcggtatcggtatcgccccgggcgccaacatcggtgacgagtgcgcgctgttcgaagcgactcacggtactgcgccgaagtatgccggccaggacaaagtgaacccgggctccatcatcctgtccgcagagatgatgctgcgccacatgcagtggttcgaagccgcagacctgatcgtcaaaggcatggaaggcgctatcgccgccaagaccgtgacctatgactttgaacgtctgatggaaggcgctaaactgctgaaatgttcagagtttggcgacgcgattatcgcgaacatgtaa

SEQ ID NO: 653 - DNA, 1044 bp, Klebsiella pneumoniae
ttaacgtcgcgagtagtgtatgacatccgccagctacacggcaaaccctatttaacatttaccagagaggacaagggaatgcgtaacgtgcgagtgtatgaggaagcctggccgctccataccccttttgtgatcgcccgcggtagccgcagcgaggcgaaagtggtggtagtggaactggaagaggacggcgtgaaaggggtaggcgaatgcacaccctatccccgctatggcgagagcatcgcctcggtcatggcccaggtgatggcgatcggcgagcaactggaggcggggcttacccgcgaacagctgcagcggctgctgccggcaggcgccgcgcgcaatgccattgactgcgcgctatgggatctgcaggcccggcgcgaaggcaaaaccttggcccagctgttgggcgtggcgttgcctgaccgggtgattaccgcccagacggtggtcattggcacgccggatcagatggcggccagcgccgcggcgctgtggcaggcaggggcccagctgttgaaggtgaagctcgacgatcgactgatcagcgagcggctaatcgctatccgccaggcggcgccggaggctacgctgattgttgacgccaatgagtcctggcacagcgaggggctggcggcgcgctgtcagctgctggcggacctcggtgtggcgatgcttgagcagccgctccccgccgacgacgactcggcgctggaaaacttcgttcatccgctgccgatttgcgccgacgagagctgccacacccgggagagcctgccgcggctgcgcgggcgctatgagatggtcaatatcaaactggataaaacgggcggcctgaccgaagcgctggctctggccggggaggcggaacggcagggatttgaacggatgctgggctgtatgctctgcacctcgcgcgggatcgccgccgcgctccctctggcgccgctggcgcgcttcgctgacctcgacggcccgacatggctggcggtggacgttgagccggcgctgcggttcagcaccggcgtgcttcatctttaa

SEQ ID NO: 654 - DNA, 783 bp, Klebsiella pneumoniae
gtgcactggcggcgtcttccgcccgctctcgggcctgattatagtgaagacctcctttctgcagcgagagacatcatgaaatccgatcagcacaacactatcctcatcgtcggcgcctcgcgcggccttggccatgctatggcggcgacgttcctccagcacggctgggaggtcatcggcaccgtgcgtgatttatcatcccacacgccgctccacgacctggccaaaacgcatcccctgcggctacgcctggcgacgctcgacattcgcgatgaagcccagctggccgcgctgcaggcgacgcttcccccggcaagcctcgatatgctgtttgtcaacgccggtaccaccaatcgtgacccatcgcagaccattggcgacgtctccaccgaggagttttaccaggtgatgctcaccaatgccctggcgccgatgcgggttatcgagcgcctgcagcaggccgttaaaccgcaggggctgctcggcgtgatgtcctccggccaggggagtctgaccaataaccttaccggccagcgggaactctatcgcgggagtaaagctgcgctgaatatgttcatgcgcagcttcgccgctcgcccctcctcggcctcccatccgctggtggtgatggccccgggatggatccgcaccgagctcggcggggcagatgccccgctgaccatcgaagagacaatcccacgcctggtgaacgtcctgctcgacaaacggctacgtccgggactggagtatctcgattaccagggccgtaccgtgccctggtga

SEQ ID NO: 655 - DNA, 204 bp, Klebsiella pneumoniae
cgtgcgtggcgcagcggaaaacgatcagcgttgaccgccgtcgtgctggcctttgcccttccctttttcggctcgccgctgcacaaaatcttcaatgatgccgacaacccagttgagaggtttccacagcaccaccagcagcagcaacggaccgtatattcgcacaccgcccgtcgcgacctgaccggtgaacagcagggctaa

SEQ ID NO: 656 - DNA, 1821 bp, Klebsiella pneumoniae
tcaaaacagcttcatctgcatgcaaggaaattcacggtgagaatcgccaccatcactaactgggcttacgggatcaccgttggcctgacgctggcttccgggagcgctatgctcatggcctccagcgccgaccgcgtcgaacgccaggcggtacagcagcgccaggtctttgataccctctccgacgaggtggaaaacgacgcctgggcgctgtctgacctcgcccggctgtacgtgataaagccttcgccggagacgcttacgcaatatcagcagctgcagcagaccgacaagagcatagagcagcggctgggcggcctgaaagataacggcgccagccgcgaggagctggcgctgctccaggatggcctgcggatcgccaatgagctacaggatgaacagcaggcggccctggcgcatgtcgctcgcggcgatgcgccagcggccatcgcggtgctgtacggcaccgcgtacgagactgaactggagcgcatgcagacgcagatcgatcgcttccgccagatgcttgagcatcgcgccgccgtcgctatcgaccaggccaccgagcgctcgcggatctggcgtacgctgtcggaaatcatggtcggcctgaccgccctgatgtttttgttcgtcctcggcttcattctcaaacgccgggtgctctacccggtggttcgcctgagcgacgtagtccagcgtctcgcctcccaggattatgcggtggagacgccgcactttacccaggtggatgagattggtgacatggctcaggcgatccgcatttttcgcgagaacggcctggcccgtcagcggctggagcagcagcgcgacgccgactgggcgatccgcgagctgctggcgcgtatgactcagcggctgcagggctgtgaaaccattgaggatgtgattaaggtggcggagcggtttgcgccgaatatcgccccgacgatccccggtaaactgtatgttctggataccgacccctggcagctgcgctgcgtagcgcagtggctgtcgcccgccggtgagacgacgcccttttctcccgacgactgctgggcgatacggcgaggactcagccatccgccggtgcagggcgagcccgatatcacctgctatcatctgccggagacgcacgccggccagtcgctctgcgtaccgctcatcgcccagggcgaagccattggcctgctgaccttccagaacgtcaccgccggtgacgctccttcccgggcctatctcgagctgatggcggaagcgttgggcctggcgctggccaatcagcgtttgcgcagcgccctgctggaaaaagcgctgttcgattccctgaccggcctgcgtaaccgccatcatcttgacgaagcgctgcattcgcagatggcgctggcggtccatacccatactccgctgagctgtctgatgatcgacatcgatcattttaaaaccatcaatgatcgctatggccatgaggctggggatctggtgattaagagcgttgcgaccattgtgcagcgcgcggtgcgcgatatcggcatggctttccgctacgggggcgaggagtttttagtgctgctccccgggattgacgaagccggggcgcaccagtgcgccagcgagatctacacccaggtgcgcaatatgacgctgcgcgatggtctgaccgagataggccaggtggatgtgtcgattggcatcgccagctacccgcagcacacccaaagcgatagtctgctgcgcgcggcggatgccgcgctgtaccgggcgaaagagctgggccgctcaaggattgtcagctttggccgcctgaagaccagctaa

SEQ ID NO: 657 - DNA, 468 bp, Klebsiella pneumoniae
tgttttgttagaattggagcgaaagtagtccattgcaaagcgagatgtaagcccatggcgaataaacccaccccggaagagctgaaaaatggcttgagcgaaatgcagttttacgtgacgcagcatcatggcaccgaaccgcctttcaccggacggctgttgcacaacaagaaaaatggcgtgtaccactgcctggtgtgcgatgcgccgctgtttaactcccagactaaatacgactccggctgcggctggccgagcttctacgagccggtaagcgcggaggccattcgctatctgaccgacaattcgcacggcatgcagcgcattgagatccgttgcggaaactgtgatgcccatctcggccacgtgtttccggatggtccgcagccgaccggcgagcgctattgtgtcaactcggcatcgctgagcttcaccgatgagcaaaatggcgagcaaatcaagggttga

SEQ ID NO: 658 - DNA, 279 bp, Klebsiella pneumoniae
tacccatctagcttcgccatcatcggcgaatccgtccagcacatcgattttcagctcccagtttttggttttctgagcgctctcgataaagctaaggaccgcatttggaaaatgcttgtgaacctggtcgagttttactctggtatcaatgagttcttgtcgcaactgggacaactcatcattgatgctcattttattttttcggtactcttccagcttatacagggcaatctttctatcaatttcttttcgaacacgcttccgctcgagtgcaaatga

SEQ ID NO: 659 - DNA, 363 bp, Klebsiella pneumoniae
ataacttatagagaggccactttgtgctttgccttaacgccaccagcttttaatccgccttcgattggcgaacgtaaaaagctggtcagtatcctcaagcggtccgggttgaccctgacgaccgcccggatcaaccttcttcaccacctgacgcaaaaccagatcccacttacggccttcgacctgtcaaagttggttaacctgccgctttcaacagtacatcgaaatctttcgatgttcgctgattttgggctggttgattatatcgttgaccgttcaagcgtctgccgctggtatcttctgaccgcaggccgtccgaacttctgcccgacctgtaaccaggctttcaacaccgcttactga

SEQ ID NO: 660 - DNA, 192 bp, Klebsiella pneumoniae
ggaagatatagcatgctaatttcagttctgagttttattgtcggcctcactggtgctggattgttatcagcaggcgcctggcttatttctccatcagtgggattgataacaggagggattatttgtctgggctggtcatatatgacaacccgggccttttcctccggcgtcagcaatggcggaggtgaataa

SEQ ID NO: 661 - DNA, 252 bp, Klebsiella pneumoniae
tccatgaatagattattcaggagaaaaaaaatgatgacttcaacgagcaaaaaaatggctgctgtcgttctggctgtcactgtagcaatgtctctgagcgcttgctctaacatgtctaaacgcgatcgtaacacggctatcggcgctggcgccggcgctataggtggtgcggtgttaactgacggtagcgcgctcggtaccctgggtggcgcagcagtcggtggtattattggtcaccaggtcggcaaataa

SEQ ID NO: 662 - DNA, 1425 bp, Klebsiella pneumoniae
gttggtcgtagacaggcgcagtataaagagacgcaggaaaaaatacagcgtcggtcgcgggctttgtggcagtgttggcaggagagggaaaaaggctgccccgggagacggggcagccgctgcgtattaacggatgttagcgcaggtcaggcagaaggcatagcgattctgcgggtcgttaaacgccgccagcttgtcgctctccgctttcaccgtctcggccgccgcggcgaccggcgcaggcagccaggcctgaatggccgccggcagcgaggcgcgtatcgagccggtcaggctatccagcaccatcgagaagaaggtcggctcttcctgatagtagttgaggtgccaggttttcagcttcgccagctcggcggctttggctaccgcgtcgtcgaagtcgccgaggctgtcgaccaggccgttggctttggcatcttccccggtccagacgtggccctgggcgatctggtcgattttctccggcgtgctcttgcgggcgttagccaccagggtgataaagcgctgatagccattctcaatgctcaactgcatcagctgctgcacttccggcggcagcgctttggtgctggagacatccgccagcggcgacgtggcgacgccgtcggtgtggacgccaatcgacccgagggtattttccacggtgttgatcaccccaaagatgccaatggagccggtgagggtgcttgggttcgccacgatgtaatccgctggggtggagatccagtagccgccggacgccgccatgccgcccatcgagaccactaccggtttaccggcggctttggctgccgccagctcttcacgaatgatttccgaagcggttacgctgccgcccgggctgtttacgcgcagaacgatggccttaattttcggatcgaggcgcgcatcgcgaatttgcgctgcggtggtgtcgccgccgacgttgcccggggtctcttcaccgtccatgatggcgccgttggcgaagattaccgcgatggcggaaccctggtcagacggcgtcttcacgttgtagtcgtaatagctgattgcccggtaattgttatccgctttgctccagccaaactgtttggtcagcgccttttccacttccgtggaggtcgccagctcatccaccagcttattgtccagcgcatatttcgccgtatcgccgcccaccttacgcaggccatcgataatgccctgggcgcccgggaagagctgctgggcggtgatctggcggttggcggcaatggtgttgaggtagttctgccacagttcgccaatccagcggctatccgcttcgcgggcggcaggggacatatcatcgcggatgaatggctcgacggcggatttataggtgccgacgcggaagacatgggtggagaccttcagcttatccagcagcgatttgtaatatag

SEQ ID NO: 663 - DNA, 1272 bp, Klebsiella pneumoniae
cccgttggtagcgaagccgtgcaggtctacctcgccctgcggcgagagccagattttgttggcgaagctcgccaggtagtactggccctggctgtagctgctgccgacggcatacaccggtttgccgctatcgcggaattcgcgcagcgctttgccgatgtactgcatggatggctggtcgccgccgacgaagtttttcaaatccagcacaataccggtgatattgcggtcatccttcgcctggcgaatggtctgcacgatatcgaacagggaattctcctgcagacggtccgagctggcgccaaacagttggcggccaatcacgccgagcttgctgctggcggatggcttatccaccaccacgccggtaatatccagcaacagcgcgccgcgcgcggcatgttcgctggtggtgctgctgaactggctccagatgccgatacacaccagcaccagcaccaggaagatcgcattgagggccagtttgcgaataaagttgagtatccgccacgtccatttaaaaaagctggcaatcagtcgccaaagggttcgcatgtcttctccctaacgttatctaaaaagggcaggccgcaggggccgccgcgtctggctatcctaaagagtgagccgtcggttgtcagcaggaatcaccgaccgcgctgtaacaaaatccttgtgcatgttaattttatgaaaaatgacatcacaggagttatacagatggatgctctcgatctactgcttaatcgccgcagcgcttcccgcctggcggaacctgccccggcgggcgaacagctggaaaacattctgcgcgccgggctgcgcgccccggatcatggcaccctgcagccgtggcgcttctttattatcgccgatgacggccgcgagcgcttcagccagttgctggaaaaaggggccagagaggccggccaggatgagaagggaattgagaaagcccgcaatgcgccgttccgcgcgccgctgattattaccgtggtcgcgcgctgtgaagaccaccctaaggtgccgcgctgggagcaggagatgtccgctggctgcgcggtgatggcgatgcagatggcggccctggctcagggattcaacggtatctggcgcagcggagcattgaccgagagtccggtggtgcgggccggcttcgagtgccgcgaacaggataaaatcgtcggcttcctctatctggggacgccgcagctaaaagcctcaaccaccattgccctgccggataccgcgccgtttgtgacgcgattctga

SEQ ID NO: 664 - DNA, 507 bp, Klebsiella pneumoniae
aacccattcaggagatccatgatgcgtatatttcttaccggcgcgagcggatttatcggctcacgtattcttccggcgctgcaggcgtcgggccatcaggttatcggcctcgcgcgcagcgaaagcaccgcacaggccctgaaggcggccggcgccgaggtgcatcgcggcacgctggatgccccggagtcgctgctggctggcgtcgggaacgccgacgcggtgatccataccgccttcgaccacgacttcagccgctttgccgctaactgcgagaaagaccgacaggcgatcctggccctgggccaggcgctgcgaggcagcacgcggccgctggtgatcacctccggcacgctgatgggcgacgacgggagcggcgccccggcccgggagtcgttcttcaactcagggcaccccagcccgcgcaccgcctcagagctcgcggggccagcagttgctggaggcgggagtggatgtcagggtggtccgcttaccgcaggtgcatga

SEQ ID NO: 665 - DNA, 1476 bp, Klebsiella pneumoniae
acagcatccagggcaccacccacagcagatggccccacaggacggtccaccagtcaccgtcaagccaggcatacagcgccaaccggtactggccgtcggccagcggcagggccggcaggaccagcggtagccagacccagccatcgcctcgcgccgggccgcaggccagccacagcaggcagacagccgcgccgagggcgcaggccgccagcgccagcccaaggctgttgccgagggcatccatctgcggcggcgccgagcgcgccagccccgccagcaatagcgcgcccagcagaccgctcagcggcagcagcgccgccagcaggcggccgggcagggcatgaggatgcgggtgacgaacaccgcgcagatcgggctggtactggcgctgtagccgccatacgccccaggcgaccagcgccagcccgccgaggatcgccatcagcagcaggttggccagcgcccctttggcctgctgcagctcatcgccctggcttaaccattgccacgccagcacggcgagggtgggcggattgccgggccccagcaccagggcgacgtctaccgccgacaggctccaggcggtggtggccagcagcaccatgccgagggcgggcagcagggcgggcagcaccagccaacgcaggcactgccagcggccgtagccgaggctcttcagggcggtcgcctggtcggcgaggcgtttctctcccagcaggccatagatcacccacagcacaaaggcgctctctttcagggccatcgtcaggccaagcccaatgccgtaccggtcgaccggcggcgtcagaaacggcaactgctgccagagccagcccccttcggcgaacagcagcagcgccgccgtcgccagggcgagatggggcaccgccagcagcagcggcagacgggaagccagccgccgccagcgggccgaaggccagagggcggcgacgatggtcagggcgatcagcagcgcgccgccgacggacaacagcgtggagacgagcgtggcggccagcgcctggcccagctgcgggtcggcgaacagcgcccgccagtgggccggggagcgcgcagcgcccaccagttccccggcggcggggagcagcggcagatagatcgccgccatcgccccccaggccagcaggatcagtgggtaccgtagcggcgcagccattcctgctccagcgcgtcaacccatgccgcgtgaggctcggcaagcaccggcggcagatcctgcggcagggctgccgccagcgcctggcgctggccgtcaggcagacgctgcggatccagtacgctcggatcgccccagacggcggcatcggccttgcgcaattgcgcctcaggggagagcaggaaattggccactactttggcgccagcgatagcgcgggcgttagccgggatggtaacgaaatggacgttgccgagggtccccacggtaaagccgaagctgtagctgtccgtcggtaa

SEQ ID NO: 666 - DNA, 438 bp, Klebsiella pneumoniae
agacgccccagcggcggatcttgccctcggccaccagcttctccatcgcctcaaccgtctcctgcagcgggatatccccgcgccagtgcaggagatacatgtccagatagtcggtctgcagccggcgcaggctgttttcacaggcgcggtgcatcgccgctttgccggcatgccagggatagactttggagaccagcactacccggtcgcgcagaccgcggatcgcctggcccaccacttcctccgccccgccgtcggcgtacatttccgccgtatcgatcaccgtcagtccatggtcgatgcccacccgcagtgcagccacttcctgctgacgctgcgccgcatgttcgcccatataccaggtgcccagcccgatggccggcactgccgcctgctcgccgaagcgtactgtttttttcaccatcttctcctccttaa

SEQ ID NO: 667 - DNA, 222 bp, Klebsiella pneumoniae
cgacgtaccagattcatctctttgatgctggccccgctatggagcagggcccgggtgatggtctgcttatctgccagcgttaaccccggggcgggcagcgccatcagcgccgaccctccccctgaaatcaatgccagcaccagatcatcggcagttaaaccgcgcagcgtctccacaatcagcattgcggcaacctcgctcatggcatctgatacgggatga

SEQ ID NO: 668 - DNA, 609 bp, Klebsiella pneumoniae
actcagaccagatctctacccaaacccaacggatggattaccgaaggagtaagtatgcaaaccatctcttttaaaaatcataacccggtaatgggcctgcaactgaactcagaaaatcagttttccggtctacgccgggctcggatgaagagtagagcaatttttgctgccgttcaggaatgggagtcgactttacctggacgtgcacaggaccacatcgcgcagctggtggatgagcaatggagaaaacaaaacggtcgcggaataaacgtcaataaacagaatctgtaccgctacctgaaaaacgaatccggatcagagaagtacaccagctacgtcatgcagctttcaggagcgatcgctgatgcgatgcctattgagattgcgcgcaaacacggattgaaacgtggattgactgaaagcgagctggtggctcaagcaatcaaagagtgtatcgaagcgcaccaggcaaaattgcttggcgctccattgcaaaagttagagcgtgaaattcgggaggcagcaattgcactttttaacatgcttcctgcagatgcggcgggaccactactggcgagcataagcgccgtagcgccacagtttttttaa

SEQ ID NO: 669 - DNA, 612 bp, Klebsiella pneumoniae
aaaaacgccagatgtcatagagaaaatcgcgaacaggaacggctgaaaatgatgaaatatgtcttatcgctggtggtggtggcgatactcgcaggatgtaccagcacgccaaacttgccgcctcgggataccattgtggcgatgaaacccacagagtccggtattgtcgccagctcagcgaaatacagttaccgctttgtccgtgacggtgtgcctcaggaatatcagcgttataagaccttttatgaacgctttcaccaacaggcttccggcgtgcgggttaactttgtcgtggtacaacatgaggtgacggcggaatatctggtggtgatggatcagcgcaaactggatgccgggcagcatagcgagctggtgaatcagtatcatgcggtgcaaattgataacgatcgcctcggggtgttgtttaaagcgacaggattttggactgcatcggacgcgtcagatctggccgccgcctaccagttagcgcaccccgttgtggtatcaatcaatgataagaccaaaacgattagctcgcttggcgccgttgccctggccccgttgtttccgttttacatgatgtatggatgtgccaccgggccttgtgtctga

SEQ ID NO: 670 - DNA, 516 bp, Klebsiella pneumoniae
aactcagccagccctgtgcgctcaggctgccgtatcgcatggctggcgttcttttttattcaccatcgcaataacgctggaagcatttccgttgcaatcgttgatctcctgccaggcatatttcgctgcacaccgaagcttcctgctctggccgtcagtagactgccgggaaattcaccatggagcagacttatgattgcggtactttttgaggccgacgccttaccacaagcacaggaaagatatcttcagctggcggccgggctgacgcctttgctttcagacacgccggggtttattgccattgagcgctttcagagcctgagtacgcccggcaaaatcctctcgttatcctggtgggaagatgaagcatcggtggccaactggcagcaaaatgagcggcatctggctgcccagcgcgaaggcaaagcatcgattttttcatattacagaatacgcgtcgcccgcgtgttccgggattacgcatcggatcggggagcacagtcagatgtatga

SEQ ID NO: 671 - DNA, 1182 bp, Klebsiella pneumoniae
cgtctatacagtgttgatataaatgatatagtggttatagttaatgccttttttattattaaaacgtcttatacatcatcgctttcaggatgcattgcggcgccactatggccaactgccgggagcccagggccttcatcggcgacaagttgcctgaacgtaaagtgtattaagcggcttcattttacgcgcaaacggatatcagccatgaaactacaacagcttcgctacatcgttgaggtggttaaccataacctgaatgtttcatccaccgccgaagggctctatacctcccagccgggtatcagtaagcaggtccgcatgttggaggatgagctgggcattcagatctttgcccgcagcggtaaacacttaacccaggtgacgccggccgggcaggagatcatccgcatcgcccgcgaagtgctgtcgaaagtcgatgccatcaaatctgtcgccggagagcatacctggcctgacaaagggtctctttacgtcgccaccacccatacccaggcgcgctatgcgttaccgggagtgatcaaggggtttattgaacgctacccgcgggtgtcgctgcatatgcatcagggctcgccgactcagatcgcggaggctgtgtcgaaaggcaatgccgatttcgccatcgccaccgaggcgctgcatctgtatgacgatctggtgatgctgccatgctatcactggaaccggtcgattgtagtgacccccgagcatcctctggccaccaagggctcggtgtccatagaggaactggcccagtatccactggtaacctatacctttggttttaccggccgctccgaactggataccgcgtttaaccgtgcgggcctgacgccgcgcattgtttttaccgccaccgatgccgacgtcatcaaaacctatgttcgcctggggctgggggtaggggtaatcgccagcatggcggtggatccggtctctgacccggatctggtgaagctggatgcgaacggtattttcagccacagcaccactaagataggtttccgccgcagcaccttcttacgaagctacatgtatgattttattcaacgttttgctccccatttgaccagggacgtggtagataccgcggtggctttacgctcgaatgaagatattgaagcgatgttcaaagatataaaacttccggaaaaataa

SEQ ID NO: 672 - DNA, 771 bp, Klebsiella pneumoniae
ccccctaacagtgatgttgctatgaacgcccgacaacaaagtattttgcaagtggtcatcgataaaggccgcatgagcgtcgccgatctggcgaagatgaccggtgtctctgaggttactattcgtcaggatttgaatttgctggaaaagcagagctatttgcgccgtactcatggctatgccgtaccgctggacagcgaagatgtcgaaacccgcatgatgacccatttcgccattaagcgtgagctggccagccgggctgcggcgctagtgaataccggtgaaacggtatttatcgaaaacggcagcagcaatgccctgctggcgcgtacgctggccgagcgcggcgatatcaccatcattaccgtcagcagctatatcgcccatctgctgaaagagaccccaggagaggtgatcctgctgggcggaatttatcagaaacgcagtgagagtatggtcggtccgctaacccgtcagttcatccagcaggtgcatttcagcaaagccttcatcgggatcgacggttggcaggcggaaaccggctttaccggccgcgatatgatgcgtgcggacgtggtgaacgccgtgctggagaagcattgtgaggcaattattcttagcgacagttcaaaattcagcgcggtacatccctatccgctcggtcccgccggccgctttaaccgcgttattaccgacgatcgcttaccggacgcctgtcgcgaacaattgctccgcagcggcctgaccgtcgatatcgtgccctacatctga

SEQ ID NO: 673 - DNA, 369 bp, Klebsiella pneumoniae
ccgtttgacaggaggcagggggccatggcctatatccccaaaaattacgcacgtctggaagtgggttaccgcgaaaaggcgctcaagctttttccctgggtgtgcggacgctgctcacgggagtttgtctactccaatctgcgcgagctgacggtgcaccacatcgatcacgaccactccaataacccggaagatggcagcaactgggagatgttgtgcctgtactgtcacgatcacgaacattccaagtacaccgaagccgatcagtatggctccacggtggtggcaggggaagatgcgcaaaagagcgtcggcgaggccacctacaacccgtttgccgatctgaaagcgatgatgaacaaaaagtaa

SEQ ID NO: 674 - DNA, 240 bp, Klebsiella pneumoniae
tggtgttgcagtctgcggcagggcaataacgggaacctcaacgcctgcaaccactcgatagacatactggtagccgttatgggtacgatggagttttcccgcggcatggagctgccgcagcaagttacctgctgtactggcttgcaagtcgagcgcatcgcagacatcctgcaggacgcattctggcgtccggctaacgatggcaagcacaatctgtgctttggttactttggtttttga

SEQ ID NO: 675 - DNA, 183 bp, Klebsiella pneumoniae
gagcgatgcagagaactactgctgcgccacatgcagtggttcgaagccgcagacctgatcgttaaaggcatggaaggcgctatcgccgccaagaccgtgacctatgactttgaacgtctgatggaaggcgctaaactgctgaaatgctcagagtttggcgacgcgattatcgcgaatatgtaa

SEQ ID NO: 676 - DNA, 201 bp, Klebsiella pneumoniae
cggctgcggctatcgatgaaagcgatcgccgacgggcagtacgggcgggaaagccgttttactgacatgcagaatatgaacccggaaacgctcgcccggactagcgaagcgccgccgggcgataatcgaaagagcacgttgtctgccaccggtcacgccttcaggctccgcgctctcctcgggcgtgaatttttaccttag

SEQ ID NO: 677 - DNA, 414 bp, Klebsiella pneumoniae
ccagggcgcagcccacggccgccggcagcgctgctgacaaggatgtcacgtcatgacaggagtcagaccatgcataatccgctggttatcgaagcgatcatgttgatcgcggccattatcgttggcgtctggagccagcgcgctttaccgctacatgtcgatagccgaccgatcctcttcctgctatgtctgttcctcggcactggcagcgcgttgtgcctgctgctggatatcttagccctgctgttcaccggtcaggtcgcgacgggcggtgtgcgaatatacggtccgttgctgctgctggtggtgctgtggaaacctctcaactgggttgtcggcatcattgaagattttgtgcagcggcgagccgaaaaagggaagggcaaaggccagcacgacggcggtcaacgctga

SEQ ID NO: 678 - DNA, 1770 bp, Klebsiella pneumoniae
tcagcaagcagccgcgccttgactccgggatcgacggctcggccagcatccgcagcgcctggtcgcgcccggggcactctcgacctgaaccaggcgtttaccgacaacgcttggttccgtctgaacctgatgggggaaaaaacccatgacgctggtcgggaccgcattgaaaacgaacgctatggcatcgcaccgtcgctggccttcggccttgataccccaactcgtctgtatctgaactatctgcacgtccggcagaacaacaccccggatggcgggatccctaccgtcggcctgccgggctattcggcgccttcgccgaagtatgccgcactcaactccgccgggaaggtcgataccagcaatttctatggcaccgactccgattacgataaatctactaccgacagcggtaccctgcgcttcgaacacgatctgacggagaacaccaccgtgcgcaataccacccgctggtcgcgagtgaaacaggagtatcttttgaccgcggtgatgggcggcgcgaacaatatcaccgcccccgatatcaatgacgtcaacacctggagctggtcgcgtctggttaataccaaagatgtcagcaaccgcattctgaccaaccagaccaatatcacctcgactttcaatactggctcgataggccatgacgtcagcgccggcgtggagtttacccgggaaaaccagaccaactatggcgttaacgccaggaccgcgccggcggtgaatctctaccatccggtgagcaacctgtcgattggcgggctggacagaaacggggctaacgccaacggccagaccgataccttcgggatttatgcctttgatacgctgacgctgaccgagcggattgagatcaacggcgggctgcgtctcgacaattaccataccaaatatgacagcgccaccgcctgcggcggcagcggacgcggggctatcgcctgcccgcccggacagtcgaccggcagcccggtcaccactgtcgataccgctaaatccggcaatctggttaactggaaagccggggcgctgtaccgcttaaccgagcagggcaatgtttacgtcaactacgccatctcacagcagccgccgggaggcagcagcttcgccctggccgccagcggcagcggcaacagcgctaaccggaccgactttaagccgcagaaggcaaaatccagcgagctgggcaccaagtggcaaatcttcgacaaccgtctgctgcttagcgcggcgttattccgcaccgatattgaaaacgaagtggccgccaacgatgacggaacctggtcgcagtacggcaaaaagcgcgtggaggggtatgaactctccgcgaccggaaacctgaccccggactggacgattatcgccggctacactcagcagcatgcgacagtgacggagggacagaacgtagcgcaggatggatcttccgccctggcctacaccccgaaacatgcctttacgctgtggacgcagtatcaggccaccagcgatctgtccgccggcggcggtgtgcgctatgtcggaagcctgcgccggggcagcgatggtgcagttggtaccccggatcacaccgagggctactgggttgccgacgccaaactgggctatcgggtcaacagcaacctcgatctgcagctcaatatgtataacctgtttgataccgattacgtggcctccatcaacaagagcggctatcgctatcatccgggcgaaccccggacctttatgctgacggcgaacgtccatttctga

SEQ ID NO: 679 - DNA, 489 bp, Klebsiella pneumoniae
aaaggtggcagcatgatgaacaataacaatctgcaacataaccaattcttcaccatcgaacaggacttttcgcctgataaaattactgatgctgagcgccttgttatggagcgcttcagtcatatttatgcaaactgggccgatgaaaaaaacttaagtcgtgaggcggaagaacttcgcgtaagagaaattaaaggttttaaaaacatcctcctctctccctggacattaagcgatgtaaccattgaatgggattactgggaatccgtacttcgtcacaggtataaaacacaaaatggcgatggctacgtccagattatctgggatcggcgcgggtggctcactgaccttttgtgcgccatgaaaccagttacccgggctgaagcattaacagtctgcaagtggttactggcatgtgactattttgaggaacgggattcgctgtttgatcgcattattttgaacctggtcggggagtgcgaagaatga

SEQ ID NO: 680 - DNA, 3366 bp, Klebsiella pneumoniae
atgcgcggcagtcatgagggcattaatgtaatggcagacgtcgcatctttagcggtcgggctgcacctgaacgcagccagttttaaatcccagctgctgggagcgtatggcgatgcggagaaccagtcacgacggtttaaccgtaatgcccaggcggacgcgaaaaagacggaagacgcctataagaaggtcggtctgtcgatatccgggatggccagccggctggcggggctggcaggagccggcctttccatcggtacgatcgtcaccacgtccagacaatatggacaggcgttatcagatctgcaggccatcaccggtgcgactgcagctgaaatgaaagcgctggatctggctgcgcaggaaatggggcgcacgacagagtacagcgccagccaggccgccgaagcgttaaagctgatggcgtcggctaaaccggagcttttaaaaacgtccgatggactgcagaaggctacgaacagcgcgcttatcctggcgcaggccgccggcacaacgctgcccgatgcgaccagaacgctggcgctctccttaaaccagtacggggcgagcgcgcaggaagcggatcgttatatcaacgtgctggccgccggcgcgaagtacgggtcgtcggagattgtggatacagcggccgccattaaaaatggtggcgttgcagccgcacaggccggcgttggttttgagcagttgaatgccgcgattcaggtgctggcagagcgtgaaattaaaggcggtgaagccggcacggcgctgcgtaacgtcatcctgaacctggaaaagggcacagacaagagcctcaagccatccgtggttggtctcagccaggcgctgaccactctttccgggaaaaatctatccacggcccaggccgtaaaactgtttggcgtggagaacctgaatgcggcgtctatcctggtccagaaccgttcaaagcttgatgagctgaccgcttccctgaccggtaccaaaacggcgcatgagcaggcatccatcagggttaacaacctgaacggcgatttgctggggctgagcagtgcgtttgaagggatggtcattaagatcggccagagcagtaacgggccactccgcagcgggattcaggttgccacggaggcactgaacagcctggcagacaatttcaacaccgtctccagcgtggcgctttacagcctgatccccgtgttatccacgaaactgactgcagggctgcgggagaatatcgcggcctggcgggaaagccaggcggcggtaaaagcgcgggcgcaggctgatgcggatattgcccgcaaaactctggattcgacagctgccatcctgaaacagaacgacgctgagtttggccactaccggcagatggagcggacggctaaacagtacgggatgaatatcagttaccaggatgagtttacccgcctcatccgacaggaaactgaacaaaccaatctggccagccaggcgaaactgaaactggcggcggcaaaccggcaattgtcgatatcagcccgcgcggcctccgttgcggtggggctggcaagaggtgcattaaatttaatcggtggtccgttcggcgccgcgatgctggccggttcgggcctcctttactttcatgagaaagcaaaggaggccaggcagtcagccattgatttaaaagatgccgtagtcgaaaccagtgaagcgctgatgcgcctctcgcttaaccagctaaatgtgaagcagttcgacctggaggatcagtacgaaaaccaggtcgtgcagcgtaaccagctgatgaaagagattcaggatgccgacagtcgtatcgacagcctgaaagggtttgaccctttcggccagctggaaggggtaacaaaaggccaggcgcgtgcacgggcggatctcgatagcgttaacgagggactccgcaaaaccgaggaaaacattaagcgtgtcagtgatgcaaaaacactggctcagctgggtttatcgggaaaaataacctcccttacggacgatctgaaaggggcgttaagcacgccccccaaagagaccggagatggaaatccctggggcggcgatggcggtaccggcacggggaaaggcagtaagtccaaggtcgaccagttcaaaacgctgcggcagcaaattgaagaagcccatgcgtccagcctggccagaattaacctgcaggaaaaggacagtaacagggagctgcaggaagcggcgaagaaaaatggcgccagtgatgctgacctgcagcgcgcgctgttaatgaacgcagagaattaccagaaacagcgactggatctggccgcgcagtattcccccgcccaggaaactctgcgaaaagagcaggaagccagccgggacctggctgagcttttcaaagcccgccttcttgatgaaaaagagtaccaggccgcacgaataacgctggccagagatactgcgaaagagctgctgcaggcgcatgccgatgaaatcgctgcgccggcactggatatcgccggcgaagttgatccactggtctcgctgcgcaatcagcttgcgcagcggcaggcattgctgcaggcgtactaccagggcagcgcgatcagcaaagaacagtacgaaatgctgatgcagaaggcgacgaaagaatccgccgatgcgcagtatcagacgtcactggagttataccgatcacagggagaattccagagcctggccgtcgggttatttgaaacggcccatgagcgctcaagcaacttcctgacgagcatgctgacgcggacgagaagctttaaggagaacatggctgacctgttttcctcgctcacgcagtcgatcataaaaaacctcgttgatatggccgctcaggcgctggtcaccagttccgtcatgcaaaccattatgggcgtggtgggcgtcgggaccagcgttgtcacgggcgctgcgggcgcaggctcggggacggcgatccagaatgccgccagtaacttccagttcaacgccaaaggcggcgtttacgactcgccgtcgctgagcgcatacagcaaccaggtctacgactctccgcagttcttcgctttcgcaaaaggggccggcgtatttggcgaggccgggccggaggccatcatgccactgacgcgtgccggcgatggttcgctgggtgtacgcgctgtcggtggtggtcagaacgccggcgcgtcggaagggccaaaagtctatatcacgattgaaggcggaaacacctcaacgcaggcgccgtctggttttgagcagtttggccagcagatcggctcgtttgtggagaaaaaatacagggagctgatggcgcaggatatgcgccctggcgggatggtctggaatgcagttaaagggcaacgctaa

SEQ ID NO: 681 - DNA, 498 bp, Klebsiella pneumoniae
ttgaaaaggctaagtctggagttggttaccaggttcccccaggttctgttacaatcccgtcataggcctgaacaacctatacctgctgcgtcgcggagagaaaccatgacgcaaacccccgaagtatcaaaatcccatcagactggtgctccttcatcgagcgccggtttgctttcgtcttcaaaactaacttttcgacagcaggaagttttcgatctgctggtggcctacatcaatcagcatggctacccacctacgctatctgagctggccgatatgctcggcgttagctcgtctaatgctgtcctgttgcatctgcgtgcgttagagagaaaaaattttataaaactctctcgccgtgtttccagaggaatttccatcgtcgggcgaaaggagcctatgctcgccgtgcagctgctgcaggaaatgatcgctgaagaacccggcgcgcgtgaaagagcgattgagtttttgcgactgttcggtgatcagccatga

SEQ ID NO: 682 - DNA, 285 bp, Klebsiella pneumoniae
gcttccttaaggtgtcgccttcccaggcgtcgttgtgaaaataaaatatcatttattttcaatgacttactagatttcttggttgttattatacagccttttcaccactgtgtaaccctgtttgttgtacacctcaatgaccagattacaattataaaaagcaagatgtcccaccctcatttggtgttgatttttctttatcgcgttcgttatgattctcattacaacaagttaatcgagaactattctcatttgcacagatttatggtaaaatactctctgtaa

SEQ ID NO: 683 - DNA, 2226 bp, Klebsiella pneumoniae
caacgacaaagcaacttgctcataaaaggaatggatatgaaaaagcgcctctgggtgctccaccctctgctgctggccagcacgctgcctgcgctggcggctcagtctgatgaagacaacatcatcgttagcgcaaaccgcacccatcgcaccgtggccgaaatggcccaaaccacctgggtcattgagggccaggagattgagcagcaggtccagggcgggaaagagttcaaagacgtgctggcgcagctgatccccggcatcgacgtcagcagccaggggcggaccaactatgggatgaacatgcgcgggcgcgcgatcgtcgtgctgattgacggcgtccgactcaactcctcacgcaccgacagccgccagctcgacgccatcgatccattcaacatcgaacatatcgaagtgatctccggagcgacctcgctgtacggcgggggcagtaccggcgggcttatcaacatcgttaccaaaaaggggcagcaggatcgtcaggtcgatcttgaggtgggcagcaagagcggttttgcgaacagcaacgatcatgatgagcgcgtcgcggcggccgtcagcggcggaacagaccacgcatccggccgcttgtcggtagcctatcagcgtttcggcggctggtacgacggcaataacgatgcgctgatcctcgataatacccaaacggggctccagcactctgaccgcctcgacgtgatggggacggggacgattgagatcgatgataaccgccagctgcagttggtcacccagtattataaaagccagggcgatgatgactacggtctctggctcgggaagaacatgtccgcggtcaccagcggcggcaaagcgtataccaccgacgggctcaattccgaccgtatccccggcaccgaacgccatctgatcagcctccagtactccgatgccgactttttcggccaaaatctggtgagccaggtgtactatcgcgatgagtccctcaccttctatccgttcccgacgctcacgaaaggtcaggtcagtagcttctcctcgtcgcagcaggataccgatcagtatggggccaagctgaccctcaacagtcaaccgctggcggggtgggatctcacctggggtctcgacgccgatcatgagacctttaatgccaaccagatgttcttcgatctgccacaatcgatggcctccggcgggttgcacaacgaatcgatctacacaaccggccgctacccgggatacagtatttccaatgtcgcgccattcctgcagtccagctacgatctgaacgatatctttaccgtcagcggcggggtacgctaccagtggaccgaaaaccgggtcgacgactttgtcggctacgcccagcagcaggatatcgccaacggcaaagcgcgctccgccgacgccatcaaaggcggcaaaaccgattatgacaatttcctgtttaacgccgggatcgtggcccacctgaccgagcgtcaacaaacctggtttaacttctcgcagggtgtcgagctaccggaccctggtaaatactatggcatcggtaaatatggcgctgctgtgaatggtcatctgccgctgatctccagcgtcaacgtcgatgactcgccgctgcaggggatcaaagttaactcgtacgagctgggctggcgctacactggcgatgtcctgcgcacccagctggcggcgtactactcgacctcagataagaccattgtcgtcaaccgcaccgacatgaccatcgacgttcaatccgacaaacagcgtatttactgcgttgaaggggcggtcgactactttattccggatagctactggagcgtcggcggtaactttaacgtgctgaaatcgcaagtgcaaaccgacggccgctggcaaaaatgggacgtcaccctcgcctcgccgtctaaagccaccgcctgggtggggtgggcgccggatccgtggagcctgcgcgtgcagagtcagcaggtatttgacctcagcgatgccgccggtaacaagctggaaggctataacaccgtcgattttatcggtagttacgcgctgccggtggggaaactgaccttcagtatcgaaaacctgcttaacgaagactatgtcactatctggggccagcgcgcgccgctgctctacagcccaacctacggcagttcatcgctgtatgagtacaaaggtcgtggccgcacctttggtctgaaatacgccttaaccttctga

SEQ ID NO: 684 - DNA, 825 bp, Klebsiella pneumoniae
cagcgcaaaagtgagataccaaagatgaagcgcgatcgggaaccgatcgcccaaggagttgccgtgcattatcaaccacaacgtcacttgctgaaagatcgcatcatcctggtcaccggggccagcgacgggattggtcgtgaagcggccctgacctacgcgcgctatagcgccagcgttatcctgctgggtcgcaacgacgacaaactgcgcaccgtcgcccaggagattgagcgtgagggtggtattccccctcgctggtttaccctcgacctgctcacctgtacgccccaggcgtgccagcagctggcgcagcagatcagcatgcactatccccgccttgacggcgtgctgcataacgctggcctgctcggcgacatctgcccaatggaagagcagaagccggaggtctggcagcaggtgatgcaggtgaacgttaatggcacctttatgctgacccaggcgcttcttcctttattactccgttcggaatcgggctcgctggtcttcacctcatccagcgtcggtcgtcagggccgcgccaactggggcgcctatgccgtttccaaattcgccaccgaagggatgatgcaggtgctggccgacgagtatcaaagccgccacctgcgggtaaactgtatcaaccccggcggcactcgcaccggaatgcgcgccagcgcgttcccgacggaagatccgctgaaactgaaaacccccgctgacattatgcccgtctatctgtggctgatgggtgacgacagtcgtcgcaagacgggaatgaccttcgacgcccaaccgggacgtaaaccaggaattgcccaatga

SEQ ID NO: 685 - DNA, 1242 bp, Klebsiella pneumoniae
ataaaaaaaagaatgattttcattttcaatcgaactttttttatttcgctcagtctctatcggacgacacagaatattaataattgccgtaatgaggttaggatgatgcacgatgcaaccatgcagggttccccacgcaagaaatttaataaaataagggagctcaacagacggcggaattactttactaagaaagtacgtaatgccctgcgggtgggggtggcgaaagcactctgggatcgccgacgccgtcagccggtagatttgtcgtctgcgaaaaccgtcctgttgatgcgcaatgagggggcggtcggcgatgtagtggtggattccgcgctggtgaaatgcctgcatcagtcaggctatatcgttgattttttgctgacgacctctaacagccaggtgatgcgttataacccgcggatccgccatatttatgaagctgacccggtcacgtccgccgattttttgcgtaaatttaatcataacgttcctcgcgacgttattaatgaactggctaataataagtacgatattattattgacccttcgctgttcgatattcccgtgcatcgcctgcggcttttccgacaaataaaagccaaatcagtgctcgggtttaataaatggccatcgattaagcactactcccactcttttgattttgactgccagcgctggcacgtgacgaaaacgttcgagctgatcgccgattatctccaactggacacccgcgggctggacgcttacgacctggtggtgcccgggccgattatgcaggaggtggcgcagtatctggcgtcgctaagcggaaaagcggtggtgattaatatttttgccggccatgccgaccgcagtctctcgcagacgcagctggcggaactgctcgacaaactgctggcccgccatccggggagcgcggttattctgctcgatcaccggcgcgagatccgcatcccgctgccgccggaggtggtgattaatccatttaacacattacaccatgcgatggcgctgatcgcccaggcggagctgattatctccccggacacctcggtggtgcacatggcggcggcgtggaacaaaccgctgatcgcggtctataaggacgttctgcttaataaccggctgtgggccccgggctatgacaacgccaggcagatcattgttaaatgcgggaaggtccatcagcatcgcgggctagtggatagaattatagcggcgctaccggagacgctgtga

SEQ ID NO: 686 - DNA, 837 bp, Klebsiella pneumoniae
catcctgaaagcgcgaggggaaatctgatggaacgctatgagacgctgtttgcccaactgaaaaatcgccaggaaggcgccttcgtcccctttgtcacccttggcgatccgggaccggagcagacgctgaaaattatcgatacgctgatcgaaggcggcgccgatgcccttgaactggggatccctttctccgacccgctggcggacggcccgaccatccagggcgcggccctgcgcgccttcgccgcgggagtgaccccggcgcagtgctttgagatgctggcggcgatccgccagaagcatccgaccatcccaatcggcctgctgatgtatgccaacctcgtcttcagcccgggcatcgatgcgttctatgcccagtgcgcccgcgtcggcgtcgactcggtgctggtggccgacgtgccggtggaagagtccgccccgttccgccaggcggcgatgcgccataacatcgcgccgattttcatctgcccgcccaatgcggatgacgatttactgcgccagattgcctcttatggccgcggctacacctatctgctgtcgcgcgccggagtgacgggtgcggaaaatcgcgccgcgctgccgctgcaccacctggtggagaagctggcggaatatcacgccgcgccgccgctgcagggctttggtatctccgcgccggagcaggtgagcgccgccattgacgccggagccgccggggctatctccggttccgccatcgtcaaaatcatcgaacgccacctcgatgagccgcagaccatgctcgacgagctgaaagccttcgtccagagcctgaaggcagcgaccaaaaccgcctga

SEQ ID NO: 687 - DNA, 441 bp, Klebsiella pneumoniae
ccgggagaaagacaaatgattgacaacagaactgtcagcgctattgacctggcgttgcaaaagcacccaacgccagttggtgatctgttcgccgcgatccgccacggacgcatgaagcggtgcttcagccgggataccgcaattcgttacctggcgttcttcatgacctcccgagcttttgggcgttctggtttcaagcagcgttatccggacgtgcaggtaattcatccactgaatccagaactgagtagctggcaacgtggcgccgtgaccactgagtattttaacgcccaccagcgcaccgttcgccggctgcgtcgcatcctcgcccgcaaaagagaaatgcaaaactggtgcaaaaagtgggatgccatgcacgaccgctacgtgaaagagcgcgaagaactacaggcctgtaagcctggagggctgagtcgatga

SEQ ID NO: 688 - DNA, 1731 bp, Klebsiella pneumoniae
gggaaaatgagccatgcgcgacccggtctgacgacctgttctcagtatgatgcggccctgcacgccttgtcggcggcgcgccagcgctgggcggaaacctcagtgaaccgtcgtctggcgctcctgcgccagatcaaggatgccctggccggcattgccccggcgtgggtggccgcggcagcggcggccaaagggctgccggcgggcgatccgctggcgggggaagagtggctggcgggcccctgcgcgctaatggtcggctgcaacgggcttatcgccaccctggagcaactggaggagaagacctttctgcggcggatcccgctgcggacgctggcggacggccgcctggcgctgcgggtggtgcccggcacgctctgggatcggctgcttctgtctggtgttcgcgctgagatatggatgcagccaggcgtcaaccgggcccatctcgaccgctatgcgtcgcgggcatacgacatcccgcctgccgcgcggcagggcaagctggcgctggtgcttggcgccggcaatgtggcctcgattgcgccactggatgtgctacacaagctgtttattgagaatcaggtctgcctgctgaagctcaatccggtgaatgattatctgcacgatctgctggcccaggccctggcgccgctgattgccatggatgcgctccgcatcgtcaccggcgacgcccgggcgggagcgtggctgactacccatcccgctgtcgatgagatccatatcactggctcccgcgagacccatgacgtcatcgtctggggcgagggtgagacggctcgccagcgtcgggccgccgggacgccgctgaacccgcgtcgggtgacctcggagctgggcggcgtcagccccaccattatcgtacccgggccgtggagcgaggcggacatcgcttttcaggcgcagcagctggcgacgcagaagatgaacaacggcgggtttaactgcgtggccagccaggtgctgatcctgcagcaaggctgggagcctgcgacggccttgctgaatcagctgtaccgactgatcgccgcgaatacccgcccggactactaccccggcgctgaaaaccggctgaccgactttcgcctgcgcgcccgtcagccgctggagatagcccgcggtgacgcgctaccgttgattgtggcgaataccgacgatgatcccgggttctgccagcaggaggtctttggcccggggctgtcggtcacccgtcttgaggccgatagtgcggaaagctttttgcgccaggcgatcggctatgcgaatcagcggctgcagggcacgctgggggccaatattgtgatccacccgcgcacccgcaaagcgattggacgtaagcgttttaatgcgctgatcgccgagctgcgctacggcacggtggcgatcaactgctggagcggggtggccttcctgttagccccttgcccgtggggggcgtttcccggccacacgctcgacgatattcagagcgggcggggcaaggtgcataacagctttatgctggagaaaacggagcgcacggtgattgaggcgccgtttcggccgtttccgcgtagtctttggcatggcgaactgacgctgatgcccctgccgccctggttcatcacccaccgggggcaggaagcggtggcgcagcggctggtggatttttaccatcggccgcgctggcgcaaattgccggcgctcctctggcgcgcgctgcggggctaa

SEQ ID NO: 689 - DNA, 1068 bp, Klebsiella pneumoniae
actgcgatgagcgaaccgttaaaaccgcggattgattttgatgggccgctgcaagcggagaaaattccgccgctgaaaggcgctcgcgccttcgacaccctggaggcggacaacttcgcgccagcgcggctggtgaccggcgaagaggaagagggggcggcggaagcggtggtggagtcggtcctgcgacccaaacgcagcctgtggcggcggatggtcagcgccggactggcgatcttcggcgtcagcgtcgtggcgcaaggcgtgcaatggacggctaacgcctggcagacccaggactggattgcgctgggcggctgcgtcgccggggcgctgatcgtcggagccggcgtcggatctgtagccaccgagtggcgccgtctgtggcgactgcgccagcgcgcccacgaacgcgatgaagcgcgcgatatgctgcacagtcacgcggtcggtaaagcgaaagcgttttgtgagaagctggcgcagcaggccgggctggatcagtcgcatccggcgctgcagcgctggtatgccgcgatccacgaaacgcaaagcgatcgcgaagtggtgagcctttatgcgcagctggtgcagccggtgctcgatgcccaggcgcggcgggaaatcagccgttcggcggcggagtcgacgctgatgattgccgtcagtccgctggcgctggtggatatggcgtttatcgcctggcggaacctgcggctgatcaaccgaatcgccacgttgtacggcattgagctcgggtattacagccgtctgcgactgtttcgcctggtgttgcttaatatcgctttcgctggcgccagcgaactggtgcgcgaggtggggatggactggatgtcgcaggatctggcggcccggctgtcggcgcgcgccgcgcagggcattggcgccggcctgctgaccgccgttctcgggatcaaggcgatggagctgtgccgcccgctgccgtggatcgccgatgataaaccgcggctcggcgattttcgtcgcgagctgattgggcagttaaaagagaccgtgcagaaaagcaaaacccgcccggaaaactaa

SEQ ID NO: 690 - DNA, 369 bp, Klebsiella pneumoniae
cgcagcccgagctgcttattgactgatcgaggcattacagagcaacttattacggcatctaaagcagttgcgaagcaaatccctttcaccactgctgccgctaatctctctgaaacttttagccagctgcgtcagcaggcaaaaaaacttgccacccgcatggacgccgcaagccacaccgcaagtcttgccgctaccgtcagaatcaaaacaaccggcgccaccgccggagtgctcgccgacatgcttggaaaccttgcagaagaagctcgacggtatgctgcaatcgctgacgaacgctacacagcaggaatgaccggtgagcggatttacgaatcagtaagaacgtctatccccagtaagggataa

SEQ ID NO: 691 - DNA, 354 bp, Klebsiella pneumoniae
tcaggcccgagagcgggcggaagacgccgccagtgcactcatatcttgcagcaaacgccctgtctggcgactggagcgataatgaacgatcccgattttaatttgctggcggccctcgatccgctgccggtcagtaccgaggtgattacggtttcgcaggcgtggcatccgcgtctggagcaggccccggccaccgctggctgcggcagcgggtacgtgaggtgtgtcgcgagtaaaaaaagcccgcacaagtgcgggcaaaaatactggaagcaatgtgagcaatgtcgtactgaatacccgagtgatttactcaactattcagtgatgagaaagataatatttctcatttaa

SEQ ID NO: 692 - DNA, 804 bp, Klebsiella pneumoniae
cgcgcgacgagttttgttcgcgattctatcccccattatcatcctgtcgcctcgttgagccagagtggcttcagcggcggcagtgtgattattagcgacggcgaccggcggcacgtgctgagtcagccgcacgatccgtctgccgccacttaccattttcgccgtcagtatcacgcactccgccgactgcctgccaggctggcgccaaccccgctgttttactcaccatgctggatggtggtggagtattgcgcaggggaggtgaaaagcgagttaccggcctccccgcagctgtcaggcttattgtatgatttgcatcagcaaccgcggtttggctggcgggttagcctcacaccactgctggcccagtactggcagaggtgcgatccggcgcggcgcaagccgcgttggctgcgctggcatcagcggctgcgccgccagggcgagccccgtcccctgcggctggcgccgctgcacatggacgtccatgccggcaatattattcataatgagtccggcctgaggctgatcgactgggaatatgccggcgatggcgatatcgcgctggagctggccgcggtgtggatcacgcctggcgagcgccgtcggctggtagaagcgtatgcccggcgggcggccatcgacgcgcagctgctttggcggcaggttgcactctggcgcccgtgggtactgctgctgatggcgggctggtatgaaatgcgctggcggcagagcggggaccggcaatttatcacgctggcagatgaaacatggtgtcagttagacaacgaacgtaaaggataa

SEQ ID NO: 693 - DNA, 960 bp, Klebsiella pneumoniae
tggtcagcgagttctttaacgaagacgacccggatttcgaccactctcttgaccagaaaatgtctatcaattgggtggaaagctgggaggtggtgctggccgatgaagaacaccagtaaattccagaatgtggtgatcgccactatcgtcggttggctggtgctgtttgtcttcctgcccaacctgatgatcatcgccaccagctttttgacccgcgacgatgccaacttcgtcaaactggtcttcacgctggataactattcgcggctactggatccgctctattatgacgttctgctgcattcgctaaacatggcgctgctggcgaccctcgcctgtctggcgctgggctatccgtttgcgtggttcctcgcccggctgccgcagaaggtacggcccctgctgctgttcctgctgatcgtccctttttggaccaactcgttgatccgcatctacgggctgaagattttcctcagcactaaaggttacctgaacgagtttctgctgtggctgggggtgatcgacaccccgatacgcattatgttcaccccctcggcggtgatcatcggcctggtgtacatcctgctgccgtttatggtgatgccgctctactccagcattgagaaactggatcgcccgctgctggaagcggcgaaagatctcggcgccagcaagctgcagacctttatccgcattatcattccgctgaccatgccggggatcatcgccggctgtctgctggtgatgctgccggcgatggggttgttctacgtttccgacctgatgggcggcgccaagaacctgctgatcggcaacgtgatcaaaagccagttcctcaatatccgcgactggccgttcggcgcggcaaccagcattaccttaaccctggtgatgggcctgatgctgttgatttactggcgcgcggcgcgcctgctgaataaaaaggtggagctggaatga

SEQ ID NO: 694 - DNA, 222 bp, Klebsiella pneumoniae
aatgttcagagtttggcgacgcgattatcgcgaacatgtaatctggcccccagattatgtcagaacgggaacctggtggttcccgtttttattattagttttcgaacggttatcaaaattttatcaaaacaagttatcaaaacccctcccgaaaaacctcataaggccaccgttgtccaccccttcccacgatcatcatggtacctatccgtttgttgttga

SEQ ID NO: 695 - DNA, 825 bp, Klebsiella pneumoniae
  unsure (150): Identity of nucleotide at the above locations are unknown.
ccggcgcagagagtgctacgacggaacgatttgcggtacaatcgccggctagttaacacctgcgacactcaaggagaatgcatgtctatcacggcgaaatccgtctaccgtgacaccgggaatttttttcgtaatcagttcattactatnttactgattgcgctgttgtgcgcgtttattacggtagtacttggccatgccttttcacccagcgacgagcagctgtcgatactcagcgaaggcgataacctcgccgatagcgccgggctgttcgagctggtgcagaacatgacgccggagcagcagcaggttctgctgcgcgcctcggcggcatcaaccttctcgggtctggtaggtaatgcgatcctcgtcggcggcgtcctgctgctgatccagctggtctccgccggtcatcgcgttagcgccctacgcgccatcggcgcctcggcgccggtgctgcccaagctgctgctgctgatcctgttcaccaccttcctggtgcagatggggatgatgctggtgctggtgcccggcgtgctgctggccatcgtgctggcctttgcgccgatcatgctggtacaggacaaaatgggcatcctcggcgccatgcgcagcagcatgcgcctggcgtgggccaatctgcggctggtggcgccggctattatcggttggctggtggcgaaaaccctgctgttactgtttgcttccagctttgccgccctgacgccaaacgtcggcgcggtagtgattaataccatcagcaacctgatttccgccctgttgctgatctatttattccgcgtgtatatgcttatccgcagctaa

SEQ ID NO: 696 - DNA, 1350 bp, Klebsiella pneumoniae
aacgggcagagctatgaaccaaaacattctgaggatttacctgttcagcaacacacaacacgcattgcgatcagattatcgacacttccgtcaccggcgagagcatttttgcccgccaggtcacgcgaacggagaacagagatgcgtattgccctgaagtcggccctgatgctgaccaccagagtcatccagatcattaaccctgaactgcaccggcatatgcaacgaacggccttaatcgccctgacgctggcgcaaaggctggaactgcctgacgaacggcagcagaccattttttgcgccgcgctgctgcacgatatcggcgtgctgggggataaacgcaccattcattcgctggatgctatcgataatatccacgacccgcatcagcgccagggtgtggcgatgctggagggattagcgaccttccagcccatcgttccctttattcgcgatcaccattttagcccgaaccaccggggctcccgcgaacagcacattgtctatttcgctgatgcctttgaacggctgctgccggccgatagccacgttgccgcctggcccacgcgggcggtggtggaacagttcgtcgctttgcatcgggagatcgatccgccgctctgcgatatcctgtgcgaggtcgctgaaaatgcgaacttctggcagcaccttcaccctggccatattcagcggctgctggagattattggccccatcaacacgcgctatctggatattcacggtctgaaggatgtctgcctgctgattgccaaaatcgtcgacacctacagcagctttaccgccacccatagcatcatggtgggggaaatcgcccgccagcttgcccgctggatgcagctgccggagcccacctgccagcaaatacagatagccggctatctacacgatattggcaaagtctatatcccactctccattctcgaaaaagagggcgagctggatgatgaggagctgagtcaggtgcgggagcacagctacatgaccggcgaacttctcagcgactatagcgagctcggcgacatcattaactgggcctcgaatcatcatgaaaaaatggacggcagcggctaccctctgcatctcgaaaaggagcacctgaccctcgccgaccggattatctccatcgccgatattttcaccgcgctgaccgaagatcgcccttatcgtaaagggatggcctggcaggaagccttacagattatggaagcggatgttataaatggcgctctggatagcgatgtcttcctcgttttgcgccgccatgcggaaacgctacacgccatcattcttcagacccttgcccctctgcatagcgagcgccgcctctga

SEQ ID NO: 697 - DNA, 693 bp, Klebsiella pneumoniae
aacttttggagagatacagtggccacggcaaacatgattcaagaacttctgaaggaaaaagggtggagtaaagccgagctggctcgtcagttaggggttagcacgcagacggttgtctactggacgaagggagacactgtcccaaggggtaagagattagcccagctttctgaaatcagtggttacccacaatcctggtttctgggtgagggacaacccgccaccttccctgcgtccgctcaaaaaggagatactgatagcgttaaattcaaagtattagatattgaattcagttgtggtgatggagttagcgtgaaaagtgacttcattgatgtggtccgctccatagagttagaccccgagtacgctcgtcaagttgtaggcaacagacccttcaagaacattgagattggcaatgccaggggtgatagcatgtcgccaacaatagcaccgggtgatttattatttctagataaaacaataacatacttcgatggtgacgggatttatgctttttgttttgaaggtgaatgttatgtaaagaggctgcaaaaaataggcagcaaaattgtagtattatctgacaactcgaattaccaatcttggagcatcgagaaggatgccttggatatgctctacatccagtcaaaagttatctcatcagttcctttcaacatcaacagattcggttaa

SEQ ID NO: 698 - DNA, 897 bp, Klebsiella pneumoniae
cgaggcaggagaatggcgaaacgggaaaactataatgacctttatctgtttatgcaggtggtacgggaaggcagttttaccgccgcagcgcaacgacttggcctggcgcagtccggggtaagccgtgcggttcgtgaacttgaagagcggctgggcgttcagcttctggtgcgtaccacccgccggttgtcgctcactcaggcaggtgagcagctctatcacaacgtcgaatccggtttcgacgccttagatatggggctcgccacgctggcccactatcgtcagacgccctccggtacggtacgcatcaatgccagccagcataccattgataaagtcctgctgccgaagctggcagtatttaaacaacgctatcccgatatcagactggaactgatcagcgaaagccggtttgtcgatattattgcgcagcgattcgatgcgggcgtgcgtctgggcccggaagtcgggagtggcatgattgcggtacgcatttcgcccgatatggagatggcggtggtgggtaccccggaacattttcgccgctacggctttccacaaacgcccgccgatttagtcgcccacccctgcatcgcttatcagttcggcgacggtagcctttacgcctgggaacttaatgtggatggcaaaaaaatcacccacccgcctcagggacagtgggctttcgccgatagctatatggaggccaaagcggcgaggctcggtctggggctggcctatgtcccggaagagctgattaccgacgatctagcccagggcacacttatccgggtgctccagcgttatagccagcgtctggaaggttcatatctctattacccgcaccgcaatgtgtcgcccgcgctgagagcggtcattgatacattgcgaatgtag

SEQ ID NO: 699 - DNA, 888 bp, Klebsiella pneumoniae
caagaggggagcttcaccgtggaatattcagtattaagtaacgctcgcaaaatgccgatgctgggtttcggcgttttcaaggtgaccgataaagcggagtgtaagcaggcggtgttgaacgccattcgcaccggttatcgcctcatcgataccgctgccgtctacgataatgaagatgcggtgggtgaggccgtgcgcgaagccatcgccgaaggtctgtgtacccgcgaggcgctgtttattacctccaaactgtgggtccaggacatggccaacaccgggatggcgaaagccgggattgccgcgtcattaaaaaaatcgggcctggaatactttgatctttatttgctacatcaggcgatgggcgattatttcagcgcctggcgtgcgctggaagaggcctatgaggccggtaccctgaaagcgatcggcgtctccaatttttacccccatgtgttagctaacttctgcgaaactgtcagagttaaaccaatggtgaaccaggttgaactgcatccttatttcgcgcagcccgcggcgctggaagccatgaagcattatcacgttcagcctgaagcgtgggcgccgttaggcggtggcagacataatccgtatcaagatgcattgcttcgggggatcgccgatgcgcaccagaaaaccattgcgcaggttgttctgcgctggaacgtgcagcgtggcgtcacggtgatccctaaatccacccgccaggagcgcattgaagaaaattttgcgatctgggatttcgtgttaacagataacgaaatggcgcaaatcagcgccctggatttaggctatgttggcgaagcggtaaaacacttcaaccctgagttcgttcgcggatgtctgggggtgaaaatccacgactga

SEQ ID NO: 700 - DNA, 927 bp, Klebsiella pneumoniae
tcaggttttggtgaaaaaatggatataaatcagctacgttgctttgtggtgttaggtgatgagcttcactttggccgggctgcccgtaaactcgaaatgatgcctgcgtcactgagtcgctttattaagctactggaagatgatttggggatcaggctactgaatcgatcgacccgcaacgtgtcgctaacacctgaaggcgccgcctttttaaatgaggccaaaacggtcattgctgatttcgatgcgctacggcagcgattccggaaaaatagcctgttgcagaaaagaacgttgcggatcggggctatcgacagcgcagccaaaggattacttcctgaattgcttaatctttttgtcaggcgttttcctgaagcagatattcatcttacagaagataaatctcacaaacttatcccccgactcatttcagggtggctggatgtggtttttgtgcgcccgccggaacatattgatgccacgctgacagcgcgttttatcgccaatgaaacctgcgtgctcgccgtgcccgctcatcaccggctggtcagttatgacgaagtcagtatcgatgatttccgacacgagccggttatcttgccggaaagacgcacccggcgtcacagccatgacctgacaatgaatattttcaaagaggggggcagcatgcctgtcatcgcgcagtatgctgaagagaagcagactatcctgagttttgttgccgcaggactcggcattgctctggtgccagcgtcctataaagacatgaatgccgacggcgtgaaataccttgcgctcacgccgaaaaagcatgtcgaagggctccccctcagcgcgatgtggcatcagggaaacaacactctctatgtgagatccctgctggagatactttccgacaacatcgacgaactgacccgtgagttgtga

SEQ ID NO: 701 - DNA, 2313 bp, Klebsiella pneumoniae
aagggttttggtctatcaacgaccacttttagcaatgaaagcaggagacgagtaatgtctgataagcacccgaaccctcaccaacagcaggcaccggtccacgacagcgaggaagcgcagccgggtctcgattcgctggcgccggacgatcgggagtggcgccccacgccgaaacctaccgctccgggcgtcgaacccaccgccccaggcagcctgaaagcgcccgatactcataacagcaaactggattccctggaggcgcaacgcaaagggggggaagattttccgctgaccaccaaccagggcgtgcgcattgctgacgatcagaattcgctgcgcgccggtagccgcggcccaacgctgctggaagattttatcctgcgggagaagatcacccactttgaccacgagcgtattccggagcgtatcgttcatgcccgcggctctgccgcccacggctacttccagccctacaaaagcctggctgcgttgactaaagccgattttctttcgtcagccgataaaatcaccccggtgtttgtacgcttttccaccgtgcagggcggcgcggggtcggcggacaccgtccgcgatattcgcggcttcgctaccaagttttacactgacgaagggatttttgacctggtgggcaacaacacaccggtcttcttcatccaggacgcgatgaagttccccgactttgtccacgccgtgaagcctgaaccccactgggccatcccacaagggcagagcgcccacgatactttctgggactatgtttccctgcagccggaaacgctgcacaacgtgatgtgggcgatgtcggatcgcggcatcccgcgcagctatcgcaccatggaaggcttcgggatccataccttccgtctgattaatgccgagggcaaagccaccttcgttcgctttcactggaaaccggtcgccggcaaggcgtcgctggtgtgggatgaagcgcagaagctgaccggccgcgaccccgattttcatcgccgcgatctatgggaggccatcgaagccgaggactacccggaatttgagcttggcctgcaattgatccccgaagagaatgaatttgcttttgacttcgacctgctcgatcccaccaagctgatccccgaggcgctggtgccggtgcagcgggttggcagaatggtcctcaaccgcaacccggataacttctttgccgaaaatgaacaggcggccttccatcccggacatatcgtcccgggcattgatttcagcaacgatccgctgctgcaggggcgtctcttctcttacaccgatacgcaaattagccgcctgggtgggccgaacttccatgaaatccccatcaaccgtccgacctgcccgtatcataatttccagcgtgacgggatgcaccggatggacattgacaccaatccggccaactacgagcccaactcgattaacgacaactggccgcgcgagacgccgcctgccgccaaacgcggtggctttgagtccctcgccgagcgcgtcgacggcgaaaaaatccgccagcgcagcccttcgttcggcgaatattacgcccagccgcgtctgttctggctgagccagacgccgattgaacagcagcatattatcgatggtttcagcttcgaactcagcaaagtggtccgcacctggatccgcgagcgggtggtcgatcatctggcccacattgatactaagcttgcggaagcggttggggcgaacttagggatcgaactgagcgacgatcagcgcaacattaccctgcccgccccggtcaatggcgtggagaaagaccctagcctcagcctctacgccgatgccgaaggagatgtgaaaggtcgcgtggtggcagtcctgctcaacgaacgcacctcagcgcaggatctggttcagctcctgcaggcgctgcaggcccagggcgtgcacagcaagctgctctactcgcgaatgggcgaagtcattgccgacgatggttctccgctgccgatcgccggcaccttcgccggctccccttcgctgacggtggatgcggtggtggtgcccggcggcgacctcagcgccctgagtcagagcggtgacgcgcgctattacctgctggaagcctataaacatctgaagccgatcctgctggcaggggatgcgcggcaactgacgtccgttctgcatgttccgacccagggtgaagagggggtcatcgtcaccgatgcgctcgacacgccagcggcggacaaactgctcgccctgatgacggcccaccgcgtgtggtcgagaagcccgaaaatcgccgctattccggcgtag

SEQ ID NO: 702 - DNA, 960 bp, Klebsiella pneumoniae
gaccgcgttgggcgacaggatagttttgccagctggaacaatgtcatggataaactggatactctgaccttgtttgtgcgcatcgtcgaacggggctcattcagtgccgccgccgcggatctgggggtttcccggccagtagcgaccgcggctattaaagcgttggaggtcagtcttggggcgcggctgctacatcgtaccacccggcacgtacggccgacggcagaaggctcgctgtattatcagcgctgcgtgtccattctggcggcccttgaggaggccaaccgcagcgccggggggagcatctccggcaccattcgggtagacgtggcgggcaacctggcgcggaccctgctgctgcccgcgctgccacagtttctcgcccgctacccggacattacgctgcagatcggcgaaagcgagcgtgacgtcgatctggttcacgagggagtcgactgcgtcattcgcggcggccatctccccgacagcgagatgatctgccggccgctcgccgggttgcaggagatcacctgcgccagcccgacctatctcgcccggtacggcaccccgcatacgattgaaggactgacgggccacgtgatgatcgggtttgtttcatcgcgcacgcaacgtaccttgccgctgagctttacccaggatggccgtcagagcgaggtcagtttgccctgtcggctgctgacttccgatgccgacgtcggcgccgaagcggcaaggcttggctttggcctgtatcaggcccccttgccccgccttgaggccgatctggcgtcgggcgcgttaacggaagtgctggccgattttcgccctgcgccgctcccgctctccctgctctatcccagtaatcggcagctctctgcccgggtacaggtatttatcgactgggtgacggcgctgatgaagcctcccctggcgcagcaggcatccggaaggctaaaataa

SEQ ID NO: 703 - DNA, 2280 bp, Klebsiella pneumoniae
ggattttatggagattcatctcgttacattgtaatgataattgttatcattaatattctcgatctcattttgcattgttttgaaaaggatatttacatgagatcgccgcaatattctgtgcccacgaccctggcgctggtcatatccagtctcctcgcccctaacgcctttgctgaagaatcagaacaagataccgaaacgatgattgtgcgcagtacggcggaagaggcgcttaagcaacagcccggggtgtcgattatcacggctgaggatattgctaagcagccgccggtcaacgatctctcagacatcatccgtaaaatgcccggggtgaacttgaccggcaacagcgccagcggcagtcggggcaacaaccgccagattgatatccgcggcatggggccggagaacaccctgatcctgatagatggggtaccggtcacgtcacgtaacgcggttcgctatagctggcgcggcgaacgcgatacccggggcgacagcaactgggtacctgccgaaatggtcgaacggattgaagttctccgcggtccggcagccgcgcgctatggttccggcgcggcgggcggagtggtcaatatcattaccaaacgtccgaccaacacctggcacggttcgctgtctttcttcaccaaccagccggaaaacaacaaagaaggcacgaccaatcgcgctaacttcaatctcagcggcccactggccggcgaggcgctgacgatgcgcctgtatggcaatatcaataaaacggaacccgacgcctgggatattaaccatgcgcaaaacggctcttacgctgcggggcgcgaaggggtccgcaataaagacattaacgcgctactgtcatggaaaatgaccccgcaacaaattctcgatttcagctacgcctatagccgtcaggggaatatctatgctggcgatacccagtacagcaacggcagtcttagcccgaacgggctggtggactccctgtacggccacgaaactaatcgcctctatcgccagtcctggggactgacctacaacggtctatgggattggggccagtccaaagccggtgtttactacgagaaaaccaacaatacccgcctgcaggaaggctctaccggccgcgtcgaaggcatgatcaacagtgaagattatgccaccagccgtctggaatcctggcgtactacctcggaattcaatgtgcctttcttctggctggcggaccagacgctgacgctgggaatggaatggaaccatgatcagctcgacgacccggcatcgatgcaggccactaacagcaacggcgagactatccctgggacctcgggcgaccctacgcaacgcagtaccaaaaacagcgccaccctcaccggtatctatctggaagataatatcgaagccgtgcccggcaccaacctgatccccggcattcgcttcgattatcataatcagtttggcagtaactggagccccagcctcaatctgtcccaggagctcggcgatatgttcacgctgaaggccggtatcgcgcgcgtgtttaaagcgccaaacctctatcaatccagtaaaggctatttgctctccacccgcggcaacggttgtccaaacacgatcgctgaaggcagctgctacctgctgggtaaccctgacctcgacccggagatcagtatcaacaaagagatcggtatcgaatttaaccttaatggttacgctgccggagtcacctggtttcgcaacgattacaaaaacaaaatcgtctccggaacagaggtactgggctatacctccagcggcaataatattttgcaatggcagaacggcggcaaagccgtggtcgaggggctggaaggaaatctgctgatcccggtgctgagagatgtcctcagctggcggaccaatgccacctggatgctcaaatctgaaagtaaagagactggcaacccgctgtcggttatcccgaaatataccgttaacacgatgctcgactggcaggtaaacgacgccctgtctgcgaatgtgaactggacgctttatggccgtcagaagccgcgtcagtatgcggagatccgcaacgaaaccgggacccttgcgaccaccgaggttggcgcctattccatcgtgggtattggtactcagtatcagctaaaccgggatattcgcctgaatgccggaataagtaatctatttgataaacaactgtatcgcgaaaatgccggcgcctcgacctacaatgagcctggccgcgcgtattacgccggcgttaccctctccttctga

SEQ ID NO: 704 - DNA, 384 bp, Klebsiella pneumoniae
agttcgcatggaaacccgcagcattattgcgcgtccggcggtctgacgccccttcacagcggttcctgcgggaaccgctgcttctttcctctctatccagccatttccgtcgcaccgattaaggttgtgcgtttttttcgcttctctttttcattcatttttagcatcattgatttcattcgtttttgttaccaggataatgccatgtcagatgtgaatgcccacctgctcgctcaacgtatcgataccgtgctggatattctggttgccggtgattaccattctgcgatccataatctggagatcctcaaagcggagctgctggcgctggcggcggacgatactgaacaacaaaaccaacccaaggcgccctgggaaatctga

SEQ ID NO: 705 - DNA, 186 bp, Klebsiella pneumoniae
gcaattggtggtgacaatatgataagtaatatcgattacatgaaactggcgatgtcatacgagaatgacaaaaccgaaatcgatcccgttctgcgtagtcgcgtatggggcgtagtgttggtagggttggcgatgttctggagcatcatcgcgctcaccatctgcaacatctggattgtcagctaa

SEQ ID NO: 706 - DNA, 357 bp, Klebsiella pneumoniae
actgactccggcttcgctctgttacacctcgggaaccaccggccggccgaaaggggtattgaacacccatcgttcgctggtcctgcacgccctgagcggcaaccagccggacgccgccggcatatcggcgaaggacagcctgttgccggtggtgccgatgttccatgtcaacgcgtgggggacgccgtttatcgccgccatggtcggcgcgcggctggtgctgccggggccgcacctcgatggcgacagcctgctgcagctgctggccgccgagaaggtgacggtggggtttggcgtgccggtgatctgggccggcttgctggcggcgatgcgccggacagaggtccggctgcctga

SEQ ID NO: 707 - DNA, 1416 bp, Klebsiella pneumoniae
acttccgccggtgaccgcgcaatgcttaaaaccctagctcgctggctgaccgtcgccatcctcctgctgcttatcgccctggcgctgttcagtcgcgaaggcgcgtggtggcgctggctgaccaaaggcggctggcacaccaccgcccgtatcagcagcctgacgccgcaggagcggacgtgggcgcagatcgcctggcggtacgtcgagaacaatacccagccgcaaaccggcctggtcaacggcagcgacaaacagccgcgcgcgacgctgtggcagatgggcgacacccttatcgccctgctcgccgccagagagctggagttggtaaaggaagcggaattcgacgcccgcctgacgcccctgctcggcaccctcaatcgcttgacgctgaccgacgatggctcgccgggcaggctatactccactcagacggcgacccctgtcgactttagcggcaaaccggcggccagcggctggtcagcaaaagatatggcccgactcatgctcgccctgcggctcaccgccgaacgcgcgccgcagtacggcgagtacattgataaaattatcctgcgctggaacttctgtccggtgatcgataaagacggagagctgtggtccgcctcactgcagaacggccagcggacgatccgcgaggagcttcgactgggagacagtgaatacgccgccagcgcgtttcgcctgtgggggttcccggccggcaaggccttctctcccccgacgcgcaatgtgattatgtatcagcgtcgcctcgccgttgacgaccgcgacccgcgaaccacctggcaacccgtggcgctctccactctgcccgccatgctaccgggactggagttcggctggcagccgcccggcgtgccggaagaggtacaaaaagccatgcgcgaacgggcggaagggatatggctcagccagaaaacgcgctggacacaggataaagtgctaaccgcccgggccgatttttcgcttacccaggcgccctggcacgtggaagataccgtctgggggaatggctacgcctggaatacgctcggggacgacgggaagtactacccccggctggcgcaggtgaccaccaaggcggtctttgtcctgtggacgctgtgggaaaccgagtataccgatgcgctgatggcggtcactacccatcttaacgacccgcagcgcggctggtttgaagggcgggtcgaggccaccggcgacgtcaacgccaccctcaccctctccactaacgccatggtgctggaggcgctgttttacaaacacaacgccgggccgttgttcaaaaacggcctcgcggatgacaacagctactttgcccgccgcgcgacggacgaatttaacccgccccgccgctgcctgccgggcgaacgggtcatgaggagcgcaccatga

SEQ ID NO: 708 - DNA, 1653 bp, Klebsiella pneumoniae
agcccgcgcggtgctgcgcgccattgcccaggcccatcacgcgaaggagattttctgatggctgacattctgctgctcgataatatcgattcctttacctataacctggcagaccagctgcgcgccaacggccataacgtagtgatttatcgcaactccgttccggcgcaggcgctgattgagcgtctgggcaccatggacaacccggtgctgatgctctccccgggcccgggtacgccaagcgaagccggctgcatgccggagctgctgacccgtatgcgcggcaagctgccgatcatcggcatctgcctcggccaccaggccattgtcgaagcttacggcggctatgtcggccaggcgggggagatcctccatggcaaagcctccagcattgagcacgacggccaggcgatgtttgccggtctggctaacccgctgccggtggcgcgctaccactcgctggtcggcagcaatattcccgccgggctgacgattaacgccaatttcaacggtatggtgatggcggtgcgtcacgatgcggatcgggtgtgcggcttccagttccacccggaatcgatcctcaccacccagggcgcgcgactgctggagcagaccctggcctgggcgctgcagaagctggagcataccaacaccctccagccgatccttgagaaactgtaccaggcggaaaccctgagccagcaggagagccaccagctgttctccgccgtcgtgcgcggcgaagtgaagcctgagcaactggccgccgcgctggtcagcatgaaagtgcgcggcgagcagccgcaggaaattgccggcgccgctaccgcgctgctggaaaacgccgcgccgttcccgcgcccggactacctgtttgccgacatcgttggcaccggtggcgacggcagcaacagcatcaatatctccaccgccagcgcctttgtcgctgcggcctgcgggttaaaagtggcgaaacacggcaaccgcagcgtctccagtaaatcaggctcttctgacctgctggcggccttcggcattaatctcgatatgaacgccgataaatcccgcgccgcgcttgatgagctgggcgtctgcttcctgttcgcgccgaagtaccacaccggtttccgccacgcgatgccggtccgtcagcagctgaagacccgcaccctgttcaacgtgctggggccgctgatcaacccggcgcatccgccgctggcgctgattggcgtctacagcccggaactggtgctgccgatcgccgagaccctgcgcgtgctgggttatcagcgcgcggcggtggtgcacagcggtgggatggatgaagtttcactgcatgcgcctacggtggtggccgaactgcataatggagaaattaaaagctatcagctgaccgccgacgacttcggcctgacgccttaccatcaggcgcagctggcgggtggcaccccggaagaaaaccgtgacattctgacgcgcttgctacaaggtaaaggtgaagccgctcacgaagccgccgtcgccgccaacgtcgccatgttgatgcgtttacacgggcatgaagatctgaaagctaacgctcagcaggtactggatgtgctgcacagcggcgcggcctatgacagagtgaccgccttagcggcaagagggtaa

SEQ ID NO: 709 - DNA, 282 bp, Klebsiella pneumoniae
actacgcgcggagaaaaagaggagtccgttatgcaaggtacaacccaaccaatcgatcgccagacgctgctcgaaaaagccaacaaacttattcgcgaacatgaggatacgttagccggtatcgaagccaccgacgtcgttcagcgcaacaatgtcctggtgtttagcggtgagttttaccttgatgagcagggactaccgacgccgaagagtacagcggtatttaacatgtttaagtatcttgctcacgagctgtcggacaagtaccacctggtcgattaa

SEQ ID NO: 710 - DNA, 765 bp, Klebsiella pneumoniae
ttatcaggcggcggagagggcccgggagtatattcatgcctgttttatgcaggatatgaccctcgacaccctgtcgcaggtcagcggccgggaccgctggagcctgagccgggatttcagaacgctgtacggcaccagcccgtggcgttacgtcatgatgcgtcggctcgatttttgccgccagcggatgcgcgccggggaacgtctggtggatattgccgccgacgcgggctttgccgatcagagccacatgacgcgccagtttatcagccgctttggtctctctccgggccgctggctgcgggcgatccgcggctagcgcggttcaggttgcacaatcgttcaagcgtgaccgcggcgaggcgaactatgctgactgcctttatcacaaggagacagcccatgtatcaactcgttaatcttgctcataaattttccctgttcagcgatcaatggcagcccaaagtggtggctgaaatgaacgactatcagttcaaggtcgtgcgcatcgtcggcgattttatctggcacagccacccggaaaccgatgagacattgatggtggtggagggggtattgcgcgtggacttccgcgacgggcatgtgctggtgaaggccggggagatgatcgtcgtgccgcgcggggtggaacataagacctcggcggagacggaagcgaagctgatgctgattgagccgcgcggggtgttgaataccggccacgagggcggcgagcggacggcggtgaacgacgtttggatctga

SEQ ID NO: 711 - DNA, 441 bp, Klebsiella pneumoniae
gcaggctcaggaagctggggtagactatatggtgattggtcgcccggttactcagtcggcggatccagccgcgacgctgcgggcgatcaacgattctctgcgcaagggggcataatgagcgattccaacagccgtctggtctactccaccgaaaccgggcgtatcgacgaggcgaaaccggcgccggtgcgcccgaaaggcgacggcattgtgcggatccagcgccagaccagcggccgcaagggcaaaggcgtctgtctgattagcgggattgatgccgatgatgctgcgctaaccgctctggcggcagagttgaaaaaaaagtgcggctgcggcggcgcggtgaaagatggcgtgatcgagatccagggcgataagcgggatttactcaagtcgctgcttgaggcgaaagggatgaaggtcaagttagccggtggctga

SEQ ID NO: 712 - DNA, 411 bp, Klebsiella pneumoniae
cggcgatcaggttgggtcatggcgcacctcctcactgcacgccgccacgcgacgggcgcgggcaaaccgtttgcctatctgcaccagggcaaacagcagcccgccggcgaggctcagtttgagcgcgaaggcgagggtcgccccctcgcgggccagttcgctggccatcaccgaatagatgaccagacccggcagggtggtcacggccgagatcagggtaaagggccagaagcggatcgccgtcaggccgtaggcgtaattctgaatgttgtagggaaagagcggcaccaggcgggtgaggatcaggaaatcgcagccgctgcgggcgataccgcgctcaatcgcctgaaagacggtggtatggccgacatagcgctgcagcagatcgcgtccaagccagcgggcgattaa

SEQ ID NO: 713 - DNA, 882 bp, Klebsiella pneumoniae
acagtaccaggagttattgtggccagaaagcaatcagccccgcgtctcgagtttgaggcggcggcgatctatgaatatcccgaacatcttcgcccgtggctggaggcgctgccgaagctgccgggcgtctatcagtttcacggcgacagcgacacgatgccgctctatatcggtaagagcgtcaacctccgcagccgggtgttatcccacctgcgcacccctgaagaggccgcgatgctgcgtcagtcgcggcgtatcacctggcagcgcaccgctggcgagctgggagcgctgctgctggaggcgcggttgattaaagagcagcagccgctgtttaacaagcggctacggcgtaacaagcagctctgcgcctggctacttgcggacgaccggccgcagattgtctatgcccgtgaggttgatttctcgcaccagcagcatctctatggcctgttcgccaaccggcgggcggcgctgcagatgctgcagagcctcgctgacgaacagcgcctctgttatggcctgcttggtctggaaccgctcagccgcggccgcgcctgctttcgctccgcgctgggccgctgcgccggggcctgctgtggaaaggagagcgtggaggcgcacaaagagcgcctgctggcgcagatgagcagactgcagctggtgtgctggccgtgggcggggcccgtggcgctggaggagcgcggcccggacatgacgcagtatcacgtcattcataactggctgtggctgggcgccgttgaatcgctcgaccaggcggcggagttgacccgtctgcccgccggatttgaccaggatggttacaagatcctctgtaagcctttgctcagcggagactatccgctgcatccgcttggctga

SEQ ID NO: 714 - DNA, 2202 bp, Klebsiella pneumoniae
  unsure (1275): Identity of nucleotide at the above locations are unknown.
ccaccaccagggcggctgccatcagctgccgggtatcttacaatccaaaggagcccaaacgcaatgaacaactacccgtatctcattaaagctaaggcaaaagcaaacgaagcgaaaagcctcttctgctggttctctgctaaatccgattctcgcgccgagcgcaaaatcctggacatcctggaagacgctgaaattaacgttggccgcggcgccagccatcagctgccgatccgcaccaactggctcatcgttgatgacttaccggaagaaggtgtactggatgacacctggtgcgatcgctacgagcttggtggtgaagacgggctgacatggcaaaaaatcgttgcgccagcggctgctgaaccacagccctccagtaaaccagaaaacgatatctctcctgcaaatagcgatgaagaggactattcgaacaatgaagaagcactcttcaacctggcggaaatgtcattccgcacgcagctgcttgcccagtatatggccgacgagcgtcacgtgtatcacattagcattcctcatcgtaaccgcctttcagcgatggaaatggatacggataatcacggtgtgcagaatctactgctgacggcagaaaatattccggagcttaaaaaatatgatatgcctggcctgtggaaatttaccagtgcatttaagagcgtatttcctgtggggaaacgccatgagctcggcaagcaaattcagttcgccaaattgtggcttgaaacgtcgcacattgaccgcgggatccttacaaaggaatgggctgctggaaactatatcacctcaataaacaaaaccgatgccggcgccaatgctggcggcggtaacaaaactgaccgcaatccggattatcagcattcgctggatactctggatatagagatcgctcttgcaacgatgcctatggattttgacatctataattttccggcatcagtccaccgccgcgcgaaggaaatagtacagaagaaagaaagtccatttaaagaatggtctgcagcattacggagcacaccaggcatccttgattattcccgtgcagcgatttttgcactgatcagggaagcatccagtggaataactccttttccagatcggttacgtggctacatcaacgcgaatctgactgaacataagcatgataccccgagcgctgagacgcttaccaaggcgggacatattccatctgctgcagtcactctggatgcaacaacccaagtaatcgccggagaggatagcagcgcaaaactgganacactctcctccgacattaaagcagttggtgccgaactggtaaaagaggctcaaaagcaacgtccggacgctaatcaggttctgcccgccgagcgcggcgaatatgttgaaggggttagcgaccctacggatccgaagtgggtaaccgaagaccttaccaagaccaggcagcctgaagtttcaaaaattggggacggagtattttccatcgaaggtcttgttgacgttacgggcaaggttaaccaaaaagaaaaaacagatgaagttattcatcaaacggatgctgtagatattaaacccggtcatcataataaggaggaagatcagccaattgattatgttcacgttatggttgatctggaaaccatgggtaaaaaacataacgcccctatcgtcgctattggtgcggttgttttcgacccggcaaccggctctattggagaaagtttctataaagtcgtatgccttgaatcctccgtgaactggggcgccgtaatcgatccatctactgttatctggtggcttaagcagtcctccgaagcacgctctgcgatcgtaaatgatgatgctatcccgttgcaggatgcattactccagttcagagaatttgtttctgataatgtcgctggtgggagcaaaaaggcgcaggtatggggtaacggtgcgtcattcgacaactctattctgcgttcttcttacgattgcattgctgaagattatccgtgggaatactggaacgatcgggacgtacgaacaatggtagagctcggccaagccattagcttcgaccccaaaacaacgatccagtttgaagggtctcgtcacaatgccctcgctgatgctattcatcaggcccgctatgtatcagcgatctggcagcgaataattgccggcaatcaggtgctgcaaaaattgatgcaaaactga

SEQ ID NO: 715 - DNA, 1305 bp, Klebsiella pneumoniae
tgcagtacaggagggcatatgacctggttcatagaccgacgcctgaacgggaaaaacaaaagcgccgtcaaccgccagcgctttttgcgccgttataaggcgcagattaaacagtcgatctccgaggccatcaacaagcgctcggtgaccgatattgagagcggagaatccgtctcgatcccgacggacgatatcaacgagccgatgtttcatcagggtcgcggcggcctgcgcaaccgcgtccacccgggcaacgaccattttgtgcaaaacgaccgcattgagcgcccgcagggcggtggcggcggcggcggcggtagcggtcaggggcaagccagcgccgatggtgaaggaaaggatgagtttgtcttccagatctcgaaagatgaatacctggatctgttatttgaagatctggccctgccgaacctgaagaaaaaccagcaccggcagctgaacgagtttaaaacccatcgcgcgggttttacctccaatggggtgccagccaacatcagcgtggtacgttcactgcagaactcgctggcccgccgtacggcgatgaccgccggcaagcgtcgtgaactgcgcgccctggaggaggatctggaagccatcagccgcagcgaaccggtgcagctgctggaggaggagcgcctgcgcaaagagattgccgaacttcgggctaaaatcgagcgggtgccgtttatcgacacctttgacttacgctacaaaaattacgaaaaacggccggagccttccagccaggcggtgatgttctgcctgatggacgtctcaggctcgatggaccaggccaccaaagacatggccaagcgcttttatatcctgctgtatctgttcctcagccggacttataaaaacgtcgacgtggtctatatccgccaccatacccaggcaaaagaggtggatgagcacgaattcttctattctcaggaaaccggcggcaccattgtctccagcgccctgaagctgatggatgaagtagtgcaggcccgctatgatccggcgcagtggaacatctacgccgcccaggcgtcggatggcgacaactgggccgatgactccccactgtgccacgaactgctggcgaagaaaattctgccggtggtgcgttattacagctatatcgaaattacccgccgggcgcatcagaccctgtggcgcgagtatgaacacctgcaggcgacctttgataatttcgccatgcagcatattcgcgaccaggaggatatctacccggtattccgcgaactgtttcacaagcagtcatctaaaagtgaagcttaa

SEQ ID NO: 716 - DNA, 1527 bp, Klebsiella pneumoniae
atacccacaggacgtcatcaccacggtgcgcggccagggctatctgttcgaattgcgctgatgaagggactgttgcggcatatcttcccgctgtcattacgggttcgcttcctgctggcgaccgccggggtggtgctggtgctcaccctggactacggcatggtggccctggtgggctatagcgttagcttcgataaaaccacctttcgcctgctgcgcggcgagagcaatctcttttatatgctggcgagatgggaaaacggcgctattgacgtcgacatcccggaaaacctgaatatggaaagcccgacggtgacccttatctacgatgagcagggcaaactgctgtgggcgcagcgtgatgttccatggctggcgaaacgcattcaaccggaatggctgaaacgcaatggcttccatgagattgaagccgatgtcgacagcagcagtatgctgttgcgcaataaccatgagattcaggaacagctggacgctatccgcgaacagggcgacgactctgagatgacccactcggtggcgatcaacctctacccggccaccagcaaaatgcctcagctcagcattgtggtggtcgacaccattccggtggagctcaagcgcagctatatggtgtggagctggtttgtctatgtgctggccgccaacctgctgctggtgatccccctgctgtgggtcgccgcctggtggagcctgcggcccattgagtcgctggccaaagaggtgcgcgaactggaggaacatcaccgcgaaaagctcaatcccaacaccactcgcgagctgacccggctggtcagcaacctcaaccgcctggttcgcagcgagcgcgaacgctatgacaaataccgcactaccctcaccgatctcactcacagtctgaaaacgccgctggcggtgatgcagagtacactgcgctcgctgcgcggcgagaagatcagcgtcgacgaggcggagccggtgatgctggagcagataagccgcatctcgcagcagattggttattacctgcatcgcgccagcatgcgcagcggcggcaccctcttgagccgggaattacacccgatcgcccccctgcttgacagcctgacttccgctctcaacaaggtctatcagcgcaaaggggtcaatatctcgctcgacatctcgccggagatcacttttgtcggcgagcagaacgattttatggaagtgatgggtaacgttcttgataacgcctgtaagtattgtctggagttcgtggaagtttccgtgcgccagaccaccgacagccatctgcacatcctggtggaagacgatgggccggggatcccgcagagccagcgccgggccgttttcgaccgcggccagcgggctgataccctgcgtcccggccagggggtagggctctccgttgcgcgtgaaattgtcgaacaatatgatggagagatcatcgccggggaaagcctgctcggcggcgcctgcatggaggtggtgtttggccgccagcagatggaagataaacagagttaa

SEQ ID NO: 717 - DNA, 726 bp, Klebsiella pneumoniae
cgacacacaggaagccctatgtctatttcacgtcctcgcccgcagcgcggcgactttccgccgggaacccggcagtatggcagctcggaactgggcgcgccgctgctgtggtttcctgcgccgcaggccgacagccgtagcgggctgattattgccggtacccacggtgatgagaattcgtcgattgtgaccctctcctgcgccctgcgcaccctgaaacccgagctacgccgccaccacgtggtgctgacggtcaatcctgacggctgtcagctcgggctgcgcgccaatgcccgcggcgttgacctcaaccgtaactttccagcagccaactggaagcaaggggaaacggtttaccgctggaatagcgcggcggcggagcgcgacgtggtgctgttgaccggcgagcagccgggttcggaacgggagaccgaggccctgtgtcagttgatccatcagattcatccggcgtgggtggtctcctttcacgatccgctggcctgcatcgaagatccgggccacagcccgctgggtcgctggctggccgacgccttctccctgccgctggtgggcagcgtgggctacgacacgccgggctcctttggcagctggtgcgccgatatcggactcccctgcatcaccgccgagttcccgccggtctccgccgacgaggcaacggagcgttacctgccggcgatgaccgatctgctgcgctggcaggcttaa

SEQ ID NO: 718 - DNA, 873 bp, Klebsiella pneumoniae
attctaacaggcagaatccacaggcagatgatgaacacttctgacaaccatgctttaggcgattttctccgcgcccgccgccagcgtctcgatccggcaacgtttggcttcccggcgggacgccggcgcaccccggggctgcgccgcgaagaggtcgcgcagctcgccagcatcagcccgacctggtatacctggcttgaacagggtcgcggcggggcgccttcccgcgaggtgctggagcggatcgcccgcggtctgcggctgaccaccccggagcgcgagcatctgtttattctcgcctttggccatccgccgcagacgcgtctgacggtgacggatgatatgacgccgcggctgcagcgggtgcttgacgctttcaccattccggcgattatccgcaccgccagctgggacgtcatcgcctggaacgcgccggcggccagggtgctgaccgactacagccaactgccgctggcggagcgcaacgtgctgcgccgcctgtttacccggccggaggcccgctgcactctggaggactggcagagggtggggcagcttatcgtcaacgccttccgcgccgacgtcacgcggatgggcgccacgaaagaaactgaccagttgatcgcggagctcagccagcagagcgtcgagttcgcccgtttctggcaaagccatgacgtcgccggccacggcgagggctataagcgcattaatcacccgcagatgggtccgctcgacctggaatttacctcctttgccgtggagggccgtcccgatctttccctgctggtctttaatccggcaacgacggagagccagcggaaaattcacggtttacttcagggggcgggatccgcgccggaggagagctga

SEQ ID NO: 719 - DNA, 882 bp, Klebsiella pneumoniae
tgtccagcaggagtccttttgagcgacagccaatacgcagtgatttacgatctgcacagccataccaccgcctctgacgggcggctgactccgcaggaactggtccatcgcgcccatgagatgcgcgtcggcaccctggcgatcaccgaccatgacagcgtggcggcgatcccggcggcccgggaggagatcgcccgcgccggattacccttgaccctggtgaacggcgtcgagatttccaccctttgggagaatcacgagattcatattgtgggtctgaatattgatattgcgcacccaacgatgaccgccctgctggaagagcagaaagcgcggcgccagcagcgcggtcagatgattgccgagcgcctggagaaggcgcggatccccggcgcctgggaaggggcgctgcgactggcggacggtggcgccgtcacccgcggccattttgcccgttttctggtggaggccggccatgcgaaaaacatggcggaagtcttcaaaaaataccttgcccgcgggaaaaccggttacgtgccgccgcagtggtgtacaataaaacaagcgattgatgtgattcatcattctggcggcaaggcggtgattgcccatcccgggcgctacgatctctccgccaagtggttgaagcggctgttggcccactttagcgagcagggcggtgatgccatggaagtggcccagtgtcagcaggcgccccatgaacgcgcccagctggccaccctggccgtgcagtttggtcttctggcgtcgcagggatccgattttcatcagccctgcgcgtggatcgaacttggccgtaagctctggcttcctgccggcgtggaaggcgtctggcacagttgggaagcggccgccgaataa

SEQ ID NO: 720 - DNA, 423 bp, Klebsiella pneumoniae
gctgcagcaggccaaaggggcgctggccaacctgctgctgatggcgatcctcggcgggctggcgctggtcgcctggggcgtatggcggctacagcgccagtaccagcccgatctgcgcggtgttcgtcacccgcatcctcatgccctgcccggccgcctgctggcggcgctgctgccgctgagcggtctgctgggcgcgctattgctggcggggctggcgcgctcggcgccgccgcagatggatgccctcggcaacagccttgggctggcgctggcggcctgcgccctcggcgcggctgtctgcctgctgtggctggcctgcggcccggcgcgaggcgatggctgggtctggctaccgctggtcctgccggccctgccgctggccgacggccagtaccggttggcgctgtatgcctggcttga

SEQ ID NO: 721 - DNA, 1956 bp, Klebsiella pneumoniae
aaaacgaaaggacggcatgccatgaatatattcgatcactatcgccagcgctacgaagctgccaaggacgaagagttcacactgcaggagtttcttaccatctgccggcaagatcgcagtgcctatgccaatgcggcagaacgtctgttgatggccattggtgaacccgtcatggttgatacggctctcgagccgcggctatcccgtctcttttcaaaccgggttatcgcacgctatccggcatttgaagagttttacggtatggaagacgccattgagcagatcgtttcctacctcaagcatgccgcccaggggctggaagagaagaaacagatcctctatctgctggggccggtgggcggtggtaaatcgtcgctggctgaacggctgaaagcgctgatgcagcgcgtgcccatctatgtgctgagcgccaacggcgaacgcagtccagtcaacgatcacccgctgtgcctgttcaatccgcaggaagatgcgcagatcctccagaaagagtatggcatcccgacccgctatctcggcaccattatgtcgccgtgggcggccaagcgcctgcacgagtttggcggcgatatcactaaattccgcgtggttaaagtctggccatcgattctcgagcaggttgccatcgccaaaaccgaaccgggtgatgaaaacaaccaggatatttcagcgctggtcggtaaggtggatatccgtaagctggaacactatgcgcagaacgacccggacgcctacggctactccggtgcgctgtgccgcgccaaccaggggattatggagttcgtcgagatgtttaaagcgccgattaaggtgctgcatccgctgctgaccgccacccaggaaggtaactataacggcaccgaagggatctccgccctgccgtttaacgggatcatccttgctcactccaacgaatcggaatgggtgaccttccgtaataacaagaacaatgaggccttcctcgaccgcgtctatatcgtcaaggtgccttattgcctgcgtatctccgaagagatccgcatttatgaaaaactgctcaacaacagtgagctgacccatgcgccctgcgccccgggcaccctggaaacgctggcgcgcttttcgattctgtcgcgccttaaagagccggaaaactcgagcatctactcgaagatgcgggtctatgacggcgaaagtctgaaagataccgacccgaaagcgaagtcctatcaggagtatcgcgattacgccggggttgatgaagggatgaacgggctctccacccgctttgcctttaagatcctgtctcgggtgtttaacttcgaccacgtcgaggtggccgccaacccggtgcatctgttctatgtgctggagcagcagattgagcgcgaacagttcccacaggagcaggccgagcgctatctggaattcctcaaaggctatctgatcccgaaatacgccgagtttatcggcaaagagatccagaccgcttatctggaatcctactccgagtatggacagaacattttcgatcgctatgtcacctacgctgacttctggatccaggatcaggaataccgcgatccggacaccgggcagctgtttgaccgtgaatcgttgaatgccgagctggagaaaattgagaagccagccgggattagcaacccgaaagacttccgtaacgaaatcgtcaactttgtgctgcgcgccagagccaacaacagcggacgtaatccgaactggaccagctatgagaaactgcgcacggttattgagaagaaaatgttctccaataccgaagagctgttgccggtcatttcgtttaatgccaaaacctcaaccgatgagcagaaaaaacacgacgactttgtcgaccgcatgatggagaaaggctacacccgcaaacaggttcgcctgctgtgcgagtggtacctgcgggttcgtaaatcgtcctga

SEQ ID NO: 722 - DNA, 2688 bp, Klebsiella pneumoniae
gataaaggaggagctatgtcgtcaaccctacgagaagccagtaaggacacgctgcaggtcaacgataaaacctggcattactacagcctgccgttggcggagaagcagctgggcgagatcagtcgactgcccaagtcgctgaaggtgctgatggagaacctgctgcgctggcaggacggtgactcggtaactgaagaagatattcgcgccctggccggctggctgcaacaggcccatgccgaccgggaaatcgcctaccgtccggcacgcgtcctgatgcaggactttaccggcgtgccggcggtagtggatctggccgccatgcgcgaggcggtgaaacgccttggcggcgatacggcgaaggttaatccgctatcgccggttgacctggttatcgaccactcggtgaccgttgaccgcttcggcgacgacgaggccttcgaagacaacgtccgcctggaaatggagcggaaccacgaacgctacgcttttctgcgctgggggcagcaggccttcagccgcttcagcgtggtgccgccgggcaccggtatttgccaccaggtgaacctggaataccttggccgggcggtctggagcgaggaggtgaacggccagtggatggcgtggccggatacgctggtgggcaccgactcccataccaccatgattaatggtcttggcgtgctgggctggggcgtgggcgggattgaagcggaagccgctatgctgggccagccggtgtcaatgctgatccccgatgttgtgggctttaagctcagcggcaaactgcgcgaaggcatcaccgccactgacctggtactgacggttacccaaatgctgcgtcagcatggcgtcgtcggcaagtttgttgaattctacggtgacggcctggataccttaccccttgccgacagggcgaccatcgccaatatggcgccggagtatggcgccacctgtggctttttccctatcgatgacgtaacgctcagctatatgcgtctcagcggccgtagcgaagaacaggtcgcgctggtggaagcctacgctaaagcccagggcatgtggcgccagcctggcgatgagccggtctttaccagtaccctggcgctggatatgagcagcgtcgaagcgagcctcgccgggccgaagcgaccgcaggatcgcgtggcgctgggcgatgttccgaaagccttcgccgccagcggcgagctggaggttaaccaccttcagcgtcagcgtcagccggttgactatacgctgaacgggcatcactattcgctaccggatggcgcggtggctattgcagcgattacctcctgcaccaatacctctaaccccagcgtgttgatggccgccggcctgctggcgaaaaaagccgtcgaacgcggcctgcagccgcagccgtgggtgaaagcttccctggccccaggctcgaaagtggtgtcggattatctggcccatgccggcctgacgccttacctcgaccagctcggcttcaatctggtgggatatggttgcaccacctgtatcggtaactccggtccattgcctgaacctatcgaagaagcgatcaaaaaaggcgatctgaccgtcggggcagtgctctccggtaaccgtaacttcgaagggcgtattcatccgctggtgaaaaccaactggctggcctcgccgccgttggtggtcgcctatgcgctggcggggaacatgaatatcgacctcacccgcgagccgttgggacagggcaagaatggcgagccggtctatctgaaaggtatctggccgagcggggaggagattgcccgcgcggtggaacaggtctccaccgagatgttccgcaaagagtacgcggaagtgttttccggcactgaggagtggaaggcgatcaaggtggaggcgtcagatacctacgactggcaggaggactcgacctatattcgcttgtcgccgttctttgacgagatgggcgccgagccgctgccggtagaggatattcgcggcgcgcggatcctcgccatgctgggcgactcagtcaccacggaccacatttcgcctgcggggagcattaaagccgatagtccggcaggccgctatctgcaggagcatggggttgcccggcgcgactttaactcctatggttcccgtcgcggtaaccatgaggtgatgatgcgtggcaccttcgccaatatccgcatccgtaacgaaatggtcccaggggtggaagggggcatgacccgccatctgccggatcctgaaccgatggcgatctacgatgcggcgatgctgtacaaggctgagggcacaccgctggcggtgattgccggtaaggagtatggctcaggttccagccgtgactgggcggcgaaggggccgcgcctgctggggattcgggtagtgatcgccgagtccttcgagcgtatccatcgttccaacctgatcggaatgggcattttgccgctggagttcccgcagggcgtcacccgcaaaacgctacggttgaccggggaagagcggattgatatcagtaatctgcagtcgcttcagcctggcgctacggtgccggtgaccctgactcgcgctgacggctcgcaggaagcgatcccttgtcggtgccgtatcgacacggcgacagaactcacctactaccgcaacgacggcatcctgcactacgttattcgtaatatgctgtga

SEQ ID NO: 723 - DNA, 1227 bp, Klebsiella pneumoniae
ctacagctggggcctgtactttgtcgccggattgctggcgctctcggccctcgtggtcatgattctttctgccagagcgaacaaatcgccgacggcagagcttccacatcctcatactcattaactggagaagtaacgatgcgtcactacaaaattgctgccatccctgcggacggtatcggaccggaagtcatttcggcaggtattgaagtcttgcacgcgctgacgcgccacgatccgcaactgaaatttgatatagagacctttgactgggggtcagactattacaaaaaacatggcgtgatgatgccggaagaagggctgaacatgctgaaagcatttgatgccatttacttcggcgcggtgggggccccggatgtccctgaccacatcacactctggggcctgcggctgcctatttgccagggctttgaccagtacgccaatgtgcgacccaccaaaattctgccgggcgtcacttcaccgctgcgcaaccgcgggcctggcgatcttgactgggtcatcgtgcgcgaaaactccgaaggtgaatattctggtaacggcggccgtacccaccgtggtttacctgaagaagtcggtaccgaagtggcaatctttacccgtgttggggtgacacgcattatgcgctatgccttcagactggcacagtctcgtccacgtaaactgctgaccgtggtgaccaaatccaacgcccagcgccatggtatggtgatgtgggatgagattgccgctgaagtggcgcaggaattcccggatgtgcagtgggacaaaatgttggtcgatgccatgacgcaccgtatgacgttgcatccccagaccctggataccatcgttgccaccaatctgcacgccgatatcctttccgatctggctggcgcgctggcgggtagtctgggcgtagcgccgaccgcgaatattgatcctgaacgccgcttcccttccatgttcgaaccgatccatggttccgcattcgatatcaccggcaaagggattgcgaaccccattgccactttctggaccgcggtacagatgcttgaacatctgggcgaacgccatgccgctgcgctgattatggaaagcattgagtatgtgtgtgaaaaaggcattctgacgccagatgtcggtggctcagccaataccgcggaggtgacacgcgccgtggtgcactacattgacgctaaagctgacattgccgagaccgcataa

SEQ ID NO: 724 - DNA, 1383 bp, Klebsiella pneumoniae
gcactgatgggcgttaagggatactatttattcagaggtgataagacacgatgtggtggcgttatcactgaaggatggagcgaccaccagcattttgacagagatatgtcctgtgaagggcataaagtaacttgtggtaaacatccagggctttaccgtatttgtggtgggcttgatgatgacatacacggcaaaaggattgccggaacactacacagttatagctcctgcccctgtaaatccaaattcatcaattcaaactgggatgatgattacgaacttggtggagaagcaacggtaacgcacactgatctacctcacctcgtcaagatgcctgaacttccagggccgattgagtcagaaccggaacagaacgcccaaacagcaaaaaagaaaacaggtatagatgcaggttttgccgttatcacttatggcggtactacggaagcgtggcaacgtctgttattcaccgaaaacccaccagcaggggcaaaagagctattctctattctgaacggcccggatgaaagatacaaagctggttcgattatgcttctggttgatccagagaaacaggacgacgagcagattgcccacatgaaagccgcgaaagcgcgagttgatgcggcgttagaaccgctgacaatccaggaagctaacttgctgcacaaacactacgcaaccatagctaatttcaccagctacgctgatacaggaattggccttgctgctgatcctgttggaaaatactttgagagtatcgaaaaaatactcagagagattcaagaaacgtataagaatacctacataacgagaggctcgttgataggagaacaattttacgttcaacgtagccagttgtttaaagagcttgaatcaatacttaaagtcagattcctgaataaggctatgaaattcggagagtatacaaaaataaaaaaagcacttggcctatccagcagttctattacccacaaatggaatgaaacggggatcagtgacattgaaggctatgctacccacatcgaacgggcagctaaatacgtaaaagcaatgcgttacactggttatttaggcattggttttagcggactgcattcactaaatgaaataaatgaggcttgttctgttggtcgcgaagctgaatgtaccaagaaaaagtatactgagattggtagctttgctgtaggtacgggggttggtgttgctggtggctatttagcaatacctctttgtatcgctatcggtgttggtactgctggtgtcggagggcttgcttgctctgtgattgctagggctggtttaggctatgtcggtagtagtgcaggtggcgcattcggtgaatggggtggagagcagctgtatgaaactttcggtaattaa

SEQ ID NO: 725 - DNA, 975 bp, Klebsiella pneumoniae
tctccaccgggatcacctacaccttctgattgtgcattcttacagtgcgcttcatgcatcaaaacagggccttgcgccctgttttgctttatggtggtgcatacggttaaggaggagaagatggtgaaaaaaacagtacgcttcggcgagcaggcggcagtgccggccatcgggctgggcacctggtatatgggcgaacatgcggcgcagcgtcagcaggaagtggctgcactgcgggtgggcatcgaccatggactgacggtgatcgatacggcggaaatgtacgccgacggcggggcggaggaagtggtgggccaggcgatccgcggtctgcgcgaccgggtagtgctggtctccaaagtctatccctggcatgccggcaaagcggcgatgcaccgcgcctgtgaaaacagcctgcgccggctgcagaccgactatctggacatgtatctcctgcactggcgcggggatatcccgctgcaggagacggttgaggcgatggagaagctggtggccgagggcaagatccgccgctggggcgtctctaatctggacaccgaggatatgcaggcgctgtggcggacggcggatggcgagcactgtgcaaccaaccaggtgctctaccatctcgcatcgcggggcattgaatacgatctcctgccctggtgccagcagcacagtctgccggtgatggcctactgcccgctggcgcaggcggggcgcttacgcgatggactttttcagcatagcgatatcattaatatggctaacgcgcgggggattacggtagcgcaactgctgctcgcttgggtgattcgtcatccgggagtgctggcgatcccgaaagcggccagtattgagcatgtggtgcagaatgccgcagcgctcgacatcgtccttagtggggaagagctcgcgcagctggaccgcctctatccgccgccgcagcgaaaaacccggctggatatggtttaa

SEQ ID NO: 726 - DNA, 588 bp, Klebsiella pneumoniae
ccaggaccggggccttccccggtccgtcctgaaagacgggatcgatgtatgaagcagtttctggattttttaccgctggtggtcttctttgccttttataagctttacgatatctacgccgccaccacggcgctgattgtggcgaccgccgtcgtgctgatctacagctgggtgcgctaccggaaagtggaaaaaatggcgctgatcaccttcgtgctggtggccgtcttcggcgggttaaccatcttcttccataatgatgagtttattaaatggaaggtgacggtgatctatgccctgttcgccggcgcgctgctgttcagccagtgggtgatgaaaaagccgctgatccagcgcatgctgggtaaagagctgagcctgccgcagcaggtctggtcgcgacttaacctggcctgggcgttgttctttattctctgcgggctggccaatatctatatcgccttctggctgccgcagaatatctgggttaactttaaggtctttggtttaaccgccctcacgctggtctttaccttgctgagcgggatctacatataccgtcatatgccgcaggacgaccaccactaa

SEQ ID NO: 727 - DNA, 1272 bp, Klebsiella pneumoniae
ctcatatttattaacattattgctacttttaatttaccggaagaggtcgatatgtctcagtcaattacgcgtaaccactttgatgaatggatgatgccggtctacgcgccagcggcgtttattccggtgcggggcgccgggtcacggctgtgggatcagcagggcaaagagtatatcgattttgccggcggcatcgccgtgaacgcgctggggcatgcccatccgcgtctggtgcaagccctgaccgaccaggccggcaagttctggcataccggcaacggctacaccaatgagccgatcctgcgtctggccaaaatgcttatcgatgctaccttcgccgaccgggtcttcttctgtaactccggcgccgaggccaatgaggcagcgctcaagctggcgcgtaaatatgcccacgatcgctttggcagcgagaaaagtggcatcgtcgcctttcagaacgctttccacgggcggacgctgttcaccgtctcggcgggcggtcagccggcctattcccgggatttcgccccgctgccgccgcagatccagcatgccgtatttaacgatctcgagtcggcaaaggccttaatcaatgaccagacctgcgcggtgatcgtcgagccggtgcagggcgaagggggcgtggtgccggccagcgtcgagtttttacgcggcctgcgtcagctttgcgaccagcacaacgccctgctgattttcgatgaagtgcagaccggggtcgggcgcaccggcgagctgtatgcctatatgcactacggcgtgacgcccgatgtgctgaccaccgccaaagcgctgggcggtggtttccctattggcgcgctgctggcgacagaggcctgcgccagcgtgatgaccgtcggcacccacggcaccacctacggcggtaacccgctggccggggcggtggccggcgaactgctgtcgatcgtcaacaccccggaagtgctctccggcgtcagacagcgccatcagtggttttgtgaacgcctgcaggcaattaacgcccgctatggcctgttcaaggagatccgcggcctgggactgctgctcggctgcgtgctaaacgacgcctgggccgggaaggcgaaaaccctcagtaacctggcggcggaagagggggtgatgattctgatcgccggcgccaacgtggtgcgtttcgcgccagcgctgaacgtcagtgaagaagaggtgaacagcgggctggatcgcgtcgagcgggcctgcgcgcgtttcgtggcaggagtctcatcatga

SEQ ID NO: 728 - DNA, 660 bp, Klebsiella pneumoniae
ggggtaattataatgatgaaaatgtgtcgctatgcgttaatcacagcactggcgatattcctcgcaggctgtgcggggttgcgggagcagcccgcgccggtagaagaggccaaaccgcagccgcagcagcctgcgcagccgcagcccacggtgccgaccgtaccggcggtgccctctgtcccggcgcagcctgggccgattgagcatcaggatcagcagtcgggtcagccggcgccgcgcgtgcgtcattatgactggaacggcgcggttcagccgctggtggggcagatgctgcaggcgagtggggtcaatgccggcagtattctgctggtcgacagcgtgaacaaccgcaccaacggttcgctgaatgctggagaagccaccactgcgctacgtagtgcgctggccggtaacggcaaatttaccctggtatcggcgcagcagctggcggtcgccaagcagcagctgggcctgtcgccgcaggacagcctcggcagccgcagcaaagccatgggcattgcccgcaacgtgggcgcgcagtatgtgctttactccaatgccaccggcaacgtcaacgcgcctgagctgaaaatgcagctcatgctggtgcaaaccggtgagattatctggtcaagtaaaagtgctgttcaacaacaataa

SEQ ID NO: 729 - DNA, 594 bp, Klebsiella pneumoniae
gaggatgttatgagccgtacctttgcatactgtcgcgtttctaccagcgaacagaccccagaaaaccaaattatggcgattcgccaggctggctacgacattcttgatagtcgtattgtctcggaaattgtttctgggggcgtacaggcgatgaagcgtaaaggctttgccgatatgattacccacaagctggagaaaggagatcagttggtggtcttgaaactggatcgcttaggtcgcgacaacatcgatgtgcagcaaacgatagcgatgcttgtggaaaaagggatcgatattgtgtcgctggatttgccagtgcgtaatcttgccagcacggaaggaaagttgatgcttcaaatgttctcggctttcgcggagttcgaaaagtcccgcatcattgagcgtaccaaagagggcctcgcacgagcgaagaaggaaggtaagaagttaggccgtcctgtggcgactgatacccttaagcgagtgcaggaagctaaagcaggtggattgagtcagtcaaaggcggcgcgtgaattaggattgagcctgccaacgattaagcgtaactggaatactaaaaaggaatcaccgtaa

SEQ ID NO: 730 - DNA, 1071 bp, Klebsiella pneumoniae
ttaatgtctatgaagggagtgacctgtatgaattttagagcattacttgccattgcgttattgacgatgagcagcctggcgtttagcgagacgcgtcttccgcatattgttattttagccaccggcggaacgattgctggttcggcggccagcaatacccaaacaaccggctataaagccggggcgattggggtgcagacgctgattaacgccgtgccggaaatgagtaaaatcgctcacgtcgagggcgagcaggtggccaatattggcagtgagaatatgaccagcgatattattctccagctctcgaagcgggtgaatgcgctattggctcgggacgatgtcgatggcgtggtgatcacccatggcacggacacgctggatgaaaccccgtatttcctcaatctgacggtgaaaagcaacaagccggtggtctttaccgcggcgatgcgcccggcgacggcgatcagcgccgacgggccgatgaacctgctggaagcggtcacggtcgccgccgatcctgatgcccggggacgcggggtaatggtggtgcttaacgaccgcatcggcgcggcgcgctttgtcaccaaaactaatgccacttcgctggataccttccgggcgcccgaggagggctatcttggtgtcgtggtgggcggaaaaccccagttcgagacgcgggtggataaaattcacacgctgcgctcggtgttcgatgtgcgtcagctgaaggttctgccgaaggtggtgattatttatggttaccaggacgatccggagtatatgtacgatgcggcgatcgcccatcatgccgacggtattatctacgccggaaccggggcggggtcggtgtcggtacgtagtgccgccggtatcaaaaaagcgcagcaggcgggcatcgtggtggtgcgagcctcccgtaccggcagcggcgtcgtaccgccggatgacagccagcccgggttggtggccgactccctcaacccggcaaaagcgcgtatactgctgatgaccgcgctgacgcagactaaagatccgcagctgattcagcaatatttccatacctactga

SEQ ID NO: 731 - DNA, 1437 bp, Klebsiella pneumoniae
cggaacgctatctgcgctaatcacgagaaacgggagggccatgcgatgagcactgtcacaataagcgacaccccgtttgtcggcaacgatcgcctgctggtggggattgtgttaagcgttttaaccttctggctgttcgcccagtcggtgattaacgtggtgccggcgatgaaaagcagccttgatatctctcttgagatcttaaccctggccgtcagtctcagcgcgctgttcagcggctgcttcgtggtcgccagcggcggcctggcggacaagtttggccggatgcggatgaccaccctcgggctggggctgagcatcgtcggcagcgccatgctggtggtcgctcagggatcggggctgttcctcgccggccgggtgctgcaggggctgtcggcggcgtgcattatgccggcgacgctggcgctgattaagacctggtatgaggggcgtgcgcggcagcgggcggtcagcttctgggtcatcggctcgtggggcggcagcggtctctgttccttcgttggcggggctatcgccaccggactgggctggcgctggatcttcgtcttctcgatcgccgttgccctgctggcgctgtttttgctgcgcggcacgccggagagccgcagcgccagcgccagccagcataagctggacgtcggcggtctgctgagcctgattgttgcgctggtgctggtgaatctgtttatcagcaagggccacggctggggctggagcagcccgctgtcgttgaccatgctggccggggcgctggcggcggggacgatatttatccgcaacggcatgcgcaaaggcgaggcggcgctgattgattttgcgctgtttcgtaaccgggcctacggtgcggcagtgctgtcgaactttctgctcaatggagcgattggcaccatgatgatcgccagcatctggctgcagcaagggcaccacctgacgccgctggagagcgggatgatgaccctcggctatctggtgaccgtcctggcgatgatccgggtcggcgagaagctgctgcagcgctatggcgcccggctgccgatgatggccggtccggtgttgaccgctatcgccatcgcgctgatatcctgcacctttctcgaaaaggcgctgtatatcggggtggtgttcgccagcaacgtgctgtttggcctcgggctgggctgctacgccacgccatcgacggataccgcggtggccaatgccccggagaacaaaatcggtgtcgcctcggggatctataagatgggcagctcgctgggcggggcgatgggtatcgccgtgacagcgtcacttttcacgctgtttttaccgctgggcatggcccatgccgcccagtatgccctgtggtttaacgccgtcttatgtctgggggcgatggcggtgagcgcgctgctgctgccgcgcgcctctcacagctga

SEQ ID NO: 732 - DNA, 300 bp, Klebsiella pneumoniae
ggcccgcatatgcgggcttttccctttcaggagaatgttatggctgcgaaaaataaagcagtggagccggaagaaacggtcgcacaggacaaccatgcgaccgtggtcgcacaggcagagcgtaaatccgttgtgttccttgggccgcaccaccgttattcccgtggagatatcgcgtgctttgaaggaacgcgcgccgaagaactggttaagcggcgtatcgcggtatggccggaggatgccgaacgtgcgctgaaaccgaagccgggagacagcgattttgatactgacattggatga

SEQ ID NO: 733 - DNA, 294 bp, Klebsiella pneumoniae
tctgtaaatatttcatggcacacagcatggcaaacaacgtaccacacaagctgtcacacaatgattcgtgggcgcacatactacacgaattttagactaaatgattcaacaagttttgtgcgcctgagtctttctgaacttagacgtataacgatgagcaatccggaacagtcaagcacagcgaacgggaaaacgctgtgtgtctattccaacagtatctacacatttaccttcgtcacggagtcgcagcattgcccgtacagcaaaagcttcgacatagtcgatagtaaatga

SEQ ID NO: 734 - DNA, 219 bp, Klebsiella pneumoniae
gggggagatatgagaggtattctattgatttgcggtatgttgctggcttttaatactgcggcaagcaaaatcaccatgagcaaccccgacgagaaggagctaaagggcggaaagcggctttgcacttacgaaaacaacatttacctgtttacgctggtgactcgttctcagacctgtccctattctaagacgtttgacactactgaaaacgaaaagtga

SEQ ID NO: 735 - DNA, 225 bp, Klebsiella pneumoniae
gttctactcttccaggaagaaacattcctgacctcttgccgggataccgtgtaccagtttgctagtgcgccgctcttttatggttctgccttcaagatcggtacctacctaacccatgtacctgtctgttggaaaaggacgctattcctgcctaaactcccaactccccccaaacccccttcttccctcttccccatcctatgtactcgcaagctgatacagtga

SEQ ID NO: 736 - DNA, 294 bp, Klebsiella pneumoniae
cgaatctgtatttcaaaattaaagatgaccggcgcaaagcggcacggagtggtgatgggaaacagagcgaaacttagtgccgcaatgctggccctcatggctgctggtgcatcagctccaacattgatggatcagttcttggatgagaaagaaggaaacagccttacagcgtatcgcgatggcagtcaggggatctggacaatttgccgcggggccacgcgtatagatggtaaacccgtcactcagggtatgaaactgacgcaggccaaatgcgatcaggtaaacgcgatatag

SEQ ID NO: 737 - DNA, 651 bp, Klebsiella pneumoniae
ggaggacgtatggcacatcgagcgctgttactggttgatttgcagaacgacttttgcgccggcggcgcgctggcggttcctgaaggcgacagtaccgtcgacgtagccaatgcgcttatcgactggagcctggcgcgcggcgagcccatcgtcgccagccaggactggcatccggcggatcacggcagtttcgccagccagcaccaggtggaaccctacaccgagggcgagctggacggcctggcgcaaactttctggccggatcactgcgtgcagcacagcgaaggcgcggcgctgcatccgctgctcaagcagcaggcgatcgccgctgtgttccacaaagggcaaaaccggatcatcgacagctatagcgctttctttgacaacggtcaccggcagaaaaccgaactggacggctggctgcgtggtcaggggatcgtggagctgaccgttctcggcctcgccaccgattactgcgttaagttcaccgtgctggatgccctggcgctgggctacgcggtcaacgtcatcaccgacggctgtcgcggcgtaaatctgcagccgcaggacagcagccaggcgtttatggagatggccgccgcgggcgccacgctctataccctcgacgactggcgggaaactcaggcctga

SEQ ID NO: 738 - DNA, 1299 bp, Klebsiella pneumoniae
caggcgcgtattgacgtcagggatgaaatcatcaggcagcagggaaggcatgcgcagttcaacctccgtctgctgactggtgagatcttccagcgagggttcacgcccggctttcagcgcatcgactgcgttctccagcagctccatatacagggagaaaccgatggtttccatctgaccgctctgatcttccccaagcagttccccggccccgcgaatctccagatcgtgggttgccagcgcaaagccggcgccgagatcttccagcgacgcaatggcctcgaggcgcttttgcgcatcggtggtcatcgctttcggatgcggcgtcagcagccaggcataggcctggtgatgcgaacggccaacgcggccgcgcagctggtgcagctgggcgaggccaaaatggtcggcgcgttcgatgatgatggtgttggcggtgggaatgtcgatcccggtttcgatgatggtggtgcacaccagcacattgaagcgttgatgatggaagtcattcatcacccgctccagttcgcgctccctcatctgaccgtgaccgatggcgatccgcgcctccggcaccagctccgccagcttgtcggcggctttctggatgttctcaacgtcattaaacagatagtagacctggccgccgcgcagcgtttcgcgcaggatcgcctcgcgcaccaccagggcgtcatattcgcgaacgaaggtcttcaccgccagacgtcgcgccggcggcgtggcgatgatcgacagatcgcgcatcccgctcatcgccatgttcagcgtccgcgggatcggcgtggcggtgagggtcagaatatcgacatcggcgcgcatcgctttgatgcgctctttatgccgcacgccaaaccggtgctcttcgtcgacgatcagcagcccgagatcgcgcagcttcacctcgctctgcagcagcttgtgggtgccgatcaagatatcgattttgccttccgcggcctgctcgaggatctgcgcctgctctttagcgctgcggaagcgggagagcatttcgatgcgtaccggccagttggcgaaacgatcgcggaaattgtcatagtgctgctgagccagcagggtggtcggcaccagcaccgccacctgcttgtggttctccacggcgaggaaggcggcgcgcatggccacttcggtcttgccgaagcccacatcgccgcataccaggcggtccatggccagcggctggcacatatcgctgaggacggcgttgatcgcctgcgcctgatccggcgtggtttcaaatgggaagccgtcgcagaatag

SEQ ID NO: 739 - DNA, 246 bp, Klebsiella pneumoniae
ttcaagctctttaaacaactggctacgttgaacgtaaaattgttctcctatcaacgagcctctcgttatgtaggtattcttatacgtttcttgaatctctctgagtattttttcgatactctcaaagtattttccaacaggatcagcagcaaggccaattcctgtatcagcgtagctggtgaaattagctatggttgcgtagtgtttgtgcagcaagttagcttcctggattgtcagcggttctaa

SEQ ID NO: 740 - DNA, 630 bp, Klebsiella pneumoniae
gagggaagtatgagccagtttttttatatccatccggataacccgcaggcgcggttgattaaccaggcggtggagattgtgcgtaagggcggggtaatcgtttatcctaccgactccggctacgcgctgggctgcaaaattgaagacaagggggcgatggagcggatctgccgcattcgtcagctgccggacggccacaactttaccctgatgtgccgcgatctgtccgagctgtcaacctacgcttttgtggataatgtggcgtttcgcctgatgaaaaacaacacgccgggcaactatacctttatccttaaggggaccaaagaggtgccgcgtcggctgctgcaggagaagcgtaaaaccatcggcatgcgcgtcccgtctaaccccatcgctcaggcgttgctcgagaccttaggcgagccgatgctctccacgtcgctgatgctgcccggcagcgactttaccgaatccgacccggaagagatcaaagatcgtctggagaaagtggtggacctcatcattcacggcggtttccttgggcagcagccgaccacggttatcgatctcactgaagacaccccggtggtgctgcgcgaaggcgtcggcgacgtgaggccgtttctctaa

SEQ ID NO: 741 - DNA, 1236 bp, Klebsiella pneumoniae
ctgaaaatctttgccgtcaattttggcatgggcgtagtctccggattagtcatgtcctatcagttcggcaccaactggagcggattttcccagttcgctggcagtattaccggcccgctgctgctgtacgaagtgctgaccgccttcttccttgaagcgggattcctcggggtgatgctgtttggctggaataaagtgccgccagcgctgcatttttttaccacctgcatggtggcgcttggcacgttggtttctaccttctggatccttgcctccaatagctggatgcagacgccgcagggttttatcatcgaaaatggccatctcatcccgcaggactggctggcgattatctttaacccctcttttccgtatcgcttgttccatatggcgatagccgcgtttctcagtagcgccatgttcgtcggggcgtctgccgcgtggcatcttctgcgcggcaacgactcgccggccatccgcaaaatgctgtcgatggcgatgtggatggcgctgctggtggcgccgatccaggcggtggtgggggatatgcatggtcttaacacccttgagcatcagccggcgaagatcgcggccatcgaagggcactgggaaaatcgccccggcgaggccacgccgctgctgctgtttggcctgccggacatggagcaggagcggacccgctatggtcttgagatccccgctctcggtagcctgatccttacccacagcctgcataagcaggtgccggccctgaaagacttcccgaaagaggaccgaccctattcgcccgccgtcttctggtcgtttcgcatcatggtcgggatgggcgtgttgatgatcgccttagggatctgcagcgcctggctgcgctatcggcggcggctgtaccactcgcgtcccttccagtggtttgcgctctgtatggggcccgccggtcttattgccctggtcgccgggtgggtgaccaccgagatgggccgccagccgtgggtgatatacgggttgttgcgcacgcgggatgcggtgtcgttgcacagcaccctgcagatggccatcagcctgctggtatttatcgtggtttactgcgccgtgtttggcgtggggtattactatattttccggcttatcaaaaaagggccgcagccggtgacggagctgacctcgcaaaccgcaggcaccccggcgcgtccgctctcagcggctgagccggtgcgtgatgaggagaacgcatcatga

SEQ ID NO: 742 - DNA, 192 bp, Klebsiella pneumoniae
accgtcttcatccggcaggccgagatcgacgatggcgatatccgggagatgttcgcccagatagtagtccgcttccctggcatcttccgccgcatcgacctgatggcccagctcctgcagctgaactttgaggtggtgacgcagcagggcattatcctcaaccacgagtacgcgcatggctgttctccctag

SEQ ID NO: 743 - DNA, 1029 bp, Klebsiella pneumoniae
gggggcttcatgagcattgacgcaatgcgatgggccaaaaaagtcaagacagggaagtcctctgcaaaagctgttctgacctggatggccgacatgtgcggagctgatctctgtgcttttccatccattcctgcgctggcagaagcaactgagctggataagaaaacggtccagtcgagcctgcagtatctggtttcgatcgggcttattgaagatacaggtgaacggcgtggaaagactaaacaaatcccggtttaccgacttcttggtgtggaagaaagcgttgctgaaattgaacacacccaaaaacgggaacattaccaaaaacgggatcgtttaaacacacccgaaaacggggttgttacagcagaaaaggcgcccgaaaacgggactgtttcctgtacgcaaaacaaccaaacaatcccgttttttccgtcaaacgatcccaaaaacgggatccggaatctaccagaggaaccaaaagatataacccccacacatagggatctggtcgaaccagttgtgccggcctatccgaatcaaccgggaatagttcctggtgaaacacaatcattcggaaaatttgcgatgtatttcgggtggaaaccttccgaggatttttcccggctggcaacgatttggggaatgccattaagaccggggataaatcttgctgccgagttgagcagtttcatcgcgtactggcaggctgaaggcagggtgtttcaccaggtccagtgggagcaaaaactagcaagacatcttaaccgtgcggaagtccgccagaaaaaaccagtgaacgggggtatcgatcatgtgggagtacgagcagagccagcagcatccagagctgttcaacagattcgagccgcccgtgagcaacggttgcgagttgcaagatcagatggccgtagaaacggcatggcgcctatgggaagtaatgggcgaaatcttttcgaaccggtggatcctgaagaacggagaggaaccatcagaactctggatcgctcagattggatcgatgagtga

SEQ ID NO: 744 - DNA, 576 bp, Klebsiella pneumoniae
tatgtgctcataacaaaaaataagcctgcatttatcatggaaaaaaacgcttctctgcctttcggcagtttcaactcattggcattgtttacaggtctgtgtctgggagcctcgccggcagcaggcatcgcagcggaaaattcggtcaaaaatagtgaagagacgctggtagtggaagccgctccgccttcactctactcccccggcgcttccgccgatcccaagttcaataaaccgctggtcgataccacccgcaccatcaccgtgatcccggaacaggtgattaaagatcagggcgtcaccaacctgactgacgccctcaaaaacgttcccggcgtgggggcgttttatgccggggagaatggcagctcaaccaccggggatgccatctttatgcgcggcgtggatacctctaacagcatctatgtggacggcattcgcgacatcggcagcgtgacgcgcgataccttcaatacccagcaggtggaagtcatcaaagggcccgccggcacggactatggccgcagcgcgccctccggctcgatgcaatatgatcagcaagcagccgcgccttga

SEQ ID NO: 745 - DNA, 960 bp, Klebsiella pneumoniae
tttatcgtcatcgtcggcctggctgacgacacaagaggaattgctgaaatgtattatggatttgacattggcggcagcaagatagcgctgggcgtatttaatcaggagcggcgactgcagtgggaaaaacgcgtcgctacgccgaaaagtagttatgaggattttctccaggcggtagaggcgctggtccgcgaggccgatgagcgcttcgaccagcagggttcggtcgggatcggtattccgggaatgccggaaacggcggacggcacgctgtatgccgctaacgtgccagccgccagcggccggccgctgcgcgctgacctcagcgcgcggttggggcgcgatgtgcgtctcgataatgacgccaactgtttcgcgctgtcggaagcgtgggacgatgagtttacgcaatacccgctggtgatgggattgatcctcggcaccggcgtgggcggcggcctggtgttgaacggtaaatcgattaccggacatagctatatcaccggcgagttcggtcatattcgcctgccggtggatgccctggaggtggttgggcgcgattttccgctgctgcgctgcggctgcggccagctgggctgtattgaaaattatctctccggtcgcggtttcgcctggctgtacgaacatttttatcagcaaccgctctcctcgccggagattgtggcgcagtggcagcagcacgatccgcgcgcgcaggcgcacgttgagcgctatctcgatctgctggcggtgtgtctggggaatatactgaccattgtcgacccggatttgctggtgctcggcggtggattatctaactttacggccattagcgaagggctggcgcaacgattgccgcgccatcttctgccggtcgccagggttccgcgcattgagcgcgcgcgccacggcgatgccgggggaatgcgcggtgcggccttccttcacctgacccattaa

SEQ ID NO: 746 - DNA, 330 bp, Klebsiella pneumoniae
tctggagtcattgtgctggacctgccacagcaagaaaacagcaacagagagaacccgatgaagagtttcaaaattgaatacgttgatggcgttttgaccgttctggagacggatggtcagtcacgaatgaatgaagccgtgcatggcatccattttgagcatgtccagggcggccgcccactgctgaaactgacgattgcgcatgatattgcaccggcaccggctgctgagtcggctcaggaacctttagtgggtgagctggtacaggagcaacaatctccgcttcccggcggccgtcgttcccgccatcgtaggggaggtaagcaatga

SEQ ID NO: 747 - DNA, 747 bp, Klebsiella pneumoniae
ggtctggtcatgacgtctacagctatcccatcttcccgcgctgtcacatcctctcccgttgtggttgcgctcgactatgataatcgcgataaagcgctggcatttgtcgaccgcatcgacccgcgcgactgccgcctgaaggtgggcaaagagatgttcaccctgctgggcccgcagtttgtccgcgatctgcatcagcgtgggtttgaggtgttcctggaccttaagtttcacgatattcccaacaccaccgcccgcgcggtggccgcagcggctgagctgggcgtatggatggtgaatgtccatgcttccggcggcgcgcgaatgatgaccgccgcgcgcgaagcgctgctgccgtttggcaaagatgcgccgttgctgatcgctgtcacggtgctcaccagcatggagtccagcgatctacaggatctgggcattaccttatctccggctgactacgcggcgaagctggcggcgctgacccaacgctgcggccttgatggggtggtgtgttcagcccaggaggcggtgcgctttaagcatgagctggggcaggcgtttaagctggtgaccccggggattcgtccgcagggcagcgacgctggcgatcagcggcgaattatgactcctgagcaggctcaggaagctggggtagactatatggtgattggtcgcccggttactcagtcggcggatccagccgcgacgctgcgggcgatcaacgattctctgcgcaagggggcataa

SEQ ID NO: 748 - DNA, 408 bp, Klebsiella pneumoniae
agagttgccatgctttttcattccaccgctgcggcgaaaatgatactttatagggctgaaagcgggttttttcgcgcaacccacataacgggaagtcatgtgaaatatttactcattttcttactggtgttagcaatcttggtcatttcagtgacgctgggggcgcagaatgaccaacaggtcactttcaactatttactcgctcagggtgaattccgcatatcgacgttgctggcggtgctgttacccgcgggctttgccattggctggctgatctgcggcctgttctggttgcgggtgcgtgtctcattggcgcgcgcggagcggaaaattaagcgtcttgagcatcagattgcccccgtcagcccggcggctgtcgacgcaggcgtgcctgcggtgaaggaataa

SEQ ID NO: 749 - DNA, 1341 bp, Klebsiella pneumoniae
caaccctacatcactatggagcatcccgtcatgaaaaacgacctcgaaaagaaggtgatgcgtaaggttaccctgcgcattattcctttcatcatgctgctgtacttcattgccttccttgaccgcgtcaacattggctttgccgccctgaccatgaatcaggatctgggattttcacccaccgtttttggtctgggcgctggaatttttttcctgggttattttctgtttgaggtaccgtcaaacttaattcttcataaagtgggcgcccgcatctggatcgcccgcgtcatgattacctggggattcgtctctggctgcatggcttttgtgcagggcacgacgagcttctacattctgcgttttctgctcggcgtggcggaagccggtttcttcccggggatcattctctatctcagctactggtttcctgccgccaggcgtgcgcaggtcactgccatctttatggccgcagctcccctgtcgacagcactgggatcgccggtttcggccgcactgctggagatgcatggcttccttggctacgccggctggcagtggatgtttgtactggaagctttgccggcgctggtgctcggtgttgtggttctgttcttcctgacggatcgtccggccaaggccaaatggctgactgatcaagagcgtgcctggctggaaaacgccatgcaagacgaggagcgggcacgggcggcaaaacagagccattccagcgcatggcgagggctagcggatatacgcgtcctggcgctggcgctggtctatttcggtacctcagccgggctgtatacgcttggcatctggtccccgcaaatcattcgcagtttcggtgcttcctcgctggagattggtttcctgaacgcctttccggcggtgatcggcgtcatcgccatgatcctctgggcgcgtcattccgatcgaaccaaagagcgcagctggcacgtcattggcgcctgcctgctggcggttgccgggctgatatacgccggtaatgtcagcacattgtttaccgtaatggtcgccttaacgctggtcaccgtggggattagcgcatcaaaaccccctttgtggagcatgccaaccctgttcctcagcggcccggctgcggccgctggcattgccgctatcaactccatcggcaacctcggcggtttcgttggcccgatgatgattggcgtgatccgcgagcaaaccggtagctacagctggggcctgtactttgtcgccggattgctggcgctctcggccctcgtggtcatgattctttctgccagagcgaacaaatcgccgacggcagagcttccacatcctcatactcattaa

SEQ ID NO: 750 - DNA, 744 bp, Klebsiella pneumoniae
atttcatacatatatgaattatttatttttaaaccgacagcgctggccccggcgatcgtttatttttataatggcctttcaccaaaccaacataggtacaacggcaccatgacaactgacgttcaaagttgcgccaaaaaaagccgtggccgaccgaaggtgttcgacagggatgcggcgctggacaaagccatgacactcttctggcagcacggctatgaggcgacctcgctcgccgatctggtcgaggcgacaggagcaaaagcccccaccctgtatgcggaatttgtgaataaagaaggcctattccgcgcagtgttggatcgttacatttcgcgctttgccgcgaagcacgaagccgtgctgtttgccgagggaaaatccgtcgatcgcgcgttgcgtgactacttcacggcggtcgccacctgctttaccagcaaagagacgccggccggctgctttatcatcaatacctccgccgcgctggccgcctcctcgacggatatcgccaataccatcaaatcccgccatgcgatgcaggagcaggcgctaacccagtttctgcagcagcggcaggcgcagggcgaactgcccgcgggccgcgatgtcgcgcagctggcgcaatttcttaactgcgttctgcaggggatgtcgattagcgcccgggaaggcgcggatttcgacaagctgatgcaaatcaccgataccactctccgtctctggccgcaggtcctcgggtcctga

SEQ ID NO: 751 - DNA, 234 bp, Klebsiella pneumoniae
ggagtacacatgagcatgctttttctcgccattccgctgacgctgtttgtgctgtttgttctgccggtctggctgtggctgcactacaacaatcgcggcgccaacggcagtctgacgcaaaatgagcagcaacggctgctgcagttgaccgatgacgcgaagcggatgcgcgaacgcattcaggcgctggaagcgatcctggacgccgaacatccgaactggagggacaaataa

SEQ ID NO: 752 - DNA, 1863 bp, Klebsiella pneumoniae
ggagaagacatgcgaaccctttggcgactgattgccagcttttttaaatggacgtggcggatactcaactttattcgcaaactggccctcaatgcgatcttcctggtgctggtgctggtgtgtatcggcatctggagccagttcagcagcaccaccagcgaacatgccgcgcgcggcgcgctgttgctggatattaccggcgtggtggtggataagccatccgccagcagcaagctcggcgtgattggccgccaactgtttggcgccagctcggaccgtctgcaggagaattccctgttcgatatcgtgcagaccattcgccaggcgaaggatgaccgcaatatcaccggtattgtgctggatttgaaaaacttcgtcggcggcgaccagccatccatgcagtacatcggcaaagcgctgcgcgaattccgcgatagcggcaaaccggtgtatgccgtcggcagcagctacagccagggccagtactacctggcgagcttcgccaacaaaatctggctctcgccgcagggcgaggtagacctgcacggcttcgctaccaacgggctatattacaaatcgctgctggataagctgaaggtctccacccatgtcttccgcgtcggcacctataaatccgccgtcgagccattcatccgcgatgatatgtcccctgccgcccgcgaagcggatagccgctggattggcgaactgtggcagaactacctcaacaccattgccgccaaccgccagatcaccgcccagcagctcttcccgggcgcccagggcattatcgatggcctgcgtaaggtgggcggcgatacggcgaaatatgcgctggacaataagctggtggatgagctggcgacctccacggaagtggaaaaggcgctgaccaaacagtttggctggagcaaagcggataacaattaccgggcaatcagctattacgactacaacgtgaagacgccgtctgaccagggttccgccatcgcggtaatcttcgccaacggcgccatcatggacggtgaagagaccccgggcaacgtcggcggcgacaccaccgcagcgcaaattcgcgatgcgcgcctcgatccgaaaattaaggccatcgttctgcgcgtaaacagcccgggcggcagcgtaaccgcttcggaaatcattcgtgaagagctggcggcagccaaagccgccggtaaaccggtagtggtctcgatgggcggcatggcggcgtccggcggctactggatctccaccccagcggattacatcgtggcgaacccaagcaccctcaccggctccattggcatctttggggtgatcaacaccgtggaaaataccctcgggtcgattggcgtccacaccgacggcgtcgccacgtcgccgctggcggatgtctccagcaccaaagcgctgccgccggaagtgcagcagctgatgcagttgagcattgagaatggctatcagcgctttatcaccctggtggctaacgcccgcaagagcacgccggagaaaatcgaccagatcgcccagggccacgtctggaccggggaagatgccaaagccaacggcctggtcgacagcctcggcgacttcgacgacgcggtagccaaagccgccgagctggcgaagctgaaaacctggcacctcaactactatcaggaagagccgaccttcttctcgatggtgctggatagcctgaccggctcgatacgcgcctcgctgccggcggccattcaggcctggctgcctgcgccggtcgccgcggcggccgagacggtgaaagcggagagcgacaagctggcggcgtttaacgacccgcagaatcgctatgccttctgcctgacctgcgctaacatccgttaa

SEQ ID NO: 753 - DNA, 1224 bp, Klebsiella pneumoniae
gccacccgcataaactcgaaagtgtcgtgcaaacacaacacaggaataacaaaaatgacacatccgttgctagaagcattgcaggttaacgaggcgcaatttatcgctctgcgtcgtcggttccaccagcagccggagatcggctttgaagagcaccagaccagcagcgaggtcgcccgactgcttggcgagtggggatacgaggttcaccgcggcctggcgggcaccggagtggtgggcacgctgcgcgtcggcgaggggaaaaaacgccttggcctgcgggcggatatggatgccctgccgatgcaggagcggagcggtaagccgtgggcaagccaggttgaagggcgctttcacggctgcggccatgacgggcacaccaccacgctgctctacgcagctgaatatctggcgcgcacccgccagtttaccggcacgctgcagctgattttccagcccgcggaagagttgctgtacggcgggcgggtaatggtcgaggacggtctatttgaccagtttccctgcgacgccatcttcggcctgcacaatatgccgggtcagccgttgggcaagatcggcctgcgcgacggggcgatgatggcctcctccgatacgctgcatattgaagtgaagggcgttggcggccacggcgcggtgccggagcatacggtggatgccacgctggtggcctgccatattaccctcgcgctacagtccatggtctcgcgcaatatcaccccgtttgaaccggcggtggtgaccgtcggcagcatccaggccggtcatgcgcccaatatcattaacgatcacgtgctgatgaagctcacggtgcgcaccctcaatgagcaggtgcgcgagaccgtgctgcagcggatccatgatatcgccgtggcccaggcggagagcttcaatgccaccgccacgctgacccacgtcaacggcagcccggtgttgcgtaacgatccggcgacgaacgccatggtgcgggaggtggcgacagcgctgtttggcgcagagcaggtgggcgaggtgaagccgtttatgggcagtgaagattttgccttcatgctggagcagcacccccacggcagttatttcactatcggcgctggcgacgaacctgaccgctgcatggtgcataacccggggtatgacttcaacgacgcgctgttgctgaccggcgcggcgctgtggtgcggcctgacggaacgctatctgcgctaa

SEQ ID NO: 754 - DNA, 1023 bp, Klebsiella pneumoniae
ggagaacgcatcatgagcatcgatatctcggtgatttggtttgtcatcattgtcttcgccacgctgatgtatatcgtgatggatggtttcgatttaggtattgggatgctgttcagcgtggtgcatgatggcgaagagcgcgatgtgatggtcaacagcgtcgcccccgtctgggatggtaacgaaacctggctggtgctcggcggggcagggctgttcggcgcctttccgctggcctatgcggtgatcaccgatgcgctggttatcccgctgacggcgatgctcatcggcctgatttttcgcggcgtggcctttgaatttcgttttaaagcggttccctcgcatcgcatcttctgggactatgcctttgccggcggctcgctgttggcgaccttcagccaggggattgtcgtcggcgcgtttatcaacggctttgcggtggctgaccgccgcttcgccggttcgacgctggactggcttacccctttcaatctgttctgcggtctggggctggtggtggcctatctgctgctgggcaccacgtggttgattatgaaaagcgaaggcgcgctgcagcagcggatgcgcgagctgacccgcaaggtactgctggcgctgatggtggtgatcgcggtggtcagcgtctggacgccgttgggctggcgctacgtggcggaacgctggtttacgctgcccaatttcttctggttcgtgccggtgccgattctggtgttggctctgagcctgtggatctggcgcctgagcgcgcgccccgccagccatgcccgcccatttatcctgacgctgggcctgattttcctcggcttcagcgggctggggatcagcgtctggccgaacattatcccaccgcatatctctctgtgggatgccgctgcgccgccgtccagccaggtatttatgctgccgggcgcgctgctcattatcccggtgatcctgatgtataccgcctggagctactacgtctttcgcggcaaagtctccggcagcgagggctatcactga

SEQ ID NO: 755 - DNA, 1203 bp, Klebsiella pneumoniae
ggagcaataatgagcactttactgaacccctacttcggcgaattcggcggcatgtatgtgccgcagatcctgatgcccgccctgcgccagctggaagaagcctttgtcagcgcgcagaaggacccggcctttcaggcggaattcaccgacctgctgaaaaactacgccggtcgtccgacggccctgaccaaatgccggaatctgaccgaaggcacccgcaccaccctgtacctgaaacgcgaagatctgctgcacggcggcgcgcacaaaaccaaccaggtgctgggccaggctctgctggccaaacggatgggcaaaaccgaaattatcgccgagaccggcgccggccagcacggcgtcgcctcagcgctggccagcgccctgctcggcctgaaatgccgtatctacatgggcgccaaggacgtcgagcgccagtcgccgaacgtcttccgtatgcgcctgatgggcgccgaggtgatcccggtgcacagcggctccgccacgctgaaagatgcctgtaacgaggcgctgcgcgactggtccggcagctacgaaaaggcgcactatatgctgggcaccgccgccggtccgcacccgttcccgacgattgtgcgtgaattccagcgcatgattggcgaagagaccaaagcgcagatccttgaaaaagagggccgcctgccggacgcggtgatcgcctgcgtcggcggcggatcaaacgccatcggcatgttcgctgattttatcgaggaaaccaacgtcggcctgatcggcgtggagcccgccggacacggtatcgagagcggcgagcacggcgcgccgctgaagcatggccgcgttgggatctacttcggtatgaagtcgccgatgatgcagaccgccgacggccagatcgaagagtcttactccatttccgccgggctggacttcccgtccgttgggccgcagcacgcgtttctgaacagcaccggtcgcgctgactatgtgtcgatcactgacgacgaagcgctggacgcgtttaaagcgctttcccgccacgaagggattatcccggcgctggagtcctctcacgctctggcccacgcgctgaagatgatgcgcgagaacccggaaaaagagcagctgctggtggttaatctctccggccgcggcgacaaagacattttcaccgtacatgacatcctgaaagcgcgaggggaaatctga

SEQ ID NO: 756 - DNA, 912 bp, Klebsiella pneumoniae
ggaagctcaatgagcgagaaactgcaaaaagtgctggcccgcgccggccacggctcccgccgtgaaattgaagcgaaaatcgaagctggccgcgtcagcgtcgacggcaaaatcgccaccctcggcgatcgtgtggaaattgtccctggtttaaaaattcgtatcgatggtcatctgatctcggtgaaagagtctgccgagcagatctgccgcgtgctggcttactataagccggaaggcgagctgtgcacccgtaacgatccggaaggacgcccgacggtgtttgatcgtctgcctaaactgcgcggcgcgcgctggattgccgttggtcgtctggacgtgaatacctgcggcctgctgctgttcaccaccgatggcgaactggccaaccgcctgatgcacccgagccgtgaagtcgagcgtgagtacgccgttcgcgttttcggccagttggatgatgataagctgcgccagctgtcgcgcggcgtacagttagaagatggtccggcagcgtttaaaaccatcaaattcaccggcggcgaagggattaaccagtggtataacgttaccctgaccgaagggcgtaaccgcgaagtgcgtcgcctgtgggaagcggtcggcgtgcaggtcagccgtctgatccgcgtgcgctacggcgatattctgctgccgaaaggcctgccgcgcggcggctataccgagctggacctggcgcagaccaactacctgcgcgagctggtggagctcacgccggaaaccagctctaaggttgccgtcgagaaagaccgtcggcggttgaaagccaatcagatccgtcgggcggtgaagcgtcacagccagaccagcgctaatccgcgccagggtaacaacagcaaccgtcgttccagtactcgcaataagactaacggttaa

SEQ ID NO: 757 - DNA, 1005 bp, Klebsiella pneumoniae
ggcgggtcaatggctgcaaagtctgagttcttttccagttttgtcgatatagaaaagcgtccgcgcttctcctctgaatgtgaaatcagtcctgaaaacttcaaagctctggttggtgagtaccgattgggtgaagatgtcatttgccaggtgaaaggtcacaaggggatttgccatcaaaagcatagaagcggctggttaggggtaaccagtgatggatttgaagttctaatcggcggtcactgtgcccgtaactatttcaaagcggataaatcatttgcactcgagcggaagcgtgttcgaaaagaaattgatagaaagattgccctgtataagctggaagagtaccgaaaaaataaaatgagcatcaatgatgagttgtcccagttgcgacaagaactcattgataccagagtaaaactcgaccaggttcacaagcattttccaaatgcggtccttagctttatcgagagcgctcagaaaaccaaaaactgggagctgaaaatcgatgtgctggacggattcgccgatgatggcgaagctagatgggtatcaggttcattgggcaaacggaagacgctgccatatagctatgaagtctttggattgataaacaatgtgaaaaccctttctgcaacttttgacgaggcatgtcaggtcaacccagacgacatcaaaacaccaaagttgaagagaataatcgaaattcttaatgaaaaagaagagtttaagaaaactagctcagctctacacagagatgtttttgccttcgttgatccacggaatttggaaccgttaatctacacatgtgatgactacgaagaggagttcctcgtagcgaaagcaatcatggcggtcacaggtgcgaaagtgtcgagtgaggggcatataaatcttcgactgaggcggattaaggaacgtatagagaagcaatttgacggaaaacttatcaggaaaaaccagatttccgaaaggttccagcgtcgaaatgcattcgtgggttaa

SEQ ID NO: 758 - DNA, 894 bp, Klebsiella pneumoniae
gattgcacaatgataaataaaatttttgctctcccggtgaatgaaaccatttctcccgtgatctcccgtcgccagctggacgacctggagctgattgtcatcgaccatccgcaggtgaaagcctctgtggcgctgcagggggcgcacctgctctcctggaaacccgccggtgaagaagaagttctgtggctgagcaacaacaccccgtttaaacagggcgtcgccctgcgcggcggcgtgccgatttgctggccctggtttggtccttctgcgcagcaaggtctgccgtcgcacggctttgcccgcaatctgccatggaccctggaaggtcatgacgaagacgacagcggcgtaatgttgacctttgcgctccagcacagcgctgaaaccatgaagctctggccgcacgagttcaccctctatgcccgctttaagctgggtaagacctgtgaaatcgagctggaagcccacggtgaattcgagaccacctctgccctgcacagctatttcaacgtcggcgatatcgcggcggtgaaggtgagcggtcttggcgagcgctatatcgataaagtgaacaatgccgaagaaggcgttctgagcaacggcgtgcagaccttcccggaccgcaccgatcgcgtctatctcaacgccgacagctgcagcgtgatccatgacgacgcgctaaaccgcactatcgacgtggtgcatcatcatcagcacaatgtggtggcctggaacccgggcccggcgctgtccgtcagcatgggcgatatgccggacgatggctacaaaaccttcgtttgcgtcgaaacctgctgcgtaacccagccgcagaaagccagcgaagagacgccctctcgcctggcgcaaaccatcagagtgaaaaaacgctaa

SEQ ID NO: 759 - DNA, 456 bp, Klebsiella pneumoniae
ctgccgacaatctgtgttgatgcgtttttttcaggtgtaattatgagtgaaatcaacccgtgcatgacgtgcggtgcctgttgtgcgtattttcgagtctctttctactgggcggaagccgacgacgcgggcggcctggtgccctccgcgctgaccgaaccgctgacccctttcctgcgctgcatgagcggcaccaatcagcgccagagccgctgcgcggccctgtctggcgatatcggcgatgccgttcactgcactatttatgaaaaccggccttcgccgtgtcgcgaattcgccatgtccggggaaaatggcgaggaaaacgatgcctgcaaccgggcgcgggcgcgctacggcctgccaccattgcggcctctttacaaagatatacctgccctgaccggcgcagagagtgctacgacggaacgatttgcggtacaatcgccggctagttaa

SEQ ID NO: 760 - DNA, 1449 bp, Klebsiella pneumoniae
tgccagaaaatgttccaccgcgcccccttattgctgaaatggataaaccgaaccgagctgcaggatctgggtcaaccgatccagcgcgtcgcgcccttcccgcagcagctgcgggtcggcgaggtcggcctgggtgagacgatcgcgatagtagcgatccacccagtcattgagggtgacaaacagcgtatcgttcatcaggacgtgcggattgaccgcctgatactcctcggccgtcaacaccacccgcaggcgcaggcacgccggaccgccgccgttggccatgctctcgcgcagatcgaacacccgcaggtcggcgatagggttatccccggccagcagctcattgaggtattcccacacgccggcatgctcctgcgcttcctgaggcaggataagcgccatgctgccatccgcccggctcaccagctggctgttgaacagataggtggcaaccgcctctgccaccgagacccggctggcgggaaccaccagcggcgtaaaacccggcacccgctgcgccagctgctggagaagcgcggtctggtcggcaaaggcctgctcatggcagaacaggacctgacggttgctcaccgcgatgacgtcgttatgaaaaacccccgtgtcgatcgccgccggatgctggcggacgaagatcagctggcggggattgacctgattgaggcgcgctaccgcctggctggcctcaagggtttgccgcgccggatagcgacgcggcgcctcctcgctcccccggcggcggccatagacaaagagctggacgccgggagcgccatactcgccgccgagacgattatggttcgccgccccttcgtcgccaaaccaggccgaggcgggcagcgccgggtggatagcaaatcgcgtgcggtcggggaaaatcgcctgcagcagcgcctctgtagtcggtgcttcgctggcgcggtggaatttatcctgcagattcgccaccgtcagatgcaccaggccatccagcgaatcggcggagggacacaccgtcgccgcgttcgccacccacatcgccgaggccgaactcaccgccgacagcagatccggctcctgctgcgccacccgggccaccacctgctcatcgctgccgctaaagcccagctggcgcagaagcggcacgttgggacgctcctgcggcgggatcaccgcctgcgggtagccagcgtcggcgagggctttcatttttttcagcccctgctttgccgccagctgcgggttagacacccgatagcgatgccgggtggaagcctcattgccaaaggagagcccggcgtagtgatgggtcagcccgggcagaccgtcaaagttgacttcgcgggcggtcatgacgcctccccggccagaaagtcgagacccgggctcaggctggcgggcagcgtcagggttggcgattcaaggctggccatcggccaggcgcaataa

SEQ ID NO: 761 - DNA, 417 bp, Klebsiella pneumoniae
cgcactgaaattctgataccgcgcggtacgggcagcgtcccgtaccgcctgataaatgagggaaatattatgtttgatctggacaacatcgacgcggtagagaccccggaaaatgacctcgaagaggtagtgatggggctgattatcaactccggacaagcccgcagcctggcctatggcgcgctgaagcaggcgaagcagggcgactttgccgcagcgaaagcgatgatggagcagtcgcgccaggcgctgagcgaggcgcatcgcgtgcagacccagcttatcgaaagcgacgagggcgaagggaaaatgaaggtcagcctggtgctggtgcatgcccaggaccatctgatgacctccatgctggctcgtgagctggtggccgaattgattgagctgcacgagaaggtacaatag

SEQ ID NO: 762 - DNA, 762 bp, Klebsiella pneumoniae
cgtaaggaaattctaatgaaaaagcgtgttcttgccctttgcctggccagtttcttctccgttaacgcctttgctctggttccccccgggaacgatgtcaccaccaagcccgatctctactatctgaccaatgcccaggccatcgacagcctggcgctgttgccaccaccgccggcggtgggcagtatcgcatttttaaacgatcaggcgatgtatgagcaaggacgtctgctgcgcaataccgagcgcgggaagctggcggcagaggatgccaacctcagcgcgggcggcgtggccaacgccttctccagcgcctttggttcgccgattaccgagaaagacgcgccgcagcttcacaaactgctgaccaatatgattgaagacgccggcgacctggcgacccgcagcgcgaaagagaaatacatgcgcattcgcccgtttgcgttctatggcgtctccacctgcaacaccaccgaacaggacaagctggcgaaaaacggctcttacccgtccgggcatacctctatcggctgggccaccgccctggtgctggcggagatcaacccgcagcggcaaaacgaaattttgaagcgcggctatgagctcggcgagagccgggtgatctgcggctatcactggcagagcgatgtcgatgcggcgcgcatcgtcggctccgcggtggtcgctacgctgcacaccaacccggccttccagcagcagttgcagaaagccaaagatgaattcgcgaaaaggcagaagtaa

SEQ ID NO: 763 - DNA, 522 bp, Klebsiella pneumoniae
cacgaggaaatcacgatgaatcacgttgaacattaccatgactggctacgagatgcgcatgccatggaaaaacaggcagagtccatgctggaatcaatggctggccgtatcgataattatccggatctccgtgccagaatcgaacagcatgttaacgagaccaaacggcaaattaccgtgctggaagagatcctcgaccgcaatgagatttcgcgctcggtgattaaagattcgatgagtaaaatggcggctctcggccagtccatcggcgggatgtttccttccgatgaaatcgtcaaaggctcgatcagcgggtacgttttcgagcagtttgaaatcgcctgctatacctctctgctggcggccgctgaaaaagcgggcgataccgcctccatcccagccattgaagccatcctggcggaagagcgggaaatggccgactggctgattaaacatattcctcagaccacggagcagtttctcctgcgttcagatgctgacggcgtagaagcgaaaaaataa

SEQ ID NO: 764 - DNA, 870 bp, Klebsiella pneumoniae
ttcacacccttctctcgcctcccgctgtgcggggggcagaatttcctgagcaaaatcaacaaagcgacggtaaaccattgtgacggtcgtcggaacaggatactgtcgcgcgcactttttgatgtccactgcgtccagactgtacaggagcacctctcatgcaaaagaagccgtcatccggccattggtaaagggctgggacttctcgcgctggtggccacgctggccgttatcagccaccgcgtcggtctccacgatctgctgactcacctgcatctgcttcaggacaccctccgccatcagggcgcctggggatatctggtctatgctgcgctgtttatcattgccaccctgtgtctgatccccggcagcctgctggtgatcgccggcgggatgctcttcggcccgctaacaggctccttgctctcgtttgccgccgccaccctcgcctcttcgctgtcgtttttaatcgcccgctggcttggacgcgatctgctgcagcgctatgtcggccataccaccgtctttcaggcgattgagcgcggtatcgcccgcagcggctgcgatttcctgatcctcacccgcctggtgccgctctttccctacaacattcagaattacgcctacggcctgacggcgatccgcttctggccctttaccctgatctcggccgtgaccaccctgccgggtctggtcatctattcggtgatggccagcgaactggcccgcgagggggcgaccctcgccttcgcgctcaaactgagcctcgccggcgggctgctgtttgccctggtgcagataggcaaacggtttgcccgcgcccgtcgcgtggcggcgtgcagtgaggaggtgcgccatgacccaacctga

SEQ ID NO: 765 - DNA, 240 bp, Klebsiella pneumoniae
cactcactgatatcaggtaaatacgaggtaagtaaaatgctatctactgataaccaaagaatttcagagatttttgaacgtttggcagaaatagcagctaaaactgctgaattaacaagcaaccctaatctatcccctgctcaaaagcaggcagcatgtgacagttactttagcgaacatgatcagttaacaaccgaagccctagagatcttcaaaaaaatcactaaaaatcctcagtga

SEQ ID NO: 766 - DNA, 1359 bp, Klebsiella pneumoniae
ggggaactgatatctatggatcagacgtgcactctggaaggctttctcacccgcgttcaacagcgcgatcctcatcaaaccgaatttgctcaagccgtccgggaggtgatgaccaccctgtggcctttccttgaggaaaatccgcgctatcgtcagcttgctttgctggaacgtctggtggaaccggagcgcgtgatccagttccgcgtggtgtgggtggacgaccgcaatcaggtccaggtcaaccgcgcgtggcgcgtgcagttcaactcggccatcggcccgtataaaggcgggatgcgttttcacccgtcggttaacctgtcgattctcaaattccttggcttcgagcagaccttcaaaaacgccctgaccactctgccgatgggcggcgggaaaggcggcagcgatttcgatcctaaaggcaagagcgatggcgaagtgatgcgtttctgccaggcgctgatgaccgaactctatcgccaccttggcccggataccgacgtaccggcgggcgatatcggcgtcggcggtcgcgaagtcggctttatggccggaatgatgcgcaagctctccaacaacagcgcctgcgtcttcaccggtaaaggactctcctttggcggcagcttgatccgtccggaagccactggttacggcctgatctacttcaccgaagcgatgctcaaacgtcatggcctcggcttcgaaggcgctcgcgtggcggtctccggctccggcaacgtcgcgcaatacgccattgagaaagcgatggagcttggcgcgcgggtggtgacggcctccgactccaacggcaccgtcgttgacgaagcgggcttcaccaaagaaaaactggcccgcctgatcgacattaaagagcgtgcccacggccgcgtggccgattacgcccgcgaatttggcctcacctatcttgaaggccagcagccgtggtcagtgccggtggatattgccctgccttgcgcgacccagaacgaactggacgtcgatgccgcccgccagctgattgccaatggcgtcaaggccgtggcggaaggcgccaacatgccgaccaccatcgccgcaaccgacctgttcctggaagctggcgtgctgtttgccccgggcaaagcggccaacgccggcggcgtggcgacttccggtctggagatggcgcagaacgccgcgcgcatgggctggaaagcggaaaaagtggatgcccgtctgcatcacatcatgctggatatccaccacgcttgcgtgcagtacggcggcgaagcgaagcagaccaactacgtgcgcggcgcgaatatcgccggtttcgtgaaggttgcagatgccatgctggcccagggcgtgatttaa

SEQ ID NO: 767 - DNA, 363 bp, Klebsiella pneumoniae
gcttcaccgatgagcaaaatggcgagcaaatcaagggttgaagaaacgattcagcaaattattccaggcggaggtgagcggaagatggatattgagcaaattatcgacagtatgacgccggaagtgtatcagcgtctggcgacggcggtagagctgggaaaatggccggatggcgtcgcgctgacgccggagcagaaggaaaatagcctgcagctggtgatgctctggcaggcccggtataacaccgacgcccagcacatgaccatcgacaccagcgggcagatggtaatgaagagcaaacagcagctgaaagaggattttggcatcgtgccgaagccgatcgccaccgttaaactgcaataa

SEQ ID NO: 768 - DNA, 813 bp, Klebsiella pneumoniae
gcaataacgataaggattaaagctatgggttttctttccggtaagcgcattttgatcactggcgtcgccagcaaactgtccatcgcctacggcatcgcgcaggcaatgcaccgcgaaggcgcggaactggcattcacctatcagaatgagaaactgaaaggtcgcgtagaagagtttgctgccgcgctgggttctgacattgtgctgccgtgcgacgttgctgaagatgagagcatcaccgcgctgttcaccgagctggaaaaagtctggccaaaattcgatggtttcgtccactcaatcggttttgccccggctgaccagttagacggcgactacgttgacgttgtcactcgcgacggctttaaaatcgcgcacgacatcagcgcttacagcttcgtggcaatggccaaagcctgccgcggcatgctgaacccgggttcggctctgctgacgctctcctacctgggcgcagagcgcgcgatcccgaactataacgtgatgggtctggccaaagcctctctggaagctaacgtccgctatatggctaacgccatgggtccggaaggcgttcgcgtcaatgccatctctgccggtcctatccgtacgctggccgcgtccggtattaaagatttccgtaaaatgctggcgcactgcgaagcggtcaccccgatccgtcgcaccgtcaccattgaagatgtgggtaacagcgcagccttcctgtgctccaacctgtctgcggggatctccggtgaagtcgttcacgttgacggcgggttcaatatcgccgccatgaacgagctggaactgaaataa

SEQ ID NO: 769 - DNA, 1188 bp, Klebsiella pneumoniae
ggagtaacgatgcgccgtttgcgtgattacagcctctgtctgtgcctgctgctgctctggccgctggcggttaatgccgacgacagctggcggcagattcagacggaagcccgcggacagaccgtctggtttaacgcctggggcggcgatccggccgtcaatcgctatctggcgtgggtcagcgaagaggtcaaacgctattacgcaatcgacctgcgtattgtgcctgtcgccgacgccgccgacgcagtgaaacgcatccagaccgaggcgcaggccggtcgtcgccagggcgggtcagtggatctgctgtggatcaacggcgaaaactttcgcacgcttaaacaggccaacctgctgctcaccggctgggccgcatcgctgcccaactggcgctatgtcgatctgcaaaagccggtacgggaagatttttcagttgccaccgagggcgcggagtcgccgtggggcagcgcccagctgacgtttatcgcccgccgcggacaaacgccgcagccgcccaccagcccgcaggcgctgctggccttcgccagagcccatccgggcagcgtaacctacccgcggccgccggacttcaccggtaccgccctgctggagcaactgctgatcgcgctcaccgaccagccagccgccctgcgccagccgccgcagccggcgaccttcgcggcggtcaccgccccgctgtggcgctatctcgatgcgctgcacccggccctgtggcgggcgggcaaggatttcccggcgtcgccggcgcggatggacgccatgctcaaccagggcaccctccgcctgtcgctgacgtttaaccccctgcacgcccggcagaaagccgccagcggcgaattaccgacggacagctacagcttcggctttaccgtggggaccctcggcaacgtccatttcgttaccatcccggctaacgcccgcgctatcgctggcgccaaagtagtggccaatttcctgctctcccctgaggcgcaattgcgcaaggccgatgccgccgtctggggcgatccgagcgtactggatccgcagcgtctgcctgacggccagcgccaggcgctggcggcagccctgccgcaggatctgccgccggtgcttgccgagcctcacgcggcatgggttgacgcgctggagcaggaatggctgcgccgctacggtacccactga

SEQ ID NO: 770 - DNA, 1002 bp, Klebsiella pneumoniae
ttacactacttaatggcgaaattcatcatggcgcagtacaaggataatctgctgggcgaggccaacagctttctcgaggtgctggaacaggtttcccggctggccccgctggataaaccggtgctggtcatcggcgagcgcggcaccgggaaagagcttatcgctaaccgtctccactacctctccagccgctggcaggggccgtttatctcgttgaactgcgcggcgctgaacgataatctgctcgactcggagctgttcggccacgaagccggggctttcaccggggccagcaagcgccatcccgggcgcttcgagcgcgccgacggcgggacgctgtttctcgatgagctggcgacagccccaatgctggtgcaggagaagctgttaagagtgattgaatatggcgagctggagcgcgtgggcggcagccagccgctgcaggttaacgtccggctggtgtgcgccaccaacgctgacctgccgcagatggtcgaggaaggtcattttcgcgccgacctgctcgaccgcctggccttcgacgtggtacagctccccccgctgcgcgaccggcagagcgacatcatgttgctcgccaaccagtttgccatccagatgtgccgcgaactcggtctgccgctgtttcccggctttagcgaacgagcgaccgcgacgctgctcggctaccgctggccggggaatattcgcgaactgaagaacgtggttgagcgctcggtgtatcgccacggcgacagcgaacatgagctggacgcgattattattaacccttttcgtcagtcccccggctctccgccggaagccgcgcccggcgatgagctgcccgcgctaccgctggatctgcgcgatttccagttccagcaggaaaaacgcctgctgcagcggagtctggagcaggcgaagtatcatcagaagcaggcggcggagctgctgggattaacctatcaccagctccgcgcgctgctgaaaaagcatcagctgtga

SEQ ID NO: 771 - DNA, 366 bp, Klebsiella pneumoniae
atgagtaacttaattactacctatcgccgccgaattttaaaagcagccttgttacgccaccagcgaaagactgggagtagcttacttgtcattaagcttaacaagggtggtattagtactatcgaattaactgagattcttcttgatggattgttgcggaaattcgagcgactggccctcggtgaatacggaaatgtggaaggcgtgaaagctcttaagggaatctacagcaactctgttgatgttaatggcagcggcgaattcctcacagaaagcgggaaagagttaatcgacgagcttatttctgaactggtggagttcgtcaaaaagcagaaaccagttactgcggagtccggcaatgaataa

SEQ ID NO: 772 - DNA, 375 bp, Klebsiella pneumoniae
ggactacctgtgaaagataaagattacctgtccacgctgaaatccgcgttgcttaaatcggagccaaccgtcattaaaaccgagttgtttggcgccaccgtattcatccgccgcctgaccggggattacctcatcagctacgaagagaaaatggctgaaaccgcaaaagctggcgcagcgcgcgaggcatcggagcaagtcatccagatcgtcatcgatgcactggttcagccggatggaacggccattccggatgagtttaaacccacggcagccgagctgctgaaggcccatgaaaaccccgaactgctggccgcagtggaaaaagtgaagcaacacgcaatcggcaagctggaggaagcggaaaaaaactga

SEQ ID NO: 773 - DNA, 1281 bp, Klebsiella pneumoniae
agtcgtcatgtatcagtcgtttacgctgcctctaatcgcttatatactcgggcatcggctatcagcaaccagatggatgacatgtaccaacctgccgcactctttatcggcctacgctatatgcgcgggcgcgcagccgaccgcttcggtcgtttcgtctcctggctctcaactatcggtattacgcttggcgtaatggcgctggtgacagtcctgtcggtgatgaacggctttgaacgcgagctgcaaaacaacatcctggggctgatgccacaggccattcttagcgccaaacagggttcggtgaaccctcagcaactgccggagcgcgaagcgaaacttaatggggtaacccgcgtagcgccgatcaccaccggcgacgtggtgctgcagagcgcgcgcagcgtggcggtcggggttatgctgggcattgatccggcgcagaacgatcccctgactccatacctggtgaacgtcaaacagagcgatctgcaggcgggcaaatataacgttattctcggcgagcagctggcgggccagctgggggttaatcgcggcgataaaattcgcgtgatggttccttccgcgagtcagtttacgccgatgggccgcgtgccgagccagcgtctgttcacggtcatcggcaccttcgccgccaacagcgaagtcgatggctatcagatgctgaccaacatcgacgacgcctcccgtctgatgcgctatccgctggggaatatcaccggctggcgcctgtggctggatcaaccgctgcaggtcgacaccctgagtcaacagacgctgccgccgggaactcagtggcaggactggcgcgagcgcaagggcgaactgttccaggcggtgcgcatggagaaaaatatgatgggcctgctgctgagcctgatcgtcgccgtcgcggccttcaacattattacctcgctggggatgatggtgatggagaagcagggcgaagtggcgatcctccagacccaggggctgacgccgcggcagattatggccgtctttatggtgcagggggccagcgccgggatcgtcggcgcgctgctgggagcggtgcttggcgccctgttggccagccagctgaataatttaatgccgatcatcggcgccttccttgacggcgcggcgctgccggtggcgattgagccgctgcaggtcattgttatcgccctggtggcgatggtgctggccctgttgtctacgttgtacccttcctggcgcgctgccgccacccaacccgctgaggctttacgttatgaataa

SEQ ID NO: 774 - DNA, 192 bp, Klebsiella pneumoniae
tccatcaatgttggagctgatgcaccagcagccatgagggccagcattgcggcactaagtttcgctctgtttcccatcaccactccgtgccgctttgcgccggtcatctttaattttgaaatacagattcgtcaggtacgtaagcagaccaaaaagaaggctgccaagcacgccaatggctgcccattgtga

SEQ ID NO: 775 - DNA, 441 bp, Klebsiella pneumoniae
gccatattcgtcttattaaccttgatgcttatgctaaaaatgattgatgttgtcgccgccattattgaacaggatggccagattctgctggcgcagcgtccgccccacgccgaccagccggggatgtgggagttcgccggcggcaaagtggagccgggtgaaagccagccgcaggcgctggcccgcgaactgcaggaggagatgggcatcatcgcccgcccggcttgctatatcgctagccatcagcgggaggtctccggccgccggatccatctgcacgcctggtgggtgccgcactttcagggcacgccgctggcccactatcacactcagctgcgctggtgccttcccacagaagcgctggccctcgatctcgccccggccgatattcctctgctgcacgcctttatcgcccagcgccccaccctttccgtccgctga

SEQ ID NO: 776 - DNA, 183 bp, Klebsiella pneumoniae
aaaatcgtcgtgaagctggtgacgtgcgcgtcgggcctcgtcaagctcggtgatgtcggtatgcagactgacaattccaccatccgccagccgctgatgctgaacgtaaatctggcggttgcccgactggcggacttcgcaatggttcgcctggcggcagttgcggataatcgtctcgcgtag

SEQ ID NO: 777 - DNA, 1965 bp, Klebsiella pneumoniae
tcgagatccgttgattcgatgcggttgtttattgcagaaaaaccgagtctcggtcgggctatcgccgatgtgttgcctaaaccgcaccgcaaaggcgatggctatattgagtgcggcaacgggcaggtggtcacctggtgtatcggccacctgctggagcaggcgcagccggacatctacgacagccgctatgcccggtggaatctcaacgatctgccgattgtgccggagaaatggcagctgcagccaaagccctcggtcaccaaacagctgaatgtcatcaagcgcctgctcggcgacgccgaggaggttatccacgccggcgacccggacagagaagggcagctgctggtggacgaagtactcgactacctacagctggcgccggagaagcgtcagcaggtgcagcgctgtctgattaacgatctcaacccgcaggcggtggagcgggcgatcaaccgtctgcgcgccaacagcgagttcgtgccgctctgcgtgtcggcgctggcgcgggcccgcgccgactggctgtacggcatcaatatgacccgcgcctacaccctgctggggcgcaacgccggctatcagggggtgctctcggtggggcgggtgcagaccccggtacttggcctggtggtccgtcgcgatgaagagattgaaaatttcgtcgccaaagatttcttcgacgtgaaggcgcatatcgtcacgccgcaggaggagcgttttgtcgccacctgggtgccgagcgaagcctgcgaaccttaccaggatgaagaagggcgcctgctgcatcgtccgctggccgagcatgtggttaagcgcatcgaaggccagccggcaatcgtgaccggctataacgataagcgcgattccgaacccgcgccgctgccgttctcgctgtcggcgctgcagattgaggcggccaaacgtttcggcttcagcgcgcagaacgtgctggatatctgccagaagctgtacgaaacccacaaactcatcacctatccgcgttcggacagccgctatctgccggaagagcacttcgctggccgccatgcggtgttgaatgcgattgccgtccatgcggcggacctgctgccgcagccggtagtggatccggagatccgcaaccgttgctgggatgataaaaaggtcgacgcgcaccatgcgattatcccaaccgcccgcagcagccaggtgaagctcaccgataacgaagcgaaggtgtacaccctgatcgcccgccagtatctgatgcagttctgccctgacgcagtgttccgcaaatgccagattgatcttgagatcgccaacggcaagtttgtcgccaaggcgcgttttctggccgaggcgggctggcggacgctgcttggcagcaaagagcgcgatgaagagaacgacggcacgccgctgccggtggtggccaaaggcgatgaactgctgtgcgagaggggtgaggtggtggagcgtcagacccagccgccgcgccactttaccgacgccacgctgctgtcggcgatgaccgggattgcccgcttcgtgcaggataaagatctgaagaagatcctccgcgccaccgacggcctcggcacggaagcgacccgcgcagggattatcgagctgctgttcaagcgtggtttcctgagcaaaaaggggcgctatatccactcttcggaggccggcagggcgctcattcattccctgccggagatggccgggcgaccggacatgaccgcccactgggagtcggtgttgacgcagatcagcgagaaacagtgccgctatcaggactttatgcagccgctggtggggacgctgtatcaactgatcgatcaggcgcgcagcacgccggtgcgtcagttccgcggcctggtggcgccgggcggggcgaagaagtcgttcagcaaaggtaaagggaagccgaaaggcaaaaaagcggcagacgataccgcgccgccgccgcagtaa

SEQ ID NO: 778 - DNA, 990 bp, Klebsiella pneumoniae
ggaggacccgtgaaatatattgctatcagccaaccgggcggcccggaggtattgcagatccgcgaaggggagatccccaccatcggggagcatgaggtgctcattgaggtgaaggcggcgggcgtcaaccggccggatattctgcagcgccagggtctgtatcccatgccggagggcgtcacccccgtgcccggcctcgaggtggcgggcgtggttgttaaggtcggcgcgcaggtcacagcgtttatgcccggcgatcgcgtttgcgcgctgaccaacggcggcggctatgccgaatactgcgccgtgccggcaggccagacgttgccgatcccggcgggcctcagctttagcgaagcggccgccattccggaaaccttcttcaccgtctgggcgaacgtcttccagctgggtaagctgcagcctggcgaaagcattctggtccacggcggcgccagcgggattggcaccaccgcggtccagctgtgccacgcgctggggatgaccgtctatgccaccgtcggccaggacgaaaaaattgttgcgctacgtccctatgctacggcgattaactataaaacagatgattttgccgagaaaatcggccagctgaccaacgatgaaggggtggacgtcattctggatattgttggcggcccttactttaaacgcaaccttgggctactgaaaaaggatggacggctggtcatcatcggctttatgggcgggcgaatcgctcatgaggttgatattcagactctgatgctcaagcgagccaccgtcaccggctcgaccatgcgcggccggacggcggcggagaaacagcagattgccgaggcgctgcgccgccacgtctggccgctgctagaggcagggaaatgcaagccgctgatctacgccagctacccgatggcggagattgccgaggcccatgcctgtctggacagtggtcagcatctggggaaagtagtgatcacgatgacgtcgtga

SEQ ID NO: 779 - DNA, 375 bp, Klebsiella pneumoniae
ccaatggccgttacggccggagaagtgattatggaatttggaatgaaacgcgttctggcatctgtccaggccgccgccactttgaataagctctatgacggctcgcccgtttcactgacggccatcagtaaagagtcaaagctgtctacttcataccttgagcagatcttcaaaaagctgcgggcgggtaacctggttatttcacagcgtggcccaggtggtggttatagcccccgcggcgatgacattaccgttacagaagtgatcactgcggtatctaaactgccagcccataaaacttttgagcctatcctgcgagcgcttgacgacgttcgcgtatcacagctgctgcggggcgattcgccagccccataa

SEQ ID NO: 780 - DNA, 1254 bp, Klebsiella pneumoniae
gccgttaacgttcagcgcggtacgccccatatcgatcagcggttcgacggagatgagcagggctaccagggtcaccggcaggcccatcgccggcaggacgatcagcgcggcgaaggtcgcgccgccgcccaccccggcgacgcccgccgagctgacggtgacgatgcccacgagggtggcaatccacatcggatccagcgggttgatgcccacggtcggcgcgaccatcaccgccaacattgccggatagataccggcgcagccgttctggccgatggtggcgccaaaggaggcggagaagctggcaatcgactccggtacgccgagacgacgggtttgcgcctcaacgttcagcggaatggaggcggcgctggagcggctggtaaaggcgaaggtgatcaccggccagactttacggaagtacttcagcgggctgacgccgttaatcgccagcagcaggccgtggacgacaaacataatacccagcgcaatgtacgaggctaccacgaagccgccaagcttgatgatgtcctgcaaattcgacccggcaaccactttggtcatcagggccagcacaccgtaaggggtcagctgcatgaccagacgaaccagcttcattacccagccctgcagggtatcgatcgcggtcagcacgcgctggcctttttccacatcctctttcagcaacttaagcgctgcgacgccgaggaacgccgagaaaatgacgatgctgatgatggaggttgggttagccccggtcaggtcagcaaacgggttcttcggcacgaaggaaaggatcagctgcgggacgctgagatccgctactttccccacatagttgctctggatggcgttcagacgggcggtctccgcgctgccctggaccagaccctcggcggtgaggccgaacatattggtcaccagcacgccaaccagggcggcgatcagggtggtgaacaacagagtaccgatgctcaggaagctaattttccccagctgcgaggcattgtgcaggcgggccaccgcgctaaggatggaggcgaagaccagcggcataacaatcatttgcagcagctggacgtaaccgttgccgacgatattgaaccactggatggaatccttcagcacctggctgtcagacccgtagatcagctgcagcgccagaccaaataccacgccagtcgccagaccgaccagcacttttctggccaggctccactgtttatgacgtgtttgccccagcgcaaacagtaa

SEQ ID NO: 781 - DNA, 363 bp, Klebsiella pneumoniae
ttattgaacgtacaggggacagtgatgaaaattgaaaccgaacggcaggcctcggtgacgatcctgacgccggcggtgcgtcggctggatgcttccgtcgcagtagcctttaaatcggcaatcgcccaggagataggcgaagcgcccggcgatctgattgttgatttcagcgaaattgattttatcgacagtagcggtctgggaaccctggtttctctgatgaagatgatgaacgggagaggggagatgacgctgtgcgcgctgaatcctggcatccgcaatatgttcacgctgacccgtatggatcgtattttccgcatttgcgaggatcgcacctcggcacttgcgcagttaaatgagtga

SEQ ID NO: 782 - DNA, 423 bp, Klebsiella pneumoniae
aaaatgaacgtttacacgccggttgagctacgtcagattgtctcctttcccttttttgccgacctggtgcagtgcggctttcccagcccggctcaggactatgttgagaagcgaatcgacctcaacgagctgctggtgcagcatcccagcgcgacctattttgtcaaagccgctggcgacagcatgatcgatgccggcattgacgaaggcgatttgctggtggtggacagcgcgcgtaaagcggagcatggcgatatcgtgattgccgccgtcggcggcgagtttacggtaaagaagctgcagcttctgccgcgggtgcagcttaacccgatgaacccggcctattcgcccatcgtggtcggccgcgaggagacgctcgatattttcggcgtcgtaacctacatcatcaaggcggcgggctga

SEQ ID NO: 783 - DNA, 471 bp, Klebsiella pneumoniae
atgagtgacgtgcccgtgaatagcaacatgatgtttcctgccgaactcacctcgctttcaccgctggcggagtggcttgcccagcaaatggcttcgttgcctgttgcggacgagtggcgtttcgcgctcgatctcgccgcctgtgaaacggcaacgaatattattcgctatgcgctgcatgaggatcgggaaagtcgttttggtgtggaatttagggtcgcggaccgacgggtgacgctgcgctttaccgacgcgggggaaacctttcccgccgagcgcctggcgatggcgcgtggtgatgagcatttcgatgtcgatccgttagcggaaaacggtagaggcttgcggcttattctgcgtgcggtggacttttttgacgttgaaatgaatgcagggaaaaatattaccaccctgatgaaagcgttgcctgatcccgctgttaattattcaaccgacaaaaacggaggttga

SEQ ID NO: 784 - DNA, 423 bp, Klebsiella pneumoniae
cacccgtgcgtcagggactggctgacctgctacatcgaacgcgcggtcgccaacggggcggtagccatgcgcggcgagggaagcaaccgatggtcagccgcccatgtcgatgacgtcgcacgtctgtatgtcagcgcgctgcttcagggcgcggccggcgagcgctatcatgcggtggccgaagaggggatcgcattacgcgctattgccgcggtaattgcccacggattaaacctgccgctgacccacctggatgagtcgcaggtcgacgcctggttcggctggtttgcgccgtttaccgcccttgacctgcgcgccagctcggcatggacccgcgagcgcttgcagtggcagccggttggccccgggctgctggaggacctgcagaacatggactatcataaagtgacactgtcacaataa

SEQ ID NO: 785 - DNA, 324 bp, Klebsiella pneumoniae
tcgacgagcttatttctgaactggtggagttcgtcaaaaagcagaaaccagttactgcggagtccggcaatgaataaccagcaaacaatgctctatcagggtgtgctgatcccccgccccgtgttgaacgtggatctgcatgtcctccctgattttaccgggcgggtagtcgtgcacatcgagaacgggagggtgatatgcgaccgccagctgttcgtcgacgagcacatttgctcactggccacgtttatcgaaatggcgcgagaaatggagctgagatttgaggaggtagctggtggcactgacagcaatacgaattcctga

SEQ ID NO: 786 - DNA, 462 bp, Klebsiella pneumoniae
atgagccgagtaaccgccattatcagcaccatagtgatctgcctgatagccagtcttggctggctagccaatcactaccacacgaacgccaccgagttcaaaagtcagcgcgataaagcgactgagcaacttagcctggcgaacgaaaccatctctgacatgcaagtcagacagcgtgacgtcgctgcgctcgatgccaaatacacgaaggaattagccgatgcgaaatctcagcttgaagatctgcagcgttgcgttagcgctggcaagtgcgggttgcacgtcaatgccagatgtccctcgaacggagcgcccggcgccagcggcgtgggccatgcttccggcccccgacttactgacgccgctgaacgggattatttcactctcagagagagaatctctttagtgacaaggcaggttggctatctgcaggaatacatcgacacgcagtgtttaaaatag

SEQ ID NO: 787 - DNA, 981 bp, Klebsiella pneumoniae
atagtgcgagtcagtgatatgaaaacagcagaagcagcaaaaggccggtggtcagaaatttttgaatattacgggctgccgcctatcaccgggaaaaaccattacaagggagaatgtccggtctgtaaggcgcgggggaagtatcgcgttgatgaccgtgacggtcagggtacatggatctgtgtatgcggtagcggtgacgggatgaagctgctgaccctgacccagtcaaaaagcttttccgccatctgcgcagaagtggaccagctcatcgggaataactatcagcgcatcaacgtgcctgctaacagttcggcggcgcggcagcgccagcgagtcattagtaagttttccaagttgctcgatttacggggaactagcgcggctggttaccttcttcaacgtgggataagccgcctgccggcagaaggcatccgtttttgtgaccgccaacgccatgctgggcgtgtatatcaggctctgtatgccctggctaccgatgacaaagccgagctttgttacctgcaccagacgctgctggacggcgacaggaaagcagatattgatagtgcgaaacgtcttaagtcgcttcaagaggacagttatttggatcacgctcgctctgtggccattcgcatgtttccggtatcaacgacgatcggcatcgccgaaggtatcgaaacagcactctcctgttatcaggtttatggcgtcaatacctgggcggtaatcaacagcgggtttatgaagaaattccgggtcccggcaggtgtgaagcatctgattatttttgccgacatggacaagcactctgcaactggacatgccgcggcgttcgagtgcgcccacgcaaacctgctggcgaaaaacgacctggtcaaagtcagcatacgctggccggataacggagatttcaatgatatgcttatgaacggcgatcaggttcgtgaacaagttttctataaaaaggtggcagcatga

SEQ ID NO: 788 - DNA, 282 bp, Klebsiella pneumoniae
tgtgggagagtgatcagctcttcgctgggcccgctctccaccgtctgcccgcagtacatgacgttgattttatccgcccatttgctgagcatttgcaggtcatggctgatcagcaagatggtggtgttgttgttctggttgagccgcgtcagcaggcgaataatctgcgcctgggtggtcggctccatggcgttggtcggctcgtcggcaatcagcagacgcggctggttggccagggcgatggcgatcatcaccttctggcactcgccctcggtcagctga

SEQ ID NO: 789 - DNA, 330 bp, Klebsiella pneumoniae
tgcaggggagtccgatatcggcgcaccagctgccaaaggagcccggcgtgtcgtagcccacgctgcccaccagcggcagggagaaggcgtcggccagccagcgacccagcgggctgtggcccggatcttcgatgcaggccagcggatcgtgaaaggagaccacccacgccggatgaatctgatggatcaactgacacagggcctcggtctcccgttccgaacccggctgctcgccggtcaacagcaccacgtcgcgctccgccgccgcgctattccagcggtaaaccgtttccccttgcttccagttggctgctggaaagttacggttga

SEQ ID NO: 790 - DNA, 480 bp, Klebsiella pneumoniae
gctatgtcggtagtagtgcaggtggcgcattcggtgaatggggtggagagcagctgtatgaaactttcggtaattaattttataatgatgcatcgtaactcgattggattggtattgtgtctatgcctaatacttacgggggttatttcaattatttacgatcgcatttcgaaaaataaattcattactctctgttcgctatttgttgaaaaatttggcgcaagaccagtagaggctttaatttatcaggatggggggttctttttctcgtttatgcgtgatgcattttttattaaagcattatactttaaagaaaactcatttcacacgcgaggaatggataatgaacaaattcgattcattaaagaacttcctaatcagtataccgattggttacgtgtaaaagtacgattttccgtggtcggtattatttttctattcatgatgttatcagttttctatttaccatcattcatttaa

SEQ ID NO: 791 - DNA, 975 bp, Klebsiella pneumoniae
gggggcgcggtggaacattttctggcattaaccctggcggggcgattgccccatcactttcacggcgagacggcccatttccgctggcactggctcggggaagggatccttgagctgacgccgcatgcgcgctgcgagcgcgggctggtactttcctgcgccattcatggcaacgaaacggcgccggtggagatagtcgaccacctggtgcagcgactggtccgggaggcgctcccgctgcgctggcggctgctggtgatcgtcggcaatccaccagcgctgcgggcgaataagcgctatctgcacagcgatatgaaccgcatgtttggcgagcgctggcggcagtttccgctcagtgaggagacgcagcgggcgcagcggctggagcaggcggtggcccgcttttatcgcgaccacgatggcccgcgctggcacctcgatctgcataccgcgatccgcgggtcgctacatccgcgcttcggcgtgctcccggcccgcgatacgccgtgggaggaggattttcttcactggctgggcggcgccgggctggaggcgctggtgtttcatcgccagcccggcgggaccttcacccacttcagctgcgaacggttcgcggcgctggcctgcacccttgagctgggcaaagcgctgccgttgggggaaaacgatctgacgcagtttgccgccgtccagcgggcgctctcccggctgctggtgggggatctggccattgccgacgccccggcgccgctgcgctaccgggtggtacagcagctaacccgccatagcgatgatttccgcttgcatatggcggatcagacgctgaacttcacccccttcgaacccggcacgctgctggcagaggagggcgagacgcggtatgtggtggggcctgagacggagtatgttctgtttcctaacccgacggtggcgaaaggactgcgcgccggcctgatgctggagaaattatcctga

SEQ ID NO: 792 - DNA, 1476 bp, Klebsiella pneumoniae
cgcctggcggttgcctgttgccggacgtcaaaaaataatgagtttattttcccgtcaaagagtaatttcatacatcatcgccgtaatagtttattgcggcttttaagggtattgactatgagtaaagtgatcgattcgcttgaaaaggtactccttccttttgcagtgaaaataggaaagcagccgcatattaatgcaataaaaaatggatttattaaattaatgccgttgaccctcgccggggccatgtttgtgttaattaacaacgtttttctgagcttcggcgaaggctctttcttttattccatgggcattcgcctggatgcctccaccattgaaaccttaaacggctttaaggctatcggcggaaacgtctataacggcaccctcgggattatgtcgctaatggcgccgttctttatcggctccgcgttggcggaagagcgcaaagttgacccgatggcagctggcctgctggcggtggcggccttcatgaccgtgaccccgtatagcgtgggcgaagcctatgcggtgggcgccaactggctgggcgggcagaacatcatctccgggatgattatcggtctggtcgttgcggaactgttcaccttcgtgatccgtcgcaactgggtgattagactgccggacagcgtgccggggtcggtatcacgctctttctcagcgctgatcccgggcttcttgatcctctccatcttcggcattatctcgtgggccctggcgagctatggcagcaacttccaccagatcatcatggactctatctcgacgccgctggcggcgatgggcagcgtggttggctgggcatacgttatctttaactctctgctgtggttcttcggtgtgcacggttctctggcgcttaccgccctggataacggcatcatgacgccgtgggcgctggaaaacatcgcgctgtacaaccagtacggctctgttgatgcggccatcgaagcgggcaaacagttccacttctgggctaagccgatgctcgactcctacatcctgctgggtggctccggggcgacgctgggtctgattatcgccatctttatcgcttctcgccgcgctgaccatcgtcaggttgccaagctggcgctgccgtcaggcatcttccagattaacgaaccgattctgtttggtctgccgatcatcatgaacccggtgatgttcatcccgttcgtgctggttcagccgattctggcggccattacgctggcggcctacagcctggggattatcccaccggtgaccaacctggcgccgtggactatgccgaccggtttgggagcgttctttaacagtaacggcagcgttgccgccctgctggtggccctgttcaaccttggcgtcgctaccctggtctacctgccgtttgtggtgctgtcgaataaagcgcagaccgttatcgagcaggaagagagcgaagaagacatcgctaacgcactgaaattctga

SEQ ID NO: 793 - DNA, 753 bp, Klebsiella pneumoniae
aaagctttatttaacagccgtttatattttgcgtatataatgagcgtcagactactatcgaaaatgctagggagaacagccatgcgcgtactcgtggttgaggataatgccctgctgcgtcaccacctcaaagttcagctgcaggagctgggccatcaggtcgatgcggcggaagatgccagggaagcggactactatctgggcgaacatctcccggatatcgccatcgtcgatctcggcctgccggatgaagacggtttatcactgatccgccgctggcgcagccacgacgtgtcgctgccggtgctggtgctgaccgcccgcgaaggatggcaggataaagtggaagtgctgagcgccggggcggatgattacgtcaccaagcctttccatattgaagaggttgccgcccgcatgcaggcgctgctgcgccgtaacagcggtctggcctcgcaggtgatctccctgccgccgttccaggtcgacctctcccggcgcgagctgtcggtgaatgaccagccgatcaagctgaccgcctttgaatacaccattatggaaaccctgatccgtaaccgcggcaaagtggtcagcaaagattcgctgatgctccagctttacccggatgccgaactgcgagaaagccacaccatcgacgtgctgatgggtcggctgcgcaagaaaattcaagctgaatacccacaggacgtcatcaccacggtgcgcggccagggctatctgttcgaattgcgctga

SEQ ID NO: 794 - DNA, 1161 bp, Klebsiella pneumoniae
tcacgtttatttaggggaattttgatgacggttttcaccaaaaaactgacagccgcgatacccgccatgctgctttgcgcctcattaactggagtcacaacgatgagctctgctgagacaactaacccgaatgcgcctgtttcaatgattgaaaaatgggacaaaacttttgctgagagttcgaaagtggatcaccgtaaggtgaccttccagaaccgctacgggataaccttagttggcgatctctacctgccgaaggatcgcggtgaacgcaaactggcagctattgccgtgagcggtcccttcggcgcggtaaaagagcagtccagcggcctgtatgcccagacgctggccgaacaggggtttgtcaccctggcgtttgacccatcctatacgggcgaaagcggtggctacccacgcaacgtggcctcaccggatatcaataccgaggattttagtgccgcggtggactttctgggcctgcaaaaagaggtggatcgcaaccgtatcggtttgctcggcatttgcggctggggcggtatggccctgaacgacgcggcgatggatacacgcgtcaaagcggtggcgaccagcgtcatgtatgacatgagccgcgcgatggggcatggagtgggcgatggcaaagaccgctataccactgccgatcgtcgcgccgtactgcgctatctgaacgtgcagcgctggaaagatgcggcaaacggcaccttcgtccccggtgggcatgacatttatgttgatgataagggcaacgtcagcgctgccgatcgtattttgccggaaaccttgcccgccaaccccaacccggtcctgaaagagttcttcgattattaccgtatgccgcgtggtttccatgcgcgttcggttaattcaaccggggcatggaatgcgacgatgccgctgtcgtttatgaatatgccgctgctgagttacgccagtgaagtgactattccgacgcttattgtgaccggcgaaaaagcccactcacgctattttgccgaagatgcctttaaggcgatcggcagctcagagaaagcgctggtgattgtccctggcgcaaaccacgtcgatctctatgacaacgtcgcgggcaaaattccctttgcgacgttcgcgcaattttttaaaaccaacctgaaatag

SEQ ID NO: 795 - DNA, 195 bp, Klebsiella pneumoniae
ataatattattaaaaatcaaaaactggcatgggttttggctatttaccccttcatctttacgattatttgcttttttagcttgttacgcagaggtgctgcttctaaactttataatgaagtacataactcacaaaattaatatttatataaattcatttccgtctggcattactgtttgcattgatcggaattaa

SEQ ID NO: 796 - DNA, 192 bp, Klebsiella pneumoniae
gtatcgatattgttcaggcatagacggtttcatgatctcttagggattcgctctgccgatatggagggcaactcgctgatattcaatagtgagattatccgcgattggtctggattcgccaacccgaattgccatcgcgtattgggtgaagaaaggtcagcgctgtcgataagcgtaaagataaataagtaa

SEQ ID NO: 797 - DNA, 813 bp, Klebsiella pneumoniae
ttgattgtattgaggcacctgccgatggtgtacttaatctattcagctatggaggctgttttgaaaaagattcttgtattacctcttatgttcttttccttctcgtccttctctgaaggcgttccgtctacagatgtacagccatatcctgattacctagctgcttatgtcaaaacgattgttactgccggatgcgaacaggcgctgaaaggtggttcaaaggatgtattgatcgagcgggcaacgcaggggatgaagaaggatactgagagttactataccttgcacaatgctgttgtactgggaacggcttttggcggtgagctaaaagaaaagggaaaatttatcactaaagagaaagttgcgattgatagttgtggaggtgcagccgcttataccttattgcaaaaggatttcatgaaaaaagtgattggtactttgatatcatcagcacaatcgcaagcctcagaatcaaaaccaaaggtagcaacttctgacgaaagcgtgtatcggacgacagcaaaagatctggctgcactgtacgatgaaaatgaagttgcagccgatgacaagatagcaggccgcaaggtggaagtgaccggagttgtccaggacataacaaaaaatttcgcgaatgatgtagtccttaaacttgaaagcggtaatcgcttcatgcctgtcagcctgagcatgacggattcagaaaaatcacaggcgtcgaagctgaagaggggacagaagatcactgtgacttgcgaaaagatgctgcttttcatcggtgcgccgtctggcggcaactgcacctttaactaa

SEQ ID NO: 798 - DNA, 255 bp, Klebsiella pneumoniae
gctgtaccattcaatcccgatctgttcgtatggtggcaagtcaccgaaaacgagtgcagaagatttgatgtttttaactcgctcaaccaaaagggcctcaagtgttctactcacaggtatctgccgctgagcatgttcagttttaccatcagcgataaaaatgtaataacgccccgtctcctcatctttacggaactgctctttacgaatggcagcaatttcacctcgtcgtgctcccgtataaatcaaagttag

SEQ ID NO: 799 - DNA, 684 bp, Klebsiella pneumoniae
actgtcgcattgcaattagctacgttcagtccggtcgtgggccgctgggcgaaccgctcccggaaaagcaggttgaatcgggaaaagcgtgggcaaaacgggagctggtatcggggcgaaaagtccgcacgctggatcagcagcaggtggtggaaacctgcctgtttacggtctatccgggcgtgctggttgatattgactggaaaatcacgacgaaaaatctggtttataccgtccggaatatcgaccgcaaaacagaccggatcattatcacgggggaggctgacgggcggcatgatagagctggcgattaagggtacgctggagcgcatcaccggcatgaatgcgtatccgcttttactgccggacacggtccaggaaggagcgacctttcagcgtatctctgacccggagatggtctcgggaatgctgcgaacggggatcgtctctgcccgtatccaggtgaacctgtaccttctcgataattacacctcactgctgcagctggataaaaaaatctgggcggaactgaagtcagtcgttcatggccagctggagggcatcccggttcagtatgtggagcgaggcggtatccatcaggataaaaaccagctgacgaatcgtcgcattcagtatcgcctgacccgcgatttcatcattcactacgtggaggactcctcgtga

SEQ ID NO: 800 - DNA, 1407 bp, Klebsiella pneumoniae
ctgtccgcattgttgcggagagcggcctgcgtccaggcgcagcgcctaagggagaaaaagatgagccagaaattaaaagtagtcactattggcggcggcagcagctataccccggaattactggaaggatttctgaaacgttatcatgaactgccggtaagcgaactgtggttggtagacgtcgaagagggccaggagaagctcgatattatccacgcgctgtgccagcggatggtggaaaaagccggcgtgccgatgaaagtctataaaacgctggatcgccgcgcagcgctgcagggcgcagatttcgtcaccacccagctgcgcgtgggccagctgaaggcgcgtgaaaaagatgagcgcatcccgctgagccacggctacctgggccaggaaaccaacggggcgggcgggttgtttaaaggactgcgcaccatcccggtgattttcgatatcgtgaaagatgtgcaggaaatttgccccgacgcatggatcatcaacttcaccaacccggcgggcatggttaccgaggcggtctatcgccacaccaatttcaaacgttttatcggcgtgtgcaacattcctatcggcatgaagatgttcatcaccgacgtgctgcagctgagcccgagcgatgagctgaatatcgacctgtttggtctgaaccacctggtgttcgtccgcgacgtgctggttaacggcgtctcgcgcttcgatgaactgctggacggcgtggcctccggccgtctgaccgcgaactcggtgaaaaacatcttcgacctgccgtttagcgaagggctgatccgctccctgcgcctgatcccatgctcttacctgctctactactttaagccaaaagagatgctggcgattgagatgggcgagtactacaaaggcggtgcgcgcgcccaggtggtgcagaaggtggagaaacagctgttcgagctgtataaaaacccggatcttaacgttaagccgaaggagctggagcagcgcggcggggcctattactctgatgccgcttgcgaagtaatcaatgccatctataacgataagcagactgagcactatgtgaatatcccgcatcatggtcatgtcgataatatcccggcggactgggcggtagagatgagctgcaccttaggccgcgacggcgcgaagccgacgccgcgcattactcatttcgatgagaaggtgttagggcttatctacaccatcaaggggttcgaagtggcggccagccaggcggcgatcagcggtgagctgaacgatgtcctgttggcgctgaacttaagcccgctgatccattccgatcgtgacgccgaacagctggcgcgggagatgattctggcgcatgaaaaatggctgccgaactttgcggcgacgatcgaaaaactaaaatcgtaa

SEQ ID NO: 801 - DNA, 477 bp, Klebsiella pneumoniae
gaaacttttttccggaaggtttcatctatcaaaggaacgtttatggccggaggaattcgatcgtccggtggtggccgaaaacccactttacccaccgggcaaaaaagcaaattaacacgtattgcgcctcccgctgagttaatgggggaggcggcaataagaatgtggaagacgcaaagcaaaatactcatcgaccgaggggtgtttgagctggaggacgcacctttgttgctggcttactgcaatgcttttcatctgatgctcgaagccgaaaaaatgctggccagcggactgacctcagaaagtgaaatgggggggctgaaaaaacaccctgcagttaatgtccggaatgactcggtttcccagcttgcccgcctgggctctctgttggggttagatccgctcagtcgtcttcgcatgaccagcggacaaaaggatccggacgatgacgggaatgaattcgatgagtttgactga

SEQ ID NO: 802 - DNA, 8043 bp, Klebsiella pneumoniae
accatccaattcaggccaccttgcggtggctttttttatgggcgtaatatggcaaataacataattaaagggcgcaagggtggcggctcaaagcagcgtacaccgacggaacagccggatgatttacagtccgttgcgaaagccaaaattctgctcgcattaggtgagggtgaatttgcaggtggtttaaccgggaaagatatttatcttgatggcaccccgcttgaaaatgctgatggttcgcaaaacttcagtggcgtgtcctgggaatttcgccccggcacgcaggctcagacttatattcagggtattcccggtactgaaaatgaaatcagtgtaggaacggaagtttccagcaagacagcctggacccatacctttactaatacccagctttctgccgttcgtgtccgcctgaaatggccgtccctgatgaaacaggaagatgacggcgacgtggtgggcaataccgtcaagtatgcgattgacctgcagaccgacggcggcgcctggcagacggtgctggaaaccgctgtcacgggtaaaaccacctccggttatgagcggagccatcgtattgatcttccccaggccggcagtacctggacgctacgcctgcgtaaaatctctccggatgcaaacagtgtcaaagttggcgacgtgatgacgctgcagagctataccgaagtgattgacgcgaagctgcgttatcccaacaccgcgctgctttatatcgagttcgactccagccagtttaatggctccattccgcaaatttcctgtgagccgcgtgggcgcgtgattcgtgtgccggataactacaatccggaaacccgcgaatataccggcgtctggaccggcgggtttaaatgggcctggacggataacccggcctggatctattacgacattgttatagctgaccgttttggtctcggtaatcgtctgagcagcgccaatatttcgaaatggacgctgtaccagattgcacagtactgcgatcagctggttcctgacgggcgcggtggtgacggcatggagccgcgctatacctgtaacgtctacgtccaggaacgcaacgatgcttacaccgtgctgcgagactttgccgccattttccggggcatgacctgctggaacggtgagcagattgttgtgcaggctgatatgccgcgtgatgtcgattttacctatacgcgcgccaatattgtcggcaaaccccgttattcgagcagcagcagccaggttcggtacaccaacgccctggtttcctggtctgatccggataatgcttatgctgatgcgatggagccggcgtttatcccggaactggtttcccgctacagttttaaccagctcgaactgaccgcgattggctgtacgcgccagagcgaagcccaccgtaaggggctgtggggcatactgaccaacaacaaagaccgggtcgttgagtttgatgtggggctggacggtcgcattcctcaacccggttatatcattgccctggcggatgagttgctggccggacgggtcaacggcgggcggatcagcgcggtgaatggccgggtgattacgctggatcgtgatgtggatgccaaacctggcgaccgcctccagctaaacctgccatccgggatctcacagagccggaccatccaggccgttaacggacgccggcagattacggtcacaacggcgtacagtgagacgccagaacgggaatgcgtctgggccgtagaatctaatgacctctttctgcagcagtaccgggtcacaggggtaaaagagaacggcgatgccaccctcacgatcaccggcgtgtcacatgacccggataaattcgcccgcatcgataccggcgcgattatcgatcagcgcccggttagcgtattgccggcgggcaaccagtcacctcctgacgatattgtcatcacatcccgctcggtcgtgaatcaggggatcagcgtcgaaacgatgcaggttaactggtcagcggtcagcggcgctattgcctacgaggcgcagtggcgccgtaacgacgggaactggattaatgtgccgcgcagctcgaccacctcgtttgaggtcagcggcatttatgccggtcgttacctggttcgcgtccgtgcgatcaatgcggcggagatctcgagcggctgggcgtattccgaagagaaaaccctgaccggcaaggtcggcgagccgctggcaccgctggcgctggcaacccgttcgctggttcatggggtccaggttagctgggagttcccgaccggctccggggatacgctgcgcacggaactgcagtacagcaaaaaccaggacggcagtgcgccaatgccgttatcagacgtagcctatccggggaaaagctatcagcagatgggcctcagtatgggcgccgaattctggtaccgggcgcgccttgtggatcgtcttggcaatgaaagcccgtggaccggctgggtccaggggatggccagcgataactttgatgactactacgaaaacctgaccgacgcgatcaaggatacggctgcctgggaggaaacgcagcgcaccattagcgaaacacaggaaggtatccgcaatacgcagcaggaactggagcagaccgctgaagctctgcgtaaggaagccgaagaccaggcgaagcaggtcagccaggatattgatgcatcggcgaaaagcatcacggctgatgttgacgggaagatctccgccgtgaataaaaccatcacggatgagatcacctcggtcaatgaggctctcgattctggtctggctcaggcaaacaaaggcgttcaggaggcaaaatccgccgtcgcagatgcgaacaagcagatcgcaactgtgaacaagtcgctgaccgacagcatcacccaggtaagacagtcagtcaccgatacggctgcggaaatcaacgccaccatcgacctggagattgccagggtcagcaaaacgctggccgacggcgatgccgcattgaatgcgcagataaagactgccgaaaatggcctgaagcagtcgctgtctcaggtcaacaccacgctgaccaatgcggtgaagcaggagaccgcggatcgtatcgccgatgttaacgcgaaggcgtcacaggccgctgatgaactgctggcggcaacgcaggggattgaggcgagtatcgagagcctgactcaggtgatgaagaccgccgatgaaaatctggcgcgggaaatgtccagcctcgctgccggcgctaatatccagttcgattcgcaggttatctggcatttcaacaatcagacgaccgagggctggaccggcagcgccggcgtaccgggtgtgtcacaggatggctggttacgcccggcggacagcgccaccgatccgtacattacctctcctggcgggctggctgtcgatggtgcggcgtaccgtttcatcatgctgcgctttcgtaaaaccggcaaaccagtttgggcaggtgagatccgctgggtgtctgccggcgaaaacttcaataacacgaagcgatacattgttgctgagccggaatatgccgatggggtggcaaccctgacggtgcgtgatattccgtggacagggaacattgatcgtattcgcctggacctgacgaaccagcaggatgccagcaactttatcgaattcgactggatcgccgttggccggccagcacccggcgccagtacggcggctctgcaggatgtgcgcagtacgctgagtaacgcgctgaccgccgaagcacaggcacgcagcacgctggcggcgcagatgcgtggctcctatgatgggagcgatctggagaaagtcacctccgggctgctgtaccaggaaaaaaccgcgcgcgttaccgccatctcggcggaagttaaggccagagagtccctgcagacgcagtttaacgacaacaaagctgctgtttctggtgaactgagttctctgacgacagagcagagcgcgcaggcgagccgtatcggtggcctggaaaccagcctcgggaaaaaagccgatgcggccgcgctgacgtccctgacgcagaaagttgagcaacagggcgccacgctgacatctcagggcgccgcgttaacatcgctcactaaccgggttggccagacggaaacgggcctggctggtacgaatgaggcactgagcgggctgcagtctgttgttacccagcagggcgacaggataaccagccagggtcagtccatcacgaaactgacgagcgatttgggcacgacaaatgccgcgctggcgaagaaagccgaagcggctgcggtcactgccttaacgcagcaggtagagcaaaacggacgggatattcgcagcaatactgacagcatcaccagcctgtcgaatcaactggtcaatggccagccgaatcgctggtcccgtcgactctatccggtgcagctggctaacgccgggacagtcccgtcattcagcgatgttcgcgctgtggcaccaacggtagtggatgaggtggccgacgcggccaaactggactttacgtccgccggcagctatctgatcgcgctgtattcctgccaggtgaaagtggccgcagataccaccatcacactggcgcccggcgccagggtttttgatgataccggcgccatatttgtgaatggggttcaggtcgcctggggtaacgccagctggaataccgtcagttttgaactgaaagccggctggaacaccgttgagtttctggtgaatcagtggaccggccaggcgtatatcaacctgggcctgaagctgtcagacaaggttgccgagatgtactccggtctcggggtttccgcgctggcaaacgcagccggcgtgctcagctcgaatgtcagccagattggcaacgaggtggtcagcaattcgcagagcatcacccaactccggaatgcgctgacgcagacagacgcgaacgtggccagcaaagcggatcagacggcgatgaactcgctaaccggacgagtggagaagacggaatccgggctgacggctgctaacgccaacattacctcgctgaaatccgctgtacgggccggaaacgcatcaggcggagatttaattcccaacccgacatttgacccggcttacgaccagatggggtttagcgtcgtatccacgacggctgaggaggtccctcctagctgcccgtatggttatgcggccagaattgccagccgggatcaccatcctaactttgccgcgttcccggccacgcttaacgatgtgattgagatcagcgcactggttgcctgcggcgccggcacggcgaattttaatctgtatgttggcaccgccgttcggccagatacgagcaccggtgcgccactcatggcggggggcggaaaatcaccttccgcgacctggcagagaaccacctggcgcttcaaggtcacgcaggcgatggtagacaggggttatatccgcccgttcctgcagatctcgcagaacagcccgtatggcaccgtatggttcgttacggactggcatatgcgaaatgtgacagcggcgcaaaaggttcaggatactgcggatgccacggcggcggcggttgactcgctgaccaccaccgtgacgcaacagggtaatctgctgacctcgaccggcaaccggacaacccagctggaaaacgggctggccaccaccaatgccgcagtggccaaaaaggctgatgcgacagcggtgcaggatttgaccaataccgtcacacagctgggcaacgatctgactgctgcgaacagcgccatcacgaaactgaccggaaatctggcgaataccgataaagcgctggcgcagaaagccgatgcgactgcgctggccacgctcgacacgaaagtgacgcagcagggtaaaacgctggagagccagagcaattcgctgacgaatctgtcgaacagtctctcgcaagttgcggcagatatcgatgccagcggtcagataccgggtaacctggtcgtgaatccctcatttgaacgcgggctggatggttataccgggcggtcaaccgcgaccagtgtggtggaggtttccgctcctcacagcgggacgcgggcgctgaaggttgatccggggagcgtgtctccggggcaatacatcccgtttgttcaggggcgaacctatgaaatcggggtgtgggtcaaggaacccggagcgacgacggataatggcgcggggaacaacaagttgcggatcggtaactctgccggccagccggtctttgagcgtccgtacaacagcggcacggtggggacaaactggaccctggtttccggtcgctggaaagcgacggagacagccagcctgccggtgacgctgagcaactatctgattagtggcagccgctacttcgatgatttttacgtcactgacgttaccgaccgggtggacatcgatgccaccgccggcgccgttaccggactgacgagccgggtcagcacagcggaaggggctatcacctcgcaaagccagcagctgacgaacctgcagaacagcctgaacacgaccaacagcaatgtgtcgaagaaggccgatgcaacggcactgacttcggtcgataaccgggtgacagaggcggaagggaaactgaccacacagagccagcagctgacaaatctggcgaatgtgctgacggccacccgcaacgctggcgacaacctgatcccgaactttgattttctacagggcagcactgcctgggatattcagtatccagccggtgtgacttttggcgatttcggggacgggaaagcgggggtccggctgaaccggacgactaacaccagtccggggatcttctccaacaacaacaagccggtgccgctgaatggccagcgcaagtaccgcgtggtggtgaaggccaaaggtgtttccggcgcgatgagtctgctgatccgtcgccagaacaaaatcggccagacggacagtacgcatgaggataaaacggtcacgctgaccactgactggcaaaccatcacctgggaaaccggattgacggctgccggcgcggacgggcagaacttcaaactttattctcatccgacaaacggtgaaatctggctcgattccgtccgggtttttgatatcaccgatgaaaccaacatcaaggcgaccagcgatgctatttcgtctctgaccgggacggtgacgaaccaggggaacaccctgacatcacaggggcaatccatcacggcgctgaataacgcgctggaaggggtcaaaggcgatgtgtcgaagaaggccgatgcaacggcactgacttcggtcgataaccgggtgacagaggcggaagggaaactgaccacacagagccagcagctgacaaatctggcgaatgtgctgacggccacccgcaacgctggcgacaacctgatcccgaactttgattttctacagggcagcactgcctgggatattcagtatccagccggtgtgacttttggcgatttcggggacgggaaagcgggggtccggctgaaccggacgactaacaccagtccggggatcttctccaacaacaacaagccggtgccgctgaatggccagcgcaagtaccgcgtggtggtgaaggccaaaggtgtttccggcgcgatgagtctgctgatccgtcgccagaacaaaatcggccagacggacagtacgcatgaggataaaacggtcacgctgaccactgactggcaaaccatcacctgggaaaccggattgacggctgccggcgcggacgggcagaacttcaaactttattctcatccgacaaacggtgaaatctggctcgattccgtccgggtttttgatatcaccgatgaaaccaacatcaaggcgaccagcgatgctatttcgtctctgaccgggacggtgacgaaccaggggaacaccctgacatcacaggggcaatccatcacggcgctgaataacgcgctggaaggggtcaaaggcgatgtggcgaagaaagctgatgcgtcggcggtcagttcactgacccaaccgggttaccccagactgaaaaggatatccgtagccaggccgacagcctga

SEQ ID NO: 803 - DNA, 585 bp, Klebsiella pneumoniae
ttatccttttccttgcaccctgaagtgaaagtatctcctgcgagtctgtcacagactcgcagttattttctgactccagaaggtatttctatgaatatgaaaagcattgaagatgtatttattcacctgctctcagatacctacagcgcagagaaacaattaacccgcgggctggctaaactagccagagcggcgtccagtgaaaaactcagcgcggcgttcaatgctcatcttgaagaaacccagggccagatcgaacgtatcgaccagattattgaacaggaatccaacctgaaaatcaaacgcatgaaatgcgtggccatggaaggattaatcgaagaagctaatgaagtcgttgagagcacggaaaaaaatgaggtacgtgatgctgcattaattgccgctgcgcaaaaggtcgagcattacgaaattgccagttacggtactctggtcaccctggcagagcagttgggctataaaaaagcagccaaactgcttgccgaaaccctggaagaagaaaaacaaaccgatgtgaaattaaccgatctggcggtaggtaatattaataagaaagcggaaaaataa

SEQ ID NO: 804 - DNA, 888 bp, Klebsiella pneumoniae
tggccaatttcctgctctcccctgaggcgcaattgcgcaaggccgatgccgccgtctggggcgatccgagcgtactggatccgcagcgtctgcctgacggccagcgccaggcgctggcggcagccctgccgcaggatctgccgccggtgcttgccgagcctcacgcggcatgggttgacgcgctggagcaggaatggctgcgccgctacggtacccactgatcctgctggcctggggggcgatggcggcgatctatctgccgctgctccccgccgccggggaactggtgggcgctgcgcgctccccggcccactggcgggcgctgttcgccgacccgcagctgggccaggcgctggccgccacgctcgtctccacgctgttgtccgtcggcggcgcgctgctgatcgccctgaccatcgtcgccgccctctggccttcggcccgctggcggcggctggcttcccgtctgccgctgctgctggcggtgccccatctcgccctggcgacggcggcgctgctgctgttcgccgaagggggctggctctggcagcagttgccgtttctgacgccgccggtcgaccggtacggcattgggcttggcctgacgatggccctgaaagagagcgcctttgtgctgtgggtgatctatggcctgctgggagagaaacgcctcgccgaccaggcgaccgccctgaagagcctcggctacggccgctggcagtgcctgcgttggctggtgctgcccgccctgctgcccgccctcggcatggtgctgctggccaccaccgcctggagcctgtcggcggtagacgtcgccctggtgctggggcccggcaatccgcccaccctcgccgtgctggcgtggcaatggttaagccagggcgatga

SEQ ID NO: 805 - DNA, 1749 bp, Klebsiella pneumoniae
ccgctgatttctgtacgtttttttgtgcagaccggcaaatgtagaccagattcaataggcgcccgcacgatcgcgccgcgcccctcgattccgccggacgtctgtaaaggagaccccgccatgccgtcaccgatgatttatcaggatctcaccactgccgcgctgctcggccatgcggcgcagtatcacagcgagaccgagattgtctcggtgagtactggcggtgagaaggagcgcagctgctggggggaggtggccagccgtgctcagcggctggcatcggcgctggcgtcgctggggctgccgccgggcgcccgctgcgccacgctggcatggaacaaccgccgccatctggagatctattttgccgtcgcctccggcggctgggtgacgcacaccgtcaatccgcggctgtcggttgaccatctgcggtatatcctcaacgacgctgccgatgaagtgctgttttttgaccagacctttttgccgctggtagcgcagctgctgccgcagctgccgacggtgaaacacgtcgtgctgatggagtcccgcagcgaagcggcgctcagccagctgccctcattgctgttttatgacgatctgttgcagcaggggatggcagactatcgctggccgcagctcaatgaactgactccggcttcgctctgttacacctcgggaaccaccggccggccgaaaggggtattgaacacccatcgttcgctggtcctgcacgccctgagcggcaaccagccggacgccgccggcatatcggcgaaggacagcctgttgccggtggtgccgatgttccatgtcaacgcgtgggggacgccgtttatcgccgccatggtcggcgcgcggctggtgctgccggggccgcacctcgatggcgacagcctgctgcagctgctggccgccgagaaggtgacggtggggtttggcgtgccggtgatctgggccggcttgctggcggcgatgcgccggacagaggtccggctgcctgaatttaaacgtgcgctggtcggcggctccgcgctgccgccgtcgatggccgaggcctttcagcgtgattacggcattgcactgacccacgcctggggaatgaccgaaacatcgcccatcggcaccatcaacacaccgttgagcaaacatgacgcgctcccggcacaggagcagcaaaagcagcgcgccggtcaggggcggcccattttcggcatcgaactgcaggtggtggacgtggatggcgaaccgttgccccgggatggtcaaagccagggttatctgcaggtcagagggcactgggtggtagagcaatactatggtcaggacgcgagcgccctgaccgcggcaggctggtttgataccggtgatatcggtacgctcgacgccaatggttatctggtgatcagcgatcgggcaaaggatattatcaagtccggtggcgagtggatctccaccgttgagctggagaatatcgccatcgcgcatccgggggtgcgcagcgcggcggccatcgccgcccgccatccgcgctgggacgagcggccggtgctgctgtgcgtccgtgcggaagggggcgaagtggaggagaccgatctgctgagctggtttgagaagcgggtgcctaaatggcagatcccggaccgggtgatatttgtcgatgcgctgccggtcagcgccacgggtaaggtgctcaaaaatcagctgcgccaggcctacggagagattttaatgagtgagggaaaatga

SEQ ID NO: 806 - DNA, 1374 bp, Klebsiella pneumoniae
tctatggaattatcctcactgaccgccgtttcccctgtagacggccgctacggcgataaagtcagcgcgctgcgcggtatcttcagcgaattcggtttgctgaaattccgcgttcaggtggaagtacgttggctgcaaaaactggccgcccacgcagcgatcaaggaagttcctgcttttgctgccgacgcaaacggtttccttgataaaatcgtcgccgatttcagcgttgaagacgcggagcgcatcaaaaccatcgagcgcaccactaaccacgacgtgaaagcggtagagtatttcctgaaagagaaagtcgctgacgtcgccgagctgcacgcggtatcagagtttattcacttcgcctgtacgtctgaagacatcaataacctctcccacgcgctgatgctgaaaaccgcccgcgacgaagtggttctgccttactggcgcaaactgattgatgcggtaaaagatctggcgacccagtatcgcgatgtgccgctgctctcccgtacccacggccagccggcaacgccgtccaccatgggtaaagagatggcgaacgtcgcctaccgtatggagcggcagtatcgtcaactgaaccaggtggaaatcctcggtaaaatcaacggcgcggtgggtaactacaacgcccacatcgccgcctacccggaagtcgactggcatcagttcagcgaagagttcgttacctcgctgggtattcagtggaacccgtacaccacgcagatcgagccgcatgactatatcgctgagctgtttgactgcatcgcgcgcttcaacaccattctgatcgacttcgatcgcgacgtgtggggctatatcgcgctcaaccacttcaaacagaagaccatcgccggggaaatcggctcctccaccatgccgcacaaggtgaacccaattgacttcgaaaactccgaatgcaatctcggcctggccaatgcggtcatgcagcacctggccagcaaactgccggtttcccgctggcagcgcgacctgaccgactccaccgttctgcgtaacctcggcgtgggcatcggctatgcgctgatcgcctatcagtccaccctcaaagggatcagcaagctggagctgaaccaggatcgcctgctggacgaactggatcacaactgggaagtactggctgagccgatccagaccgtgatgcgtcgttacggtatcgaaaaaccgtacgagaagctgaaagagctgacccgcggcaaacgcgtggacgcggaagggatgaagcagtttattgacagcctcgccctgccggaagaggaaaaagtgcgtctcaaagcgatgaccccggccaactatatcggtcgggcaaccaccatggttgacgagctgaagtaa

SEQ ID NO: 807 - DNA, 1593 bp, Klebsiella pneumoniae
caacgtaattcgcggttcatcaacctgataacaatatatggccccgcaaggggccttttctttttccagggaaaaccatccaggaggaactttattatggcgatgtatgaagtcggtaccgtcacgggtgccgcgtcgcaggcacgggtgacaggtgcgacaacaaaatggtcacaggaggcgctggggatactgcccgggtcgattctagtggtctaccgcagcggtagtgctgacctgtatgcgatcaaatccgtggacagcgacacgcaactgacgctgacccggaatatcaccaccgcattttccggtgccagttacggcattattaccgctgaaaccgccagcacctcgtcgtttgctaaccagctggccagcgcgtttgcattctggagtagtgtagtggagggctggtcgatggccctgaccggcagcggcaatattaccctgactgacccgatcacaggaaagcaggtgaccgtgccggcgatagccgggatggcgaaagcatcggatcttaacgcgctggcaaaactcaccggaggaaacaaactcgacggctcgcaggttataaccagcgataatgccggttttattctcggtaagaattcagatctggctctgctcaaaaaacaggggcaaggcgggacgattgccgttggctcgggaacaccgttcagggttcagcgttcaagagcgaccactatatcaccggcagacacctttgatgacatcctcgttattggcaccaataaccagacgacgttgcccggagatttggttgtcggtggtggtttcgataatacggcaaagggcaagctgtattcccaggcgttagagctgtcgatgggcactccgtacatcgattttcatcataacaaaagtgctaacgactataccgcacgcatcatcactacagccgcagatcaacttagtgttcagggaagtcatctacgggtagacagagacctgcgggtggggcaagcggccgacatcggcagctggatgcagtgtcgctatgactgtgtgtcccagcagaccgacttcggttcccctgccattggcgcgttagtttccggtggcagagtacggtcccgcatgacagggcgtggaggaaacggcgacacgtctggagcgtggggtggtttctaccttgaagaatacgttgggtacaaccaccgggtggtactgtatatggacggtttcggccaaaaagatgcctggctcttttacaccggagggacaatctccacccctaaaggcgatgttatgaccactggctcagacgtgcggctgaaaaaggattttacggaatcccaggaaggggcctccaggcgtattaacgcgctgggggtatgtgagttcaacatgaaaggcgaaacacgccgtaggcgtggatttattgctcaacaagctgaaaaagttgacccgatttacacctttcaaagcggcgatgtagaaattgatggcgagaagatcaatatccttaacgtagaccatacggccatcatcgcggatcttgttcttacggtgcaggagttaacaaaacaagtgcgtgatttgaacaagcaggttcaaacaaaagagtactga

SEQ ID NO: 808 - DNA, 2250 bp, Klebsiella pneumoniae
attccacactccgtttcatctggtatgaccagatcatattgctggattcaggagactgacatgctctacaaaggcgacaccctgtacctcgactggctggaagatggcatcgccgaactggtgttcgatgccccaggttcggtcaacaagcttgataccgcaaccgtagccagcctcggtcatgcgctggacgtactggaaaaacaaagcgatctcaaaggtctgctgctgcgctctgaaaaagcggcatttatcgtcggcgcggatatcaccgaattcctctcgctgttcctggtccctgaggagcagttaagccagtggctgcattttgctaacagcgtcttcaatcgtctggaagatctccccgtccccacaatctctgccgtcaatggctatgcgctgggcggcggttgcgaatgtgtgctggcgaccgattaccgcctggcgacgccggatctgcgcattgggctgccggaaaccaagctcggcattatgcccggcttcggcggttccgtgcgtctgccgcgcctgctcggcgccgatagcgcgctggaaattattgccgccgggaaagacgtcggcgccgatcaagcactgaaaatcggcctggtggatggcgtggtcgctgcggaaaaactacgcgacggcgcgctggcgatcctacgtcaggccatgaatggcgacctggactggaaagcgaaacgtcagccgaagctggagccgctgaagctcagcaaaattgaagccgccatgagcttcacgattgccaaaggcatggtcgcgcaaaccgccgggaagcattacccggcgccgatcaccgcggtcaaaaccattgaagccgccgcgcgtcttggtcgtgaagaagccctggtgctggaaaataaaagctttgtcccgctggcccataccaatgaggcccgcgcgctggttggtatcttcctgaacgaccagtacgtcaaagcgaaagcgaaaaagctgaccaaagatgtcgagacgccgaagcatgctgccgtcctgggcgctggcattatgggcggcggtatcgcttaccagtcggcctggaagggcgtgccggtggtgatgaaagacatcagcgacaaatcgctgacccttggcatgaccgaagcggcgaagctgctgaataaacagctggaacgcggcaaaatcgacggtctgaagctggccggagtgataagcaccattcagccaaccctggaatacagcggttttgatcgcgtcgacgtggttgttgaagcggtggtcgaaaacccgaaagtgaagaaagccgtactagcggaaaccgagtcaaaagtgcgcccggataccgtgctggcgtccaacacctcaacgatccccatcagcgagctggccagcgttctgcagcgcccggaaaacttctgcggtatgcacttctttaacccggtgcatcgcatgccgctggttgaagtgatccgcggcgaaaaaacctcggataataccattgccaaagtggtggcctgggccagcaaaatgggcaaaacgccgatcgtggtgaatgattgtcccggcttcttcgtcaaccgggtactgttcccctacttcgccggcttcagccagctgctgcgcgacggggcggacttccgcaaagtcgacaaagtgatggagaaacagtttggctggccgatgggcccggcttatctgctggacgtggtcggcatcgataccgcgcaccatgctcaggcggtcatggcggcgggcttcccgcagcggatgcagaaagattatcgcgacgccatcgacgccctgtttgacgccaaccgtttcggccagaagaacggcctcggcttctggcgctataaagacgacagcaaaggtaagccgaagaaagaagaagatgctgccgtcgacagcctgctggccgacgtcagccagccgaagcgcgatttcagcgatgaagagattatcgcccgcatgatgatccccatggttaacgaagtcgtccgctgcctggaagaaggcattatcgccagcccggcggaagcggatatggcgctggtatacggcctgggcttccctccgttccacggcggcgcattccgctggctggacaccatcggcagcgcgaagtatctcgatatggcgcagcaataccagcaccttggcccgctgtatgaagtgccagccggtctgcgtgacaaagcgcgccataacgaagcgtattatccccaggtagagccagcccgtccggttggcgctctgaaaacggcttaa

SEQ ID NO: 809 - DNA, 660 bp, Klebsiella pneumoniae
cggcgggtatcgttgctttgcatcgcggttacaagttctgacaggagggacgctatgcctttcacacccctggttaccgctggcattgaaacggcgctgaatactttcctctggcgcgacaaagcgcttaaacccgctcgtcagcgcctgctgggcaaggtattgcgggtccagctgcaggatttcgccacgcccgtggtgctggtattcagcgaacgccgggttgacgtcctgagcgcctgggacggagaggccgattgcaccgtgattacccggctcagcgtgctgccaaaactgcgcaatcgtcagcagctcacggcgcttattcgcagcggtgatctggaagtgcagggcgatctgcaggtggtgcagaatatggtctccctgtgcgacctggcagagtttgatcccgctgaactgctggcgccctataccggcgatattgtggccgaaggcgtcggtaaagtcctgcgaggcggcgctcagtttctgctgaagggcgcagagcgccagcagcgctatgtcgcggaagcgatcactgaagagtggcgcctggcgccggggccgctggagctggcctggtttgctgaagagacaacggctattgagcgcgcgctggccgcactggaaaaacggctggaaacgctggagggcaaatga

SEQ ID NO: 810 - DNA, 1335 bp, Klebsiella pneumoniae
aagatggaatccctggccgcgctctataaaaatcatattgttaccctacaagaacgtacccgcgacgtcctggcccgttttcaaatggatgctctgctgattcactccggcgagctggttaacgtcttccttgatgaccatccgtacccgttcaaggtcaatccgcagttcaaagcctgggtgcctgtgactcaggtgcctaactgctggctgctggtggacggtgtgaataaaccgaagctgtggttctatctgccggtagattactggcataacgttgagccgttgccgacctctttctggaccgaagagatagacgtgatcgcgctaccgaaggccgatggcatcggcagccagctgcctgctgctcgcggtaatattggctatatcggtccggtgcctgagcgcgcgctgggcctgggtatcgccgcggataagatcaacccgaaaggggttatcgactacctgcattactaccgggcttacaaaaccgattacgagctagcctgcatgcgtgaagcgcagaagtcggcggtgaatggtcatcgtgcggcctacgaagctttccagtcgggaatgagcgaattcgatatcaaccaggcctatctcaccgccaccggccatcgtgataccgacgtgccttacagcaatattgtcgcgctgaatgagcatgcctccgtcctgcactacaccaaactggaccatcgtgccccggcggagatgcgcagtttcctgctcgacgccggtgcggaatataacggctatgccgcagatctgacgcgcacctgggcggcgcacggcgataacgactttgcccatctgatcaaagacgttaacgatgagcagcaggcgctgattagtaccatgaaggccggtaccagttacattgattaccatatccagttccatcagcgtatcgcgaagctgttgcgtaaacaccagttggttaccgacatgagcgaagaggcgatggtggagaatgacctgaccgggccgtttatgccgcacgggattggccatccgctgggtctgcaggtgcatgatgtcgctggctttatgcaggatgacaccggtacgcatctggcggcgccgtcgaaatacccgtatctgcgctgcacccgtattatcgagccgcggatggtgttaactattgaacccggcatctacttcatcgagtcgttactggcgccgtggcgtgaaggcccgttcagcaagcactttaactggcaaaaaattgacgccatgaagccgttcggtgggatccgtatcgaagataacgtggtgattcacgaaaacagtatcgaaaatatgacgcgcgatctgaagctggcctga

SEQ ID NO: 811 - DNA, 1011 bp, Klebsiella pneumoniae
gcaaactggtcgacgttgcctgcgtcgagatccagcaacccacatcacaacaaatccgcgcctgagcgcaaaggaagaaaaatgacgacgaaaaaagctgattacatttggttcaatggcgagatggttccgtggggcgaagcgaaagttcatgtgatgtcccatgcgctgcactacggtacctcggtattcgaggggatccgttgctacgactcgcacaaaggcccggtggtgttccgtcatcgcgaacatatgcagcgtctgcatgattcagccaaaatttatcgtttcccggtctcccagagcgtcgacgaactgatggaagcctgccgcgaagtcattcgaaccaataatctgaccagcgcttatatccgtccgctggtgtttgttggcgatgtcggcatgggggtaaacccgcctccgggttataacactgacgtgatcatcgcggcgttcccatggggagcctacctcggcgcagaagcgcttgagcaggggatcgatgcaatggtctcttcctggaaccgcgcggcgccgaacactatcccgacggcagcgaaagccggtggtaattatctttcctcgctgctggttggcagtgaagcgcgtcgccatggctatcaggaaggtatcgccctcgatgttaacggctatatctccgaaggcgcaggggaaaacctgtttgaagtgaaggacggtgtactgttcaccccgccgtttacctcttccgcgctgccgggcattacccgcgacgccattatcaagctggcgaaagatcttggtatcgaagtccgcgagcaggtgttgtcccgtgaatccctgtatctggcggatgaagtcttcatgtccggcactgcggcggaaatcaccccggtacgcagcgtggacggcatccaggtcggcgcaggccgtcgcggtccggtaaccaaacgcattcaggaagccttctttggcctcttcaccggtgaaacagaagataaatggggctggttggatccggtaagtaagtaa

SEQ ID NO: 812 - DNA, 1266 bp, Klebsiella pneumoniae
gctacttctcctgatatgtcgttagcaaaagcctcactgtggacggcggcatcgacgctggtcaaaatcggcgccggtctgctggtcgtcaagctgctggccgtctcgtttgggccggcgggcgttggccaggccggtaacttccggcaactggtcaccgtactcggcgtgctggccggggccgggatatttaatggcgtcacgaagctggtggcgcagcatcacgacgatcccccgcgcctgaagcaggtggtgggcacctcgtcggcgatggtgcttggcttttccaccctgctggcgctggtatttttactggcggcggcgccgataagccaggggctgttcggccatacgcactatcaggggctggtacgcctggtggcgctggtgcagatggggatcgcctgggcgaatttcctgctggcgctgatgaaaggctttcgcgatgcggcgggtaacgccttctcgctgattgccgggagcctgatcggcgtggcggcttactatgcttgctacgtgttgggaggctatcagggcgcgctgctggggctggcgttagttccagcgctggtggtggtcccggcgggtattatgctctggcggcggggtaatatcccgctgagcgccctgcgtccgcgctgggataacggtctggcgggacagctatcgaaatttaccctgatggcgctgataacctcagtgaccctgccggtagcctatgtgatgatgcgtaatctgctggcggcgcattatggctgggaggcggtcgggatctggcagggggtgagcagcatctccgatgcctacctgcagtttattaccgcctcgtttagcgtctatctgctgccgacgctgtcgcggctgagcgccaaaacggatatcacccgcgagattggcaagtcgctgaaattcgtcctgccggcagtagcggcggcgagcctgacggtctggctgctgcgcgattttgccatctggctgctgttttccgatcgctttaccgcgatgcgtgacctgttcgcctggcagctggtgggcgacgttttaaaagtaggcgcctacgtctatggctatctggtgatcgccaaagcgtcgctgcgtttttatattctgacggaaatcagccagttcgcactgctgaccgcattctcacactggcttataccggcgcacggcgcggttggcgcggcgcaggcatatatggccacttatattgtttatttcgccctttgtagtggcgtgtttttactctggcgtaaacgggcatga

SEQ ID NO: 813 - DNA, 1113 bp, Klebsiella pneumoniae
ccgcgtggtcctactggtttatgtggatggcggtgggattctcggagattaccgcccatcggggtctatgtgcagttctggttcccggagatggcgcagtggatcccggcgttaattgccgtgggactggtggcgctggcgaaccttgcggcggtccggctatacggtgaaatcgagttctggttcgccatgataaaagtgaccaccattatcgtgatgatcgtcgtgggtctgggcgtcattttcttcggctttggcaacggcggccactccatcggttttggtaatctcaccgaacatggtggtttctttgctggcggctggaagggcttcctgacggcgctgtgtatcgtggtcgcgtcctatcagggggtggagctcatcggcattaccgcaggtgaagcgaaaaacccgcaggtgacgctgcgcagcgcggtgggcaaagtgctgtggcggatcctgattttctacgtcggcgcgattttcgttatcgtcactatcttcccgtgggatcaaatcggctccaacggcagcccgttcgtactgacgtttgccaagatcggtattaccgcggcggcgggaattatcaacttcgtggtgctgacggcagcgctttccggctgcaacagcggaatgtacagctgcggacgtatgctgtacgccctggcgaagaaccgtcagctgccggcggcgatcggtaaggtatcgcgcaacggcgttccgtccgtcggtgtggcgctgtcgattctgatcctgctggtgggctcctgcctgaattacattattcctaatccgcagcgggtgttcgtctatgtctatagcgccagcgtcctgccggggatggtgccctggtttgttatcctgattagtcagctgcgtttccgtcgcgtgcatcaggcggcgattgccagccatccgttccgttcgctgctgtttccgtgggccaactatttcacgatggccttcctgatctgcgtgctggtcgggatgggactgaatgatgaaacccgcatgtcgctcttcgtcggcattatttttctggccgccgtcaccctgatttataaggtgtttggcctcggaagacaggggcaagtcaataatacggctgaataa

SEQ ID NO: 814 - DNA, 1497 bp, Klebsiella pneumoniae
cgaataatcccctctgtttttagcctatcaaaggaagcgccagagatgcattttcgcgccataacccgaatcgttggactgctggtcatcttgttttcggggacgatgatcgtcccgggattagtggccctgatatatcgcgatggcgcgggacgggccttcactcaaaccttctttgtcgctctggcgagcggctccatgctgtggtggccgaaccgtaagcaaaaaggcgaactgaaatctcgtgaagggtttctgatcgtggtgctgttctggaccgtgctggggagcgtgggggccttgccctttatcttctccgaacagccgaacctgacggtgacggatgccttcttcgagtcattttccggcctgacgacgaccggggcgaccactctggtggggctggactcgcttccgcacgctatcctcttttatcgccagatgctgcagtggttcggcggcatggggatcattgtgctggcggtagcgattctgcctatcctcggcgtcggggggatgcagctctaccgcgcggaaatgcccggcccgctgaaggataacaagatgcgtccgcgtattgccgagacggcgaagacattgtggctcatctatgtgttactcacgatcgcctgcgcattggcgctctggtttgccggtatgccggcgttcgatgcgatcgggcacagtttcgccaccatcgccatcggcggtttctcgactcacgatgccagcgtcggctatttcaacagcccgatgatcaactccatcattgccatcttcctgctgatctccggctgtaactacggtctgcatttttcgttgttgagcggacgcagcctgaaggtgtactggcgcgaccctgaatttaggatgttcattggcgtccagttgacgctggtcatcgtctgtacgctggtgctatggcttcataacgtgtacggctcggtgttgacgacgctgaaccaggcgtttttccaggtggtgtcgatggcgaccaccgcggggttcaccaccgatagcattgcacgctggccgctgttccttccggtgctgttgctgtgctccgcatttatcggcggctgcgctggctccacgggcggtggattaaaagtgatccgtatcctgttgctgttcaagcagggcaaccgtgagctgaagcggctggtgcacccgaatgcggtgtatagcattaaattaggtaaccgcgcgctgccggaacgtattctggaagcggtatggggattcttctccgcctatgcgctggtctttatcattagtatgctggcgattatcgccaccggggtggatgacttctctgctttcgcctccgtggtggcgacattgaacaacctcgggcctgggctcggcgtcgtcgcggataactttgccaccatgaacccggtcgcgaaatggatcctgattgctaatatgctgtttggtcgtctgcaagtgttcaccttgctggtgctctttacccccactttctggcgcgaataa

SEQ ID NO: 815 - DNA, 333 bp, Klebsiella pneumoniae
cgacaacaccctctccgcagaagcgatggaacggggctggcagtgcttacgcctgtttgccgagcgcctgcaggatattccgccgacgcaaatccgcgtcgtggccaccgccacgctgcgtcttgccgtcaatgcgggggagtttctggcgaaagcgcaggagatcctcggcactccagtgcaagtgatcagcggcgaagaagaagcgcgcctgatttaccagggtgtcgcccacaccaccggcggcgccgatcagcgcctggtggtcgatatcggcggcgccagcaccgagctggtgaccgggaccggcgcacaaacaacctcgctgtttag

SEQ ID NO: 816 - DNA, 756 bp, Klebsiella pneumoniae
tggagaagccccgcgatgagcatcctggtcactcgtccactaccgcaaggagaagcgctggtcagccgtctgcgggccatgggacgcgtggcctggagctttccgctgatagaatttacgcctggcagggagcttcccgcgctgggcgatgcgcttgcccgactggggcccgacgatctgctatttgcgctatcccagcatgcggtggaattcgcccatgcccgtctgcagcagcagggcctgccctggcccacttctccgcgctattttgccattggccgcacgacggcgctggccctgcatacggtcagtgggcagcatatccattacccgttagatcgggaaattagcgaagtcttgctacaattacctgaattacaaaacattgccgggaaaaatgcgctgatcctacgcggcaatggcgggcgggaactcttaggcgcgacgctgaccgagcgcggcgccagggtcacattttgtgaatgttatcaacgtagtgcaaaacattacgatggcgcagaagaagcgatgcgctggcaatctcgcggagtcaccacgctggtggtcaccagcggcgagatgctgcagcagctatggtcgttaataccgcaatggtatcgcgaacagtggctcctgcactgccgcgttgtcgttgtcagcgaacgtctggcccttcaggcccgggaactgggctggcaggagattcaggttgccgatagcgccgacaacgatgcgctgctacgcgcattacaataa

SEQ ID NO: 817 - DNA, 1182 bp, Klebsiella pneumoniae
tgttctgcttttccccttctggagttggggcatcatcgctatacttcccggattaactatgctgagagcacatgcgttgtgaatttactcactgctattactgaattaatcagtattttcttattcacgaccctctttatttttgtcgcgcggaaagtggcaaaaaagatcgggttagtggataaacccaactatcgcaaacggcatcaggggttgattccgttggtcggtggtatctcagtttatgcaggtatctgtttcactttcgccatcgccgattattatattcctcacgcctcgctgtatctggcctgcgcgggggtattggtgctggttggcgcgcttgacgatcgcttcgacatcagcgtgaaaattcgcgcggtcattcaggccgcgatcgccgtgattatgatgatggcagggaatctgcatctgagtagtttgggctttatttttggctcgtgggaactggtgctggggcccttcggcttcttcctgacgctgtttgccgtctgggccgctatcaatgcgttcaacatggtcgatggtatcgacggcctgctcggcggactgtcatcggtctcttttgcggcgaccgggattattctttggtttgatggtcagtacagcctggcgatgtggtgtttcgcgatgatcgccgccattctaccctatattcttctcaatcttggcgccctcggccgccgctataaagtctttatgggtgacgccggcagcacgatgattggcttcaccatcatctggatcctgctggaaaccacgcaaggtaaaacgcatcccattagcccggtgaccgcgctgtggattatcgctatcccgttgatggacatggtggcgattatgtatcgccgcctgcgcaaaggcatgagtcctttctcaccggaccgtcagcatattcatcatttgatcatgcgcgccgggtttacttcccgccaggcgtttgtcctgattaccctggccgccgccctgctggcgctggttggcgtcgtggcggaatacacccgcattgtgccggaatgggtgatgttaattctctttttggtagccttctttctttatggctactgtattaagcgcgcctggaaagtggcgcgcctggttaagcgcatcagacgcagaattcggcgacacagcggcaataatccgaaactaaccaagtag

SEQ ID NO: 818 - DNA, 834 bp, Klebsiella pneumoniae
cgctcgtcgccctgcttagaggttaacttttttatgtaccaggttgttgcgtctgatttagacggcacgctgctttcccccgatcatttcctgaccccgtatgccaaagagacgctgaagctgcttaccgcccgtgggatcaatttcgtcttcgccaccggccgtcactacatcgacgtcgggcaaatccgcgataatctcggcatccggtcgtacatgatcacctctaacggcgcccgcgttcacgatagcgatggtcagcaaatctttgcccataacctcgatcgcgatattgccgccgacctgtttgagatcgtgcgtaacgacccgaaaatcgtcactaacgtttatcgggaagacgagtggtatatgaaccgccatcgtccggaagagatgcgcttcttcaaggaggcggtgtttaactacaagctgtatgagccgggcgaactggatccgcaggggatcagcaaagtattctttacctgcgaggatcatgagcatctgctgccgctggagcaggcgatgaacgcccgctggggcgatcgggtgaacgtcagcttctccaccttaacctgcctggaagtcatggcgggtggggtatcgaaggggcatgcgctggaggcggtggcgaagatgctcggctacactctttccgattgcatcgccttcggcgacggtatgaacgacgctgagatgctgtcgatggctggcaaaggctgcatcatggccaacgcccaccagcggctgaaggatctgcatccggaactggaagtgatcggcagtaacgccgacgatgctgtcccgcactacctgcgtaagctatacctcgactga

SEQ ID NO: 819 - DNA, 1707 bp, Klebsiella pneumoniae
cgtgcatggcccgcgcgctgcggccaaaatggcggctttccgccagatgcagaaaggttttcagatcgcgtaaatccacggcgcgtactccccggttttgtatttcataaaatgcaacgtgacgttgtgaatatatcaatttccgcaataaaattcctgtcatatagtaagttcattctcgcaaaagcgaaccgaacaataagcacgacacaacatcacggagttacagacatggctaactactttaatacactgaacctgcgccagcagctggcacagctgggcaaatgccgctttatggcgcgcgacgaattcgccgatggcgcaagctaccttcagggtaaaaaagtggtcatcgtcggctgcggcgcgcagggcctgaaccagggtctgaacatgcgtgactccggcctggatatctcctatgcgctgcgtaaagaagcgatcgctgagaagcgcgcctcctggcgtaaagcgactgaaaacggcttcaaagtcggcacttatgaagagctgatcccgcaggccgacctggtggttaacctgacgccggacaaacagcactcagacgttgtgcgctccgtacagccgctgatgaaagacggcgcagcgctgggctactcccacggcttcaacatcgtggaagtgggcgagcaaatccgtaaagacatcaccgtggtgatggtggcgccgaagtgcccgggcaccgaagtgcgtgaagagtacaaacgcggtttcggcgtaccgacgcttatcgcggtacacccggaaaacgacccgaaaggcgaaggcatggcgattgccaaagcatgggctgcggcgacaggcggccaccgcgcgggcgtgctggagtcttccttcgtggcggaagtgaaatctgacctgatgggcgagcaaaccatcctttgcggcatgctgcaggcgggttctctgctgtgcttcgacaagctggtggcggaaggtaccgatccggcgtatgcagaaaaactgattcagttcggctgggaaaccatcaccgaagcgctgaagcagggcggcatcaccctgatgatggatcgcctctccaacccggcgaaactgcgcgcttatgcgcagtccgagcagctgaaagagatcatggcgccgctgttccagaaacacatggacgacatcatctccggcgaattctcctccggcatgatggcggactgggcgaatgatgataagaaactgcttacctggcgtgaagagaccggcaaaaccgccttcgaaaccgcgccgcaatatgaaggcaaaatcggcgagcaggagtacttcgataaaggcgttctgatgatcgcgatggtgaaagcgggcgttgagctggccttcgaaaccatggtggcctccggcatcatcgaagagtctgcttactacgaatcactgcatgagctgccgcttatcgccaacaccatcgcccgtaagcgtctgtatgagatgaacgtggttatttccgataccgctgaatatggtaactacctgttctcttacgcttgcgtaccgctgctgaaagagttcatgaccaccctgcagaccggcgacctgggcacagcgattgccgaaggcgcggtagataacgcgcagctgcgcgatgtgaacgaagcgattcgcagccacgctatcgagcaggttggtaagaaactgcgcggttatatgaccgatatgaagcgtatcgcggtagccagctaa

SEQ ID NO: 820 - DNA, 828 bp, Klebsiella pneumoniae
atgatgcagttctctaaaatgcatggccttggcaacgattttatggtcgttgacgcggtaacgcagaatgtttttttctcgccggagctgattcgccgcctggcggatcgccaccttggcgtcgggttcgatcagctattggtcgtcgaaccgccctacgatccggatctggatttccactaccggatctttaacgccgacggcagcgaagtgtcgcagtgcggcaacggcgcgcgctgttttgcccgcttcgtccggctgaaaggcctgaccaataaacgtgatatccgcgtgagtacggccaacgggcgtatggtattaagcgtaacggaagacgatctggtgcgggtgaacatgggcgagcccaacttcgagccgtcccaggtgccgttccgcgccaacaaagcggaaaagacctatatcatgcgtgccgccgagcagacagtattgtgcggcgtggtgtccatgggaaatccgcactgcgtcatccaggttgatgatgtggatacggcagcggtggaaactctcggcccggtgatggaaagccatgagcgttttccggagcgcgccaatatcggctttatgcaggtggtcggccggtctcatatccgtctgcgcgtctacgaacgcggcgcgggggaaacccaggcctgcggcagcggcgcctgcgccgcggtggcggtggggatccagcaggggctgctggcggaaacggtacgcgtggaattacccggcggtcgtcttgatatcgcctggaaaggcccgggccagccgctgtttatgaccggcccggcggcccatgtctatgatggatttattcatttatga

SEQ ID NO: 821 - DNA, 372 bp, Klebsiella pneumoniae
gggaacagtacccggttgacgaagaagccgggacaatcattcaccacgatcggcgttttgcccattttgctggcccaggccaccactttggcaatggtattatccgaggttttttcgccgcggatcacttcaaccagcggcatgcgatgcaccgggttaaagaagtgcataccgcagaagttttccgggcgctgcagaacgctggccagctcgctgatggggatcgttgaggtgttggacgccagcacggtatccgggcgcacttttgactcggtttccgctagtacggctttcttcactttcgggttttcgaccaccgcttcaacaaccacgtcgacgcgatcaaaaccgctgtattccagggttggctga

SEQ ID NO: 822 - DNA, 2226 bp, Klebsiella pneumoniae
tcaccagtcactctgtatatattaacaggggttcgtggaaccccttctcttccggcggtgccaatggacgtttcttacctgctcgacagccttaatgacaaacagcgtgaagccgtagcggcctcgcgcaccaatatgctggttctggcaggggcgggcagtggtaagacgcgcgttctggtgcaccgtatcgcctggctgctgagcgtggagaactgttccccgtattccattatggcggtgacctttaccaacaaagcggcggcggagatgcgtcaccgtatcggccagctgatgggcaccacccagggcggcatgtgggtgggcaccttccacggcctggcgcaccgtttgctgcgcgcgcaccatctggatgccaacctgccgcaggactttcaaatcctcgacagcgaagaccagctgcgtctgctgaagcgtctgattaaggcgatgaacctcgatgagaaacagtggccgccgcgccaggcgatgtggtacatcaacagccagaaagatgaagggctgcgcccgcatcatattcagagctacggcaatccggtcgagcagacctggcagaaggtctatcaggcctatcaggaagcctgcgaccgcgccgggctggtggacttcgccgagctgctgctgcgcgcccacgagctgtggctgaacaaaccgcatatcctgcagcactaccgcgagcgcttcaccaatatcctcgtcgatgaattccaggataccaacaacattcagtacgcctggatccgcctgctggcgggcgataccggcaaggtgatgatcgtcggcgatgacgatcagtctatctatggatggcgcggcgcgcaggtcgagaacattcagcgcttccttaacgacttccccggcgcggaaaccatccgcctggagcagaactatcgctcgaccagcaatattcttagcgctgccaacgccctgattgaaaacaacaacgggcgcctgggcaaaaagctgtggaccgacggcgccgacggcgagccgatttcgctgtactgcgccttcaacgatctcgacgaagcgcgctttgtggtgaaccgaattaaaacctggcaggagaacggcggcgcgctggagcaatgcgccattctctatcgcagtaacgcccagtcgcgtgtgctggaagaggccctcctgcaggccagcatgccgtatcgtatctacggcggcatgcgcttcttcgagcgtcaggaaatcaaagacgcgctctcttacctgcgccttatcgccaaccgcaacgacgacgcggcctttgagcgcgtagtcaatacgccgacccgcggcattggcgaccgcacgctggacgtggtgcgccagacgtcgcgcgatcgccagctgacgctatggcaggccagtcgcgagctattgaaagaaaaagcgctggccggtcgcgccgccagcgccctgcagcgctttatggagctgattgacgcgctggcgcaggagaccaccgatatgccgctgcacgttcagaccgatcgggtgattaaagactccggcctgcgcgcgatgtacgagcaggagaaaggcgagaagggccagacccgtattgaaaacttagaggagctggtgacggcgacgcgccagttcagctacaacgaagaagatgaagatctgatgccgctgcaggcgttcctctcccacgccgcgctggaagcgggcgaggggcaggcggacacctggcaggacgcggttcagctgatgaccctgcactcggcgaaagggctggagttcccgcaggtgttcatcgtcggcgtcgaagaagggatgttcccgagccagatggcccttgatgaaggcggccgcctggaagaggagcgtcgcctggcctacgtcggcgtaacgcgcgccatgcagaagctgacgctgacctatgcggaaacccgccgtctgtacgggaaagaggtttatcaccgcccgtcgcgctttatcggcgagctgccgcaggagtgcgtagaagaagtgcgtctgcgggccacggtgagccgcccggtaaaccatcagcgactgggcgcgccgattgccgagagcgataccggctacaagttaggccagcgcgtacggcatccgaagtttggcgaaggcactattgtcaacctcgaaggcagcggcgagcacagccgactgcaggtggcttttcagggccagggaatcaaatggctggtggcggcttacgcccggctggaggcagtgtaa

SEQ ID NO: 823 - DNA, 1206 bp, Klebsiella pneumoniae
cctttatccacgtgccgccgggccgcgccaaccgtaccggttggtatctgtacaaccgcgcgccggacatggaatcgatcatcagccatcagcccgctggaatataaccgttatcttaataaactggtggcctgggcctggtttaacggcctgctgacctcacgcacccgcctgtttattaagggcaacggcatcgtcgatctggcgaagctgcaggagatggtggccgacgtgtcgcaccacttcccgctgcgcctgccggcgccgacgccaaaggcgctgtacagcccgtgcgaaatccgccacctggcgattatcgtcaacctcgaatatgacccaaccgcggccttccgcaaccaggtggtgcacttcgatttccgtaagctggatgttttcagcttcggcgaagagcaaaaatgcctgatcggcagcgtcgacctgctgtatcgcaactcgtggaacgaagtgcgtacgctgcactttaacggcgagcaggcgatgatcgaggcgctgaaaacgatcctcggcaaaatgcaccaggacgccgcgccgccggacagcgtggaggtgttctgctatagccagcacctgcgcggcctgatccgcacccgcgtgcagcagatgatctccgaatgtatcgaactgcgtctctccagtacccgccaggataccgggcgcttcaaagcgctgcgcgtctccggccagacgtgggggctgttcttcgagcggcttaacgtttcggtgcagaagctggaaaacgccattgagttctacggcgctatctcgcacaacaagctgcacgggctgtcggtgcaggtggaaaccaatcacgttaagctgccggcggtggtggatggcttcgccagcgaagggattattcagttcttctttgaagacgcggataacaacgacagcggctttaacatctatattcttgatgagagcaaccgcgccgaggtctatcatcactgcgagggcagtaaagaggagctggtgcgcgacgtcagccgcttctattcgtcatcgcacgatcgtttcacctacggctccagctttatcaacttcaacctgccgcagttctatcagattgtcgaggtagacgggcgcacccaggtgatccctttccgcactcaggcgattgccgccgcgatacccaccagccaggacgttaccgcctcgccggtgctgcagcagcgctactcgtag

SEQ ID NO: 824 - DNA, 1347 bp, Klebsiella pneumoniae
aggccgttaacaggcatggaagttcctgccataccattcacaacattaagttcgagatttaccccgagtttaagaacccacaccactatgaatcttaccgaattaaagaatacgccggtttctgagctgattactctcggcgaaaatatggggctggaaaacctggctcgtatgcgtaagcaggatattatttttgccatcctcaagcagcattcgaagagtggcgaagatatctttggcgacggcgtactggagatactgcaggatggatttggattcctccgctccgcagacagctcctacctcgccggccctgacgacatctacgtatcccccagccaaatccgccgtttcaacctccgcactggtgacaccatttccggtaagattcgtcctccgaaagagggtgaacgttactttgcgctgctgaaagttaacgaagttaactacgacaagccggaaaacgcgcgtaacaagatcctgttcgagaacttaacgccgctgcacgcgaactctcgcctgcgtatggagcgtggtaacggttctaccgaagacttaaccgctcgcgtactggatctggcctccccgattggccgcggccagcgtggtctgatcgtcgcgccgccgaaagccggtaaaaccatgctgctgcagaacatcgcgcagagcatcgcatacaaccacccggactgtgtcctgatggtactgctgatcgacgaacgtccggaagaagtgaccgagatgcagcgtctggtgaaaggtgaagtggttgcttccacctttgacgagccggcatcccgtcacgtgcaggttgccgagatggttattgagaaagcgaaacgtctggttgaacacaagaaagacgttatcatcctgctcgactccattacccgtctggcgcgtgcctacaacaccgtggttccggcttccggtaaagtgttgaccggtggtgtggacgccaacgccctgcaccgtccgaagcgtttctttggtgcggcacgtaacgtcgaggagggcggtagcctgaccatcatcgccacggcgctgatcgacaccggttccaaaatggacgaagttatctacgaagagtttaaaggcaccggtaacatggaactgcacctctctcgtaagattgctgaaaaacgcgtcttcccggctatcgactacaaccgttccggtacccgtaaagaagagctgcttaccactcaggaagagctgcagaaaatgtggatcctgcgcaaaattatccatccgatgggtgagattgatgcgatggaattcctcatcaataagctggcaatgaccaagacgaatgatgacttcttcgatatgatgaagcgctcgtaa

SEQ ID NO: 825 - DNA, 483 bp, Klebsiella pneumoniae
ttcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccggccgtcacaccatgggagtgggttgcaaaagaagtaagtag

SEQ ID NO: 826 - DNA, 786 bp, Klebsiella pneumoniae
gcgcgtaaaaccgctttcgcaaccgcaagtctgagaaggatggacatgactgggaccatttccgcgccgttgtacctgttaagagggctgcagctcataggctggcgcgatatgccgcacgctctggattatttgtttgccgacggcgcgctccgggaggggacgctggtgcccattaatgctgagaaaatgctggccgtagaagataacccggaggtacgggcgctgattgaggcggcggagtttaaatatgccgatggcatcagcgtggtgcgttcgctgcgcaaaaaatacccgcaggcccaggtatcccgcgtcgccggggccgatctctgggaagcgttaatgcagcgcgctggcgctgaagggacaccggtgtttttggttggtggtaaacctgaggtcctggcgcagacagaatccaggctgcgtcagcgctggcaggtgaacatcgtcggcagccaggacggttatttcacccctgagcaacgccaggcattgttcgaacgcattcgcgacagcggggcgaaaatcgtcaccgtcgcgatggggtcgccgcgccaggagatcttcatgcgcgactgccggcgcctgtatccgcacgcgctgtatatgggcgtcggcggcacttacgatgtttttaccgggcacgtccatcgggcgccgaagttctggcaggatctggggctggagtggttctatcgcctgcttttgcagccgagccgcatcaagagacagttccgcctactgcgctatttacgttggcattattccggtaagctctga

SEQ ID NO: 827 - DNA, 2229 bp, Klebsiella pneumoniae
tcgaagctgacgccccgctccagtttggcgaggatctccagcgccagtttctcttctttgaccaggatatgcagggccgctgcgctttttgccatgacatcattctcaggatggtttgtgtggctgacactttaccatcagtcagtaaatctcggctccgctttctgctacaatccccaccccgttcgaagattgagcaagactcccatgcgtttaaaccctggccaacaacaagccgtcgaattcgtcaccggaccgtgcctggtgctggcgggcgccggttccggtaagacccgcgttattacgaataaaatcgcccacctgatccgcggctgcggctatcaggcgcgccatatcgcggccgtgacctttaccaacaaagccgcgcgcgagatgaaagaacgcgttgggcaaacgctggggcgcaaagaggcgcgtggcctgatgatttccaccttccacactttggggctggatatcattaagcgcgaatacgctgcgctgggtatgaagtctaacttttccttattcgacgataccgaccaggtggcgctgcttaaggaactgaccgaaggattgatcgaagatgacaaagtggtgcttcagcagctgatctcgacgatctccaactggaaaaacgatctaaaaaccccggcgcaggccgccgctggcgcaaaaggcgaacgggatcgtattttcgcccactgctatgggctatacgacgcgcacatgaaggcctgcaatgtcctcgattttgacgatctgatcctgctgccaacgctgctgctgcagcgcaacgaggaggtgcgcgagcgctggcaaaataagatccgctacctgctggtggatgagtatcaggataccaataccagccagtatgagctggtgaaactgctggtgggtcagcgggcgcgctttaccgtggtgggcgatgacgaccagtcgatctactcgtggcgcggcgcgcggccgcagaacctggtgctgctcagccaggacttcccggcgctgcaggtgatcaagcttgagcagaactaccgctcatccgggcgtattctgaaagccgccaacattttgatcgccaataaccctcacgtctttgaaaagcggctgttctccgaactgggatatggcgcggagctgaaagtgctctccgccaacaatgaagatcatgaagcggagcgcgtggccggggagctgatcgcccaccacttcattaataaaaccaattacaaagactacgcgatcctttatcgcggcaatcaccagtcgcgggtctttgaaaagatgctgatgcagaaccgcatcccgtacaaaatctccggcggcacgtcgttcttttcgcgtccggaaattaaagatctgctggcctatctgcgcgtgctgaccaacccggacgacgacagcgccttcctgcgtatcgtcaacacgccgaagcgcgagatcggcccggcgacgctgcaaaagctcggtgagtgggcgatgggccgcaacaaaggattgttcaccgccagctttgatatgggtctcagccagacgctgaccgggcgcggctatgaatctctcacccgcttcacccactggctacgcgagatccagcagctggccgaacgcgagccggtcaacgccgtgcgcgatttgattcgcgggatcgactacgaatcctggctgtatgaaacctcgcccagcccgaaagccgcggaaatgcgcatgaaaaacgtcaaccagctgtttacctggatgaccgagatgctggaaggcagcgaaatcgatgagccgatgaccctgacccaggtggtcacccgctttaccctgcgcgacatgatggagcgcggcgaatcggatgaagagctggatcaggtgcagctgatgactctccatgcgtcaaaggggctggagttcccctacgtttatctggtgggaatggaagagggattgctgccgcaccaaagcagcattgatgaagataacgtcgatgaagagcgccgcctggcctacgttggcatcacccgtgcgcagaaagagctgacctttacgctctgtaaggagcgccggcaatatggcgagctggtgcgtcctgaaccgagtcgttttctgctggagctccctcaggacgaccttatctgggagcaggcacgcaaaaccattacgcctgaagagcggatgcaaaaaggccaggccaacgtcgctaatattcgggcgatgctggcaaaggcgaaaaaagcttag

SEQ ID NO: 828 - DNA, 909 bp, Klebsiella pneumoniae
acgcgcatgaccgattctcctctcttctccgccgtcgcccgctttcttcgccatcttggcgttgaacgccagctcagcccgatcacgttactgaattaccagcgacagctggacgcgctgatcgccctggcggatgaggcgggcctgaaaagctggtcgcagtgcgatgccgctcaggtgcgaagctttgcggtgcgtagtcgccgcgcggggttaggcccggcaagcctggcgcttcgcctgtcggcgttgcgcagtttcttcgactggctggtcggccagggcgagctcagcgccaatccggcgaaggggattgccgcgccgaaaattccccgccacctgccaaaaaatattgacgtcgatgatgtcaatcgactgctggatatcgatctcaacgatccgctggcggtgcgcgatcgggcgatgctggaggtgatgtacggcgcgggattgcgtttgtccgaactggtcaacctggatatcaaacacctcgatctcgaaagcggtgaggtctgggtgatgggcaaaggcagtaaggagcgtcgtttgccgatcggtcgcaacgcggtggcatggattgagcactggctggatttgcgcggcctgttcggtaccgatgacgacgcgctgtttttgtcgaagctgggcaaacgtatttcggcgcgcaacgtacagaagcgattcgccgagtggggcattaagcaggggctgaacagccatgtgcacccgcacaagctgcgccactcctttgccacccatatgctggagtcgagcggcgatctgcgcggcgtgcaggagctgctggggcatgctaacctctccaccacccaaatctatacccatcttgattttcaacaccttgcctcggtgtacgatgccgcgcatccgcgcgctaaacgggggaaataa

SEQ ID NO: 829 - DNA, 1083 bp, Klebsiella pneumoniae
acgggcatgacagcactgatacatgtactgggatcggatatcccgcatcataaccagaccgtactgcggttctttaacgacgaactggccgccgacccgcaggccaggagatttatgatcgtcggtgatgaggccagcgtgcgtgatgggtatccggcgctggatgtcacctgttatccggggaaaaaggcgctggcgcaggcagtgattgctaccgcgaaagccaaccgccagcagcgctttttcttccacggccagtttaataccgggctgtggctggcgttgttgagcggtggcatccgcccgtcgcagtttaactggcatatctggggggcggatctgtatgaaaattctgccagcctgaagtttcgcctgttctatccgctgcgccgtatggcgcaggggcgggtagggcgcgttttcgccacccgcggcgatctcagctggttcgctaaccgccatccgcgcgtcccgggcgagctgctctacttcccgacccgtatggatccggcgctgaataccctggccgataacgctccgcgcggtgataccctgactattctggtgggcaactccggggatcgcagcaatgaacatattgccgcgctgaaggcaatccatcagcaatttggcgatacggtaaacgtcatcgtgccgatgggctatccagcgaaaaacgacgcctatatcaatgaggttcgcgaggcgggggcggcgctgtttagcggtgagcatctgcagatcctcagcgagaagctggagtttcatgattatctggcgctgctgcgccgctgcgatctgggctattttctgtttgcccgccagcaggggatcggcaccctgtgtctgctgattcaggcgggcatcccctgcgtgctcaatcgggaaaacccgttctggcaggatatggccgagcagcatgtgccggtgctgttcaccagcgacgcgctggacgtcagcgtggtgcgcgaagcgcagcgtcagctggcgagcgtggataaatccgctatcgccttcttccggccgaactatctgacgggctggcggcgggcgctacggttagcggcggaggggcaggcatga

SEQ ID NO: 830 - DNA, 855 bp, Klebsiella pneumoniae
atcatcacgacaaataattttgtggagaacggtgtggatacggaattgctcaagactttcctggaagtgagtagaactcgtcactttgggcgagcagcagaggcgctttacctgacacagtcagcagtcagctttcgtattcgtcagctggaaaatcaacttggtgtgaatctgttcacccgtcatcgtaataacatccgcctgacgactgccggcgaaaagctcctcccctatgccgaaacgctcatgaatacctggcaggctgcgcgcaaggaggtggcacactcttcgcgacataatgaattctccattggggccagcgcctccctgtgggaatgtatgcttaacagctggctcggtaccctctacagcgcaccttacaatctccagtttgaagcccgtatcgcgcagcggcagtcgttggttaaacagcttcacgaacgccagttggatctgctgatcaccaccgaatcgccgaagatggatgaattaagcagccagctgttgggtaattttactcttgccctgtattgcgcatcgcctgcaaaaaacagaaatgaattgaattacttgcgccttgaatgggggcctgattttcagcaaaacgaagtgggactgataggaagcgatgatgttccgctgctcactacctcttcagctgaactgatctatcagcaattatcgcgcctgaacggctgctgttggctacctgttcgctgggcgaaagagaagcatgggttacatacggtcatggacagcgctacgttatcccgtccactttatgcgatctggttacaaaatagcgataagcaggcgcagatccatgagatcctgaaaaaccctattctggaataa

SEQ ID NO: 831 - DNA, 1665 bp, Klebsiella pneumoniae
ctctgttttgcgatcaaacgtccattttcggctaaatgtaacgatatgccgcgaaaagtatggatacgcagttctaaattcgcactttttccattctcgctttacgtcatgccaaccataattcttctctgtccaggaggttttatgtcgctcgctatcgtctatactcgcgcggcgctcggtatcgaagcgccattgattaccgttgaggttcatctcagcaacggtcttcctggtctaactatggtcgggctgccggaaaccaccgtgaaagaggcccgcgaccgggtccgcagcgccctgatcaacagcggctacgcttttcctgcgaagaagataaccattaacctggcgccagcggatctgcccaaagaaggcggacgatacgatctgcccatcgctctcgcgcttctcgttgcctcagagcagctcaacacgacgcgactgaatcaatatgagtttgtgggcgaactcgcccttacaggtgggttacgaggcgttccaggggcaatccccagcgcaatggaggccatcaaagccggccggcgcattgtcgtctcctctgacaatgcggcggaggtcggcctgatcggcggcagcgattgtctggtcgccgaccatctgcaggaggtttgcgcatttcttgcggggcagacatcgctttcaccgcctctcgccgaggcgcctgctcgggatgaacgctacgaagatctgctcgatgttatcggccagcagcagggcaaacgagcgctggagattgtggccgccggtggtcacaacctgctcctgataggcccgcccgggaccgggaaaaccatgctagccagccgactccccggtctcctgccgccattaagcaatcaggaagcgctggagagcgcggccatacagagtctggtcaacctccacaccgcaaagacgcggtggcgtcagaggccgttccgcgccccccaccatagcgcctcgctggcagcgatggtgggcggcggctcgataccggtccccggtgagatttccctggcccataatggcgtgctgtttcttgatgaactgccggagtttgagcggcgggtactggatgcgctacgcgaacccattgagtcaggcaagatccacatatcacgctcgcgcgccaaaatagaatatccggcgcgctttcagcttattgcagcgatgaatccaagcccgacaggacattatcagggtaaacataatcgtgcatcgccggagcagacattgcgctaccttggacgcctgtcaggccccttcctcgaccgcttcgatctttccttagagatcccattgccaccgccaggaatactgagtcagggctcgcagggcgaagaatcgagcgcaacggtccggcagcgggtgctggcggcgcgtgaacgacaaatgctcaggcaaaataaactcaatgcccatcttgagaatcgtgaaatgaagaactgctgtcgcttaaggcgggaggatgctgtctggctggaacagacgctaacgcagctggggctttctattcgcgcctggcagcgtctgttaaaggttgcgagaaccattgccgatctggcagaggttgaagagattgaacgctgtcatttgcaggaggcgctcagctatcgggcaatagatcggatgctcaaccatctgcagaaaatgatggcgtaa

SEQ ID NO: 832 - DNA, 396 bp, Klebsiella pneumoniae
catccgactgcgcgcgcttttgtttcgcgctatactgcgacccatcttcaaaaatcaaaaaagcagaatcaaattatgaacgacagtgaattccatcgcctggccgatagcctgtggatgaccatcgaagaacgtctggacgactgggacggcgatagcgacatcgactgcgaaatcaacggcggcgtgctgaccatcagctttgaaaacggcagcaaaatcattattaaccgtcaggagccgctgcaccaggtgtggctggccaccaaacagggcggctatcacttcgatctcaaaggcgacgagtggatctgcgatcgcagcggcgaaaccttctgggatctgctggagcaggcggcgagccagcaggccggtgagacggtgaaattccgttaa

SEQ ID NO: 833 - DNA, 1275 bp, Klebsiella pneumoniae
tcaggtaacgctatgagtttttctaccatttcagtgattggccttggctatatcgggctgccaaccgctgccgcgttcgcctcccggcagaagcgggtggtcggcgttgatgttaatcaacatgccgtggagaccattaaccgtggagagattcatatcgtggagccggatctggcgagcgtggtgaagaccgcggtcgagcaggggtatttaagcgccaccaccaccccggtggaggcggatgcttacctgattgccgtgccgacgccgtttaaagatcgccacgagccggatatggtgtttgtcgagtcggccgccaaatccattgcgccgacgttaaagaaagggtcgctggtgatcctcgagtccacttcgccggtcgggtcgaccgaacagatggccgagtggctggcggagatgcgcccggatcttagcttcccccagcaggtgggtgaagcggcggacgtgaatatcgcctactgcccggagcgggtattgcccggtcaggtgatggtcgagctgattaaaaacgaccgcgttatcggcggcatgtcgccggtctgctccgctcgcgcctgcgagctgtataaaatcttccttgaaggcgaatgcgtggtgaccaactcgcgcaccgccgagatgtgcaagctgacggaaaacagcttccgcgacgtcaacatcgcttttgccaacgaactgtcgctgatttgcgccgaccaggggattaacgtctgggagctgatccgcctggcgaaccgccatccgcgcgtcaatatcctgcagccgggcccgggtgttggcggccactgtatcgccgtcgacccatggtttatcgtggcgcaaaacccgcagcaggcgcgtctgatccgcaccgctcgcgaggtcaacgaccacaagccggaatgggttatcgagcaggtgaaagcgcaggtggcggactgcctgaatgccaccaacaagcgggccagcgaactgacgatcgcctgttttggcctcgcttttaaaccgaatattgacgacctgcgcgaaagtccggcgatggaaattgccgcgcagattgcccgctggcacagcggcacgacccaggtggttgagcccaacattcacgcgctgccgaagaaactcgatggactgtgtacgctggcgacccttgaggcggcgctggccagcgccgatgtgctggtgatgttggtcgatcataaccaatttaaagccgttagcggcgatagcgtcacccaggcgtttatcgtcgacaccaaaggagtgtggcggtga

SEQ ID NO: 834 - DNA, 843 bp, Klebsiella pneumoniae
tcgaggccagcatgttcgtgcagaccgtcgagaagcgccagggctttaaaatcgcctgtctggaagagatcggctggcgtaacggctggctggacgacgacggcgtcaaatgtgcggcgaagcggctggaaaaaaccggctacggccaatatctgctggatctgctccgtgcccgtccgcgccagtattgaccccctggagtgggagaaccgcttctttgccgtgaacagcgcgatcgtgcgctttgacgagcacgcgccgcggctgacgcctgaggcgctggcggggtggtcgcgagtgcaggcgaagatcgccgccagcgacaccgtccggctggacgcgctgcagcggctgggttttcagctggtggaaggtgaggtcgatctggcgctgccggtgggcagccctgcagatgccggcgcagacgtcgccgtggaagcggatattgcgccgctgcgcgagcaggcggcgcaggcatttgccatgagccgctttcgcgcgccctggtacgctgccgacgccagcggccgcttctatgcccagtggattgaaaatgcggtgcgcggcaccttcgatcatcagtgcctgatttaccgccatcctgagggcgatattcgcgcctttgtctccctgcggcagatcactgcgaccgaagcgcgtatcggcctgctggccggacgcggcgccggggcgcagttgatgcaggcggcgcggtactgggccgcctcgcgcggactttctacactgcgggtggcgacccagatgggcaacaccgccgcgcttaaacgttatattctcagcggtgctaacgtggaaagcaccgcctactggctatacaggtga

SEQ ID NO: 835 - DNA, 1062 bp, Klebsiella pneumoniae
tacgtgaaagcttttattctcctcgcatcaagccacactgacacatatcgcaaggaaaatatcatgcgcggaaaaattgctttagaagaacacgtatccactcctgaaaataaccgtctgtgggattcatctggtgaagcaggtcgtaacggcacagaatatatgaaagatgtcgaacgccgcctgctggatcgcagcattcagctggaagaaatggcgcagcgtcatattgatcatgtaattctttctctgacttcacctggcgcccagtctattttagataaagccaaagccgtctcttttgcccgcgataccaacgattttatcgttgagaattatgttaagccaaatccggacaaattcagcgccttcgccaccctggcattgcagaacccggaagccgcggcggaagagctggagcgcgccgtgaaaaagttaggcatgaaaggtgcgctgatcaacggctacaccaacgttaaagatagcgagcatggcctgtatcttgatgacgaatccatgctggtattctgggataaggtcaacgagctgaacgtgcctgtctatctgcatcctcgtgaaccgctggaaggcccggcgcgtggcatctataccggttacgaaagcctgatcggctctgcctggggcttcgctcaggaaacggcagtgcatgctattcgtctgatgatgagcggtctgttcgatcgttatcctaacctcaatctggtgctgggtcacctcggcgaagggctggtacatatgctgccgcgcactcaacatcgtctctatcgtcagcgtttcggctgcggtctgggtaaagcggaaaaaccgttaatgcactacctgcagaataacttcatcgttaccaccagcggccatttcaatacccattcactgaataatgctattgaagtcatgggcgccgatcgcgtgatgttctctgtcgattatccgtatgaagatattcatcaggcctgcgactggtttgatcctttagaacttgaagcaggcctgaaagagaaaatcgcctggggtaatgccagccgcgtatttaacattaaataa

SEQ ID NO: 836 - DNA, 1068 bp, Klebsiella pneumoniae
ccaagtagagctggggatgtgatgactcaaccattaccgggagcacaagcagtgaacgttgagaacgagctggatattcgcgggctgtttcgcgctttatgggcaggaaaaggctggatagtcggcggcgccgtactcttcgccgccatcgtgctggtgtacaccttctttgctcgccaggagtggagcgccacggcgatcaccgatcggcctactgtcaatatgttggggggatactattcccaacagcagttcttacgcaatctggacattaaagccgacctcgcctcggtcgaccagccttccgccatggatgaagcgtataaagagttcatcatgcagctggcctcctgggatacccggcgcgatttctggctgcaaacggactactacaagcagcgtcagtcgggtaatgcccgcgctgatgcggcgatgctggatgacctgattaacaatatccagtttatgccaggcgatgcggccaagagcattaacgacagcgtcaaactgaccgccgagaccgggcaggatgccaataatctgttgcgtcagtatgtggccttcgccagccagcgggcggcaggccatcttaacgacgaacttaaaggcgcctgggcggcgcggacggtgcagatgaaggcgcaggtgaagcgccaggaagaggtggccgaggccatcttcaaccgccggacgcacagcgtggagcaggcgctgaaggtggctcagcagcacaatatttcacgtagcgaaacggatgttcctgccgatcagttgccggattcagagctatttttattgggcaggccgatgctgcaggccaggctggaaaacctgcaggccgtcgggccggaatatgacctcgattacgaccagaaccgcgccatgctgagcacgttgaacgtcggtccaacgttagatccgcgttttcagacttaccggtatttgcggacgccggaagaacctgtaaaacgcgatagcccgcgccgtgtatttctgatggtgatgtgggggattgtgggtgcgctcatcggcgcaggcgtggcgttatcgcgtcgtcgtgtcctgtga

SEQ ID NO: 837 - DNA, 861 bp, Klebsiella pneumoniae
agccgcagagcacagagaagagtaataccgccaaccgcccgtcagggcggttggcatatgggagcgatcatgtttgatatcggcgttaatctgaccagttcgcagttttcccgcgatcatgatgaggtagtggcgcgcgccctggcggcgggggttaacggcatgctgctgaccggcacaaatttggcggagagccagcaggcgcagaaactggcgagccgctattccggctgctggtccacggcgggggttcatccccatgacggtagcagctggacgccagcggtcgccgaggcgatttataccctcgccggcgagccgcaggtggtggcgataggcgagtgcggtctggattttaaccggaatttttccacgccgcacgagcaggaggtagcgttcagcgcccagttggcgctggccgctgagctgtcgatgccggtgtttttgcactgccgcgacgcccacgatcggtttctgacgctgcttaaaccctggcttgagaagctcccgggcgcggtgctgcactgctttaccggcagccgcagcgaggtgcaggaatgcctggatctgggcctgtttatcggtattaccggttgggtttgcgatgagcggcggggactggagctgcgcgagctgctgccggcgatcccggcggaacgtctgctgctggagaccgatgcgccttatctgctgccgcgcgatctcaagccgaaaccggcctcgcggcgtaacgagcccgcgtatttgccgcatatcctggccagcgtcgcggcctggcgcggcgaggaggcgcaatggctggaggcgcaaacggacgcaaacgtcagggcgctgtttggcgtcgacattaacggcgtttag

SEQ ID NO: 838 - DNA, 1350 bp, Klebsiella pneumoniae
cgtcagctggcgatcgcgcgacgtctggcgcaccacgtccagcgtgcggtcgccaatgccgcgggtcggcgtattgactacgcgctcaaaggccgcgtcgtcgttgcggttggcgataaggcgcaggtaagagagcgcgtctttgatttcctgacgctcgaagaagcgcatgccgccgtagatacgatacggcatgctggcctgcaggagggcctcttccagcacacgcgactgggcgttactgcgatagagaatggcgcattgctccagcgcgccgccgttctcctgccaggttttaattcggttcaccacaaagcgcgcttcgtcgagatcgttgaaggcgcagtacagcgaaatcggctcgccgtcggcgccgtcggtccacagctttttgcccaggcgcccgttgttgttttcaatcagggcgttggcagcgctaagaatattgctggtcgagcgatagttctgctccaggcggatggtttccgcgccggggaagtcgttaaggaagcgctgaatgttctcgacctgcgcgccgcgccatccatagatagactgatcgtcatcgccgacgatcatcaccttgccggtatcgcccgccagcaggcggatccaggcgtactgaatgttgttggtatcctggaattcatcgacgaggatattggtgaagcgctcgcggtagtgctgcaggatatgcggtttgttcagccacagctcgtgggcgcgcagcagcagctcggcgaagtccaccagcccggcgcggtcgcaggcttcctgataggcctgatagaccttctgccaggtctgctcgaccggattgccgtagctctgaatatgatgcgggcgcagcccttcatctttctggctgttgatgtaccacatcgcctggcgcggcggccactgtttctcatcgaggttcatcgccttaatcagacgcttcagcagacgcagctggtcttcgctgtcgaggatttgaaagtcctgcggcaggttggcatccagatggtgcgcgcgcagcaaacggtgcgccaggccgtggaaggtgcccacccacatgccgccctgggtggtgcccatcagctggccgatacggtgacgcatctccgccgccgctttgttggtaaaggtcaccgccataatggaatacggggaacagttctccacgctcagcagccaggcgatacggtgcaccagaacgcgcgtcttaccactgcccgcccctgccagaaccagcatattggtgcgcgaggccgctacggcttcacgctgtttgtcattaaggctgtcgagcaggtaagaaacgtccattggcaccgccggaagagaaggggttccacgaacccctgttaa

SEQ ID NO: 839 - DNA, 915 bp, Klebsiella pneumoniae
acggcaatggcggaaacggcgacccctcatgatgcgatatttaaaacttttctctcacgggtagagacggcgcgcgattttatcgagctccacctgcctccgtcgttaacacagatctgcaaactggacaccctgcgtctggaatccggcagctttctcgaagacgatctcaggccttactacagcgatatactttattcgctggaaaccacccgcggtgcgggctatgtccatgttctgatcgagcaccagagcgcacccgataagctgatggcctttcgcttaatgcgctatgccatcgccgccatgcagcggcacctggagagcggccataaaacgctgccgctggttatccctattctcttctatcagggacgacgcagcccctatccctggtcgatgcgctggctggataattttgccgatcctgagaccgccagccagctctatagcggagcgtttccgctggtcgatatcacggtgatccccgacgacgacatcatgcagcaccgcagcatggcagccctgacgctggtgcaaaagcacatccgccagcgcgatatggcgcaattgctggataagttgacccacctcttaatgctggagcagatgagcggacaacaaatcaccgtattggtaaactatatggctcaggcaggggatgccgaagatactcggacactcttgtacgggctggcacagcgcgtgccgcagcatggaggattactgatgacgctggcggaaacatggcttgcagaaggtatggagaaaggcgtacagcagggcataaaagaaggtaaacaccaggctctggtgcaggttgccgaagcgatgcgcagtcgcggtattgatgaccaggcgattatggaaatgaccggtctgtctgaagacgagctgcagcggcttcgccactga

SEQ ID NO: 840 - DNA, 1689 bp, Klebsiella pneumoniae
cataaaattctgtttctcccgatttatgacggggaactaactatgaatggcgcgcagtgggtggtacatgctttgcggacacagggagtcgacacagtttttggctatccgggtggcgcaattatgccggtttacgatgcactgtatgacggcggcgtggagcacctgctgtgccggcatgagcaaggggcagccatggcggccattggttatgcgcgagcaaccggtaaaaccggggtgtgtatcgcgacgtccggcccgggcgcgaccaatctgatcaccggcctggcggacgccctgcttgactctattcccatcgtagctatcaccggccaggtggccgcacccttcatcggcacggatgcgttccaggaagtagacgttctcggtttgtcactggcctgtactaagcacagtttccttgtgcagtctctggacgaactgccgcgggttattgccgaggctttccaggtggcaaactcaggccgtccaggtccggtgctggttgatatccctaaggatattcagatggcgcagggcgacctcgatccccatttctctaccgtcgccgatgagatggcatttccgcaggcggaagtggcgcaggctctgcagatgctggcccaatcgcagcaaccgatgctgtatgttggcggcggggtcggcatggcgcaggcggtaccggctttgcgcgaattcctggcggtgaccaggatgccggcaacctgcaccctgaaagggctgggcgtggtggatgctgattatccctattatctcggcatgctgggaatgcacggcactaaggcggccaacctggcggtacaggagtgcgatctgctgatcgccgtcggcgcgcgttttgacgatcgcgtaaccggtaagctcaataccttcgcaccgcatgccaaagtgatccacatggacatcgatccggcggagctgaacaagctgcgtcaggcgcatatcggtctgacaggcgatctgaactgcctgctgccggcgctgcagcagccgttagctatcgatggctggcgcgagcggagtgccgcactgcgtgccgagcatgcctggcgttacgatcatcccggtgaggcaatctacgcgccgctgctgctgaagcagctttccgaccgcaagccggcggacagcgtggtgaccaccgacgttggccagcaccagatgtggtcggctcagcatatgacctatacccgcccggaaaactttatcacctccagcggcttaggcaccatgggctttggcctgccggccgccgttggcgcccaggtggcgcgccctaacgatacggtgatctgtatctccggtgacggctccttcatgatgaatgtacaggagctgggcaccgttaaacgcaagcagttaccgctgaagatcgtgttactcgacaaccagcggttagggatggttcgacaatggcagcagctgtttttccaggaacgttatagcgaaaccactctgactgataaccctgatttcctcacgctggccagcgccttcggtattcctggccaacacatcacccgtaaagaccaggttgaagcggcactcgacaccatgctttcgagccaggggccatacctgcttcatgtctcaatcgacgaacttgagaatgtctggccgttggtgccgcccggcgccagtaactctgaaatgctggagaaattatcatga

SEQ ID NO: 841 - DNA, 1284 bp, Klebsiella pneumoniae
ctgatattctaccacactatgagcaaaacacatttaacagaacagaagttttccgacttcgccctgcacccggcagtcattgaagcccttgaaaagaaagggtttcataattgcacacccattcaggccctcgcccttccgctgacgctggaaggccgcgatgtcgccgggcaggcgcaaaccggtaccggtaaaacgatggcgttcctgacgtcaacgtttcattatcttctctctcacccggctatcgccgatcgccaggttaaccaaccgcgcgcgctgattatggcgccgacgcgtgaactggcggtacagatccacgccgacgctgaaccgctggcgcaggccaccggtctgaagctgggtctggcttacggcggcgacggttacgataagcagttgaaagtgctggaaagcggcgtcgatattctgatcggcaccactggtcgtctgatcgattacgcgaagcagaaccacattaacctcggcgccattcaggttgtcgtgctggacgaagccgatcgcatgtacgatctcggctttattaaagatatccgctggctgttccgccgcatgccgccggccactcagcgcctgaacatgctgttctccgcgaccctttcttatcgcgtccgcgaactggcgttcgaacaaatgaataacgccgagtacgttgaagtcgagccggaacagaaaacgggccaccgtattaaagaagagctcttctacccgtccaacgaagaaaaaatgcgcctgctgcagacgctgctggaagaagagtggcccgatcgcgccatcgttttcgccaataccaagcaccgctgcgaagatatctggggccatctcgccgccgacggccatcgcgtaggtctgctgaccggcgacgtggcgcagaaaaaacgtctgcgcattctcgaagaatttacccgtggcgacctcgatattctggtcgcgactgacgttgccgctcgtggtttgcacattccggccgtgacccacgtctttaactacgatctgccggacgactgcgaagattacgttcaccgcatcggccgtaccggtcgcgctggcgccagcggtcactccattagcctcgcctgcgaagagtatgcgctgaatctgccggcgatcgaaacctatattggtcactcaattccggtcagtaagtacaacccggacgcgctgatgaccgacctgcctaagccgctgcgtctgacccgtgcgcgcccaggcaacggcccgcgccgtaacggtccaccgcgcaatcgtcgtcgttcaggttaa

SEQ ID NO: 842 - DNA, 924 bp, Klebsiella pneumoniae
catcactctctttggcaatggattttaccgatggatgcgaaacagacgcggttggggatcattctggccctcgccgcctactttatctggggtatcgcgccagcgtacttcaaacttatctactatgttcccgccgatgaaattctaacccatcgcgtgatctggtctttcttcttcatggtggcgctcatcagcgtcagccgccagtggccacaggtgaaaaagctgctgaaaacgccgcgcaagatcttcctgctggcgctctcggcagtgctggtcggcggtaactggctgttgttcatctgggcggtgaataaccaccatatgctggaagccagcctcggctactttatcaacccgctggtgaatattttgttggggatgattttcctcggcgaacgctttcgtcgtctgcagtggctggcggtgatcctcgccttttgcggcgtgctggtccagctgtggacctttggttcgctgccgataatcggtcttgggctggctttcagttttgccttttacggcctggtgcgaaagaaaattgctgtcgatgcgcaaaccggcatgctggtggaaacgctgtggctgctgccggtggcagcaatctggttgttcggcatcaccgacagcccgaccagccatatgggcgagaacccctggtcgctcaatctgctgctgatggccgcgggcgtggtgaccaccatccctttgctgtgctttaccggggcggcaacgcgtctgcggctctccacgctgggctttttccagtacatcggcccaacgctgatgttcctgctggcggtgacattctacggcgaagtgccgggcaaggataaaatggtgacctttggctttatctgggtcgcgctggcggtgtttatcgtcgatgcgctgtatacccagcgccggttgcgcagaggctaa

SEQ ID NO: 843 - DNA, 951 bp, Klebsiella pneumoniae
aataatatccagccaggagggcggatgcgggaagaactggatttcaaatcgctacgctttttctctgcgctctaccgcttgggcaatgtttccccagcagcggacgcgctcgatatcagccagcccaccggcagccttttgctgaaaaaactacgagatcattttgctgacccgctgtttgtccgggtcgggcagcggatgatcccgacgccgcgagcggacgcgatcgctcccaccatctcgactcttctccagcttgccgataacgatttagcggtcaaacctgaatttcttccccagcagagccagcgtaattttacgatcggtatgaccgatatcagccaaatgacgctgctgcctttattgcaaattgcgctccagcagcaggcggcggacgggatcacctttacggtacagaatctggatgagcagaccctcaacgccctcgaatccgggaaatgcgatctcgcgatcggctatctgacgcagcttccggaaagcgtctaccagcaacatctcttcgatcaatcatatgtctgcctggctgcggaaaaccatcctcgcattcgcgcacagctccgcgccgaagactggcgccaggaaaagcatctggcgatccgcgtggaggggactgcccatggcgatatggataagctgcttgatgagcaccacatgccccggcgcattgcgctaacgttaccaagttttttaggtaccggtgagctggtggccgaaagcgatatgattgccgtcgtcccggaacaggtggcgcggcatatcacccggcgctatccctgccgcagctggccgctgccttttcccctcgccaaaatcgccatccgtcaggtctggcatcagcggctgcaccgcgatcccggacatatctggctacgctcgctgatcgctacgcttgccgatcccgcacagcagagtacttctattaaaatctaa

SEQ ID NO: 844 - DNA, 318 bp, Klebsiella pneumoniae
agtgtcagccacacaaaccatcctgagaatgatgtcatggcaaaaagcgcagcggccctgcatatcctggtcaaagaagagaaactggcgctggagatcctcgccaaactggagcggggcgtcagcttcgatcatctggcgaaacgctattctaaatgtccgtctggccgcaacggcggcgacttaggcgagtttcagcaaggcgcaatggtcggtccgtttgatcaagccgtcttcagctgtccgctgctcaaaccctatggcccggtgaaaaccaaattcggctaccacatcatcaaggtgctgtatcgccgctag

SEQ ID NO: 845 - DNA, 963 bp, Klebsiella pneumoniae
atagtgatacacatcacattaacaagttatattcatcatcacagaacaaaagatagccgctttcaggcactgtgctttattaccgcccgaactaaaggtaaagggtctatagttactgatgcgctaataaataagggtacggagaataccatgaccaccaccaagcaacctggattcgcacctgcagcttcaccacacgccgcaaccgccgttcatacgccggaagagcatattatcgccggagagacgtcgattccctctcagggtgaaaacatgccggcctaccacgcccgcccgaaaaatgccgacggtccgctgccgatcgttatcgtggtacaggaaattttcggcgtgcatgaacatattcgcgatctttgtcgccgcctggcacaggaaggctatctggctatcgcgcctgaattgtacttccgtcagggcgatccgaatgagtaccacgatatcccgaccctgttcaaagagctggtcagcaaggtgccggacgcgcaggtgctggcggatctcgaccacgtcgccagctgggcggcgcgccacggcggcgatgcccatcgtctgctgatcaccggcttctgctggggcggacgcattacctggctgtatgccgcgcataacccgcagcttaaagcggcagtggcctggtacggtaagctggtgggagaaaaatcactgaattcgccgaagcacccggtagatatcgccgtcgatctcaacgccccggtgcttggtctgtacggcgctaaagacgccagcattccgcaggacaccgtcgagactatgcgtcaggcgctgcgggcagccaacgccacggcggaaatcgtggtctatcccgaagccgatcatgcctttaacgccgactatcgcgccagctatcatgaagagtcagccaaagatggctggcagcggatgctcgcctggtttgctcagtatggcggtaaaaaaggctaa

SEQ ID NO: 846 - DNA, 375 bp, Klebsiella pneumoniae
tggctacgacaccaacacaccaggcttattcctgtggagttaaatatgagcgataaaattattcacctgactgacgacagttttgacacggacgtactcaaggctgacgggctgaccctcgtcgatttctgggcagagtggtgtggtccgtgcaaaatgatcgccccgattctggatgagatcgctgaagagtatcagggcaaactgaccgtagctaagctgaacattgaccagaacccgggcactgcgccgaaatacggcattcgcggtatcccaaccctgctgctgtttaaaaacggcgaagtggcggccactaaagttggcgccctgtccaagggtcagctgaaagagttcctcgacgctaacctggcgtaa

SEQ ID NO: 847 - DNA, 495 bp, Klebsiella pneumoniae
gtcattatgcaagcctggtacttactgtattgcaaacgtgggcagctacaacgagcccaggaacatctggaacgtcagtcagttaactgcctgatgccgacgattgcgctggaaaaaatcattcgcggtaaacgcaccatggtcagcgaaccgttgttcccgaactacctgtttattgagttcgatccagaggtgattcataccaccaccatcagcgccactcgcggggttaacaacttcgtgcgctttggcgccctacccgctatcgtcccctcggcggtcatccatcagctttctatttacaaaccggaagggattaccgacccggaaacgccgcatgagggcgatagcgtgctaatcaccgacggcgcgtttgaaggcctggaggcgatcttcaccgagcccgacggcgaagcgcgctctatgttgctgttaaacctgctgaataagcaagtcctgcagagcgttaaaaataccgacttccagaaaatctaa

SEQ ID NO: 848 - DNA, 1170 bp, Klebsiella pneumoniae
cgtggaaagcaccgcctactggctatacaggtgacccccatgatcccatttaacgcgccgccggtggttggaaccgagcttgattacatgcagtctgcgatgaacagcggcaagctgtgcggcgacggcggctttacgcgccgctgccagcagtggatggagcagcgatttggcacggcaaaagcgctactgaccccttcctgcacggcttcgctggagatggccgcgctgctgctggatatccagccgggcgacgaagtgattatgcccagctatacctttgtctccaccgccaacgcctttgtgctgcgcggggcgaaaatcgtcttcgttgatatccgtcgcgatacgatgaatatcgacgaaacgctcatcgaagccgccatcaccgataaaacccgggcgattgtcccggtgcattatgccggcgtagcctgcgagatggacaccatcatggccatcgccgacaaatacaacctgtttgtggtggaagacgccgcacagggggtgatgtccacctacaaggggcgcgcgctgggcaccatcggccatatcggctgcttcagcttccatgaaaccaaaaactacaccgccggcggtgagggcggggcgacgctgatcaacgatcgcacgctggtggaacgcgcggagattattcgcgaaaaaggcaccaaccgcagccagttctttcgcggcctggtggataaatatacctggcgggacattggctccagctatctgatgtccgacctgcaggccgcctatctgtgggcgcagctggaagcggcggagcgcatcaaccagcagcgcctggcgctgtggcagaactactatgatgcgctgctgccgctggcgcgcgccgggcgtatcgaactgccgacggttccggccgactgcgggcaaaacgcgcacatgttctacattaagctgcgcgatatcgaggatcgcagcagactgatcgcctggctgaaagaggcggagatcctcgcggtattccattacattcccctgcacagctgcccggcaggcgaacagttcggcgaattccgcggtgaagaccgctacaccactcaggagagcgagcgtctggtacgcctgccgctgttttacaatctgtctgtggtgaaccagcggacggtgattaactcgctgctgagctacttctcctga

SEQ ID NO: 849 - DNA, 741 bp, Klebsiella pneumoniae
cgccgctgttttgctctattgacccgacagaggggacgcatgacaaccttaagctgtaaagtgacctcggtggaggcgattaccgataccgtatatcgtgttcgattagtgccggaagcggcattttccttccgtgccggccagtatctgatggtggtaatggatgagcgcgacaagcgcccgttctccatggcttccacgccggcggaacaggaatttatcgagctgcatatcggcgcctcggagctcaatctgtacgcgatggcggtcatggatcgcattctgaaagagcgtgaaattgaggttgatattccgcatggcgaagcgtggctgcgcgatgacgaagatcgcccgctgattctgatcgccggcggtaccggattctcttatgtgcgttctattctgttaagcgcgctggcgcgtaacccggatcgcgatattgccatttattggggcggccgcgaggctaagcatctgtacgatctggccgagctggaagcgttaagcatcaagcatccgaatctgcgcatcgagccggtggttgaacagccggaagaagggtggcgtggtcgctccggtacggtactcaccgccgtgctgcaggattacggtacgctggccgagcatgacatctacattgccggtcgttttgagatggccaagatcgctcgcgacctgttctgtaatgagcgcggcgcgcgtgaagatcgcctgtttggcgatgcgtttgcgtttatctga

SEQ ID NO: 850 - DNA, 894 bp, Klebsiella pneumoniae
acaaaaataaaaactatttttcaggagaccagcatgcgtatctctttggcctgcctggtggcgctgtgcgcgctaccggccggtgttatggcgcaggacgcgtcggtacacgacaaaccggcagtgcgcggcagcattatcgccaacctgctccaggaccatgataatcctttcctgctctacccttatgagagcaactatctgctctatacgtggaccagcgacctcaataaagaggcgatccgcagctatgactgggccgaaaatgcccgtaaagatgaagtgaagtttcagctaagcctggcgttcccgctgtggcgcggtatcctgggcgataattcgctgctgggcgcgtcctatacccagaaatcctggtggcagctctctaacagcaaagagtcggcgccgtttcgcgaaaccaattatgaaccccagctgtttttgggctttgcgaccgactaccagtttgccggctggacgctgcgcgatatcgagatggggtataaccacgactcgaatgggcgttccgaccccacctcgcgcagctggaatcggctttatgcccgcctgatggcgcaaaacggtaactggctggtggaagtgaagccctggtatgtggtgggcaacaccgatgataacccggatatcaccaaatatatgggctattaccggctgaaggtgggctaccagctgggagaggcgatcctcagcgcgcaggggcaatacaactggaacaccggctacggcggggcggaacttggcgtgagctatcccattaccaaacatgttcgcgcctatacgcagatctacagcggctatggcgagtcgcttatcgactataactttaaccaaacgcgcgtcggcgtcgggctaatgctcaacgatctgttttaa

SEQ ID NO: 851 - DNA, 1041 bp, Klebsiella pneumoniae
tacacggtaaaaaaacgattttcagcggttaacaggggtgtaaacccgatgtttgggcagaaaaaggactgggaaacacgagaaaacgcgtttgcggcctttagcatggggccgctgacggatttctggcgacagcgcgaagaagctgaatttaaaggcgtcgacgatgtaccggtacgctttgtccgcttttgcgcgcaacataacgatcgtctggtgttgatttgccccgggcgcattgaaagctacgtgaagtatgctgaagtggcctacgatctctttcactgcggctttgacgtgatgatcattgaccatcgcgggcagggacgctcgggccgcctgctctcagatacccaccgcggacacgtggttaacttcagcgactatgttgatgacctggccgcgctctggcagcagcaggtggttcctggacactggcgaaaacggtttatccttgctcattctatgggcggagcgattgccacgctttttctgcaacgttaccgggcgcattgcgatgcaatagcgctctgcgcgccgatgttcgggattatcattcggctgccggactggatggtgcgccatattctcgactgggctgagggccatcagcgcattcgcgaagagtatgccatcggcaccgggcgctggcgggcgctgccttttgccgttaacgtgctgacgcacagtcggcaacgctatcgtcgcaacctgcgcttctatgccgatgagccgcggctgcaggtcggcggtccgacctggcactgggtgcgtgagggcatgctggccggcgacgaagtgctggcgaatgtggaaaaagatacggccccgacgctgcttttacaggcggaagaggagcgggtggtcgataatctgatgcacgaccgctattgcgaattacgggccgctgccggccatccctgtgagggcggtaagccgctcgtcattgaaggggcatatcatgagatcctttttgaaaaggacgctatgcgctcagtcgcgctcaatgccatcgtcgagtttttcaatcgacatacttaa

SEQ ID NO: 852 - DNA, 1200 bp, Klebsiella pneumoniae
cgcatgctgaaaattcttttactcttcgcactgttgatcgccgggatcgtgcttggcccgatgatcgccgggcatcagggctacgtcctgatccagaccgataattacaatatcgagaccagcgtgaccgggctggtgatcatcctgatcctcgccatggtggtgctgttcgccattgaatggctgctgcgccgcattttccgcaccggggcgcatacgcgcggctggtttgtcggccgtaaacgccgtcgcgcgcgtaagcaaaccgagcaggcgctgcttaagctggcggaaggtgattaccagcaggttgagaagctgatggcgaaaaatgccgatcacgccgaacagccggtggtgaactatctgctggcggcggaagcggcccagcagcgcggcgatgaagcgcgggccaaccagcatctggagcgcgccaccgagctggcgggcgatgacctgatcccggtggaaatcactcgcgttcgcctgcagctggtgcgtaatgaaaatcacgctgcgcgccatggcatcgataagctgctggaaattaccccgcgtcatccggaagtgctgcgcctcgccgaacaggcatacacccgcaccggcgcctggcagtcgctgctggacatcattccgtcgatggcgaaagctaacgtcggcgatgaagcgcaccgcgcggcgctggaacagctggcctgggttggcctgatggataaagcgctggccgatggcggcagcgaaggactacgcgaatggtggcgcaaccagagccgtaaaacgcgggcgctggtgccgctgcaggtggcgatggccgagcgcctcatcgagagcgacgatcacgataccgcgcagcaaattatcattgatggtctgaagaaacagtatgatgaccgtctggtgatgccgatcccgcgtctgaagaccaataacccggaacagctggagaaagtgctgcgccagcagatcaaagccgttggcgaccgtccgctgctgtggagcaccctgggccagtcgctgatgcggcacggcgaatggcaggaggccagcatcgccttccgcgccgcgcttaagcagcgtccggatgcctttgattacgcctggctggcggatgccctggaccgcctgcatcagccggaagaagccgccgatatgcgccgcgatggactgctgctgacgctgcagaataatcctcagccataa

SEQ ID NO: 853 - DNA, 978 bp, Klebsiella pneumoniae
cgactggcgaataagcgtccagtcgtcaacctgactcttcgctacaatgcctgttctttatccaacgagacgaccattgtggcgctgttaattatcaccactatcctgtgggccttttcttttagcctgattggcgaatacctggccggtagcgtcgacagctatttttcggtgctgatgcgcgtgggcctggcagcgctggtgttcctgcctttcctgcgcacgcgcggccagtcgccgcgcacgatcgtgctctatatgctggtgggcgcgatgcagctaggcatcatgtacctgctggctttccgcgcctatctctatctgacggtctcggaatttctgctgtttaccgtgtttactcccctgtatatcacgctgatctacgacctgctcagcggacgtaagctgcgctggggctatctgctgagtgccgcgctggcggtgctgggggcggcgattatccgctatgacaaagtcagcgatcatttctggaccgggctgttactggtacagctgtcaaacctctgcttcgccatcggtatggtggggtataagcgtctgatggaggtgcgtccgatgccgcagcacaatgcctttgcctggttctatgtcggggcctttatcgtggcggtggcggcgtggtttatgctcggcaacgcccagaagctgccgaccaccacgctgcagtggagcgtgctggtgtggctcggcgtggtggcttccgggctgggttactttatgtggaactatggcgccacccaggtggatgccggcacgctggggatcatgaataacgtccatgtccccgccgggctgctggttaaccttgccatctggcaggagcagccgcactggccgagctttattagcggagcgttggtgatcctggcctcgctgtgggtccatcgccgctgggtcgctccgcactccggacaaacggcagatgatcgcaggcgtggttccgcgcagagcgaataa

SEQ ID NO: 854 - DNA, 201 bp, Klebsiella pneumoniae
cggaagcagaacgcgtatggattaagtatatggcgcgtatcaagcggccgaagcgtttccatactctgtccggcggcaaaccgcagatggaaggcgctgacgattacaccgaaagcgatgactaagaaaaaagggcgtaagccctttttttacgccatcattttctgcagatggttgagcatccgatctattgcccgatag

SEQ ID NO: 855 - DNA, 540 bp, Klebsiella pneumoniae
ctcgtgttcgatattggttttagtgaactactgctggtgtttgtgattggcctcattgttctggggccacagcggcttcccgtagcggttaaaacggtagttggctggatccgtacgttacgctcgctggcgaccacggtacaaaatgagctggcccaggagctaaaactgcaggagttccaggagagcctgaagaaggtggaaaaggctagcctgaataacctgacgccggagctgaaagcctcgatggatgaactgcgcgaggccgcggagtcgatgaagcgctcctatagcgcccacgatcccgaaaaagccagcgacgaagccaataccatccttaatccggtggtcaaaggcagcgaagcgcagcgccaggacgtcacgccggcgacggcagaacatcaggccagcgctccggctcatgcgccagatcccgttgccgacgagcaatctgcttcaccggctgaccttcaggcagagaaaacgtccgctacggcggcagttccccattcttcccccgcatcgagtgataaaccgtaa

SEQ ID NO: 856 - DNA, 381 bp, Klebsiella pneumoniae
tcggttcgcctcttcatgacgcaggcttatttgcgcaaaatcatgtcggcggccttacgaagaggcggctcgcaggatggcgtgtataatgcgtccacacaattcatcatctgtcataggggaacgtgtatgggtggtatcagtatttggcagttattaattgttgtcgtcatcgtagttctgctttttgggacgaagaagctgagctcgctggggtctgacttaggggcatctatcaaaggctttaaaaaagccatgagtgatgatgataaacccgaaaagtcggcgccagacgcagatttcacggcgaaaaccatcgccgataaacaggatgatgcaaaaaaagacgagacaaaacgccacgacaaagagcaggtgtaa

SEQ ID NO: 857 - DNA, 381 bp, Klebsiella pneumoniae
gacgctggcctggtttatggtggttgccagcctgttcgccctgcccgggatgcgccgcggctatcagcggatggcgaagtggatcgacggtatcgccggtacgctgtttgcgggcttcggcatccacctgattatctcgcgttaaccggcatgctgtttcccacccggttgtttccgggtgggaaagtatcagtggcgaagccgctgcagctcgtcttcagacagaccggtcatttccataatcgcctggtcatcaataccgcgactgcgcatcgcttcggcaacctgcaccagagcctggtgtttaccttcttttatgccctgctgtacgcctttctccataccttctgcaagccatgtttccgccagcgtcatcagtaa

SEQ ID NO: 858 - DNA, 276 bp, Klebsiella pneumoniae
aatgctggagaaattatcatgatgcaacatcaggtcgctttacaggcacgtttcaacccggaaaccttagagcgcgtgctgcgcgttgtccgccaccggggtttccacatctgcgcaatgaacatggaaaccgcgccggacgcacagaacataaatatcgaattgaccgttgccagcccgcggcccgtcgaattactgtttagtcaattaagcaaactggtcgacgttgcctgcgtcgagatccagcaacccacatcacaacaaatccgcgcctga

SEQ ID NO: 859 - DNA, 333 bp, Klebsiella pneumoniae
cgcgtgatactatggcgccctaatttattccaactcactcaaggcgcaatcatggctaaaaccgcggcagcactgcatatcctggtaaaagaagagaaactggcgctcgatctgctcgagcagctcaaaaacggtgccgatttcggcaagctggcaaagaaacactccatttgtccgtcaggcaaacgcggcggcgatctgggtgagttccgccagggccagatggtaccggccttcgataaagtggtcttctcctgccctgaactggagccaaccggcccgctgcatacccaattcggctaccacatcatcaaagtgctgtaccggaaataa

SEQ ID NO: 860 - DNA, 897 bp, Klebsiella pneumoniae
tgtgtatcactatttactgaaaaacaactgcaatcattattggtcttggtgactatcatcacaaaatgttgccaggggcttctgtacagtaccgttttgcttctgctgataattcgacccacagaggagttttttatgtccaagtctgatgtttttcatctcggcctcaccaagaacgatttacaaggggctacgctggctatcgtccctggcgatccggagcgtgtggaaaagatcgccgcgctgatggataagccggttaaactggcatctcaccgcgaatttacctcctggcgcgcggagctggacggcaaaccagtgatcgtctgctctactggcatcggcggcccgtcgacttccatcgccgtggaagagctggcgcagctgggggtgcgtaccttcctgcgtatcggcaccaccggcgcgattcagccacatatcaatgttggcgatgtactggtgacgaccggttctgtccgtctggacggtgccagcctgcacttcgcgccgatggagttcccggccgtcgcagacttcgcctgtaccaccgcgctggtggaagcggcgaaatcaatcggcgccaccacgcatatcggcgtgactgcctcctcggataccttctacccgggccaggagcgttacgacaccttctccggccgcgtggtgagccgcttcaagggctcaatggaagagtggcaggcaatgggcgtgatgaactatgaaatggaatccgccacgctgctgaccatgtgcgccagccagggcctgcgcgccgggatggtggctggggttatcgtgaaccgtacccagcaagagatccctaacgccgaaaccatgaagcaaaccgaaagccacgcggtgaaaatcgtcgtggaagcggcgcgtcgtctgctgtaa

SEQ ID NO: 861 - DNA, 1017 bp, Klebsiella pneumoniae
aacccaatttgtttctgtgtgcccaccgaactgtccgataatttttttgcattgggagtcccggtcatgctgagcgcatttcaactggaaaacaatcgtttaacgcgcctggaagccgatgagatcaaacacctcgccagctcggtgtgggtcgatctggtcgagcctgacgacgatgagcgaagccgcgtgcagacggaactgggtcaaaacctggcgacgcgcccggaactggaagatatcgaagcctccgcgcgtttctttgaagatgaagacgggttacacatccactcgttcttcttttttgaagatgccgacgatcacgccggcaactctaccgtggcgtttaccatccgcgaaggccgcctgttcacgctgcgcgagcgcgaactacccgctttccgcctctaccgtatgcgcgtgcgtaaccagacgctggttgacggcaacgcctacgaactgctgctcgacctgttcgagaccaaaatcgagcagctggcggatgaaattgaaaacatctacagcgacctggaaaagctgagccgcgtcattatggaaggccatcagggcgacgagtacgacgaagcgctgtcgacgctggcggaactggaagatatcggctggaaggtgcgcctctgtctgatggatacccagcgcgcgctgaacttcctcgtgcgcaaggcgcgcctgccggcgggccagctggagcaggcgcgggagatcctgcgcgatatcgaatctctgctgccgcacaacgaatcgctgttccagaaggtgaacttcctgatgcaggcggcgatgggttttatcaatatcgagcagaaccgcattatcaagatcttctcggtggtctcggtggtattcctgccgccaactctggtggcctccagctacgggatgaactttgaatttatgccggaactacactggagctttggttatccgggagccatcgtgtttatgatgttggccggcctggcgccgtatctctacttcaagcgcaaaaactggctgtaa

SEQ ID NO: 862 - DNA, 615 bp, Klebsiella pneumoniae
tatgctgtttggtcgtctgcaagtgttcaccttgctggtgctctttacccccactttctggcgcgaataacaggagtgctcgtgaaaactttaattctcttctccacccgcgacgggcagacccgtgaaatcgcttcgtttctcgcctctgagcttaaagagctgggcatcgatgcgtacaccctgaacctgacccgtaccgatgtcgtcgaatggcatcactacgatcgagtggtcattggcgcgtcgattcgctacgggcactttcatccggcggtggaccgctttgtgaaaaagcatctggcagcattgcaggcgctgccgggggcattcttttcggttaacctggtggcgcgtaaacccgagaagcgcacgccgcagaccaacagctatacgcgtaagtttctgctgaactcgccgtggcagccgcagagctgcgcggtatttgccggcgcgctgcgctacccgcgctacagctggtacgatcggtttatgatccgcctgattatgaaaatgaccgggggtgaaacggatacccgcaaagaagtggtctataccgactggcaacaggtatcccggtttgctcgggaaatcgcacaaatggcgcgcaaatag

SEQ ID NO: 863 - DNA, 216 bp, Klebsiella pneumoniae
tgtccgacctgcaggccgcctatctgtgggcgcagctggaagcggcggagcgcatcaaccagcagcgcctggcgctgtggcagaactactatgatgcgctgctgccgctggcgcgcgccgggcgtatcgaactgccgacggttccggccgactgcgggcaaaacgcgcacatgttctacattaagctgcgcgatatcgaggatcgcagcagactga

SEQ ID NO: 864 - DNA, 1509 bp, Klebsiella pneumoniae
ttagccgcctgtagagaggtcaataacacttccatgaaatatcacgatcttcgcgactttctgacactcctggaacaacagggcgaactaaaacgtatcactctgccggtcgatcctcacctggaaatcaccgaaattgccgaccggactctgcgcgccggcggcccggcgctgctgtttgagaatccgaaaggctataccatgccggtgctgtgcaatctgttcggcacgccgcgtcgcgtggcgttggggatggggcaggaggatgtcagttcgctgcgcgaggtgggtaaactgttggcctttctgaaagaacctgagccgccaaaaggcttccgcgacctgtttgataagctgccgcagttcaagcaagtgctgaatatgccgaccaaacgcctgcgcggcgccccctgtcagcaaaaaatcatccagggcgatgatgtcgatctgaataaaatcccgattatgacctgctggccggaagatgccgcgccgctgatcacctgggggttgacggtaacccgcgggccgcacaaagagcggcagaacctgggaatttatcgccagcagctgatcggcaaaaacaaactgattatgcgctggctgtctcatcgcggcggcgcgctggatttccaggagtggtgcgcggcgcgtccgggcgaacgcttcccggtttccgtggcgcttggcgccgatccggcaaccattcttggcgcggtgacgccggtgcccgataccctgtcggaatatgccttcgcaggcctgctgcgcggcaccaagaccgaagtggttaagtgcgtctccaatgaccttgaagtgccggccagcgcggaaattgtgctagaaggctacattgaggccggtgaaatggcgccggaaggcccgtatggcgaccacaccggttactacaatgaagtagaccagttcccggtgtttacggtaacccatattacccagcgtgaagacgcgatttatcattctacctataccggccgaccgcccgatgagccagcggtgctgggcgtggcgctgaatgaagtcttcgtcccgatcctgcaaaagcagttcccggaaatcgttgatttctatctgccgccggaagggtgctcctatcgcctggcggtggtgaccatgaaaaaacagtacgcgggacatgccaagcgcgtaatgatgggcgtctggtcgttcctgcgccagtttatgtacaccaagttcgtgattgtctgcgatgacgacgtcaatgcacgcgactggaacgatgtgatttgggcgatcactacccgtatggacccggctcgtgatacggtactggtagagaatacgccaattgattatctggattttgcctcgccggtttccggcctgggttcaaaaatggggctggatgccaccaataaatggcctggcgaaacccagcgtgaatggggtcgcccaatcaaaaaagatcctgccgttacggcgcgtattgacgccatctgggatgaactggccatctttaaacaacagtaa

SEQ ID NO: 865 - DNA, 1251 bp, Klebsiella pneumoniae
acaacgagctgcgcagcctacgggatatcaatacctcgcctcgaggccgatctccgtgaggtcaccacccggctggaatccacccagctgcatgcggaagataagatccgccagatgatgaacagcgagcagcgccttagcgagcagtttgaaaacctcgccaaccgtattttcgaacacagcaaccggcgggtcgatgagcaaaaccgccagagcctgcatggcctgctgacgccgctacgcgaacagctggacgggttccgccgccaggtgcaggagagctttggccaggaggcgcgtgaaagacataccctggcgcatgagatccgcaatctgcagcagttgaacgcgcagatggcacaggaggcgctgaacctgaccaaagcgctgaagggggataacaaaactcagggcaactggggggaagtggtcttaacccgcgtgctggaggcctccggcctgcgcgaaggctatgagtaccagactcaggtcagtattgagaccgacaaccgctcgcggatgcagccggacgttatcgtgcgcctgccgcagggtaaggacgtggtgatcgacgccaaaatgaccctggtcgcctatgagcgctatttcaacgccgaagacgactacacccgcgaagtcgcgctgcaggaacaccttgcctcggtgcgtaaccatattcgcctgctgggacgcaaggattatcaacagctgcctggcctgcgctcgctcgactatgtgctgatgtttattcccgttgagccggcgttcctgctggccatcgatcgccagcctgagctcatcagcgaggcgttgcaaaataatattatgctggttagcccgacgacgctgctggtagccctgcgcactatcgccaatctgtggcgctatgagcaccagagtcgtaacgcgcaaaagattgccgagcgggcggggcgcctttacgacaaaatgcgcctgtttgtggatgatatgtccgccatcggccagagcctggataaggcgcaagagagctatcgccaggcgatgaaaaagctcgcttccgggcgtggcaatctgctggcccaggcggaggcctttcgcggcctgggcgtggaggtcaagcgcgggattaatcctgatttagtcgaacaagctacggctcaggacgagcaatatcgtctcgaagatgaggataacctgccggaaaatgacgcattttcacccgactctgccgagacggtgcgtagccgggaggcggctccgccacgctga

SEQ ID NO: 866 - DNA, 1374 bp, Klebsiella pneumoniae
  unsure (1315): Identity of nucleotide at the above locations are unknown.
atccgctatcgccttcttccggccgaactatctgacgggctggcggcgggcgctacggttagcggcggaggggcaggcatgacgttaatgcaatttagcgggctgctggtggtctggctgctgtcgacgctgttcatcgccaccgccacctggtttgagttccgtcgggtacgctttaacttcaacgtttttttctcgttgctgtttctgctgacctttttcttcggcttcccgctgaccagtattctggtgttccgctttgacgtcagcgtggcgccgccggagattttgctgcagacgctgctgatcgcggtgtgcttctacgcagtctactacgtgacctataaaacgcggctgcgttcggcatcgcgtgaggttgcgcatcgcccgctgtttaccatgaaccgggtggaaacccatctggcgtggggcattttgatggggctggcgctgctgtgcgtcggcatcttcttcgcccacaacggtttcctgctgtttaagctcaactcctacagccagattttctctgctgaagtgtccggcgtggcgttgaagcgcttcttttacttctttattccggcgatgctggtggtctattttctgcgccaggattataaggcgtggatcttcttcctcgtcagcacggtggcctttggtttgctgacctacgccatcgtcggcgggacgcgcgccaatattatcatcgccttcgccatctttctgttcatcggtattattcgcggctggatcagcctgtggatgctggcggcggcgggtgtgctgggtattgtcggcatgttctggctggcgctgaagcgctacgggatgaacgtcagcggagacgaagcgttttatacctttctgtatctcacgcgcgacaccttctcaccgtgggagaacctggcgctgctgctgcagaactacgacaagatcgatttccaggggctggcgccgatgatccgcgatttctacgtctttatccccagctggatgtggcacggtcgcccgacgatggtgctcaataccgccaactactttacctgggaagtattaaacaaccattcggggctggcgatttcgccgacgctgattggctcgctggtggtgatgggcggcgtctggttcgtaccgctgggcgccgtggcggtagggttgattattaaatggttcgactggctgtatgagctgggcaaccgggagagcaatcgctataaagcggctatcctgcacagtttctgtttcggcgctatcttcaacatgatagtgctggcgcgcgaggggctggattcgttcggctcccgcgtggtgtttttcnctcgtgatctttggtatctgcttgctggcggcgaaactgctgtactggttcctggatag

SEQ ID NO: 867 - DNA, 390 bp, Klebsiella pneumoniae
ctaatactccgcgccataaatagctcggccaaagaatcaggagcgtgtaggatggcggaaagctttacgacgactaatcgttttttcgacaataaaaattatccacgcgggttctcccgtcacggtgatttcaccatcaaagaggcgcaactgctggaacgtcatggttatgcctttaacgaactggaactgggtaagcgcgaacctgttaccgaagatgaaaaacaatttgtctcggtgtgccgtggtgaacgtgagccggtgacggaagcagaacgcgtatggattaagtatatggcgcgtatcaagcggccgaagcgtttccatactctgtccggcggcaaaccgcagatggaaggcgctgacgattacaccgaaagcgatgactaa

SEQ ID NO: 868 - DNA, 261 bp, Klebsiella pneumoniae
atacgttcccgggccttgtacacaccggccgtcacaccatgggagtgggttgcaaaagaagtaagtagcttaacctttcgggaggccgcttaccactttgtgattcatgactggggtgaagtcctaacaaaggacccgaaggggaaccctcgggtggaataccttcttactttaaagaaccggcttttgaatacttacaacaaattgtttgatgaaattaaaccactaggtattctttgcggcttggagcttagggggtaa

SEQ ID NO: 869 - DNA, 294 bp, Klebsiella pneumoniae
gtggcggaacggacgggactcgaacccgcgaccccctgcgtgacaggcaggtattctaaccgactgaactaccgctccaccgaatttcttcgctttattaccaccggttgtcaccccggcttactgcaatttgatgcctggcagttccctactctcacatggggagaccccacactaccatcggcgctacggcgtttcacttctgagttcggcatggggtcaggtgggaccaccgcgctagtgccgccaggcaaattctgttttatcaacacgtcttaccgacgtatcgattaa

SEQ ID NO: 870 - DNA, 375 bp, Klebsiella pneumoniae
ggcgcgatgcgccgctatccgggaaacacgtcattaacggaatttcaccgtctcaccggcctgctggctcgccgcctgctccagcagatcccagaaggtttcgccgctgcgatcgcagatccactcgtcgcctttgagatcgaagtgatagccgccctgtttggtggccagccacacctggtgcagcggctcctgacggttaataatgattttgctgccgttttcaaagctgatggtcagcacgccgccgttgatttcgcagtcgatgtcgctatcgccgtcccagtcgtccagacgttcttcgatggtcatccacaggctatcggccaggcgatggaattcactgtcgttcataatttgattctgcttttttga

SEQ ID NO: 871 - DNA, 642 bp, Klebsiella pneumoniae
caccatccgcggctcgataatacgggtgcagcgcagatacgggtatttcgacggcgccgccagatgcgtaccggtgtcatcctgcataaagccagcgacatcatgcacctgcagacccagcggatggccaatcccgtgcggcataaacggcccggtcaggtcattctccaccatcgcctcttcgctcatgtcggtaaccaactggtgtttacgcaacagcttcgcgatacgctgatggaactggatatggtaatcaatgtaactggtaccggccttcatggtactaatcagcgcctgctgctcatcgttaacgtctttgatcagatgggcaaagtcgttatcgccgtgcgccgcccaggtgcgcgtcagatctgcggcatagccgttatattccgcaccggcgtcgagcaggaaactgcgcatctccgccggggcacgatggtccagtttggtgtagtgcaggacggaggcatgctcattcagcgcgacaatattgctgtaaggcacgtcggtatcacgatggccggtggcggtgagataggcctggttgatatcgaattcgctcattcccgactggaaagcttcgtaggccgcacgatgaccattcaccgccgacttctgcgcttcacgcatgcaggctag

SEQ ID NO: 872 - DNA, 183 bp, Klebsiella pneumoniae
gcggactggcgcagatttcgcgccgcttgcaccatattcgccagcgcggcgcgggtttccggccagccgcgagttttcaggccgcagtccgggttaacccacagtcgctccaccgggatacgctgcgcggctttcttcagcagcgcttcgatccactccacgctcggcacgtttggcgaatga

SEQ ID NO: 873 - DNA, 954 bp, Klebsiella pneumoniae
tcgaacaagctacggctcaggacgagcaatatcgtctcgaagatgaggataacctgccggaaaatgacgcattttcacccgactctgccgagacggtgcgtagccgggaggcggctccgccacgctgaaacgtatgggaaatgcgctgagtctgatacactcagtgaacattttcttgaaaagcaagcaggcatagagatggttgaggattcacaagaaacgacgcattttggctttcagacggtcgctaaagagcagaaagcagatatggtggcgcatgtattccattctgtcgccgcaaaatatgatgtgatgaacgacctgatgtcgtttgggatccatcgtttgtggaagcgtttcaccatcgactgcagcggcgtacgtcgcgggcagaccgtgctggatctggctggtggtaccggtgatttgacggccaagttctcccgcctggtaggggaaaccggccgcgtcatgcttgctgatatcaatgattctatgctcaaaatgggccgcgaaaagctgcgcaatatcggcatcgtaggcaacgttgagtatgttcaggccaacgcggaagccctgccttttgctgataatacctttgactgcattaccatttctttcggtctgcgtaacgtgaccgacaaagagaaagcgctgcgttcgatgtaccgcgtgctgaagccgggcggacgtctgctggtgctggagttttctaaacccattatcgaaccgctgagcaaagcctacgacgcttactccttccatatcctgccgaaggtgggcgagctggtggcaaaggatggcgacagctatcgctacctggcggaatctattcgtatgcatccggaccaggaaaccctgaaagggatgatgcaggatgcgggcttcgaaaacgtggattactacaacctgacggcgggtatcgttgctttgcatcgcggttacaagttctga

SEQ ID NO: 874 - DNA, 213 bp, Klebsiella pneumoniae
ctaccgggcagtgccattggcatgacaacccgaacaccagtgatgcgtccactccggtcctctcgtactatgagcagcccccctcaattcttcagcgcccacgggaaaatagggaccgaactgtctcacgacgttctaaaacccagctcgcgtacccactttaaatggcgaacagccatacccttgggaactacttcaagcccagggatgtga

SEQ ID NO: 875 - DNA, 237 bp, Klebsiella pneumoniae
aaagcagaaagaatgaatcacgggcaattatcaatgaaaaacgtttttcctacgcttgccgttttgtttgcgatcttcagcctgaccggctgcggtctgaaagggcctctctatttcccaccggcggacaaaaccgcgccgccgccgaccaaaccggttaaccctggcattcagagcgcaacgccggatcgtaacgatcgtggcgataccggtggtccgagccaggtcaattactaa

SEQ ID NO: 876 - DNA, 1719 bp, Klebsiella pneumoniae
acggacgcgagcgcgcggcttcagccccagctcgcgagcgcggctttcgctcatcagcagcatcgccgctgcgccatcggaaagggcggaagaggtacccgccgttaccgtaccggtcaccgggtcaaacgccggtttaagcgtggacagcgtctcgacggtggtttccgggcggatcacctcgtcatagttaaaggacttgagtacgccatcggcatcgtggccgccggtggggataatctccgctttgaatgcgccggactgggttgcggcccaggcacgagcgtgagagcgcgcggcgaactgatcctgcatctcgcggctaataccgtgcagacgcgccagcatctccgcagtcagccccatcatccctgccgcctttgccacgttgcggctgaggcccggatggaaatcgacgccatggctcattggcacatggcccatgtgctcgacgccgccaatcaggcagacgctggcatcgccggtcatgatcatacgggtcgcatcgtgcagcgcctgcatggaagaaccgcacagacggttgaccgtatttgctggtaccgaatgcgggatctccgccagcagcgccgcgtttcgggcgatgttaaaaccctgctcgagggtttgctgcacgcaaccccagtagatatcgtctatcgcgcttgcctcaagcgacggattgcgcgacagcaggctacgcatcaggtgcgcggagaggtcttccgcgcgcacgtggcgaaatgcgccgcccttcgaacggcccatcggggtgcgaattgcatcgacaatgacaacctgttccattgtgactccttaagccgttttcagagcgccaaccggacgggctggctctacctggggataatacgcttcgttatggcgcgctttgtcacgcagaccggctggcacttcatacagcgggccaaggtgctggtattgctgcgccatatcgagatacttcgcgctgccgatggtgtccagccagcggaatgcgccgccgtggaacggagggaagcccaggccgtataccagcgccatatccgcttccgccgggctggcgataatgccttcttccaggcagcggacgacttcgttaaccatggggatcatcatgcgggcgataatctcttcatcgctgaaatcgcgcttcggctggctgacgtcggccagcaggctgtcgacggcagcatcttcttctttcttcggcttacctttgctgtcgtctttatagcgccagaagccgaggccgttcttctggccgaaacggttggcgtcaaacagggcgtcgatggcgtcgcgataatctttctgcatccgctgcgggaagcccgccgccatgaccgcctgagcatggtgcgcggtatcgatgccgaccacgtccagcagataagccgggcccatcggccagccaaactgtttctccatcactttgtcgactttgcggaagtccgccccgtcgcgcagcagctggctgaagccggcgaagtaggggaacagtacccggttgacgaagaagccgggacaatcattcaccacgatcggcgttttgcccattttgctggcccaggccaccactttggcaatggtattatccgaggttttttcgccgcggatcacttcaaccagcggcatgcgatgcaccgggttaaagaagtgcataccgcagaagttttccgggcgctgcagaacgctggccagctcgctgatggggatcgttga

SEQ ID NO: 877 - DNA, 924 bp, Klebsiella pneumoniae
acgatgaagagtatgagctccacctcgctatatgccgccattgatttgggctccaatagtttccatatgttggtggtgcgcgaggtggcgggcagcatccagacgctgagccgcattaagcgtaaggttcgactggccgccggcctgaatagcgacaacaccctctccgcagaagcgatggaacggggctggcagtgcttacgcctgtttgccgagcgcctgcaggatattccgccgacgcaaatccgcgtcgtggccaccgccacgctgcgtcttgccgtcaatgcgggggagtttctggcgaaagcgcaggagatcctcggcactccagtgcaagtgatcagcggcgaagaagaagcgcgcctgatttaccagggtgtcgcccacaccaccggcggcgccgatcagcgcctggtggtcgatatcggcggcgccagcaccgagctggtgaccgggaccggcgcacaaacaacctcgctgtttagcctgtcgatgggctgtgtcacctggcttgaacgctattttgccgaccgtagtctgacgaaagagaatttcgatctcgccgaagcggctgcgcgcgaggtactactgcccgtcgccgatgtgctgcgctatcacggatggaaagtgtgcgttggcgcctccggcaccgttcaggctctgcaggaaattatgatggcgcaggggatggatgaacgaatcaccctcgccaaactccagcagcttaaacagcgcgctatccagtgcggacgtctggaagagctggagatcgaaggcttaacccttgagcgggcgctggtgtttcctagcgggctggcgatcctgatcgctatcttcagcgaactgaatattcagtgtatgaccctcgcggggcggcgcgttacgcgaaggcctggtgtacggcatgctgcatctctccgttga

(The sequence listing continues in the following parts.)

What is claimed is:

1. An isolated nucleic acid molecule encoding a *K. pneumoniae* polypeptide of SEQ ID NO: 10697.

2. A recombinant expression vector comprising the nucleic acid of claim 1 operably linked to a transcription regulatory element.

3. A cell comprising a recombinant expression vector of claim 2.

4. An isolated nucleic acid consisting of SEQ ID NO: 3526.

5. A recombinant expression vector comprising the nucleic acid of claim 4 operably linked to a transcription regulatory element.

6. A cell comprising a recombinant expression vector of claim 5.

7. An isolated nucleic acid of at least about 40 consecutive nucleotides in length, wherein the isolated nucleic acid is a fragment SEQ ID NO: 3526.

8. An isolated nucleic acid molecule of at least about 40 consecutive nucleotides in length, wherein the isolated nucleic acid molecule hybridizes under conditions of high stringency to an isolated nucleic acid consisting of SEQ ID NO: 3526.

9. An isolated nucleic acid consisting of SEQ ID NO: 3526.

10. A recombinant expression vector comprising SEQ ID NO: 3526 operably linked to a transcription regulatory element.

11. A cell comprising a recombinant expression vector, wherein the recombinant expression vector includes SEQ ID NO: 3526 operably linked to a transcription regulatory element.

12. An isolated nucleic acid molecule that hybridizes under conditions of high stringency to SEQ ID NO:3526, wherein the isolated nucleic acid molecule is at least about 40 consecutive nucleotides in length.

13. A recombinant expression vector comprising an isolated nucleic acid sequence operably linked to a transcription regulatory element, wherein the isolated nucleic acid sequence hybridizes under conditions of high stringency to SEQ ID NO:3526 and is at least about 40 consecutive nucleotides in length.

14. A cell comprising a recombinant expression vector, wherein the recombinant expression vector includes an isolated nucleic acid sequence operably linked to a transcription regulatory element, wherein the isolated nucleic acid sequence hybridizes under conditions of high stringency to SEQ ID NO:3526 and is at least about 40 consecutive nucleotides in length.

* * * * *